United States Patent 9,328,346 (POLYCOMB-ASSOCIATED NON-CODING RNAS) - sequence listing, part 64

SEQ ID NO: 12505 - RNA, 1611940 nt, Mus musculus
auauuuuagcaaccacuuuauuuucaucuaggcucagggacaguuuggaaauguuacuauucuaaguacagaacugaggaacgguggcaggcugucaaugccacuguuugggaagcuagccuauuugucaucgugauggaagcauaauacuaguggcuuccacacaugcaauaaaguucuuuguacaaggcuguggggucgugggguacaauaaagagugguuagcuucauuuccaaugucgaagacuccagaagaaugggguccauuuucuuaugccuugggaaucguuugaguuacucucaggccuggaaaugacaaaacauaaaaauagacauuugguuagaaccaguagcauuucuucugaggcacagcaauaacuaaaauaucaguuuguuuaccuuuaauccuuuggauugccauuaacauuuuaugggagaugauauugagguaugggcaagcuaugggcaauaaaugguucccaaacuuuugaugccuagacuuauucuuuggguccauguacuuucuuugaauuuuucccaucacccacauuaccaaaggucagcugaaagaacucuuaggauuccacauuagcaauucaaagcuuauacacacagcgaaccaauucagccuguaugugcuauauaaggagaacaugccaaacauuacuguugucuaaacucucugcugagcuuaagaacacagauuucuggacucuaucccccauauucugacugagcaggucuauggagaaggccagggaucuauuucaaaacaagcuuuggcugugacugaagacauuggcaccuggauuuagggacucauuaaagcacuguauggcuggcagaaucagcuuuacauauuggaagcacaaugggccagauauccuaaggacauguuccagaccuuaaacauuucuacuaagaugguuagacuucuccuccuuaucauaucuuaucuagcaagaaaauagggacauuucuugacgcuauaguguguugguuuagauauaaguggaguuggccauggaaauacauuucacaccucuguaccucccuucuuuguugcagccuuaacccaucuaaaccucaauaauuggccucaguaaaauggguguggccagcaacugggaaggcagcaucccauagcugggagcaaaggcagaaaugggaagacuuuaugaguuguaucucauaaaaucuggggaagacuggaggaaagguacuaagacaauugagcaacaauuaugcgugugauaaaugaaaagauuuugagaaacacugucacaagucacagacuucucugguguuucuauucuuaaaccuuuuuauuuuuguauauguaggugucuauguaacuacauguuguauguaugugcaagugccugaagaggcuagaaaauggcacuggaucauguggauuuggcguugcaggcuguuuugaguaguugaguaguugauaugggugcugggaacugaauuuagguccucuagaagagcagcaggugcucauaacuucugacuuauggcuccaaccccuuccucuuuguuuucaagaaaucccacaagagaauugauuugccuucuacaucuggcuugccauuuguggguuugaguucugaagagaagauguagaccugggauacuuggaaaugaugagcuagcucucuguuuauuucaagggcucuauuuaaggcugucuuagcuuuagauccauucaaacucaccuuggugaagauauacacaauggccuuuggcauauggagaacuuuugugaguuuagaaacccauuuucugcaaguugguacaaagucagagagcacagagugacacaggucuguguaaugaucaugacacagaggcagagucacuccuaaucuggaccagaguucucuccucugagcacagggcuguaccauggagaaggugggaaagcagggcguuugagccaaaguauccuccagagaugggucccguccuauucuuacaugacccugagaccauuugcugcuguuccuagcacuacuuggcuugucuggaaaugugggucaucuucuaaacauucaucacagacuucauccuugaaccauuauugacuuugagucagaggcaccugugagggacugaaaaugagugugcccucucucuucuucugccuugccugucuauggcagauuuauguccuagaaguuucuaucagcuuuauuuuuggacauuguagcccauguuacuucccccaccugucuuugucaauccagcucuguaaccugaguuugcucuaucucuuucuacacagggcccuuugucagcccacuuucaccacuucuguaacacaucuuucacacagccuuaacacccacauguccaucugccucuucaacucucugucuaugguaguuucauuuccauaccuggucuggaguaucaugggaagcagugucuaccuuucaugcuccaaacacuaaguagacuuggaggauuggaggagagauguauccagaguuuuguugugugcccgugcaggggagugaggugagcacacugaauaggagcugcagagucuuaaaacacacacacacacacacacagacacacacacacaaacacacaaaugugccugggguauugcaauguucccucguggcaggucugccucucuuguuuucaugaccaugauuucugccaucuuugcaggcacuaaagagucagcacucaguauccagugcaaguuaugccuccacaaugcagagugcagcugguggcaugcccaucuucccguguuuuaauggaccuaacacagcaugcucaucuucaggucuacaguuuccucccaugucacagcuaccacugacaguagagcuuuuuuguuguuguuguuuguuugguuugguuuugguuuugguuuuuugaaacaggguuucucuauguagcccugguuguccuggaacucgcacuguagaccaggcuggccucaaauucagaaaucugccugccucugccucccaaaugcugggauuaaaacugugccccaccacugcccagcggaugucaaugaaaggauuuacugacaaguaaacagggaucccaggagggagugaggaaguucaaucccucacaugcuucuagcccacuuguaaaauacuuuuuacagagugaggccaguacagugaucacaaggaaucaggugagcaggcuucuacaaucagggagcucagcagccaugcgugccccaccucaauguucaagucuguguugguucuugacugacauaguagcagguuaacuauccucucucuagaauaugcuugaggaaugauggggaauguauuauacugucagacacacauucuucaaggucaugaaaggcaaaagaaaggacuuuccauugcuuugcaaauagaguaggagagagauuuggggaagggagcuuuggauugagaagagaaaugaaaaugccccaaagaagaccagcaucaaaguuuucaggaaagacuacagaaaccuuuucauccaucuuucccugaaacccacaggaaagccuucaaccuuucccuguguucuguuguaugguucaaugaguacagguaacaucauggaugccauuggaucccccucugaaccgagccccacugacuuuuugaaucugaaaguaucaacauguugcccccauuuucuguuacuuuacgugaugggauccuaagauaagaaauucaugaagcugaaagguuuauuugggcucaaagauuuggagaaucugucugugaucaguugggccuguugcuuggacucaugauagugagaccacaugaugaacuagaaacagauagaacaacaacaacaacaacaacaaaagacuagaaucucaugaaagcccaaugaaccaaagcucagaggacuuuacucuuuaaggguccaucacuuccauauaaugccauguuugggcaucaagccuccagccccuaggacuuuaguggacauuguagauccuaaugguucauccauuaagcuccagaaccccuuucuccaugcccucggaguacauagaaggcagcgucuuuuuaccagguguaccaaggagguuauuuucuccuacuucaaccccuuuuaucuucaguaaagaggaugucuucuucuacacugaagcugauaugacauuucugugucuuucuccuguagguaugccuggguagaaacugcccacgggcaaaauacucugauaguguguaaagggaggcuuggacugcagagauuggcuagccuuuccuuccucucuuuacaguagugguuccauacuugcugcccauuaggaucaccuggggaggugaaaacauuucuguaccaggcuccuucuaacugauccugaucuagagaaugcagaaacuguggaccuguggacagaaaucacuagacuugauggugacaagguccgcaccuaucucccugugcuucuguucuaaaauguguucagauaguagcauggcucagccacucaagacagaauuuacacagaguaucugucuuccucacucacaugauaggggccacugcuaucuuugcagguagugacccuugcccauggggauuaauacuaugguauguuuucauugcucugugugugugugugugugugugugugugugugugugugugugagagagagagagagagagagagacagagagagacagagagacagagagagacagagagagagacacagagagagagagagacagagagagagagagagagagagagagacagagagagacagagagagagagagagagagaucuuagcagucccuuaauucaggcuguccagugagccauucagguaucucuaaccuguuucuguuuuccccaucagugccacccugugcugagauuauagguguacuccacgacaccuagauuuuuaugggugcuggggaugcaaacucaggcccucaugauugcauugcaagccaucaccccaggcccagaacugguaugaaaauuaaggaaccacauuuaccaaugacacagccuggagagguuuacccaaaaccuauuuaacaauccucuucuuuuaaaagacuuagcucacagcaggcuaguggggcaggcagaguagcuacagaacuacauucugcucucaccaaaguauggugagcaauuuucaaaggccaaggcccccugaccucucuucuucagcuuuuccuuaauaaacuggccuuuaaaacuuauaccacaaaagccacugguaguaauguguuaaaguaaguggguaaaggaaaagcugauggagagauggcaaggaucagggagccucucugauuaguaucucugagacaaugcaauuauauuucauuuccuucgagagauaggaagggguuagcccagguucacuuccagaaacccugcagugugagugugaaaucuggggagcagggcaacuuccaagcaugcuggcagacuucaaauuacuucucuguagcauguuucacaugcugauuaauaacagcacuuccugaaauguccaggggcuaauuaacuuucuauucaacagggugcauuucccagucugcagcaucaaugaaagcagaaugcaaccuagaaugcagcccuguauacuacagagucaauccuuucagaaauuaggguggagacaauuguucucuggcaaggcugggccucacucaccucugcuaagacagugaacauggacucuaaaaaucaaacucuaagaauuggaaagacuugagaaaaacaaccugaaagcuuggagcucugaguuacauacucggguauaucugggguugucucuucugcaaauuaaauggugucugcuuggagcuuggcagugggcaggaaacagaacaggcugaggacccgaaucccagcuuggacacuuccuguuacauacuauagauaggcgccaaggcucugcuggcugcuugcugugcuucuaaccauuucccugugucugcagcaugccccgcagggacuuucccugaaagaaccauucuuuccuuugggcauauugagaacagacgcuauuugucuccaaaucuucugcugauaucacaccuuuaugcgacccagucaaaaggaaagaaggauuacuuucuauucacuuguaucuugcaggagauaaacuaauuuugagaaauucccuacaacuggaagcacuuucagaagcugcaaauaggcaaagaugaagcuaaaugccaucgugcuuugucauuuacuuucggugacagcuucuucccauguugcuuugugagaguggccuucuuucagcucagucuuuagagcuaacucacguucuucuguuauaauagcauuuagagccaagcauggaagaggcuaccuuugauaauuaauggcuccaagagucugcuaagcaugucguuuaauuaauggcacuuguuccuggaguguauacaacucuggagcugaaucgcaggcacgauugcuauaguggguaggcacccacucaagaauugucgcacaguuuauaaggcuucaacacuuuuagcugacuaauggguuaaagugcccaccccuuucuucuucauuauuuaagagaacuggugaaauuauguucuuuuuccuugugaguacagauuuuaauccaaauaaaucuucagacuaauggauaaucacuuacuaccuuggagcaggacauuucaacaaaauccaaaagaugagccuuaagugguugauguuuagugggaguucaguggucagggaaguucugaucugucucaauuacucacaagccaacuggucuaaguugcaagugaguccaucuuggaaucaaaagcugaagggugagggagcgagaaagauagcucaaugguuaagagugcuucuuguucuugccauggaccuaaguuccguucuuaucauccacacugggcagcucgucaccacuuauaacuccagauccaaggcauccaauaacuucuggccucugaggucacaucuucacacauacauuuuuuuuaaagaaaaugcuuaauuuuuuuaaagguguggggguugaaaacuggaguaaaacaugaaugaacagagacuauuucacaccuucacuuccugagacuuuagucucugaacuguagauagaauauuguaaagcaauaaucaaaauaggggcauuaaugguggcgguaucaaucuuaggagagauaauugauugcccccuuuugggaaccugaggguuauuucaccucaagacuacaacacuaucucaaggauauaaaaguucaagacauaaccugcaccaaucuauagggaaagagaccaggaccauaacuagcaauaggccuuauuuucuucuacugggccccacucccuuauucaaggaagacuggaguuaaaagaugaaggaaauagggauauuaccuuagauugggcacuugagaaacaccuuuauaagcaggagauauuugggccucaucuagaauggaggaaagucggaagggaaacuauucuaguaggaagagugcccaugcuacauugaaccauggggcagguuaguguuugaugugauuguauaccagcaagaaggaagaagauuaagaaaaacauuauggaaacugcuguggggcaugaaauaggacucaugugaucuaucccugguuggcucuucagguugaugggagaccaugaccuuguuuucuauugaagaaucaugaucuuaacuuuauuuucuauuuaaaugcauaauuucuaugguguaaccuuggaggacuuagaggauauagauauuuauuuuaagaggcagacuuaacagcuuacauaugauauucuauauaaagaaaugguauuuuuaauugaaguauucugaaauucaaucuuacccagaaugagggaguucuuagauuuuuuuuuucagaaaaugcuuuucuuauaaauucuuguacuauuucaaaauucuauuuagucucccuuuuuuaaaacauuaaagaaguugaagcuaaucauacaugagcucuugagaaauuccugaauagacaacagaucuucagggagaguaaguaagauuuucaugagaauacuuggguacuggacagcuuuagacccuaggcaugguccuugcauaaacagaucauucaaaaaucuucagaagccaggaagagaugagguaauucagggagaauagcuuggcuagcuccucagagcucugcagagacaagguuggaccucucuagaaaguuccccuuucugggagcugugacucaguuucacuguuuccaauuaaaagaugauuuggauaccagcaugugcuuugauaucuuuaaggcaauaucacaccagcaauuugcagcucuaaaugccagcagcucaaaauuuuaccucauuggagcaagaugcggagcuuuagggaaagugguaagagcaucuaauugcauucaaagucgauuuuugccugucuuaaaggagugcaaaugaucugccgguuuuuauagaccuucuugaccuaaagauaucugcuggcaaaaaaagaaucuucuguugagcucuuuuaaugcuuaauuauuacaugaucuaucaucuaaagcacugacucccacucuuugaaaaaaauuaaauacccauuaaaauucauuggcuaauucuagaucauaaaguggcucugggagggcaugugauggggguuuuaggggagcagaaggagguagauauacaugacugauaaaaugucaauggguuuaugguaugaucaaugucugaagucaguuagaucagaguugugguggacaauguacuagugcuuugcccaggguccauguacuuucauguucuaguggacacccuccuccuugagaucuaccgucagcucuaauggggaaggacagcuacuguguuuggcuugaaaugaguucuuagcaaauaguuugugauuguauuaucaagccucccauuuaaaauuaccacuggggaaauagcaauuuauucuuuugauauagcuaggaauccuuuuaugacaagcaacaugucccagugucaaauuuuccucuugaugaaaagugacacagcacuuuucuaacaguacuauaccucccuucuugguaucuuggcuccuaucacuguggaggauucugcugucucugguuucuccuaaugaugaguuggaaacuucuugaagccugaagucgucaaaauccuagucgaaagcuucuagcuacauauuaaugcaucacugugaaggggaggucucuaauugauugugcuggggucagaagcuaugacaaguucuucauauggaauucauaguucccaaaugaaauaucugccuuguuccauuccauuccuauucucugauuaaaucuuucaaugaucuuccacauguuuucuaagaaacaguggcagauucuccaagacccuuuguuuaacugaaggaucaugaacggaacccguggguguccuugcugacucaagaaugcagugucuaauggauuggcaucaauaaugacuagcuaugguuuauuccugguuaucugaugaagugugaguuuucaaguucauaauuggaaacuugagacagcaucaagucccuagcaaauggcugugauggcuggcuaaagugauauacaggaagccuccagaaugggaaucaucaaaugcugacuuuguuccugaaguuagugaagaaguaagaaaaaacuauaucuuguugcucugcuucauuggauaauuccagcugugaguuaccuagaaaucuuuagagacagguguuuuccaaagacacagcaacuguguuguaaaggcuaaauaccugauccaaaguuagauaaaccgaaccucgaauuuccagaguucugggaaaagucacagcuacugcuagcuucuguucuugcuucugaaagcccaggaaaacuggagaaucucugagagguuugaaauuaagucuaugaagugcuuagaacagguuguucauaauaagcucuucuuacguagcaucauuacaaguuauuacuacuaauuaaguacucucuccacaguggucucuacuauucacuuuuaaaaauaauaaugggguugccaguguagcuucugaaagucagggacgauggugaucaaguggggugguaaacacuacauguuccgggaaugcaucugcaaagaugcuauguauggaacaguuacucucuuguucugacuaugccuacgugcaacaacugaguauccagccagcaauuagacaauacagugaagucuagcuaaacaccuucauuucucucccuguauauugcuguuguuauuuucucacuuaucugauugucuuugcuucuucuuuuucuugaacuauaauacacacagaaagaaaaacugcagacagcucauaacugucuuacagaauuaauauaaaacaagaugaaaugcauaucuuccuaccacccguuccaaggaauggaauauuaccagccugcccccaccuuccuuagaucacacuucccuccccuccccuucccuucccuccccuccccuccccuucccuucccuuccccuucuucccccuuccccauucuucccccuucccccucccccuccuccccuccucuccccuccucuccccucccccucaucuccuccccucccccuccuccucccccuccuccccuccccuucccuuuccaccucauucuuagugccugaacacaguaguggcugcuucaugaauugccuucuaauuuuaccaucucauugaguguccauaagcucuggaauagaauguugccugaucuagggacuugugugauucuguucuuccauauuauuguaaacauuuacuacaggccgucugcagaaacuuugauaacugugguaagcaagucugggacuucauugugaucuaagcuacauuuugcuccuggcuaacaaugagccucuucaacaguccuugggggguggggguggggguggucaaguuccucuuuaagagcaauuuauuaaccuuuccuugcugaucuuaaagagauuuuuuuugguaccuuguuaguuaaagcuuuucccuauagcaaauuaugaagauaaccucuagacugucuucaaaaccucuauuguuuuauauugcacauucugaguuaaaauuuaccuggaaacaaccuuuauacacaaugugaggcagggauucacuuuauuaauuuucuauguggauagccaauuuuccuagaaccauuugcugagaagauuuuccuuuccccagaggcuuguggugucauuuucucauaaaucaaguguucagauaugcccgcauaucauucuggguucuuauauuguucugucugucugcuuagauuucugccaauaucaucaagcuuucuuaagucuuguggccuuguuguaauuaagcccugauaucucuagaccaagucccaaaauauuuuuaagcuuggcuuuugaugguggugguggcuguuuguuuagguuuauacagcuacauuucuacagugagcuuaggggcaauuugucaccuuucaccaagaccaaaccaugaaacuuuggguuugcaucucccugaauuuaaaaagugucuaacacuauugcacaugccagcaagauuuugcugaagggacccugguauagcugucccauaugaggcuaugccagugccugucaaauacagaaguggaugcucacagccaucuauaggaugaaacacagggcccccaauggaggagcuagagaaaguacccaaggagcuaaaggggucugcaacccuauagguggaacaacaauaugaacuaaccaguaccccgagagcuugugucucuagcugcauauguagcagaagauggccuaccggccaucauugggaagagaggccccuuggucuuauaaacuuuauaugccccaguagaggggaacgccagggccaagaagugggaguggguggguaggaaagcagggcagggggaggguauagggaacuuucaggauagcauuugaaaugcauauaaagaauauaucuaauaaaaaaaauaaagugucugaaaaaauugaguuuucauaaaacuguuaaucucugucuauuuaagucaucuuuggugauucuuaacauuuuauacuuuuuaucuagacgauuuuuagaacauuuuccuuucuaacugugaauauagagaaauugaaacuguguacauuauucuuauguugaaagaucuuucuaagucuauugacuaauucuaauaaauuucccauauugggaguuugugaguauauuauuguauugcccacaaauaaugacaguuuuauucaucucucauuccuucucauucguugugugcuggcaccaugaguacauuucauaguacaaaugucaacaaugaucauucuuauaucauugucaaaccaggauugaugaccuuucaccauuacuuauaaauucccuuacaguuguaccaauguuucaauauuuauguagaugacauuuugaucuacaguuuaauccacaucuucugagcagauccucucauuuucucuuugacuacucugaaggaaggcauuauuuaauacuguaccacaaagcagaauucauacugaucacuaauauuguccucuugauaacuguaugaacacauaacccaugugugucugucccccauuuaucuggcaucacuuagcgcuucaucuuuuccaaguaccauuaggaugcacauuucuuuccauauuucuccugguugguuugguuucagaguaacucaaagaauuuuucuuuucuucccauuccugcucuggcagaguuucaggaucauucuucauucucuccugcauggcagguucgaccaguaaauuugucugggccuuacaacauauuugcugggaaacagcuugaguucucuaaucauuauuaaauuauuccuauaaucuuuuacaucucuggaaguuggaucaaucauauuuuucuagaaacuugacuauuucgcccaaaauuucaaauguucugcccuaguguuccucuuuuuagcaacugcacuaacuacacaggaauuugucuuuuuauuuuuaacauuggauuuccuuggugauuucucuuuucaaagaaucaggacuuggucuuuuugaucuuuuuauaugaugguauauguguuugccauuguacuguuaaucucuauuaucaucuuuuguauaacuucaugguucucuaacuguucagaacgguuucuauaagaccuuuuaguuguuauuuuauucaauaaaugcauuaagucauaauuaaaagaaaacuauccucuaaaugcuugcuuaguugucuacaaguuuuaacugucuucauucagcucagaauagcuuuuuguuuuguuuuguuuuauugcuuuuucuuuguaauuccuuuaauauaucuauugaugauaaagugucuuagguuugucagaaaaaaaagauuacuucauccucaucuauuguuagcuuccuacaaaauaccugagauaacccaaucauaaagagaaaaguuucauuugggcucauagguuuaguccacagucgaucuuguauuugggcuuauugguagagagcauguuagaauacaggcauucuccauugcagccaguggaagauaaagacccugaauccuauaguucuguucaggagcaugaccuaagacaucuuacuauacucacuuccuguuuucugucaccucccaaaugugugagaaugagacuaguccuuuaacaugugccaggcacuagggaacacugaagaccuaaauuuuuagcauucauggagaguucauggacuucguggauaugcaagucucuagcuugccagguauuuucucuuggauacuuaaauaucaugaucuacagauuuuccuauuuuuuuguuucuguuguuauuguuauuguauuugucuuugaaaauacacauuucuuaaaucuaaaagauuccuuauacuuugcugcaauuuuauuaucauacaucuucauaaggauucucuuuuuuucccugcuauggcuuggauauauucuugaauuuuuggacuuuacacauggggugggggggggggggagagagagagagagagagagagagagagagagagagagagagagaugcauauuuaggcagcuugaaaccaaccaugcaucuaaggauaaucuuggacuucugaccuucuugcuuuuaccuccagacuauugagguuuaucagagugcgccaccauaccuggcuuuuacuuuguuagcaucaaagccuucacugugugugugcucagucagaacucuauagaaugagcuacagcccuaaccacccuucuucugagacaggaucucccuaugcugucuaggugucuugaauaccuauggucaaauaguucuccugucucagcauccuuagagcuuagauuacuuuuaugaaccaguacaaacagccuuuccccuccaguuuucaaaguuucucagacauuaucaccuaaaauauuuccacuaaaauucuggaucuuauacgaauuucuaaauaaauauauaauggacuuuuccauuauacuucuauuuuuucuucuuugucucucugucucacuaugguucaaaccauuacuuucacaugguggaugcuuuagucgacuaaccccuuuguuuaugaaaaauuugucacuaaaucuacucauuaugguauugugcuuugguuuuuuuuuuuuuuuuuugguuuuacaauaauucuacuuaguacuuucuuacaucaucugagauuuuuacagaaguuuuggcaaauuuuauuugagaaaaauacuuccacugcuuaagaauuuuuagcuugagagucaucauugugccuuucacaaagaacuuucacuuccauuaucuuuuucuacuuacuuucauuuuauuaaaagauuuaauacuuuagcucacaaaugaaaguaucauacuguugguuuuaaagaggcaucuugaguuucuuagacauuucuuagaauucuuagaauuucuuagaaugagagaugucuccuagagcuccggaauuaggaggcuuggccccaguugauggcaguguuuaggaagguuauagaugcaauauaucacuagggacugccuuugagggcuuauagccuugcuguacucccuggugccuuuuccugccuauuuagaagugaaaauucuaucagcaagauucccaccccugucucccguugccaugcauuccaugacacaguagauaccaucucucuggaaucauuaaucaaacuagacuuuuccuugccuauguuauaggguaucacagcaacagaauagcauuacucuacucaaaacacuugcuguguuccaacuccuauaaaucccaaugauuaucuaucuauauaggcagaaugccauucugaagccaugggcaaaggacaauuuuauaaauaaaauacucaguuuccaauaccuacaacucaagaacugaacauacugagcuauauuuuagaguuacuggagaagagugaaaaccagaaggcucuacuuuugcuggugagucuagcauggauaauccaaguugagugaugugauaacuugagugauguucgugcaugucaaaauaaugcagcaauuacuaugaagaggcggcugaggcauacuguaggcauuggaacaggugagggcaaugaacauuagcuauuauuauguggcaaggucaaggauuauuaaugugaauuuucauugccuuccuucagauuaaccccccaugcucuccagaagucucugucuguugcuauaaaggaaggagucaggggaagacaaaauucauacacuggaaggagaagacugucagaggugagagaaacaaguagagaaagaaaaaccucgugacagagaacagguuuauuuaaggagguuuuacaauauagcagaguaugcugauuaaugugcagccauccauuucuggagacagagauagagagccuaaaauucuguuuuuaaagauuugcucucucucucucccccucucucacugucucucucuccuucucucucucucuguauauuucucucucucuuucucucucucucuguguauguguguaucucucugcaucuuucucuguguguguguguaucuuucucucgcuuucucuuuaucucuguguaucucucucucuguaucuuucuuucucuugcucucucucuuucucuguguguaucuuucucucuuucucucucucuguaucuuucugucuuucugucuuuaucucugucucucugucuuuaucucugucccucucucugucucucucucucugucucucucugucucucucucucugucucugucucucucucugugugugugugugugugugugugucuguguguguguguauguguguguauguguguguguguguguaugugugugugugugugucugugugugugugugucugugugugugugugugucugugugugugugugugugucuguguguguguguguguguguguguguguguguauguguguguguguauguguguguguguguguguguguguguguguguguguguguguccuuggagaccagaaggggaugcuggauauccuagagcuagaguuauaacugugagcugcugguaacucaacucagguccccuggaaaagcgcaaguguaccuaaccauugagucauuucuucagccauaguuauuuuggggucauaguuaauaauuucauguugguggcccaugcaguuacaaaauucacaaggagauaaacuaaccugugauauuacccauuucuauuaugggcagagauacagcuugguagaaaagucuaccccuugccuucaccccuaucuaagaacuuuuagccauuaguggccucagaaauauuuuuaccuaaucuauuuggucuaaguaggaucccagcaaaauauuaaaccaagcauaaagccuauuuuaauauugggguagacugucuuaugaacagcuguaacaaauuaaaagaguaaccgauuggcauucuggauuagccacuucauggggcauuauauuugacuauuugcagaugagucuauguauuaucauccucagguccuggggacuugguucauguuuaucuuuauguccuugcaauugaaaacauauucuauaaauguaacacaaggggcgaaggggacugaauuauccacagaaacaagaacuaagaaaaaaaaguuaaaauucccuuuucuugguucuuuuaaaucauugucuuuccugacaaaaugaaagaugaacauuacucaaauaucuucagucugaagggggcaccaucucuaacuguaccaugcuaaagcaaagcugugaucauaucaauuaaggggcgacugaaaaggccagauggauaguuuaauuccuauuaaugggaguuccucccccuggggaugcagacuaaaucccucaagaugaacuucaagcccaccuuuuuccccaaaauuucuuccaugaaucccuugagucuuucucauuggugucuguucaugugaaaggcagacacuagcuauggguacugggguagacuuuaagagacauaauuuguagacaaccaggcagaccuuuucucccuuugcugccuguggcuaucagugauucuccagcagcugaaauuauaguggcuuaaauuaaaaacaaaaaaacaacaaaacucuggugacaaaaucucucuugauaucuguaacuaccaauaaugcuguuuugggcugauucauuugcuuuaaaauugcacugcauuauuauaagcaaaugagagacaaccaacuaucuuuagcguaaugacacaccccuaagagagugcgaugaauuaugaaggaucucacugacagaacccucugugcaaaccaaucuugcuuucaauuccuauccaaguugggaguugauaucugcauaucuuacagcagagaucccuugguuccaguggggaggaggcgacgacagcaucaugucccacugggacauaucauguugaauuaaaauuagagaggcagcaaauccaaguguuaaauaccuacauggaaauucaucacacuucagaaagcaggcaagguuaagauaggagaugcagauccacugucaucuaacgugauuuagaaagacuaaaagacacaccacaaaguccaaccuggaaaucagcugaguguacagggagccaaugcauaaauucacagaggcagagaggaggcacugacuucccagaaccaaaguagcccagucuccucagggucugucagguaggcaucaagacaguuagagcuucacccagcaaccaguauauuccuauuugacuggcccagcaagguaguauuuguuuuucaugauuucccaagaaauggcgaccuagugguauucugauuggcaggggcauauaggagccuguguuucccccuggaccuuaucuucugcccaugcugggagcuguaggucugggucagcugacucugaguuugaauucugauuuucacuguucauuuuccaaaggugggaauaauacuuaaaucucugaaaaaugacuuucuuucaauguuucuaaauagaucaaguaggcaauugcaggguuucaguuuggugguagaauuuaagcugaggagagaguggccucauuuucuacaugacagaauugguagcugagucuugguaguuuuaggugagcaacuacggacagcuggcauuucauaagcacuauaucucucuucuauuuauauuuaugcuucuaauuagaaacuguucuuuuuuuacacugaggcaaggcuacccagcuuaagauaaauguacugcaauggaaaacaugaaucaaggaaauaauaagccagcaguacccuaggugauacaaaggagaagagaaaauaugagaaaagggaaggagcaauguagaauggacccacccaauguaauauugcucaggcacauggucagauggaagaguaaccaggaaggagggcagcuucaugggauaagcacccuuaaccugcaaacuacuuacugauuuggcccauagggcccauagggccaaaucacuugugaaauagggacacauuuugguuucuacuaccuugcgcgggguggcagagagacggguaaaggaacucagcaguggaagagaaaguguucucuuucuaaggaaaccagaaaggcugcuggaagggcagaagaggaccucuugagggccaccauacgagcuagugacggaaauaucaaguugcuggaguaauaagcaguguaacagcuaagagugagcccauagguccaacuuuccuguugacauuguaaaugcugccuuuccuaaaccacugaacacagagaaaaaguaacauggcugagcugggauuuuauaguaguggggauuuuuuuuguuccuucucaguaacuauccaugacugucaucccucccagaaccccaucccaucucugacuaugccucuugggaauuucaagguuuuguagaguagcaacaaagcaagucuuucuagucauccugcccaaggcagauauacugcugaccauauuaucaggaaggccuagugaagugacgaucaucuuaauuuuacauaaacagaagauacuuucuuaagucuagguaaauccaaaugguacaucauuagucuagauuuuucuguauacaaauucaguauaaagauggaauuuggaaauggaaaggucacucugacugccagggcaugugagagagccaucuuguaucccaggucccucagagacuagucugcacaggaaagcgaaggcugcagaagcaacauagcuucugggacaggccccauuucgggccuucaucuucagccaggaggcagauuugaaugccagaccucugugcaccuucccugcaagaggagagcuugccugcagagaguacucugagaacugagacccaggagaaaguuggacucccaggagugcugacagaggcuaacagaaucauaggaggaacaagcuccagccagagacagcuagaacaacuaacgccagagauuaccagauggcgaaaggcaaacauaaaaaucuuacuaacagaaaccaagacuguucaccaucaucaaaacccagcacucccaccucagcgaguccuggauaccccaacacaagauucguauuuaaaaucauaucucaugaugaugguagaggauuuuaagaaggaaauuaauaacucacuuaaagaaguacaggagaacacaacuaaacagguagaaggccuuaaagaggaagcacaaaaaucccuuaaagaauuacaugaaaacacugcuaaacaaguagaaggcuuuaaagaagaaacacaaaaaucccuuaaagaauuacaggaaaacacaaccaaacaggugauggaauugaacaaaaccauccaagaucuaaaaagggaaggagaaacaauaaagaaaacccaaaggaggagaggcccuugaucuugcaaagauuauaugcccaauacaggggaauaccagggccaagaugagggaguggguggguuggagagcagggucgggggaggguauaagugacuuuugggauagcauuugaaauauaaaugaagaaaauaucuaauaaaaauugaaaaaaaaagaaaaugaaaaggccaauaucuaauaaacaaagggacuaauuuaaggacuauaugucuucagggagguauauuuaguuccuuuguauugcaaggugcagcaguccucuugguaaaacuugaagaccgacuauuuaauacagggguuacuguauuuuuucuagucucaguaccuauaucagguuucccaacaggccauuuauuuagucugaacaaaagcccauuaaagagagaugcaaguuuuaguuaauuaaaucaaugaauaggcauggugcccaaugguuuguaugacugccuaggacaaaugucuuucugggaagaguugccaguuaaaugaauucacuuagaagauagguaaauucaggacuuggugcagaagcagguaacaaucauguaagaaucuuggguuagaaguuaaaaucuuaaugcauauauaugacccauucugauguagacccuuauaauuccacaaagaccucugcaaaauucuagaccuuccucgccucuacuucaaaacacccauuguguaggaagccagaaaaacaauuucagccuaauaaauugaaccucgagaugugggacccucauuucaucugggcauuccaaagugauccaccagacuucugaagagaaauugaauagaaagcaguguuuggucuaucccaaaggcugguguuuauuaccaaaccuucucuucagacagaauauaaggugaacagagggaaagguuaaaaauaaaacacaagcaauagcuucugcuacacuucacuguguuccuucaggcaaaggaccucugacucggugcaugcaugacauaaugaacugagcuuugcagugcuuggcugcagcagcaugcuugagcugaggggcaggaggacagagagaaaacagagaccaccuguagggcuacacaagggaacuguaauggcugcgaccaccauggccuacugaggaugccaaguauccuuugcuucaugaccauccuaccauuggccuuggaaaauugcuugcugcacacaucaaaaauuuacacagaauuuuguaggaaaagaaauagaaaaaaucugaagcauucaaaaaucacagaaagagaaaaacagguaaaugcucuuauagacaaucuugacugauuucugaauuucuucccuuaacccuugagcaauccucccucucagcucauacauuacuuuguuccaucucuggacacuuuuugugauggaggaaaguaccuggacacacuuggagggagaccuuagugugcucuuucuagccugacauuaucccaaacuuuauguacaggcaacaggacacuagaggggaaggcccucugggucacugagcaauuaaaguauuuuaaaaggaagucugaggagagauuggccaacugauacacaugucuuugaacugcuuugcauuucauaucaaaacaguauacaacaguuuucuuuucaccugcaggggauucgguccaagacccccaguggaugccucaaaccaggaauagugccaaguucucuaaauaauuuguucuguauauauacuagaaguuaauuuaugacguauaaugagagaucugcaaugaaguaagcaauuauaacaauacacaguagcaagaguuacgugaacaaacucgaaauuccagagaggcugauguuacacagauggcccagaaagguuugccacucuccucauagagccuauaguuucccagcucucuagcuugcuugcucgcugugauguguucuccuuauuauaaguuaccccuaucucuaccacucaccauagacuccugguccaguuuguuauuccaggacacaagacccuggaaaucuuuugacuuucccuccagauuccuggccauuccuacaguguuaagauguggguaagucccauaugggucaagggguuuccucaguuuucauguuuuuuguuuuuguuuuuguuuuucauccccuuugggagacuugguguugccauguaucuauccuccuucccagccauugcuuuugcuuuucugagacccaucauguuaccggauauuugaaccuguuucuaguuaggguguggcucagucuuuagcacacaccuuuaaucccucuagcuggaauacagucucucaccuuuagucacaaacaaugaagcuaaaguuaguuuguagaagaaagcacccauguucgaaagugaugucuaauugagcuacagaaaaagugaugaaucagagaaagauuugacaaaauaggauauguccaacucucaagagaaaggaaagggaagcuacuuagggagagacagacaguacaggaaaagagaguccagugcaggaauacaguagaguuuguagagaggacaguagaguugagaggagaggagagcagcacagagagggagaaggagggcguuuuaucaggagaguuuuauagagacagguuuaaaagagaacaagcuugacacaggaaaaggcaggauaauccagagaaugagauggagcagaagauuaggaauaauugcuagaguuacuuugagaccaagcagagcaauuaagaggccuagacaaaagccagaaugaaucagucagcuuggagaggaguuugagccagaagagcguuguugaaccagccggccagaguucagagaggacuagaaagggcgagcuuacucagcagcaagccucagaagcugaaaacauucuaggccuagauaagacuguaccgaggcuagaagcuucgaggacuaggccgagguuagcagaaagaggcaguaagacacuacucacuacagcaggagaauaaaagguacuuugacaauguuuaccugaaaguagacccgcagagccuccgccucugcagccaucuccuucucagaucuccaaaaggcuggcgaguccucuucuucucugucauguuucuggagcuuuggagaaagaaaauguaauaggcuuauuaaagaguccgugagauuguguuuuaauaacauugggggagagaggaagagugaaaauaguuugcaaauuagaggccuguagguguaucuuaauuacauuaauugcccaauuucgaaaauaaagaguuucgcauaagauuugacauuucuugcuucuccaauagaauaacaaggcugggcuguacuggagccgcugcugcuguaugcuugccugauaagccugugacagacugaggcugaguaaagugggagcuuggugaggauggugucccaccauccaccacagccuccaugccucuuucuguuugucaggcaccguucuguuauugauuuccuugacugcaguuaugccuugucuccagccauccuuccuggacauccuucauucuggccuacaguuuaccuaccauucauucucucugguuuucauuguauuguaugagcuccaaggaguuagaaacacuguggcuggaagaaacuuagaagcuagacacucauuugccuaaacugugaaugaauucauuuuccauuaucagaucuuuuuuucuaguuucuuuuaagaaguggcagcauugugaauccaagugcaccggcuauaauggaaacuaugagaaaacaguacagaauauuaacaacuuaguuaauuaaguuccuuuuuagagcauucugugugugugugucucuguguauaagcauauauaauacauauccacauauauuuacaaaugguaugcauauauauauuuacaagcaugucuauguguaagauuucuguaucuagugaacacaugucaauucuaucagagagcagguuuucaguugaauuuaaucuccuauuauauuucaguuuuauuaucgaaccuuuccuuccuguggcuauaugagugcaguaguaaucuauagaugaggcuuguucacaggugcagucuagcgauuuguauuauguagacuugaauuguugaauagugcagccaaugguggccaacacuucuaauguggggugggggcagugucucugcugaucauuauuucacacauaacccuuacagcuucccauugguaggcagacacuaucuaacuccaucugcccuggaggaaauuaauuuacuuacccagguagauaaugcuaggugccagcauuuucccuaaccaguccuuaaucuuggagaaucuacacaauuccauaguuacugucuacacuucagugcauauauucucaccuugaacaugaacuuugaaaguaacuuugugagcucagcaaaacauucagacugaaagaguaacauaggaacaugacaagcugaucacugggaaucaugguaaaaugaacagggagaaucacuccacacacuuguccucugaccuucacacgcauauguggaucuacuaaccccaccuacauacaauauacacaauacuaauaaaaauuuccaacuaaaauagcaauauucauuuucuugaacccccaauaccucauccuacuucagggauuccaccuuggcagccuauagcagacaaagaauuucucccauuugucucagagcaacuuugauguggaagacaacauaguaugggaaagauacccucgcucuccagcagggcuauauuuccacacugagcaagucugagccuaaaugagguucauuagcauagaacuaggccacaaauaucuuuaugagggucauggaucuuccuuucagaauuuggcugccagcacacugguuuuccauuuugccacacagauuuaauucuucuuaguggaagaaaaguacauuaagaagucauuuucuugcucguagaagcagauaugacacaguugcuaugggcaagucaaaugggauugcuauucuacccaagaacuaauuuucauuuugcuacuaccuuuaggucuguuauaaauccaucuucuaacaguuugaugggggagacaaggagcuagagaacauggcauucccacuguggcauugccacaggaagacacagaaaucaagcuuaaagcagacuugucaacacagaccauacuagcugaugccaaauaauuuagaacauuaaugcuuccugguuuauuaggcacccucuguugguaucauaugccuuacagauggcagcgcuuagacguuauuuccaggaacuaaagaaccaauagcacaaacuaaacauguuucggaaguucuguuggacaugacuauuauuaauaaaacuuuugaagacucugguugaaagcuugugguuuucugaaaaaaaacagcuaaagccugcauuaccaguggacuugcuagagacacaccuuaaaagacacaccaaggauucugacucaauguuuagagaauuugaaaagaaaaaaaaaaaaaaaaacuaaacuuuuaaaggaaagagggcaauguauauagauaagggcucuuauacgaacagaagcauggcugguaacuuguauccaugguuacagcagcuuuucguaggguaccaaaaucuagaguuguuuaagucuuagauauaaaauucauauauuugcauauaaccuuugcauauaaucugacguacguucccucuugcaaauuaucuacaaaucccaauacugcacaaaugaugugaaaauagucauucugcuuguggugaguagagaugccauuuguuuuuugcuauuuuugaucagugguugcuugaauccgcagauaacaaccaaggaccuguauugcaucuguccuuuguaaaucccauuggagagugcuuuacuuuuguuuacuguaagucaauggggcaucuggaaggcaagauuugucuaaguaccuugaugaugcuaacuugugcaggaggcugcagucucuauaggaacuaggaggcuugggacaaccugggaggaaaagacuugugcauuacaagagccaugauggaaacuaaaaaaauauaaaccugcagaaguuugugaaaaguaucugaggcaaucuaagaauguggccacagaaaucuguugccagacuaacaaauaggaacuccaugaucuuaagcaauagauuacccaaaaggcagauuugccuugugugagccauaguagggaaguuucauuuguagacgaauuuccagauuaggcugcuagaagggaaagucaaugccuaauuaacuaucauacccaauguccuaucuguccuuccagugccaagaaccaguguucucuccuguagucaaaggcacccacccagggaagacaggcacuaaaugguugguuucuaguacuauacgauuaccaaauggacagagcuggguggaugucaccuagauuucacaaagaaauggucuuaucauagccaggcguacguuuaaucccugaacuuaguaugugggguggggggaaaaaccagaaaaguuauaggaaagaggauauuauuuaaggaguaucuaacaaggguuccccaggaauggccccuauagacucagaugucugaaugcuuggccauaggaagugacacuauuagaagguguggccuuauuggaggaaacgugucauuguaggggcaggcuuggaguucuccuaugcucaagcuacacccaguauggaacacagucucuuucugcugccugcugauuaagaucuagaacucuuggcuccuccagcacuaugucugccugcaugcugccaugcuuucugcaaugaggauaauggacuaagccuuggaaacuguaaaccagucccaauuaaaugucauuuauaagaguugccauggucacaaucucauuucacagcaauaaaacccuaagacuaugguuuaacagucuauguuaauagucuaagucuaugguuuaacaguuucaaagacaaauuccucuaccucuguuacccuuuuuguaaaaggaaagcucggaaagacuugucaacagugccuggcacagaaaguacuuguuacuguuggcuguugccacuguuguuuauuaucaguguuaggcuagacacacuguccucacaagugaccacugaccaccuuagcaaguugcuaaguugcuuagcaagucuuccaagaauaagauaccuccuuugauggcuccuuaguggcauccauguuguggccuuauugaccucaccaaguacacaaaguuauagucagagcugaaggcccuguucauuaauucuaauggcauaugucuaaaacagaaccuagauccuucgguucuauaacuggucacaguaaucucuagcuuccuaguuguuacaagguggaaguaggguauuagcaauaagcaaaucagcauccaagagugaaaauacauggaaagaucaaaggcaguccaaacucucauuagagcacaguugccauguuugguacauucaucauuaguaagacauuuauuuaauuguuugauguagcaacauuucacaaauaaucuagggccauauuuauacuaaaauguguguguguguguguguguguguguguguguguguguguguguguguguacaggcauauauguauccuuuuuuuauacacaugggaaagccugguggucaaugccagauaucuucuguuaucacuguauugucuaauagugucucacuggauuugaagcucgcugauucaacuacacuggcucacuagacgagaugcuggaaucugagaguacagaggcacaucuuuugcccuggguguuggggaccaaauucaaucuacaugcuuauauaucagacacuuuacucacagccauuuuuccagcccuauguguuuuuaauguccaaaaucaaaauuuaaaagggcuuccauauuugaucugguaacucaccuuagaaaguugcuauaggaagacugugagcugcagcuaauaaucugguugucccugaauuagcuguggaccaaugugggggcagguugaucaaacauaucaaauucaagaauagcaugauguaccuuuauugccacuauuauuacuguaauguguccuauacaaaucaugagcaccguuguaauucuauagugcacuggucacaagauguacacuucuucacauuucaacaucucugagaccaaaauguaaucuguugucaagaguguugcaguuugcuugucaggguuuuuauuccuuagugguacauggcauagcagcacuucugacugcacuaggauuugauauacuggagugcuccaucucuaucuuaagucccagaagcuaaacgugacucagcuucugugacagugcucacaucacggcucuuuucuuucugaugccauaaaaguugaaauuccucacaggugcuucauuauuugauggaaggucuguagcaaagugacaaaguuugcaaaaacuugaaccaaggacuuuauuccuguucaacacaccaaaguaugugauggcuccuccaagggagcucugguucuauaaaacuuuugaaaagagauuuuuaaaaaauguaucuguagucaucucacuugaucugcuugaaaugauucuccgggcaggaaguguuaagaggauuucugcuagaagugcugaucuguguggauucugacaugcuccccccccugcacaucgaguguguuaucacaaggauauggggaagugauuaauucccccaugggaugcucaagcugucuuggcuauugaugcuucucuaguucuguaauggaauacaguaggagaaaugauucccagucguuugaauguauuguagaaugugggacuaaccuggaauagauggcaagcugccuucaaaagggagaaaaccaauucaauguguuccuuaaagagcaaguaucugaggagaaaccuggccgcacuuauaaagggauauauuaaaaaaaauaaagggauauauuuuauuauuaucaguuuuauagagcaaaauacagacaaaagagcuuaaauaaacauuucuaugggugaauguuucuguuuuuguaagguaaggucaguaaauuauugaauggaaaagaauuaaauaggacaguuaaguucaucuuucaucuuuaaagaugauucucuugauauugcucucaacugcuuuaucaggcacacauuuauuccaggcucuggacucaguuuuaugagugauagcuugauauuuaagcugaaaauccuugucuucuggagucuuauucaauaaggcaggcagauucaugcaugcaucauggaauaagaguuggaaugauggauauggacuggaagucccauccaaauguucuuggaaaaggagauuaguucucuagauugaagaucagaguuuuguugcaggaaguauuaaaaaagucaucucuccaucucuccugcccugccuguccauguucccacuccaguggcagaccaaaacacuaugcccucgugggauucugcuugguguguucucaugcugagcuacucucucccaguuugagaguuuaucucacuuucaugaaaugccccccacacucacaaucagccauuucaacaccuaguuacccaguauaaacaggacucuuaaagcuuaauuauccaaucagauuuauauaacaauaagaucacaauuuacaaaaugccaauacaauaauuucagaaccaauugauaaagauaaagcuuuaacccaauuauucuaaccuuguaaaaagcuuagcuacuuguggcuguuuaagaccacaugggaucaggaucauuuucuugcuugucugccuccauguuggcuucucuccuucuccccucuugcaaccucucuauuucucucugucccccaaacuccuagcuccaccuccuuuucccuguacaaucacaggccugccacuacccuaaugugguuggacagagaaaauccugcaauagaguuuguauuuaaacaucacagauuuggaauggguuuaauaccuuguaugagaaaggguuucuaugagcaacgaaaaugcugucugugugugcuaucugagccaggucuccuauaucaugugucaucaucagcuaaccacagcagcuuucuuaugugguaugggcagcuucuaaccaggaccugacuaucccaagaguuuaaagguaggacacacaugucagagguccagaagaugguccccaguucuacacaugcauacuacaaauaccuuugaaucugugggcuagggggugugcucagugcuuuaaagcacauuuugcuuuugcagaggaccuggguucaauucccagcagucacauggugguucucaaccauuuguaacaucaucuguaggagauuugaacccucuucuguccucuguguguguguaggacacgugguucauagacauauaugcaggcaaaauguucauacaaacaaaguaauaaaauaauuuuuuaaaauaagcauuaucuaacuuucaauucuagucuucuuacuuauguuuuaggcucuacuaacugauggaggaaaaagucuuaaugagugucaauauguucccaauguagcaccaacaugacuucugaaacagugggagaagccauccagaaugucaccguaucugccacaagauuguuuucuuuagaucauuuucaauuauggcaaauuauugaggucucugugcagggcacuuacugaaguugaaaacaggaguuaauuugaaaaauguauuaccaaaacguagauaugcuuaguguggguuuuaguuugugugcagaguuaguagguccuauagaguuacaagcagagaggugaaaagacagaguaacuuucccuaaggaaugacuggaagaugagguagaggggauaaguuaugguagcuggcauaugagaacaaugagagaugggauagggguauguggagcuuggguuccuuauaacuuaacauggucaugagccaugagcuuagcauuuccuuauagauagcuguucuguccuggcacuuguccauaaaguacaagcauccugguucccuuacagaaacugcccugaaccugugugaacaucuuucucuuccugccucaagcuguucugccuguauccagucaaacaauggccaaaguccucaagaaaccaugccccaucuuccccugacacuaagaugcaguguacuauccacaaugauuccuuaugucuugcuuaacccuaucaccucugccuucucucagcacuuuguguggugaacaaggaauaguuuuucugagugcugagcaaacuugccaauauuugcacugucuuugugaccugacaaaugaucuuuugugucuugcuuugcuuugugacaggaucuuacuauguaguucuaguucauccuccugccuuggacuccucuacaaauggguuacaggugagaccaccaagcccugcucaguccuugcccuaccccgggguuguugcuuguugcuucucuuuccuuugaacccuugagcucuucaaauauuuguucaauaaaacaaugcauucgcugauaccuuucuacuuagaugaugaaucucauagacauagaugaaucucauaguggucucuacucacuaaaggcaugccaaagccaguuauuugacagguuauagagaaauucaggaugucaucagagcacccaucauuuuauuaguugccaaagauuuaauuuaaccauaacaugcuugaaauaauuuccauguguaaguauugccuacagagccagaaugcugaaucagcuccucuauuaauuagugucaucccucuuuucagaaguauagaguguugauguuuaagaauuuguaaccuccaaaguuuuuaucaaugagaaaaaccacagaauuggaaaauaauuaugccaaaccacuguacuauauaacagaauccaauugcuuauccaauuauauauuaaaguaucacauuguugaaccaauuaccaaagcggcauaugagacaugagcucuggacuagauauuucucagcuaacugugaacacuaugacaauauagaacguagccauaaaaccugugcaaacaagaguggcucuuucagguuacucacaugccaucagaaaacugccuuaaacaacuuacacuagauugugcaguuaccccuaaaaacuguguuagagggagucaaacaaacaucaaaaaugucuccugguccugagcagagcugguuucaacugaaacaucagaggcacaugucaggagaauaaucuccauagcuaugcugagauguauauaugacaaaauuucaagggcccugcugugaugcuugcaaaauuucuuacagcauaucagggcugaaagcccagagcuucgcugugaggguugagaaucaucagcauacacaggaugaaguauggcuugccauauuuuuaggauccccucacuguuaaauucuuccacauagagccuuauguuuguaggaccaugacugacucauauaagagaugagcuggcuguucccaucauagugagagccugccuacuagaguuuggucaaaagaucaauuucuuccauuagcaggucuuugcucuucaaauaauuauagaccacugacaaguuucacuuuaguaaaaaucuucuacucucacuucuacacuuauggcagaaauggauuagccacaguaaugucccucuuuguauccuugccaccucaccagucugacagcagcagccuuuccagaagccacccacccaaugugucacuaaucugcuguuuccuucccaacauacuacccaacuucaccauucccauuuuccugaugaaccucaagucagcuaggaacauaauucguucagcccuugccauggcuauuuuggaacgguguuguugcuguuuguuuguucauuuuaaaguuugcuggcucccacuagaccacugaacccuugcuaaucucuggagaauuuugauuuggucaacacuuuuguacacaugggcugcacagcagcauggaaaacacaggcacaguugcagaaagagagauucaagcuggacccaaaguccagcuugagccccucucaucugagggguaaauugcaacacagggcagcucccaggaaguaaucauggacuguugauggaugucucaccccaggcuccuuugcggcugagcucuacuggcuuuccagaaggugggaaauuugugaacugacagggacuagagauuucuaccaguuugauuuccucaggccuccugcuucuaaaaacaugcucacugagaaaugaaaugaaacucuuucuaaaagcgguaucugccauggcacaacuccggagaaggaagcguuuauucaaaaagcaauuucuuuggccaguuuuguucuauaagccuuuucccccuguguuucagauauugguguuugagcaagaguguguucuccuuuaauccuggagugaugucaaccuucaguacuuagcacaggggguggaagaggcagagggccaauuucugccuccuuuugaaucuccugaacacuuuguuucauauuugcucagccacauauggauuaguuuucaaaggcaccucacagggucuuuggaagcaugcucccuaggcaagauaacuagcuccuaagaggguggaaugucugcccuacaggaagcuaagccaacacacagccaagaaaggcaggcaagcucacaacaaauaauucguguagacacagccucagauguuuucugaauccaaucuucuaagcagcaucaacuguguucucgagauaaaacacauuuggaaaagcgggcccagauggggcuucgcucacuccuguuccuaugcauuugaugcucguucuuugcugaauccacuccauuauucaacaaauauuauuaugcugguucauaguauuucacaauccaauaauaagcaguuuagacagcucuuagcaccaaugagaggcuguaggcaggcaacaaacaaguacgaucaucccuuauucucucaugaagaguucagaacaugguucaccucaauaugauaugaaaaucuguacuuuagagaugaugugguuuuuguguacgacuuuuauauacuguuauguauacucucaaccauuccuugguuaauuaaaacacuuaaugcaauaugaauaccagagaaauauuugauuucuaguacucuuuccgcaauaggaaaaagaaggggaaaagccuauacuugaguucaugauacucaagcaugucgcuuccaugaaaaagaacaagggagaaugacauuaggcaagugugguuuucaaaaggugcuuuggggacagggaccacaaagcugagagagaagacaaauuaccaagugcagagcugugaggaaggagggugaugccgugcugacugcuuaccgggcaaguggccagugaagggagcacagagaaaaaguccuaaacagaaggcaaaggacaagcaugugagccacaaguggcagagagaacagggacugaacaguuuaucuuagucagccuccucccaugucugcagaagacagagucaggcaguagcaguaaucccagauccagggagcugaagguggaggggacagaugagagcaguuguacccagugucaccuccagucaugggcagugccacuaauuggauauacuuuacuuucuggaccuuccuuccuccuguuaaugcacacagaaguagaugacaagagagcagucugcacaagggaugccuccucaaggccagaagaacacagggggcuuggcaaacaucccacugaaugccuguugcauguuccucaaagcuacaagagccacaccagcagcaaccagccugaggcuggcacuaggacccacaacuugauaguugaaaaaaugacuaacauaaaaccucucuuuucacaacucagcuggacuggucauuagucuuccuucuauaagaauaggguucugccccauaugacaaagccacgcccucugaaacuguuccucgcccacuggaagucacugucucugaugccuacaaaucuauuaauuucucacuugagcugucccagagcccuucaaagaaccuggccugugugagugaguuguauaaacacuaggagccagccuuucccaaaugccuuucuaguuccuuuaaaacccuucucuaaugaagacauaaagccccaacugcggccggaacccugagcugaccaugcaugacagcagaucuuucucaccaaggauuuaagugcauuucuccccuuuuagccagaauauuuaaaagaaaccaagcuuuccuugcuauugguucaacuguucauuuuauauccccuauaacuguucacaacccagaaccaacacaugccacagagauagaaggcaacugaaacuccccccacggcucccucucuccuuuucucugucugucucugucugucucucugacucugucucugucucucugucucucucucucugugucucuuacacacacacacgcaggcacacacacacacacacacacacacacacacaauuuuaccacugugaaauuuuaaaaugcaguagcaggguugugacaauuuugaaauaucauucuagaaaaacaaacaaacaaacaaacaaacccucaccucucucagcuuccuacugugaaucccaugccuccaauuuuauuacugagaauucucaagagacauguguuauuccugauccagcugaaaauauuauuguugggaauuggugagugaaaaauucaucaaaagcuuacaggauacuuaaucuuuuaauuaaucucaccuuuauucuacucaaaguuuaaacgaguuuuaaaaggacaaaagguaaaaaugcuuugaaauaaauucuuauaauuucuauuuaaagggccagacauaaauaugugagaaaugcuuguuccuaagaucagaguuugaccuugcaauugacuuaaggcauucugaaccaaauaauugcagcauuugaguccucucugccacauugcuuuugagggugcugcugacgacauccugugaagcuugccggacaggugugaggauggcaaugugcucugucacucuucaguuguguuaggauugcacucuguaacaugcacgcagguuagaaaugguucacuggagcagaggaauaaagacucacauaucaggagacuaggcuauuauaaagcaagaaaaacuaauagucaauagugacacaaagcccauauccaaaccuuccccuucucagcucuugguccuaaggguuaauauaaaaauaucaucuucagcuguuggugaauuuaaguuauaacuacacuuguucauacuguaggaggauaugaacccauauggucacucugacauuaaugguaaauguauacaugugauaagccucuucauaaacuacuuugaaacuacuguucaauauuaacaucagauagccuauaauccaccaauuucacaaccaggaauauaccuaauagaaauuacugcauacauuuaagacauguaugaaaauauucaauaucuaauuaaaauaacaugggcaagccagccacauggcucaucagguaaagauaccugcuucuaagguuaaugauagaaauucaauccccacaacucauaugguggaaggagagaaucaacucccauguguccucugacauccaugugccuguacauacauacacagagaaaaaucuaaaugaauaaaaauaaguuuaaaaguguuuaacuaggggcaugcaaagcauugauucccauuagcagagauaaagagugugauauauucaaauauauagaauauuaauauaaaguauuauaaaguuagcaaaccaaauaucugauagugacauauaaccuauacagacaaaucuuaacauaacauuuaggaaauauuaauaguucuucaaagaaaagauacaacaugauccuuauuuuguaugaaguuaaaaauaaauaugccugaaacuauauuaaaauuacaaaaggaauacagagcugugcucaugagaggcaggguggaggauaacacaauguuugaggaaaaaaaagauuagaacuuuggaauuauuauuugcuuagauguagaacaucuacaaauauauuuuucuuuuaggcaugggauuacagguacccacuagugauuaaaaaguuaguagacuacagaacagacucugaagggaaccaaaagugagcguuuaugggccccaggagagaguguaaggcuucaggacaaaaaucuguucccauuacaagaaccuccaugggauguaguacacauacauucuuugucgcggugacaacucugcaggucagucuuggcuuagacaccuggaauccauugucccuuuucuaaauguuccaugacuucuauuuugaauagaacacuccacacagggcgcuguccuuaauaaaaacuucucugucauaaaaguuuuaugucugugagauauucaccaccaugcucucuguucuacaauuuugcuuuagguccuauuucugaagcagaggaccccuagucuagauguuaauaacacgcugcaaucacaaaauaauuucaugcacuuuacacauuugauaaccuuugaguccacuuguuuacguugauuucuaaacuaagacuguacucugaagguuccguaaaucugaucgcuauuugcauagaaaacaggcacaggguauugaaagagcaauucauugccaagcuauuuugacaucagcaauaauggauuccaguucaucgacauuagacagaagccugguagccaaaguguuaguccaaaucugcaaguacuccuaauugguuaucagauuguggcuaaccugaugccaaaaucaaauauucucagguugggcaaacugauuuuuggcauuccagaggcaaaaaaagcccagugauuaacuguccuuucacuuggcaaaugguuaguuuggccuuugagugcacagacaacccaucuacuuacaaaagaaguuaaaugcaggacugggucuuucagccaaaaggcagcaaaaucaccagcaguaaauggugcucuauggaaaauggccugcuguucuggcuaagggagaaguguccuugguccgguucugaguccuuucucuagagaagugaacaucaaaggguugucgcuugcuccagaauaauauggcaugacuauguuguucuuuuuuuauugcaauuaauagagcaccugcuuuauaccugcuacugugcugggugccagauccacugugcugcuacaagaaagaugguuugggguuucucuuacugucauaaaacaacaugaccaaagcaauguggagaggaaagggcuuagguggcuuucagauaacuguccaucaucagaagaaacacaggcaggacaggaaccuguugacaggaacuaaagcagagaccauggucgaaugcuuuguaauggcuuucccccaggauucacccaguuuacucuugggccacccaaaaccauguguuccagggugacaucacccacaccacaccaggccaagccuugccgcaucagucauuaaucaagaaaacagaguugacuacaggucaguuuauuggaaacauuuucucaacuaagguucaccucuucucacaugacccuggcuugugucaagucuccagccuccaguuugaacuaacugccccauggugcuuaaaucuuccuuuucagaugaugaaguaaagguagagagauaucaccuuauacuauguguuugaacuauagcauggugcuucuauauucugcuggguuuuuuuuuuaacaauaccuaacauuuucuaagcauucaugauagagugaaauaucgcuagugaagcacuuuuaaaugaauuaguugccuaaauaaagcauguaugcaucuauauaaggaucugcacacaugugugcagcuauauguacagagacuauaagugugucagaugcucuccuuugcugugucaccuuuuccuuaggcaugcaagcaaauguccacuuacuccacaugguaacuaacaagcagaccaaaguucaauuagaccagaguccaacuugguaagaccaguggcuuuauugaguuuguuaacagagaucacaugaaaggucacaggcguguggauaacacuggaaaagcuguagcaucccaaucuuacccuaucaugguuggaaaccucauggaaguuauaccacugggucccacuuuuaauuaacccuuuccuuuuuguuuacuugggcaccagcaaagagcuugcagcgagggaaaggguggaagaguagcaucugggaucucagaaaagaucucccuccuucaucuaucaagaagugucaauagcuccaauacuguuacaguaggcauugcuaccauucuguuguucugcucuuguugccauggcuaccagagguaaagccuaagauggcaauauguaaugucuagaggaaagaguaaccaugcacuauccuguaucacucucuaccuauuucuuuaugguaaggucuuucucugaaccugggaucuauguuuucucagcuaggcuaggaggugcagaaccccagugaacuuccuaucccuguaucccugguaucuggcauuacagguauauuuguuguugggugcuaaaguuugaccuccagcccucauaacuauacagcaaaugcauuuaaccacaugaauaacacagaugcauuuaacaucugacuaugcccaaugaagcauuuucauauauaguaaugguucucagccuuccuggcgcugugacccuuucguaaaguuccucauguuguggugaccacacaaccauaaaauuauuucauugcuucuucauaaguaaaauguugcuacuguuaaaggauagcgauguaaaugucugaucugcaggauaucugauauaugaccccaaaagggucauagaccacagguugagaaucacagauauauagcaucuuauucaauuuccucaccauacagagaggcaaaacaaggucuggggauauaagcaacuacagaaauugauucacaugucugaaguucuaaauugcuuuucuguuuuaaaaagacccucaguuaaauauaauaggaguauccugcuucuagcuuucaacuuggaaaucaaaaauaaugaaaagaaguaugugaaggucaggggauggugcauccaaggcaugccaugugaguuaagcuauccuggaugccagccacaugacagacaugcagccacauggcaaggaggggagcuuuagaggaaauauaaaaagccuaaagcaccagaagaaagaaaaaaaaaacauauuugaccaauauccaaagacagacuacggaggagaaaaaugaaaugcuucaucuuucugaaucaggacuugaaaagccuggaagagugacaggguuuuggaggccauggaaggaaugcauacaggacagagaugcugaagaaaaaguacauagcucauuaaagggaucaucaucacuccuauuucuuuucuuuucuuuuuuuggggggguugguuuuuuucuugggggggagggucaagacaggguuucgcuauguaguccuggcuauccuagaacucacucuguagaccaggcuggccucgaacucagaaaucugcccgccucugccuccugagugcugggauuaaaggcaugugccaccacaccuggcugcuccuauuucuuuuaggguuuaagguaaacccaccuuccuagaggguggugcaugguuuagguguuugacuaaaugaauuggauuaauuuuaaugucuaauauaacuugggauggaaguucuccauucaggcuagagaaauagcuuucucuaauggaccuccacagagcucugauaaaggccauuguaacaacuguaaguucaaugucaaccuaguuuauacaguaagaucuaagacaacuagggauacauacuaagaccuuuucucagaaaaauaaacuucagcaaacaaauuaugaagaaacacacaugagagaauuacccauuuugaagggagaaacugggucaugaguaauuaacuggguuaugguuauuauuucaugugaacaugagauauuauuugugucaaauugacaaggaguggauuguaguggcuauuccugguugucaacuugacuauauuuggaaugaacuacaauccagaauuggaaggcucaccagugacccucaucuggaggcuggagauagaaguuucugaucuggaucuugguauggagaucuugaggcauaguggguauggauuccagaagauuaaaucuccgaguucaaggucagcugggauuaaagguguguuccaccacaccuuuaaucugggcuauaccuucugcuggagacaauauaaggacauuggaagaagggagucucgcucuagcucccuugccugcuugccgugugggacugaguaacugcuagauccuuggacuuucauucacagcuauuacugaaccauuguugggaauuggacugcagacuguaagucaucaauaaacuccuuuacuauauggagacuauccauaaguucugugacucuagagaaccccaacuaauauaauccaggguaguuucaauugguuuucucauucuugauaucucauucuuugcucuuuggccuaccuucuugguauuaauggcccuuaauuuuuacucuauccucaucucuuggcccauaugaauaugcauugcccucuagaaggccugcuuugcccacaaccagcccauugcacaugcuggucucugacucauauaacauauuuauuccccagaucuaccaaaggaugagguguccaucuuggagacuucaggaaauauaguacaagcacaaucauaugcauuugucuuccucacuaaauuauaccuugcaugugggcaaaaucaugucuauccaugacagcccauguuacauugaccuucaaaacaucagugauuauaguucaaucaaauguuuuaacaaugacugcaaaucuaauacccuaauaaugaugaccuuacaaaaucacaagcaaacaugcagagggccugugaagugcuuucuaucugaaugaacuggucacaaaagacuacucaggaggaugauacaugucuccccagccccuggccuccaauaaugaguugaucaugcuuuauaaacugcaaaaugcuaaggcaagaagagaaacaugcuagaacagauauacagaacacauaagauuucuucauagcccucaucaaccugaaaauuuaaugagaguuauucaucaaaguuugaugaaacaauaaaguuaugaaggauauggauagacagccagcucuugaauauccccuccuaacccaucuuugucccuaaaaucauaguagcuacauucuucucccuuuaaagguagcuggagaaaaaaaauaacagaaaggcaaagaaaagauauaccuacacuuacauguggguugauugucuacucugauagugacaguugcacuguuuaagagcuugaaaaugacaagcaagcuaaccucuggcuauuccacgggaaccauuauuugaaugagaagauugagaaaggacaaugaguuggcauuucaggguuuuggguacuucagauggucuacuagccagugagaacccauggcuagucaccaucuugagaugucccugcagugacaccugcacacccuccacugauuaagcgggcauaaguaccugauuguuaugguugauacugaugagcagcuugacagucccuagagucacuugugaugcagaccucuggguaugccuaugaggauguuccuagacugaauuaacugagguaggaagugccacuuaaacgugaguaacaccauuccaugagaugggcuuccagacugaauaagaagaauaaggugaggugaggagcagcauucacaccucuaccucuugacaugcaacccaacguggcaagcugcuucaugcucuugacaccauggcugccccaccacgauuaacuacaaccuugaccugugagcccaaaucaaccccugcuuccuuaaauugcuuucaauacauaacugaucacagcaacagggcaagcaacuagaagacacgcuuuguagaggacuuggaaugauauuugcaggucccuucucacuguauguaccuuccacaccacauggcaccuuagauguacauaugcacagguuguguugaauagugcuuuguuugccucuacucucugugaauuauacuuuuuaaggguguguuugugugugugugugugugugugugugugugugugugugugugugugugugugaguguaugcuacauccuacauccaugcaugugugacccuguacuuaggagcacacacucauguuuauaccaacaggagccaaagguuaauguuaagauaaggaugucuuccucagucauucugaccucauccuauuuuaaauuuuuuucuaaacauggaguuguaggcuagacuagaugauagucaucaccacuguuuucacacucugcccugcccuaggguuauagccacuuaugucgggaucucaacuuuuugcugggucuuaggaucugaacucagguccuuuuguuugcaugcaaacacuuuacuugcuaagccaucucccuagacccauuuuuaauuaguauauauaauuacuuaguguaagcugccaggccagacuuucugagcauuagucuaauuaacuuaagcuugauaauuauguuucagauccauagcaguacacacggauucugaagauguugagccagcuuaucugauuccaauaacaugguuucucaaacaugguuagaaaguuagaaggaaaaaaaaaguccauuggauaaauauuaugguuuuaaaauuggucaaguaaaaucaucuggcuacuuuaaauagcuucucaaaugaauuagacuggaauagcuuuguguauucucgugguugaaugcagagccuucuauacugagauaauaucuuuucucugcccuuucuauuucccuuuguuucaugaaaaaugagagaaaaggagaaacagaagaaauacagggaaacuucaggaauugugagaaaggucaguuuucuggcucugagagaggaauguuaaauuuucacacuuauguaaggcucagauugucucaucuaaugauccuaacaauccucagugguccauaugugcuugaggguugguucauuugugucuguccaaggcaugcugaaauccagccucccaauacuugagauuauaacuuccucugaaaauaaggauuuuacaggaagccacauuauauuagagguaucagccuuaauucaguaugacugguauccuucuacaagagaaaacauuggacagagacaaccaugaauaccagaggauaucauaugaagggaacucagaguagagggcaaugaauucaccaauggagguauaucaaguugccaauggacuguguggcagaugaggggcauagaucucauuuuucccacccagcccaggaggagcuaacaucgcugacaucuugaccacagacuucuagcuucuagagcugggaggcaauacauuuauuuugugucuuagccagugccaauguaugguuaguuauagcaacagugucuuacucuucuccccauuucauagcagccagggcacagaaaagccagaggauguguccaaggucacaaggcuaucauguggcaggaccagaguccacaguuaggacugacacuggagcucaugccuauagucacugccacaguucuuguugauacaggauccugagaaaauccuaucucagaaguggauaaaauaguauguuccuucuaaugucccacaguuuaaggaaaauggaagugguuccucuuuucaugugugcauccagagccauugauuucaaacaagagugacugcugggaacaccugcuuccuacaucuuaagggaauuuaccuuuucucagagugagaguagcaauguuaucauguuuucaucccaucucuaaaaagagaguaagaggccaaauauuaucugccaauuaugaaagccaucgggggaaauuacaaauaacaauauaaugaguagaaaaaugaacaagugggcagaaaacagaugucaugguauggggggggggagacaacaaauagaucuacuccacauagacuguagaugcugaagggaaauuauuauugagaagaaauaaacccuugguccaggagugaaaucagcagaacaagaagaaagaaaugaauaaaguuacacaaacauggaaacauagggaacuauaaccccaucaagggaggcaucuuauccacgguaaacuacaucugagcauauuuaaggauaaacaucauucuaaugagaguccugugaaauagaauauugccuggccuuauguguguguguguguguguguuuauguguauguauaucucuggaccugugugugugugugugugugugugugugugugugugugugugugugugugugugugugcgcgcacacacauguggguguaggccugaggacuauguuggcuaucuuucuccaucagucuccaucuuauuuauuugagucaagaucucuugcugaaucugagcucacauuuuuuguuuuuguuuccagcuagucuggcauccagcaauccucaauaauccuccugccuccauccuccacagugauagcauuauaagcccauguuggaacaugccugguuuguuauauggguucuggcauccaaaucccaguccucacuggaacuugguagcacucauuuccagugucuguggguaccacagcagcagagugauugugacagaaacugaacagacccucaagcaguuaccguuuggccuguugcaaucaaaagcauuggguccagaugggacuuuuugucuuagaaucacaucuguaauccuuuacuuaccuguauuaaaggaugacaaagcaacucaccugucugugucucagugccuguaucuaaaaaugggauaagaggaccugucuuacacagugugauaaagguuaugugagggguaauccuuguggaauuccuuaagaauugccauauacaugggagcgucucccuauucauuggcuacucuuaugcuacggcaaguguguaguuacaagagcuauccauacacauuucacuguuuucuuacguccugacuuacugcaggagaccagaagccccagaacugugacacucuuccuguuccagggacuaaauugggcauagauucuaucccacugcugagauucaguaaauacuuguuaaaagaaugaacaagcagaaagucauuuuccagaggcuacaacacuagagagaggacuucaguuuagucuaguccccaaguucgugacauuuucugucuauagaccuacaguauggccucaccugagagcuuguuagaaaugcugccccuagcccuacaccagaucuacuggggugagacaauuacuuaacaccaucuccaagagguucccaggcauguuuaagcuuaagcagugcuaauccaggguaacacugcaacaccuagcugcugacucauuuaccacgucccacugccccuucugugugcccugugucugauugcguagcugguuauuuccauccaccaggagaagagucuacagcaaauaucaugugcugaguucuuaccaaauucaacccuauauggaaaccugccucauauuucacccaccucuagggaucaggccauaggcuccugccaaugcagaauaucugcucaucaauaacuucccucuuggugccuccccacccccaugagcugguuuuacuguaucuuauacccaaugaaauuuacaguucuacaucauaacauaauuuaauaccucuggaaacuucuaauuugauuauacaaaugagagccaacuauguccuaauauuacaaagcaauuaaaauucuccccacacucacacugguuuccuaucucuucuuuuuuuuuuccuucuuuuuuucuuuuuaaauguuaccuggcuuaaagauccuuccauucuugacugcuuucuuagaaauuaucccuuauguggcacuucaggaagaugacaguguuuaaaauuagaacaaaagcucacaaugguuucccauuugucacagccagaagcuucaaauuguggucaucagaugaacacguuaaauuggagaaagacugauuagcauaauucuuaaaggucugaacucuaaacucacagauggccucugaagaggauugaugguccauaaaggagauuaggguaaaucuaauuaguuggggggcgucucauuuuucaagucaaguggugagcaaugggaagaagugauggauggacagauggauauaaugaagccccauuacagucucuuugauucucucuccaugauggaauacauuagccuguuaauguuuccgugggcuaacacagcccaaguuuggcgcugugaccucaaaaauuaauuugaauugccuucccauguccucaggacuuaagugagcaugaaaauccugccggucugcugaggaggcacccugaugggaaggcuggcauucuuucuugaggcagagucccagggcuuuucuguuaccauguauaacguguaaaucucccauggaaagugcuaggcuuugcacaugccucuuccugccacaugcugagauugaccccugguguucuuuucacucuggugagggcuacauaucaauaauugcuuaggggacugugcauacaguguuaggaagagaaguagugauagagguaggcauauguggcaguucacuucucuguagcugaugggaucuucugucccagagaacauaauguuagagugauauacaccaaggaaaaaccaagaaagauggugggaccccaugagauuaucuagggaaguuaucucuccccuagauaaucugagcuaucugcuaaaugguuuccuugcuucccuuuuugaauacucuagcaucaucauuugaaaagucuaagucaggacuaaggagaccucaauggguaaaacacucgucaugaaagcauaaggaccgagauuuggaucccuagaaucuauaaaaagcuaggagcaauggugcaucuguauuuccaguguuccuaccaugaaauagaggcgaagacagguaagcgggaugucuauggaccaacuagccugugcaauagcaaaacacaagacccuggaucaaacaagguggcacgugcggguugagguuuuucugaccuucaaauauaccucucucucucucucucucucucucucucucucucucucucucucucucacaaacacacacacacacagagacacaaagagagaggcagagagacagagagaccuacagacagacagaggcagacagaggcagacagacagagauagagaccaagaggcagagagagacagaggcagagauauagagagacagagacaaaacaacaaacacagagaaggagacagggacagagagauagagacagagagaaguuuacaucaguucauuugacuuuucucuccauuaggaauaaucaaaaccaacauuuacauauggugugcuaugugcucagcaguggucuaagcauauugcaaacauuauuaccuuuaaucuucauuuaaccugcaaggguuaccugacuaguaaucagcaaauuuuuagaugaacucaggcauccagcuucagaauacaguuucuaauacuauauaguuccuauucuggguucauuccaugcccuucuauacacaugggauaaacugaaacucaccacauagugcuucaauccuucccuaacucacugaagucuaaccacauucucugaguucuugaugugugcucuacuccaggcccuuugccuuuguagcagcauguucgugugcuuucuccuccuccacucauccaggaagugacagagcaucccauacuugauucucagcucucuuacauucuccucaccccuuuucccaccuagaagcucccucucaaggccagagcuugaaguguugcuuccacagcccugaaauuuagguuucuagucuugucuugccuacugaguugcugucauguuuaguccguggccuauggcaucaugccuccuccauguauaguagacaacucauuuacuaugccccacaaggaacacuugagucuggccugccucacuucagccguucaguaacaggcauugcaagcuauuuacauuuuucuucccacuuuaguaaaggacacugauaaacacuauuuucuccuauaaaaggcuagauagguauuaucuuaugcccuuggauacaaguauuuauccauuguauuaagaaaauaguuuguaagccuagcuauauuucaauaagacuuauaucuccaaauaagaucagguacaaccuggcaucuaaguuguuagugaauggccuucugccagggucuuccuguguagacaguccuuacuacacaaagguguaaauuuuuaugugaaucauaagaaaagauagccuuauuaaaugucuugaacucgcucuagaagucuucuaccuggaagagcagaucccuaacucuaacugguccuuuguuuucaucuuuccuacagaucaccuugcuuuuguaagacaacagguaguaacuuugggccggauauacaaaaccagagaaaauuaauuccaaauauggaacauacguacuagaucucagaucuuuacuacaacuguagcacaauacuguugagcagacggcagugaccagaggaagugauagcuagcuugccaucgucaugacuucagccacacccaggugugcagagccccgugaaacuuuuguuguuagcuccuuccuuagccugcacaugcacauguguagaacagaagagacuaucaugguguaccaguccagccagagcuggccugucacuuuggaaauagucacuggaaugagaagaguaaaggcuuugagggagcauggaaagaucuucuagaaagguaccaagaaccggguuccaggaagcuucagccacaagacuugagaccuucgaacauaggcaccuugccaggguuuucucugugagcugccuuuuuguuguuugccugcuuuccaaggcaccuucaaucagacaauugugcugagaugguuuauccugugaacuaagucagcucaaugacauuagcauaaauaagucuuuaguuaugugaagcaggcauugagggugugcauggcuugccuuugugaauacaccauccauucaaaacaccaauuucuucugaauacaaacuaagcuagacuccccaaauaggugguacucauuaauacagagcaacaaaaggucugaaacaugcagauccaacuguacuggauuaaccuuguuuccauauuaagaaguccucaugucagcauuucucccagggccucccucugccucccccauuucagcaagaccuuaaguggccaguagcucuugccacugcauacuuggcaaacagaaaaccgaguaacacuaaguucccagaacucagcacuauucaguaaacauggucuaaauggugguaagggaacuuccaucucaugugagaagaaggauccugacaugugcagccacagggacauauaaguagccaacaucucugugguaggaggagcagaagaaaucuuggggacaccugaaagccacaagcaucgccugucuacuggcggcuuggcagcaguucuaucaaggucaguuuacucuucccaggaagaaggccacugcuauauguguccuugucuucaaagcuguccugugcccugucauuacaucuguucacuaucccuggaaaagaaaucaguauuuuuaacucauggacacuuaacuccccaaaugaagaacaguacuaugacugaaaugaaaugcuauguaaaaauucacuaggacacacugcaaguagcaggcuugucuagcauggugauugacacaggauccagugaacagugugacuggcuuuuuuggggggggugguuuuucugagagguggagaaagaaacucuaaguagguuguugugaauagucuaagcuacaaaaacaugucaaacaugucacaguugagauagauguucauccaguaggcuuggauccuucucugcauacaggaagauagcaaagagauuacaacugccaucucggccuucuuaguuuggcccuagaaauuaauuuuagauaucuacugucuauguguucaucaguguccaugugauaaaaccuugaccauaguauaggacuuguugcuggaucuuuaggagcuuagcuuaccaugggagcucuaugacagcaugaguguucuuuccaguaguugaagacaucugaacuuuucuucucuggcauaugaggauucauugguggaagacauaagcaggaacgcggaaggcucucacuuagucccgagucaccaggaagccuauucuuggacuauagcuuccagcacuaugggaaaguagcuauucuaugauguucuguuauaguaguccaauguaagacacagaguguuagcucaagauguucuaaugucucuguguguuucagagaggaugagaaaauagauuguacacuugacuaacucuuccugcuaggccuuuugagauguaauauaacaauaaaucugaauuguggacuaaaauaaauaucuuucccuuaaaauuauauuauuuuuauuuauauguacaucuguaucguuauaugucacauguaugcauguaccugcggaggccagaagaggacaucagaucucaugaaguuggaauuauagaacggagugagucaccaaacaugggugcuagaaaccuaccuggaaguccuuuggaagagaaguacaugcucuuaaucacugagcuauaucuucagcugcagggucccucccucaaagaaaguccuuucuauagugagcagaugcuaguauuugaagguaggcucucaaaggcaguggugaaucacguuuuuuuggaauaugagcaaggccuaaccuggaaugucacuguauuucugccuccugccagugguccugagcacaugggcuaagggauggguuuccuuggcaaaucaagcaucguggagcgugugucuacuaggucagaaaagcuugagcaccugagcggggggaugaugccuuucagauggacgagucaaggcgcuuugcuaagcugacugcguuccgcagacuacuuggccaugcuacuugguucauaaaccaggaauuaagccaauucuccucuaagcuuuuuaguucaccuuuaagcaaccccuaagguuucuagaagaauuuugcuugaccuuuagcuaaaguucaaccucuaccaaguuaccgauuuuggauggucccaaggugauuacuuaagucagauuucacuauaauucagggaaaggcuaaucccuggcccacaaguucacugcggaaggauucccaguggucucauggauggaaaaaguuacagauuuuaucccacuaaugaauuuuagugauauuuucauugugcaacauugaucacugaagucagcuuggguguauuugcuggcuauugggccuacguagggaucuucucagugcucccuuauauagugaacacaaaugagcaucuucuccugcuucucauauacugagcccagugaagaccuucucagugcuuaccgcacauauuguacccaaaugaggauguucucaguauucauaucucagucccagaagaaagaugcaacccacaggaugcagaccauuauaagccacugcuuaucucuaaaauggugauagcuaugucuaaggccaucacugugaccucgauacuaggaauaaguaggaucucugugcucucagcacuuuugcuguagauguguaucugucucgcgucucuagccuucuugacauuuggagaggaaaggugugagagcaguggaagugaagcaccuugaagcgaagguacuugaagguaccuugcaucccugagcuugucuucggcaucucaaagaaguacaugaaaaaugucucaauaugcauuuaaccgggcagggugaucucccuggauucugacuaugcuguuagcugcugggugguauucauaccacaaagacaguugcccaugcccacacuagugaacacaguggucccaguuuacaaggaaaaucauuucuguccacaaaugcuguguccuuuaaauagggaccuggagucccuucccucuuggcucagaagaguaucagucuaaguauaagacuaagguaucagucuggcugucuaaacacugaaggacaucuggucccucucuuggaacuucaguggacggaagcaugcucauuuuagagaaacgacucuuagcacucuacagugggucaauacuauaauacuucaggcucagcuccaucccuucucuuuuuauugaucagcauaccucauguuauuaaguuuauuaauuaagugauaauugggggugagugcauaaguagauaaaugucucacaaacagacuccaagcuugcaggaggcaugcagcaauuuaaaacauguuuaucuuugugaggucuuuccccacaaggaaaaguagcaauugcugcaaucuuuugaaaugggagauguuugcuuuccaggcaggccuaaaagcuaaccaaggaauuaugaagauuauuugauuuuuacauauaccugcuagaauaccacaggcuaagugaccuuugguuauugguagaucugccuguaaagagacaucucaaagccacuugaaucuauaaaaauauucgacagucuguuguagauaucuagggucauggacuagucuccagcugccucaucugauuagcugacuuggugguggugguggugguggugguggugguggugguggugguggugguggugcuuugcuuguuucuuucuaagacaagaucuuacuaguuagcccaagaugaucucaaacuauugauccuccuguuucagcuuuugaagugcuuaaguaauauauaugugucaccaugugugauuucucagucaaacaugggaucucagaauaacuguaaagccugggcuucuuccugccaaucugucuugcaguugcuucccuucccccacacacauaugaagacacacaguugauccugagcaacaaacagugguacaugauagcagcacacaacccuucccaggucugacacucucaagugacaggucuuaccuucaggcucuccuguucugggucaggacuuucuuagguguguaagauuauuuugaguauggauaaugauuuguaggaugcugagucucuacucacuagaugugacaagcacacaguuuccccuucuaccaugacauccucaaacaaccgaagauaccgaaauguuuucacugagagacaaaauuguucugcauuaaaacuaaagcuauaaaggcaagcagaaaauaaugggaacagcagaguccacccuggccuuguaaacuguguucacagaccauguuauucucaggucucaguucuuauuugcagaucuagcuugcacaguaaucugaaugaaccauggaccucaacauggaacaugagaauaguaacaacugagcugacagacuuacacuggguaaacuaugugucauuuuuagcuaaggcagaugcaaggcuucaggauucuuagauaaaggaguauagauccauauucagagggaccuggaugcuguucuggaaacaggcugggaaacacagcauggaguggguaggaauacauagugccuguaugugcugaucucuuacucagucaacaggucuccuaggccauuguuuccucuucuagccacugcuccagcucugccagcaucaucauugccaucaucuuuucucuggauucucaggaaccuugcugccagcccagcucccuucuccucugcuuugggcucuuuacuccuuccucuguaagcaauuccuguuucugaaacaguaauccaccuauacuagccuaguaccagugcuucccugucuauccauccuucuagaacaaaguuccuccacaggguccauggagccauucaccaccuuuguuacuuccuucuucaaguguuugugguccaacucaaugagugcaucuuagucccucuuuguguggugugugugugugugugugugugugugugugugugugugugugugugcgugugugugugugugugugugugugaagagauaucccugucccauuggaggugcugucucgggaggaugauuacuucugauucucccuugucuucuacauugcacucugaggguuuugauccccuuuugcacuuuucuucucuuuccaguccuagagacugaacuuggggcaauccacaggccagggaagcacugggacacucaguaauaucuccagcuuuucuguuccccauguccugauccaaaaaccaucagccaaaucucaguccccaauaauagaucccaaaaacccagcugagaguuaguggcacuuuauuuauuuuuaagugacacuggucacuugguuguuuaguauuuauuacuguguuuuauguuuuuugauuuuaaaugacacuggccacuugauauuagugugcuuuaugucuuuuguuugauuuuguuguuguuuguuuaucggucuguuuguugagacaaggacuuagguagcccuggcugauuucaaacucugccuauguaggaggucugacucugaaugauccucuuggcucucccucccaaugaccuggauaacagguaugguauggaugucaaggccuaguuuuagguggugcuggaaacugaaccaagaguuccuggauguuggguaagcauucucucaaccuagcuauagcccaagccccucacaguuuuuuaaguugauugacaaaacacaaauagcauuagaaguaauuuccacacauggcaagcugagaaacaugauuagugaaagcuaucuaaguacugaguaguugagcuuguaccauaucccgguuuaucuaucacuuggacacgcuaaggagguggagccugaugauguaauagacaucaaauuguuucuuguagucucagagaguacugcuggaguuugauauagguaacacccuauuaaaaucagucagugccccagugaugcccaccuucuugcaccuaaaacucugacaguuucugucaugguacccgagcucugcagucaugucugucaugucauuuccagggucuguuacauuccauggcaugacaaggcuccagguuguuugugugcaugaaaaagagaguauuaugcuuauagcugggucuggaccacaccaaaagacaaagacagaaugauauaccuagauugcuucccuaggugacagaaacugaaguuggugauaugaauuguuugggaaaaagcuucccuuucuucucuucauguaccagggauugacugccauuggcucaugaaagcguugugacugucuccuccuggcccugagcccaggcagagaacacugcuaagaaugaacagaaacuggcaagaugugggcucacuugucccuccuuucuucccacguggugcuuuaccuugacaaauugguagcacuuggaggaauguuuccccagccacuucuggguggcagcaaguuccuuuguucuuacugacaaaaucugaaaguuagcccgaagcacucucaugccagagagagcugugucaggcaugcggugugugauaaaauacuagggugaugugaaauacugcuuugaaauggugccagggugggcacacgugcagaaugauugagaucgccugcaaacacgaaugauagcucugcgucucaucuguaaccccagugcaggaauacugggaaagucuuuucccuccuuugcaauuucuguagccucugguuggaaacuaugggaauuacaccacuaaaaguaacugccauguuuacucuguucuuucuaauguaguccccauccccaccccgcucccuguguacacaucuuucuuccuggcuccccgugauguuagcuguugcugugaacgccauugugaaauuuuauuugaagaaauccaggugccaaauccaaacgcuuccugaguggccucaggguggaggggucauauuugcauugcuggacaugaacacuacuuuaucuaccuuacaaacaaugugguacacaucugaguggacuucagucuaucccagugccuucuuaaugaucuagucaauaggaaguaucaggauguggccaauaugacuagaaaagucaacccucccagaugaugacuuugagugagauaugcugccuuucaggccagucccacccuuucuuuaaagauuacucacaucaguuuuauucauacaugucugugcgaguggauuccacauggauggcuugccuguggagaccagaaaaaggaugccaggucccuuggagcugagguugcaggcaguugugagcuguccagcaugggugcaggaaaccaaacucugguccuuugcaaaaacauuaugggcucuucuugcacacugaacccacucauuagaaccacuuauauacguguauauuauuguugauguuauucuuugcuuauuguugagauaaaauaugacuauguugcccuagguagccuggaaucugccuuaccauauacacgaggcuggccuugaacucagggauuugccugcuucuaccucucuaguuuggguauuaaagacauagauuagcccacaucaaauauuuugcagauugaccuauauuuccaccaccuaaugcuugaauccuucuuaugacaaugaaagucaaauacgaacuaguaguacuguuuuuuaguuuuaggggugaauguguauaugugugugcuugagugugugcaugcauggggugggggcgugcuuuuaccuagaccuauacguaauaggauucaugagccaguaagaagcuguuaguaacaaagagucaagcuguggccuaaaugugaaauuuuucuuguacaccaaaacuccacuggugagcuggauaguacauuucaauagcaucugugucuuuaugaaaugugaaauauuuauuuucuuuuucuacaaaggguacaagauacuuuacugauauacugacuaauucuguuacucuaaggugauaguaacagucaccauagaucagcuaguugcugcaugcuuucaaucaaguaaguacuugguaugaagaaucaugcaauucuuacagccuaguaaugcaggcucucccaccacuccacuggacaaauguagacacugaagaggaggagagcauuugucuugccaaaaucagucuguucaauuggaauuccaaucucagccucuguggcucuugagcccuauuaugaucugcuggcucaccaugguuguuagauaccauccauagucacuguuagauaaagagagaaauugggucuguccucugacuucuauagcuaaagucagaagugauacuguuuuaggaagagcacugguuuuaggacaaguugucuagauauugacugacauucagccugugucauugcccuucuggagcuuagcuuccucccuaaucugcaaauuguuaguaccaagagacaugguuugucagcccuccugcuaaacauaaaauauaaauagugaaaugugcuaucauucuauugaacacaucuuccccccucuccuaccaguucuccugggcuuuggauuucucuucuuagcaaaugcaagucaugggaggucgagcugcccucccagagcauguuaugaucuugccuagguggacccguuccaacagcugucccaacuucagaucagucaccuuucauucugagcugcauucaaccuggcucccuaacucaaaugguucacaggacacgcccuuauguccuguuuuuccaacuuuguauccagcuccagugaugacugauugcgaagauuugcccaacccuuggauuucagagucuguuucauucuagacggcucuuuccugcacagcgguuuuccaaaugacccuuucuuauuugguugauacagugucugguccuuucauuauauucguucauuccuguauaaggagcacccacucagugcauggucugacucagcagaaucucuccaacccuaucaggaaacgugacaugucuacuuuuccuuccugaggugaaggggaaugguaagcuaaucucuauggagcuccguguggcaacuccucucagcccaccaagcaaugugucucagagccacgugcuuuccugagugugguuuuauguuuucuccauuuccaaauagcaaguaaucucgcagaucaaugcccaggaccagagagacuuaugaauguuaagaagauuaugcacauaaauguaccaacuaugacagccacgcaaagaaugguaauacagcaccaagcgcuaguuuaucaaccuuugccacuuacaaaauucacagccaauuuaauuaaaaauauaacagcucugaaagcugcuaaaaugacuacaacaauaaucaaucauuuuguaauaguguugaagauccauuagggauggugcucuggaugccaacuccuuuaagcccagaaaguaggggcauugccuuccacacaaucaaugucaccgcauuuaaaauacugacuaccuauaaagaagaaaauaccaaacaucuuuauaacccgcauuuuuauggucaaaacuugcuuagaaaggugcuuugaauuuauucacuguaagcugcacauuucacauucagaaaauuaaaaugguuuccagugacuaacucauuuaaucauuuaguugauuuaaugaaaaacacuaggcauuuuucucuucuugguugcuaagauuaauacuuucugcucauuaacaaucagauaucacaggaaggcuuacauccucucacuuaacucacugccuuuuaucucaagaaauucuaauagaauuuaaaucguaucuucuaaaucacaucgaaaauuuucucccaguaacucauuuugucugguggaagaugcauugccagccugugacacagagacauuuaucugugacuucccucuccacucuuuuuuauuuugggggcagggagugugcauguacauggaggagaaggaguauagaccuugaaaaaauuaugaaugugacuuuuaaaacccugaauucauuaauaucucugcaauaccauacauucuuucagagucuacgacagggccuuugauuuaguagugcuauuuuaugggauaccugggaauguggaaacauuaaagaugcuaaguauaagcaucuggcuuucauuuaauaaguaauugaagagauucuguaaaggagaaccuacccagacauaaggcaguucuccgucuucuuagugucuuucugccacacacaccucuaugucacgguggugccuugugcagauggacugucgugacaaguuuccauugcgacucucaggauaugcaaaugagaaaagucucucuuccuucaaaccgcuuaugaagauggauucuauugugguaauguccaauggccagauuaguuacaaaauagaauaaucaacuuugccauacaguaauagucacuagcauaaaaacagcaucuccaaacuuuccuuguuuccauucggaaaagcauuuugaaccucgaaugcuucauaggagaauccaguauaaaaguagacaccauuacucaguacugagauagacacaggggaugaagacacugagcaucgaaaagaaagcaccaaguacagagcacggaggaggacaaagaugaggaagacaaggaugacaacgacgacaacgacgaugaauucaccagcagagacauaugcaggcagagcaggaaaguagccaccuaucuaacuacaaggaguccacugaccuuuugcagucuuucuuaaagguguccacuguguaugugugugugugugugugugugugugugugugugugugugucugugugugugucugugugugugucugugugugugucugugugucuacgugugcaugcaccuguguggagauguauaucaaugaaucugucugccuucuuuacuauauuauuguauuguugauugguuauaguacuagaaaacagcaacuuuaaagaugggcaaaucacagcucaaggaacuaaaguugacuacaaccuuaaacacucauuaaaaugauaacuacuuuaucauuuggacaacaauguaaaauucaauucuaauguaauuauuuuuaugugggcauauauguggaagcccauuugaggaguugauuuacucuuucuacuaugguuggaaacauaucaugccugagugucaagugcuuaccuacugagccaucuucucagccuuauuuguuuaguauuugucucuccucuauaaguuaauaucagugcaaagcaacugagugccugcugcuuccugcuguccuaucccagcacggcuacaugguugagagcuaggcaaaucuuuuuaagugaaaaaccauuuuccagggucauuccuauuugaggcauuggcagagagggcuugaugcccaguuacccuccuguacuacuccugaguuucuauuuauucuucaugacuaagugcaaaagucugucccuugagagauuucugaguucuuuccuucauuuuguggcuccauugguguuuugugggugguuuuguuuuguuuuguuuuggugguuguggucgauuuuuuuuccccuaugaagaguuauuuuaaucuaaagcaauuuuuucuuucucacuuccauaaaaacaaggugucccuucuuagguuaauauuccaaauuauaagcauaauauuuuaccaaaagaguguauaaaacuaaacacauagauguaaaugagagaaaguguacacuguauaaacuguauuauuuucaauauucacuauuucuuucaauauacaucaaauuauauuauauuaaauuccuuuguuuucuuuuaauguauugauucaguaggccauguucuccuguuguccuccauccccucugacugcuacagucuuccuuccccucuuucucucaaagggagaaaaccaaugaagaccuccaaauuaaacucuuucucuacauagugacugagucugggucucugcaccugcccccaucugcugcuggaggaagccucucuggugacaacagccaaggcaccaaucuaugaggagaauggaauaucacuaggaaucaucucauucuuuuggggauuuuguuauuuauuuauuuauuuauuuauuuauucauuauguuugauuucacccuagcucucugggcuacauagucuccacuuccuggagaaaaugaccuauaccuuggauuuugggugcaauugguuucauuucuaucugaccuuaguaagaacuuaaggucuggccucaugggauaucuauucguuggccauguuaucgaagcaguggugggcaugcaacucaggcuauaucagaggagucucagcauguauuuaacaauuaucacuuaagcaucacugaagaaaguguucucacuauaagcuaguagggugugagcuucagguugcucucacuuccuuccuugaagggacguugcuugugagaaaggcagaauaccucauagcuaucuuagaguuuccauugcuaugaagagacaccauggccaaggcaacgcucauaaaggcaaacauuuaguuggggcuggcuuacaguuucagaaguuuagucuauuaucagcagcaacaggaaacauggcagcacgcaggcagacauugugcuggagaaggaacugagaguucugcaucuugaucugaaggcagccaggaagaccagcaucugcagggagcuagggaaaagcucucuuuggcaauggguagagccuaagcauaggggggaaacuucuaaagcccacucucacagugacacauuccaacaaggccacaccuccuaacagugccacucacuaugaggcaagcauauucaaaacaccacaaauggccguagauuugggcaggccugaaucaucuccaugagagcuugagauuauaugagcaauucaaguccuaucuuuuugcugggccacuguaaguugguuacugucacuuacaaaagaagcuuugaguuuucugugucacggucuacugagcaugggcuacuugacagcauggaccuugacuucaguaaaagcuaguugacugaaaagcagcacacuuucaaggcaagggcauucaugaugccaggugugugugaagagguuccucauacuaccagcagaggguaucuaagggugaagcaccuuuuguagcaaauacucaaagacguaagaagccaugcacucagagguagcaguucaggcccugcuagaagacaaccacauucagacaccugaaagagacucuuucaguagcauuaagacagugggaguugugcagccagaaaauggauuucccuuuucagcguuccuauagugacuaagucuuaaucaucaugacaggauuucuguggcaaauggaauuaacaaucccacaugcuuuggaaauguucaauuauuaauaagccccuuagagcuuuauucuccuuugaacucaaugaaugguuuuuggcugcagaacagguacauuaaaccagugugaacugguaauugaggggcucucauagccugccuagaagagaauguucuccagcguggagaggacaagauggagccaacuuugggauuuuaaucuaaaguuuggcaguucaaggaaauaugacuuuccaagcuauuuaggaagugaggguacuggguacacccaggcuaugaugcaaaagucuugaaaauguccccuggugcucagcuucacaauagaccaguguucagucuaaaucccacaauugcuacuucuuugguaggaggaguguguuugagcugcugugcuccuaugcauaaaauugaaccaucauaacucacugaguugauuuggagaacauuaaaggaaacuguugcucuccugugcuuauggaaaugugucaacuauuaagagcucaauauacuucagcuuucaugauagugacuguagaucuaaucauuucucaucuucaaaccaagcucuguauugccaagugccucagucgguacgaacuaggucuccagugucugcucacugguccuccauguuuaccuacuguauggcacauuccaguuucuucgguugaggcucuuacccuuuucuggaguuuagucugucucaaucuccuaaaauaucuuguauauggccuauaccacgggcaccuauauacucaccucuuaccacuucccauguaaauagaggcuugcugccugagauugccauuucuucucagucccugguuuagcucagugucuggcagaaaacagcuguucaauauucauccaguaauaaaaaucaauaaauaucuccucugacucccuuaaaaaucaccuguacucaagcuuuuccaccuaauuucagguuugcuuggggacucaaguaagaacccauacugaaggaagucacugaaaggcaguuaggauuucuggagaaaguacuagagcaaggcaggaaagguggcagaggacaggcagcagccccagggagggacagaguccaggugaaccugguguuaguucuggagggcagcuuuuuuaccuagaaugacaagccuuguuugaaguuacauggcaguugccaagaacugcuaccuucugauaugauucuuauccccauccuccuucucuuaauagccgaguccuuguaaaauccaaugacaauuucagaccaaaggugcggcuaaaugguagagaaacugccuagcacgcaccaguucucaauucuacccugaauagcacagaauccaaagaaaacacacauucuuucuaucuccagaaagaaauuucgagaaacaaagauuuugacuguccgugguuaaauuaggaaaccaggccauaaaugacagaauauauucaagucuuguuaaaccugcagcaugaagagcuuguuuuguugccuugcauagaagaugagaucaugcccaucuucuuugcuuauuaaggaggguuugcugcggagggagaagggcuugaugcuugagauccugggcaagaaaagauagucacuuucucuucccucaaguucagccugcacugucccaaccagugcccaugcuacaguucuguccuccaacguggcauaggcuacaugaauaggaaugcugugggugccuuccgugggcacaguuugacacaugcuagccucgcugguacacaggcaguaugucuccaccaacuagagauuggggauuuuuaaccaucuaaaagacccaugcuuucauugcuauggcagaugcucuauucaauaaauaucacacauggauuuuacagaaauaagaugugauuugagaacaucugcaauucucuggaacauauuguugucaaaauuugacugaaaccaaauaauagacaucaaacuucccaccaaauguuuuguguggaauuuuccccuaaugguacaaauugcuccuccagaaauggcaucugacuaaauuaaaaaugucucagucugugaauauuagcacaaaugccuuucagagccacccaugccaccaauucugguacccacucuuguugcagaggugacuaucagaguggcgauaugacuagguuguccuaguugcugcucugaguuuaguacggaugccacaaacuaaagaugagauuuacucuuagaucaaccagaacagccaccauauaggaggcucuccagguggccuuuuguggguccucuaaaugcaggccuuccuacaauccccacuguaguccucagagacagcuacugucaucuucuguaauccuaccagggcauggcagccuaagauggcaugguuuauagaaucuugcuccaugggacaggcacucuuuuaucacaguauauuuacaauaucuuacugaguuuaacuaaauccuuuggagugguacauuccaaacuucaaauuaauggcugaagauaguagagaggguuccaacccaggccucauuuugagacaaagcuucuuaaaucuuuuuccucuugauggcauguaggagauaccuuuuuaaauacaagauauagacacugaaguuaaacucuucaaccucaccuuugcuggcuauaugaucuuagguaaauacuagaucccugguccagcuuccuuaugugucaaaugaaaagacaauagcauuuauggugaggauagguguuggauggggcagugagaggaauguccuugguuugccagugaggaacaccaggcacuaucuuauuuugguaaagcagcuuagaaacuaggucuugggaaucucacaggaggaauagauuauaccucgucuccaauuucagcacaucuccuaagguacaaugggguuauaucuucacagaggagauugauagaguagccuugauuggggcucuguugaggccccauuaagggaaagcuauuuuuuccaauucaaaagaauagaguugaccucuugccuuggauagagauaauacuccaagcuacucaguuaauauggcuggaccugucagucaucugguaaauaacacaccuccagaaaaggugauccauuuaagcuaugauaaggagauggaagaaauaaguauccuuuaaaugagauaauauacuuccuucucagaaugucauccucaaaaagcauaacuuuuccacuuccuacauugaacucuuucuuuugaauacagugcuaaaggaucauacuguuacagauacucuaggcgacuucaugccuuuucuaugaagcugcccagcucccuucugccuugugccacagaaacaugcaccacacagguuucucugacuucuccaucucccuuuuccaggaagacaaccauggagacagcucgcuugucuugaguauauucuccuuuaaacucugaaaauccuucuccagucaauuuuaaguuccuuucuuaacaagauuaauaauccccaaagaaacagcaauuucccuagugacauagagugucucugguguguguguggggugucuccaaaacuuccagugauaccuaccugucuaauuuguugcuaugguaaaauaacugaugagagcaauuuuuuguauuuuuuuuuaaacuguaccacauagaacaagaaguggauucaccaaggcaacuuaaggggggagcuucauuuugagucacaguucuucauggcuacggugcagaagguuuggcagcagggacugauggcaguuauuacauggccugccuagucuggaagcaauaagggauggaugcuaguguuagcuugcuuccuacucuuuauucuggcuaggaccucagccaacagagugguccuaaccauaucuaggauagugguuuugccuuuguugcaucuuucuggaaauccucucacagacaugcucaucguuuggcaacuaugugguucuaaaucuuaucaaacugauaauugagauuaacaaucucaagucuacccuugccuggaugcuaaagucucauuuuuauuucacaauuccaucugcauuuaguuuaucucaaaaaccccuguuaaucauaauggucuugguaccauucaaaaguucaaaaccuagucuuuucuaagagccaagagcuuaucuuaacugugagguccuauaauuuauguucaaggguuacacacuuccacuaugaaugagauagaguaagcauucucauucuaauuuggggggucgggguggaggcauacauguuacuagccuuaacagauuucuggcaccugagugcuagccucuaugguccuauaauuugcauuuuucaugucuacaaaacuagcuccaugugggcaauguugcuaagguuucuuccagcucaguaugaaaucuguuccauucuaucuaccccagcauugggccuucuguacaaccuugguaccucugaaaauacuucuuuaagagauuguuuuccaucagggaucuccuucaggugcaguugcagucucuguuccagcucgucccuucucaaugaauuugcauuuaccuuuaggggcuagggucuuauuuucaaggcacauuuccuauuuuuccaacuacaaagaaugaggcuucuccuuaauugcuaaacucacagcaaucagagcugcuuuaucugcccuucuugugaacaguuuucaucucuucugcacuccuuuccucuccauacuuccaguauuucaugucuuucuguucuacauacugcucccucacacaauaaagcauuuauucuauagaaguugauuuaacccaggcaguugugacaguaacagaaagcugauuagcccauccucucagagaccuucugugcggagaaaaugagauucauguauguauaaaagacaagucgcauuuguggaugaucaccaggaaugcaaaauagguuucaauaugcaccaacucggugagugugccugaaacacagucccaagaucagucggagacuguauuguccuacugaggaaggaugaagcagucucuuaguaaugucugagucagggcuggguaaggaguuuagagacacuggugcccuauauuuaauaucugugccaaagaaacgcccacucugaccaggaaguaaaaucgauguguccuaaccuuccuuuaccuuuacaucagagguucacaaccugugggucucaaaugucugucuccaaaagaauuuauauuacaauucauaaaaguagcaaaauuagaauuauaaaguagaaaugaaauaauuuuacaguugggggucagcacaacaugaggaaaugugguaacgucaugauaggaaggcugagaccuacugcucuaggcuguggggccuuaggcacgugggguuuggugcuuuuccuuccuccuuugaguuggcccucacauuuccauaccaagagcuauaaaaccuacauagauucagucauguaucugauaucaccacucuaguacugccuuuggaagucaucaaaaguuuaaaaacuuagaaaagauaaauuucccaugugcaacacagaucaccguaaaauauuauuuaacuauuagaauuuuacaaauuuuugaagguaaauuccucaaacauauuaaaacacaauuucuuuuugaucuuggauaaaacaauaugucuuagggauaugugguuuagagaaucucuccuuucuaaccccauaauaaccagcuuuugaauugaugcugcuauuacauaauuuuuaaggcauugagacagauuuuaauucauuuaauaauuaggucaauaaaaaccauuauaacugagaguaccauuaaaaguccauaauguuaccuuaaugagggaaaacuaauauaguucuguuggaauuuuucugugaaauuaauauuauagaacuuuagugggugucuuaaauagcuuaaauagacauuuuuauuaacagaacuaaucauagaauuuuaacagaugaaaaucauuacauuugcucuaaugaaggacccacccaugauuacuggauuucaugaguccuguuccugugaagauccugaauguauacuacuauaagaacaguguguuaaucucgcuggaucacugcucauuguccccuagagcuggaaauuucuguuugugacuccucuuugaccacuauggcucuacuucucagagacacuccccucucuucccauggauaaucauaaaaguccuccccucucuucccacagauaaccauuaaaauccucauaagugccucucucugguggagcucaggaagccgugcaacauggaauggauuguauuuguacuccugggaauguucaccacugcucuuucaacagcaaguaauucaaagcagagacuagaguggaugcaguauaguacugcaccaugauuucagucaguucugaccagaagggcuggauagcagcagcagagaaagucccuguguugacaguuagucuaggcucugccccacaguuaccuggcaacagccagguguaccugacucacucacuauagaaggggcugcuugcccccuccucucucucuugcccuggccucuugccccugcucucccucucucccaaucccccuccccucucucuccacuugcacauggcuugcuucuauuccucuucucucucucucucucucucucucucuuucucucucucccucccucccucccucccucccucucccuuucucucccuuucucugucucuccucccucaacuccucuccccaugccugaauaaacucuauucuaugcuaaacucuauucuauacuauaccaucuucguggcuggucccucagggagaaggaaugugucagaaugggcccacagaggcacuccuuucccccacaccauaccuugccugcaccaaacauaccccuccuucucuuuauuuuuuauaaaccacaacaaccugacucacaaaucugacuucacacuaugaaaauccuuugauucugugagcuguacaaaaagcauaagccccuuaugcacagcagcgccauuacuagaaggaucaagggggggggggggaccacaauaaccaaaugccaaagucacaggcacaaaugacagcggaucugcugacaaaaugugugacuuggcuauaagcaggaugaccacugcuagcuuaguucucuucccugugguuuuguuaugcucaagucacagggaccccaaagaccacugagaauccaauuccaaugaaaacacaaaggucuuuaucaugagcuccugaacaaggucucuuacuguccccccucacagugggucagagugagagcccugaguuuaggggugcaggguacuuuuuguaguuacagcaagcuugaggaauuucuaucugggucagcaaguuaauauuuuaaaaacugcauuucuggcauaaucuguagaaaccaaacacugaggaaaaacaaacagaauggccaagcuaucuauucucuacacggugucuucuuuaucugucuguguaccuugacccugcuauuguaaccucacuagcuauugcuaaggggaguggguugucacggaauguuugcuuagguggacuuugugguuuacuuccuggaauuggaguuuagccccugguuucacacaaaauggaguuucuucaacaaugggguugguugggcuuugcaguuucaguaucagaacaagaagcaucugagcugacuuggagaaaagagaucccaguagaaaacagccuccagcagcacggcuggcagagcaugcagcuguucuuuagaggaacaaaaggucucucaguggguauuccacuagucucaggccuuauuucccaggacacacugagcacaagaacaaaaauaaaggccaguaugauguguucccugcccugugcacucucagaaguucuugugaguuguuaucaagaccuggggcaugugaaggacacagaggauacaaagucuguuagagggacuaaguuuuagagauccaguguaaauuauugacccugaagucacuaauaguguguaaugugcuacauauucagauauugcucagaguagaucuuauagguucugaccauauaaaauaugaggugaugaguagguuaauugagaugacuucaucauuccauaaugaauacacacagccaaacaucgcacuauaccucacauagauagggaaauagcagggaaguuauaaaaacaaaaaccaaaaagugacaaacguuauaauccuauuauauauuauauaaauggagaggaugguaaaucaauguuuagauaagaacaauuuaccaauuaaagacaucuaugaaaggaagaaaaaaucaaagaagaaaagguaaagaugggccagcgaaaggaaagcagguuucugcagcagccaucauucugccugccacuggcaggaagacauacaugcugccugcgcuaucuccagcagccuuagaagcaguagguacaaauggccucccuucaauauuuuuacaaagagacugucaggaaauaucauuuucucauauaauuaacuucuuugaaaacacccacagaccaauuugcauccagcaaccauguugguuagcaaaagcagguccuguaaaccagggguacagugaagaaccuaaccagacccuacucauuucuaaucaagggaaagcccauguaggucacacugggaaaguuuaaaaugccacauaaaacaaagaagaauaacaagaaagaaaaaucacagaauggacagagcuacuuuucuuuuccuucuuucuuucuuucuuccuuucuuucuuccucccuuccuuccuuccuuccuuccuuccuuccuuccuuccuuccuuccuuccuuucuuucuuuuuuuuuuuuuuuuuuucgagacaggguuucucuguauagcccuggcuguccuggaacucacuuuguagacccggcuggccucaaacucagaacuccuccugcaugugccacagagcuacuuucccuuuuaagguuuagguuuuucuggcaucucagggagcuggacaugcaggauguucucucuccagcgagaguaaaauggagagaaaaggggcuuucacaacagguuuaguugagcuggaauacuuuaccuaggagucacuauauuaugugcagaggcccuauaggguggguuccuauaaaggaaaccuuggggagacccagugaacggucucuuggacagacaugucuacaagugccuuuuuguuucaauuucacuuaucuuagucuguaaaaagauugcacauuaacuuggggguccacuguuccuguagcaauauuuuuacuaaagguaccaaauauucuucagaacagaggcucuuaugagaaaaugggccucuaauauauaaagguaucuugcaugcacacacaugcaccgcucucuauggggagauauuuuuaaugguucagugaaggacuuccacaacaucaugaaaauuuaaagauugcucagauauuguuucccugggagggaggaaagaacagagagcuuguggcuuuugaggcuacuaccaauuucuaguuuauucaauacaagcagcagagguuaauaacugggaaguagaaaccauucaggaauacgaaguuauuuacaaacaaacaaagcagacgguacaacucauucaguucuuuuauuccaacacuucccaggaaguguaacuguguuaaacuucucucuguauuauuuaaauuaaauuaucaaaugcaaaugcuaaguccgaaccgcucagcaaagagcuggauuguaacaccaugacugcuauucaagcuaaaagcugauuacugacugguccaggggcuauaaacaugccagacaauaauuuaauugcccugcagguggggguuaggcaacauuuuuuauuucauucuggaacacgacgugacuguuuaauacacuauaaugauuguaaacacacacaagaagccucccucugacaccuguuuuaggggaaagagaagcuguagcaaauuuuugcaaagcagaagaaauuuggcagugccagaguuuucaaucacuggaugaaaggguuucucaccgagcaaccccaggcuuuugcuccugguuuagaguuaaacaacacauuuauaaaauggauuuagagcuauaaugaauuccagaugcagaggcuauuaugcaacaacuaauuugcauccuguguucaacugacauguuaacuagggacaugcaaaccucuuucucaagucacaagugaagacagaugucccacuaaguaaugaacugagagcaauauguaugcuucccaggaagagagaaaaggcuacagucuggcuaggacaguggauaggccucgggcagaaccaaaggcuaugguguacagaggaagacauagcuauucuuugggcauuccauugcugaggaucacaacagaggagcaaaggaaguuaggaaaggcaaaagaagaagagguagugaugggagggcaggaaacagaugaacauuuggugaccucuuuggucccuggaggucuucauguaucagcccucaaagucucaagggucacguucagucccuacuaucuaauauggcacacaaaagggacauagaggaaagaaaggagaacuuagcgccugggcccaacuuguacaaucacuuucaaauaagugcagcacagaaaauucucuacaaagcuccaguacuagccagaacuuuaccugcucauguguagggcacuucugacaacuauaaaccaacuucauuaagcacugugugccagggaccacccuguguuugauauauuugacuucuaguaaccucacagugagucuccauucuuaguaaaguuuaugaagcugccuaaggugauuugaacuuuacuuauuguuugugagaaagaaucucaugugucucaggauggccuggugcuucccaugugugugaggaugaccuggaacuucugaucucuuggccuagaagcugccaaacccagguuaugcagugcuagggacugaccccacaguucuguacgugcugagggaacauuuucucacuggccuguaccccuagcucauugguaccuaauuugcuaauaauagugagguauaaauguuucuccuccauuuucaugcuucacuguuuuaaggggucucuucccuuuuuaaaguuuuauauuguauauguuauguuuacaaaaccaagaacaguuuguuuguuuuuuuuuuaacucggggagauggcaguuaagugcaaaugcaaagcugccauagugucagccauaauucaucguuggucgugcgaacagauuuuuauuuucuucuuugcaugcuucugaauguuuagcuucuguaaguaaauaagugaagauauacuuguaagacgaggaaaaggcaaaaggaagagguggcucuugcaagcaucacagugugugagcacaaagcucacacuuuauuauagcauagagaacuucacuccucaaagggucugucugggugucagaaacaacacugaacauugucucuacaggauaucuccaguacauggaggcagauguuaccauucuaauugagaaacugaggagggggaggagggggaggaggaaaaggagggggaggaagaggaggaggaggaggaggggaggaggaagaggagggggaggagggggaggaagagaaggaggagggggcuuugaucacauaagugaccucugagcugauauuucauggcagcuuccucaugccuucucuguccucaaaguccuuuucaucgucccaagggucccagguccauaacuuauccuuacagucuuaccaucacagucuuauccuuccuugguuaggcuuuuuaccaagugaacucuuucuacaaagccuaucaaauguucuucauucugcaaguuuucacugagguuccuggauguaagccacggucaguccccacggucagucuccuuagaaugggccagaagacacaagguagcaaaucccaggccagcucaggcccacagaaucauuucuauggcuuuccugaagguauacuuuagauggcaaauaaaauuccaaaccccagguguuucaaaguuugaugaacagccuguggcacuauugggaaaugauacacucuuaagcagugccuggcaaaaguuaagccacuggggcaagcccucuuaaaacauauggugacaacagucucuuuuuuuucuguuugcccucuaugaagggacaucuccuucugccauguauguuucccaugccuacuucaauccaaaguaagggagccaauuuaaucucagacggaaacccccaaacuguggcccaaaguuuuauuuuuauauguugauugucucaugcauuuuguuaccacaacugaaaucugauaauauaucuaaucuguaugggagacuuuuugucuuuuuuguuuguuuguuuauuuguuugguuuuuguuguuguugguuuuuuuuuuuuuuuuuuugagacaggguuucucugugcaguucuggcuguccuggaacucauucuguagaccaggcuggccucgaacucagaaauccaccugccucuaccuuccaagugcugggauuauaggcaugugccaccacugccuggcuguaugggaguuuuaagaaguacuucccaacacucagaaacuaaaagaauuagauuuuaucccuauauacuggauaucuagucagcuaaccucuaugccugcuuggcaauaauuaacuguaccaaguaucugugcuguuagaaagucuaugcucaguucccagugacuuuccuguaacuuucuuacuuuugagacauuugucuucauacauggcuacuucauggcuuuguauucaggaagcccugggucacaguuugccucauguuuucuuuuuauaugauuuuacuucugucuuucuauccagacauaaguacuucauacaugucugcuauuuuuuaccauuuuaccugugagcacaagauaggaaccuacuccuugucagaaaauagccaaauagccauugaucuaaucucacagugagacagaaguggucugaaaugcaacuaaugagaaaauaauaacaauuugagucaaaacaaucuauucuugauauuaggaagacacuccaaguaugagcauuugaauucagaucccugucacccacaaaaaaaaguggcaucuagcuucagaagagccugucuauaauccaguguggaaauagagaggcaaggccccuggagcuugcuagcuggccagucuagcugaacuggucugaauaugucucacaaaauuagguagagggugauauggauuguaucucuguccuauacaugcacaaauagagagcacccccucacacauacaccuguagacaagacauccagaucaaccucuggccucccugugcauauaggcacacauacaccucauaaacauauacucauaaacacauauauacaugcaaacacacagacacacaagaauuacuucuuuagauuucacuuucucuauugaaguuuuaaugguauagguuuaugcuuuaccuaacucauuugaccacacccuccuaauucauaucccuaagauaacccaagcccagcuagcagaaagaucucugcauauuaaucacaggacagauaucaguccagugaucaacuuuaauccugaaaaucccaaaucucugcuguugcuacauuuagaagcuaacaagaauauguuuucacuccauucacaaaauggaaaauucaaaaauucaaaauguuaguuaucugagagucaagagacucagagaccccccuacuuuccaugguaaguuuguuccaagucacugaagcagaaaggaguuucacgaaugaggagcuugagccuuccaguuucuaucuaugccugaagcugacccugugccauagcucuccagacucaaaacccccugggagacagcuggucucccgagagugcugacacaccugaaagcacaggcgagaccaccacuucuguucaaauuccuggcgcaagggagacccguccagagccaucaggacacaggaagcaagaaagagccaggaauaggauccaucugguuucugucuuuacccugugccacagcucuccauacccaaauucugcccagagagaacuugucucccaggagacgugacacacaggcuuacaggagggacaagccauaguagcaugaccagcuaauacaacagauaaccagauggugagaggcaaggucaaagugagagguaagcaacaaaaugaaggcuacuuggcaucaucagauuccaguucucccaccacagcaagcucuggauguugcaacacaccagaaaagcaagauucagcuuuaaaauugcaucucaugaugauagaggacuuuaagaagggcauaaauaacucccuuaaagaaauacaggagaacauagguaaacagguagaagcccuaaaagaauuccuuaaagaauuacaggaaaauacaaucaaacaggugaaagaauugaacaaaaccaucuaggaucuaaaaacggaaguaaaaacaacaaagaaaucacaaagggagacagcucuggagauagaaaaccuaggaaagagaucaggaauaauagacacaagcaucacuaacagaauacaagagauagaagagagaaucucaugugcagaacauaccauagaaaacauugacacaacaaucaaagaaaaugcaaaauguaaaaaaagcuccuaacccaaaacauccaggaaauccaggacacagugaggaaaccaaaccuaaggauaauagguauagaagagagagaagauucccaacuuaaagggccaauaaauaucuucaacaaaauuauagaagaaaacuuccauaaccuaaagaaagagaugcccauaaacauacaagaagccuacagaacuccaaauagguuggaccagaaaauaaauuacuccugucacacaauagucaaaauaccaagugcauaaauaaaagaaggaauauaaaagcaguaaggggaaaagguuaaguaacauauaaagccauaccuaucagaacuacaccagacugcucaacagagucugugaaagcaaggagauucugagcagaugucauacagacccuaagagaacacaaaugccagccuaggcuacuguacuuagcaaaacucucaauuaccauagagggagaaaccaagauauuccaugaaaaaaaaauuuacacaauaucucucuacaaacucagcccuacaaaggauaauagauggaaaacucugauacaaggaguaaaacuauacccuagaaaaagcaagaaaguaaucuucuuucaacaaacccaaaagaagauagucacacaaucauaauuccaccucuaacaacaaaaauaacaggaagcagcaauaacuacuucuuaaaaucucuuaacaucaauggacucaauuccucaauaaaaaaauauagacuaacagacuggauauguaaacaggacccagcauuuugcugcauaccuauccuauauccuauagagggcuaauauccaauauauacaaagaacucaagaaguuagacuccagagaagaaauaacacuauuaaaaauggggagcagagcuaaacaaagaauucucagcugaggaaacuugaaccuaaagaaauguucaacaucccuagucaucagggaaaugcaaaucaaaaagacccagagauucaaccucacaccagccagaauggcuaagaucaaaaacucaggagacagaaugcuaguggggauguggagaaagaggaacagucuuccauuuuuaguaggauugcaagcugguacaaccacuguggaaaucaaucuggcaguuccucagaaaauuggacauaguacuucuugaagaaccagcuagaccacuccuggguauauacccaaaagauguucccacauauaccaaggacacaugcuccacuauguucauagaagcccuauuuauaauagucagaagcuggaaagaacccagauguccuucaacagagaaauggauacaaaaauugugguacauuuacacaaugcaguaccacucagcuauuaaaaacaaugacuucacgaaauucacaggcaaauggauggaucuagaaaauaucauccucaguaacaaaagaacacgcaugguguguacucacuaauaaguggauauuaggcaaagaguguggaauauccagauauaacucaugggccacaugaagcucaagaagaagaaaaaccaaagaguugaugcuucagucuuccuuagaagggggaacaauauaaucaagggugggaggaacuugggagaaaguaaggagggaguggggaaauagaggggcagaauuagguaugggagagauggagagaaugcagagggucaggaaauugaacagagguguggagcaaugggggguggaaaacuagggauagcaucccagucucagaugccaggaaagcaagagccuccuaggaccccauggggaugacauuagcugaaauaacccacaaaggggagggagaaccuguagagacuauauccauuaguuaggcauggcccccugguugagggauggggccacccaccaaucuccaaaauuuuaauccagaguuacuccuguguaaaggaaauacagggacaaaaguggagcagagacugaaugaaaggccauccagagacugcccuaucuggggauccaucccacaugcacacaccaaacccagacacuacugcugauacaaagaaguucuugcuuacaggagccugauacagcugucuccugagagacuuggccagauccugaccaauacagauacagaugcucucagcuaaccaucagacugugcacagggaucccaauggaggaguuaggacugaaggagcugaaggggccccaucuggcaucagugggaggggagacccuuggucuugagaaggcuugaugcccuaauguagaggaaugcuaaggcagugaggugggaguaaguggguggguggggagcaccuucauaggaguaggguaaggggaaaugggguaggaguuuugcagaggggaaaccaccacuaaagggaauagaauuugaaauguaaacaaaauauccaauuuaaaaaaaaaagaaaaugugaauauggaguaauuacauggacauuuacaauaaagguuacuuucaaauuuaaaaaaauaaaagauugaugaucuuacaggaaagcccagucaggcaagguuacuauuuuaaugucaaugaugugagcaaaaagauagaaauuggggcagggacaauugagggacagggacuccaaaagcgagcaguuucuacucuuggcccaaagcagaagauggccuuucucuuuccaggaaugccagaaaggagguuuguuuucuucgcuccuaaacagggaccuugcccugcagaccugugacggaaaccccaaucuagacacucaucuuuucugauccaacagcuggagaaucggaucucuggauuuucacgguacuacuggguuauacuuauuccuaaagucagcuaaaugauuuuggaauuucugcucuugauuuuaggauuaccacuguuguauuuuauaaaaagagggaggaggaauguguuugguggaggugcagucaggugugggggaagggggugccccuggggacccgggcugaggcaucucuucccacugagggaccagccacacaauauaguauagaagagaguuuacucaggguauggggaggggcauugagggaguaaagacagagaaaggcagagagagagaaagagaaagggaaagagagagagagagagagagagagagagagagagagagagagagagagaggaagaagaaggaggaggaggaggaggaaguggaggaggaggaggaagaagagaccaugagcacaucaagagagaaaggggaagggaaauggggagagagggggagcaggagcaaggggacagaacaggagcaagagagcaagagagagaggagagggcaagcagccccuuuuauagugagccaggcacaccuagcucuauggggcagagucuagacaaaaugccaacacccacucuggauuuuaauaguuuugggagacaccaaggcucugcugaggauagucuuuuggucuaaagaauagucucugcuucugaccuuagauuuaggcauuacuacuauugucuccucacuuaagaguuaacucugggcucagcaguuaagagcacuguugcccugguggaggacccagguuugauuccaggaaucuaugugauaacaugcaccucucuguaauugcaggggauucaguccacucuucugacuuugauuggcacuagguaugcacaugguucauauacauacauguacguaaaacauucauauacauaaaauaagagaaaaauauaaagcaauuuaagguaacaacaaaaaaacaacagcaucaccaacaaaaccauuaauuaauucaucuggguuuuuuaauucaacuggcugagagaccacccaucaggaaaagugauuaccuaaagccaugcagaagagauaggagguauugagaucauauacucaggccucccagcaaaccuaucuuuguuguagugacuucagaagccaccauccuguggcuuggauaaaccugauugcuucucuaaguaacucacagaaauguaacauuuccuuuuuccuucauuuuaucucuuugucuuucuuuuggauacuggccacuccccuacucuucccuccacccugccaguaggucuccacaguguggcaugccccagcuuuucugcucuguaguucauagcugaccuauauaccuaacuuaaacaucuuggcagucuuucuucuucuccaucucccuccuccugagaaccgcugagagguccagcuugccugaugcugugucucagacuuuacuaaccuuacaugccuucauucuuucuuaaauucuuucuacugagauuaagaaccccccccccaaauggcaccccaguuccuuuggcaacauauagcaccagcccuuaauauuuccuguauuaccaucuucuguuguuaaccaaugccuaguccuguaagaguuguugcuuccauagauagccaaccacauaguagccaggagaauggcuccugccucauuagcaggcugaacagccucgaagccugguucccauuaaagaaugaaaauuugcgaggcagaagcccucacuuaacaacacacuuugcauaggaacaaaggcagggggaacucaggcuuuuaacugaaaucuugccucucacuggcacuuagcaaagucuucagcgcacccuacuaaggaagggacuuuuugaccuucuuaggcuauuaagagugacccaaaaaaaagcaaaguggcuuuguucuccaaauuuucuuuuauugguugccuuggacaaccauaccugaacaaagcagccuuagggagaaagccggcaaugacucuuauuugcuucagcaagagaugccuaagaugaggauuucuuuuuucuuucuuucuuucuuuuuuuuuaagaauaucagaaugaauagagauagcagaaauuuaaggacagauccugagcacagauaagauucagggacagcuucucagaacugggacuuuaaacauuuuaaacagaaggaaagacguguguauucaucccuauaacagcuuucucauaaaauacuccgauccuucgagaggggaaaggguuucaggggccccucugagagugacuggcucuuugguuacaguuuuagggcagguguucucauuucaggaguccuaagaggcugggucugccacccaucuccaagaugccaauuaaagaucacaguuaaggggagaggcaaagaaaggagggucaaucaauguggccuaguggaagugcaacaagaaccccaaaucaaucuucuagguuuaaaaagagaaagaacggggcagggagcaagaggcacacacuccuaagcagucccagacaaugagggucuggcugaucacuaccucaguccugcugaaguccuuugcaggacaccaccuccaggacagcuaacugccuucaguggucuguccuguguugcucuuccuagacuagagcucaagguaacuuaagguuuaggacaaagauugguaucuuucagccuccaguguugauggggagugugauagacucaaccucaccauguguauauauagauaaugccugugagugauugccaugcccacgugcagagucagccuugacucugacuaaaguaaaggagaagccuucacaggaccaagggccuccccuuccacugaugccagauggggucccuucagcuccuucaguccuuccccuaacucuuccauuggggucccucugcacagucccaugguuggcugagagcaucuguaccuguauuggucaggaucuggccaagccucucaggagacagcuguaucaggcuccuugucagcaagcucuucuuggcaucagaaggcuugaugccccaguguagaggaaugcuagggcagugaggugggagugaguggguggaugggggagcaccuucauagaagcagaggaagguggaugggauagaggguuugcagaauaagaggggauggauaggagguuugcaggggggaacugggaaaggggauaacauuugaaauguaaacaaauaaaauauccaauuaaaaaaauaaaauucauaaaaguaaagcagaaggaagauacaaacugaagguagagcugccaggcucccacucugcauuuaguugcccuauggacucaagugaggagucaguauuuuuuuagaaaucaguuucuaaauaccuguuauagcagcagguuguaguuagcauguuagcauuccuuccagguucugcccaacaguuaccuagcaacagccaaguaguucuggcuugcuauaaaagacuguuuggccucuccuucuuacucugaccccuucuuuccccucccuccccuguuucuggcuggccucuccuccuucucucccucugucucucccucucugccccaccccguccuucucuguccccucucuuucucugccuuuacuccauucucaacuccccaucccaugcccccaaauaaauuucauuguuuacuagucccuuggcauggcugguaccuggggaaggggaggaugucucagcaugggcccuccaagaaauccccuuccacaccuuuagcacuuugucuaaacuccaucccacaguuaccuagcaacaaccagguguaccugauucacuauaaaaggggcugcuugccccacccugcucugucuugcucuuguugcucuugcccucuuacuucugcucuauccugucaccccccuccccccucucuccaagugcucaugaccagccucuacuccucucucucucucucucucucucucucucucucucucucucuuucucucucucucucucucccucccccccugccuuucucugucucuacuacccucucaacuccccauccccaugcccugaauaaacugaaauacuguccuaugacuggucccucaggggggagggauuccucaccauaggcccacggaggcacccucuuacccuguaccugacuacauaccaccaaacauauuccuucucucccuuaucuuuuuguaaacacaacacgcaccauauggaccuuuacaaaacguaucagaugcaucucugcuuccuuuguagcaagaaggaaaucagagaaccugaauaggcauuguuagcauucugucuaagcuucaccacaucagacaucuuacaauuguucccauaagccuguguucuaagaugucacgaaagucuaguagguggcccaugccugugaucccagcauaaagaaaggaggucaaguguuugggguuagugugggcuauauaauaaggucacugugggcuauauaauaaggcugucucaaagcagaacaucaacaauaccgaaagaaaagaaacaaaauaaauauauaaucuacccccuguccauuccauaguuuucuggcuugcugugaguuaaguguguggcagggugcaaggaggugaagaagaaaaugguuaucucuaguggggguggaaggagaggcccucgaagaaggaaguuccagcagcuuguucucugcugacuucugcauaggaauuggggugcucaugacucauaagacuacucauucuagaaagaucagagcugcccccaaaguugacugugcucuggguaucugcccuucucauuuucuccaagaugaaagcuuucucuaaauacuagcuguuagacugaccuaaccauagugcauggcauagcucugagaucaggagcucaaaaucucacuguuggccaguuucuagccugagaaucuaccuggaguggguggaagagggguuuucuuucuaaguuaaagugugggagcgcacuugaagcuugagaucaaagccucaucuuauccgugaggugagagccgcccugugcccugaagacuuacucuuucagagccucucgugacugagaaaggccucucaggcaccacacuggccuaguuuguaugauucuugggcucaaauuuccagauccaaauaucaaaguuuaucacaauccucauuuuguaggugagggugauagaaaucagguucuccauagcauagguucuaagcaaaaguaauagaauuaccaagaaguucucuaaauguuuccagcucuugcuuguucuggaauggcacccucccuuccuucuaggcaauggacaaagguucacagcaaggacucugaagaaauaagcuuugcccugguucccucaauuuaagucuuagaucauaucccguuuucccuaucacacuucuucaugacuuccacugugaugucuuccaagcacugaaaguguacuaaaaauguauacauuugacccuuccuucuagacuucguaacuagaagguuccuguaucauauaacauuacagacaugugugggcuuucuuuuagcaagcugccuuuugccaucccugaagcuaggaugagcagagggaagaauauuuucuuuuccucauuacagcaucauggagauugaaaugaaggaaagacccauccaaggauacaggaaugaaccccccuccaagggucuucuuaaacagccaacuucucuaugccagaccucucuccugagcucuagaucaaggucaagguauaaccuaucaguccucuaagauucccacaaaugaccaaaagaacugcugcuuucaaggagagccaagggucaagggucacagaaaagccugcaaugugaccccacaagggaccauuuuugcugaccagcauaggggcaaugcuuuggguuuuucucacauucacuucuaugcagguuauccaucaggauccuuaaaaauccacugaggaaaggugcccaaggaagguaauaucuaaagcaucgggccaaguacugcucucaggauaaggaugcagguagcccccauuuaaaccucacaauaguccuuguuuuacaaagaaggagagggagagaggagggagaggggggaggggaagugggaggggagggggagagggaagggggagagggggagagggagaggugagaaagggggggaugggggagggggagaaggagagggaaaagggagaggaagaggggaggggaagggagaggaaagaggaaaggggagagggggaagggaggagggagagagggggagaggggggagaggggggagaggggaagggggaauggggaggggggagggagagggagagaaaggaaggaagaaagaaagaagaaagagagaaagaaggaaagaaagagcugccuauaaccaugaagcugacaugugcaaggaacugaccccuguuugccauccucauuugaaauucacacugggauuucuaguccaugugauccuguugucuacuugccaccaccacugaauuagagggguccucacagccgggcggaacacauggaucccuagucuggagggguggggguagaauacauguguggaacauggauuuuacacuuagugacucuuggaauaaacugcaaugcuaucccgcgcagaucaugaaagagacaugcauaccucauaucuagacagugacaaggggaaagcccuugauaaagcaagauggcuucucuugucauuaaccauccagcugcauucagacaaauguagaagcagaguagccacaaagagagcccuuaacacaccucucagguagguaagaauagaagaaacagagguccuuagggcacucuccuaggugagcacagucagccccagucagcccuagacucauagccuaauaagagaacugcaugagcaaacccagaauagagaaauaggaaggcuauggaaagggcagauauauuaaggaagcucugaaauuacacucugacauguugagcuauaccuaaucagacaggauuuaaucacggucuuaaggaagucucuccuuuggucucucagauacaguggcauauauuuggaaugagguggaggaggucuaccuuaauaccaguaagaaagaugugacaucuuuauuaccuggagcaccaugggaauuaguacugacucagagaugcuaaauaggaaugcacucuugagugucaccagcaaaagccagggccagggcaagguagcaggauaugaaguuuugagaucaagaaaagaccuuggaguugcucuggaguuucauuucuuuaggggaaggaacuggggcucagaaaguugcauggugucuuucaaguuacacagugagcuggaacccagguugcgcaagacccaggcgaaagcaagcaacaggauuacaucuaguggagguuucccaggauaagaaacuuccaagaagagcugagggacaggacaggauuugaaguacacauaggagagaagugguguugucauuagagguugggggaaaacuaacacuuagucccaaggaagaggaagcagacuucaguuuggauucauucagaagguaggaaacuaauauguggaucagaaauaagcaggauuggguuuuuugugcugaaauauacauaaaauaaaaccuacuaccuacccauuuuaaacuacaauacaguggcacuuagaauauucacaauguacaacuauuauugccaucuagauacagaugugcccaacuugcaggccacaggcugugugcauuccacgaccguuaagaugaucacauuuauagauguuaaguucaacacauuuauagaugaucauaguauauugcaaugacaaaaaguuagaguccucuuauuacucuagaaccuucucauuaccuccaagggaaaccuucuagucauuaaguuguaccucauccuuucugaauccuuuccugccacuaacccugucaaccauuaaugugccuuccaccacucuggauuugcuuguuacagguauuuuguaugaauagcauccugaauagaaugcauguucuuuugauguguggggaagaugggggaggggguuguguuuguguguuugcacuuguguguacauguauguagagccuagggcucaacuuuaggugucuuccucaguugcucuccaccuuuuuuugugugucacagauucuaacugaguuuggaaguucucaguaaaguuagaguaacaugccagaagcucuauggagucucccauuucugcccucccugcagcacuagguuuacagaugugugcuuuuaaguggguacuggggauuugaaccuaggucccugagcuuuuucuguaagcacuuuacugacugagucaucucuccagcccugaagauguuuuuaugacauauccauaaauaguguugcaggcgaucagcaugcuuuguaaaggauccugggagagguacccaguucagaugcagauuacaaguuugcacaauagagcuauacugugcggaagacucuggcaugaggaaagugccagaaaggauggagcugcuucuaguacagcucuggcuaaccucccaucaccuucuacacugcuggggugggggugggguggggaagucuuuacuauaagauaaaccagguccagauauguagcuguuucugcugaucucaaaucuuccuguucuuuccccaccaccccuucugcugacaauuguuugcuaauuucccugacacacugcaauuuucuucucugaagcauguuugaccuggagcacagcuuucugcugagugauauauaguuuuagccauuagcauagccaggucuguagaagaacagggacaaacaggcaucacuucagcuuuaacuacaaugacuugucucaauaaacucagggacaaucuauaaauaugcugaagauaagggcaauacaauuagcuauaaaagggcuauagaguaaaagugauguuuuauggucacacggacacacucauacacacacacacacacacacacacacacaccaaaaacuauuaaaagcauaccuuucagcaaccaguuuagaggacacauauugguuuugaauaaauaccaaacaacagggguugaggcaaggggcucagaaggcugucaaagcagcauaucuagguugggaggguggacuucaucucaugacuguaaaccaugugagagauuuagaucuacucuguaucuacaggagaaaagcugugauggcaugaaaacaaacauccauguaccagcagcugguaagauagcccagugggcaagcacucuuuccccuaaacaugacaaauuuccuuuagucauccaaauccuuacagugaaaagagagaacugauuauuucagagugacaucugaccucuaugcaggcacacacacauacauggauuauuaaaugaaguaacuaauaagagagagagagagagagagagagagagagaaagggauggagagaaggagggauggaaggagcaagugagggggagagagggagagagagagagagagagagagagagagagagagagauauuaaggacccuauagcugauugaaugaugcuauuaaaaauccaugucuacuuaguauuucacaaugcauccccauuuggaaauaaaaucugugacacaugcaguuaagaugaggcaauacaggacuaagguaauugauaacuuuaaagacuggugcucaaucuuuuuggggugauuagaaggcauacagauauccauacagagaagaaugccauauaaauauacccagaaauugaagguauauaucuguaaacuaggcaacacugaaaacugcagccaaccacuagagaccagcauaaaggaaggaaguauugcuccccagaacuuucaugaaccuuuauuaacaucaaacucuaaugacagcuggaccuaacauucacagccuguggaccugggagaggauaaauuccuacagcuuacuccauuugguucuugcucucauccaaucauaccauccuguuuuaaaguugggaaacaugaauucuuaucaugaaauuucaucaccacuggaguucaacaucugaacaaaaguuuagccagcacucugauuacccugacuuaauaggaagggcuugcauccggggcagugugacuacccugacuuaguaagggcuugcauccggggcagugugacuacccugacuuaguaagggcuugcaucuggggcagugugauuacccugacucaauaaaaagggcuugcaucuggggcaguuugauuacccugacucaauaaaaagggcuugcaucuggggaagugugacuacccugacuuaauaagaaggguuugcaucuagggcacucuaacuacccugacuuaauaagaagggguuguaucuagggcaguguaacuacccugacuuaagaagaagggguuguaucuagagcaguguaacuacccugacuuaagaagaagggguuguaucuagggcaguguaacuacccugacuuaauaagaagggguuguaucuagggcagugugacuacccugacuuaauaagaagggguuguaucuagggcaggauguccuacaggcucuuuuguuugccuuguuuucagaaugagaagaaggcagaucuuuuuacuugucuuuaugacucccuucuuagggaucucaucucugagcccacaaaacuuuuuacucuguuuccccacuccuuugccagagcuaaccccuugucuuguaggcaagugugugcuggcuaagcagagauuauuccauguugaucaugguuuuuuauuauauuauaugagaucccucuggucguuacuagggcauaugucaguuccuagagauucgaaccaaaccaaagauccuucagaucuagaggaaaggggcucagaguucagcaguuccagcaggcaaccacaagcugccugguuagcucuggcuucagaugucauuuaugagcuugugacaugcuuuuggaagcaagggugucauuagugaugcagaggcuaugaagcccauccuagaaaccugucauuuguguuccugggaauaucagacgugaagcugucuugcugcaagaagacaguauggagcaucccugccacaugaaagggaugucucaaaccucuggccaggaaggcucagggacacugaaacuaugacaggaugagaggcugacaggacaguauugccagaccuuggcaugaaauagauuucuaagcaucucaucaaaugucugcaaggacagguucucucagugacccuccagaaucagucaaagucugcucuugucugagcuaugauuuacauauaaaagcauccaucgagcugugcccagccugucacuuugcuuagcaacaguagcagaauaagauuuuacguaggaaaugagaaucucuuuuuggccggaugaggcacugggaguugguacugggaagacucuauuaaagcacccuuauggacugaugugcacagauguguuaauuuauagcacauucaucagaagaccuaaauuaauugcucucugaugaauuucauaacaccuucuuucugcuucucaacccucccccaaaauacacugaaaaggucaacaguccuaucaaaugcaacacacuuaaacuuccuuccaagcuuauaauuaaagcuaauuaguaguuuugguaauuagcacauguaggcuuucuacucucugaauuaauaagucuuacacagguugugagccaagcaggcucuuugcuugcugauuccugaacccacgguuuggcugguuuauuuaaaacaggccucuucaaagugcaauacuagaaaggacuccuacuuaccaugaucugcuaucaggccagagugugauuguacacaggaaaagugggacuguuaucacuagaugacgucagcacauacacuccagucugcuucuccaauaaccaauccaucucaugcucucccugaggugugggcuaugucccgucagcugucacacagccuggacaaccguaaggacacugcuccccuuaugucccauucaaucuacccugagaauaccaaauaccuuguggcugugauauaacugcucuuguugauucuauuuacgaacggaaaggaggcagaucacaagccagacuggucucugccuguguuagaccaagugacuuuccagagagcuccauguuuauucuauccauuuuuucucauuuauuucagacagcauggggcauccuguaugcagacaaaauuaaaaguguauuuuuuuaaaaccaauccuauguugauuauuaagaaaaacuucggugacuuguuuucagacuuuugacaauugugagaauaguuuuccuuggguaccauacuauuuucugguuaagaaaaagaagagagagaaaaacaaagaaagaaagaaaggagggagggagggagggagggagggagggagggagggaggguagggaggaaaaggucuuggucauucacuagagucaucaaaaagucaggacaacagugguugcccacagcacuagccaccaugaauauggugagaaggaaauggccauuugcacauggggacaacuacacagcagcuuggggacauugcaaagcagaucaccaggacugguuuuaauggcacacuauugccacugugauaucuacuuuugaauccuuaugcuacuaucccugaccugauugaaaagcaaaaugucuuuggcccuguggacagcugugacugaaagcgauaaucuaagauucugaaugaccacagccucaggcacuugugugacgggagagucuuagugaaugcacucugguaaauuccccugagacucugucccuaaggacauaugaauuguucguauguuuuuuauugucgcaauugggagugggagucugguaggugggauuccaccaguggguagaagccagucauacugcgguugcacaccugacaauguacuggcuggugcucugagucagagaaucucgaagcuccauaagccagugauguuggugcaucuaagcgggaucuccucugaggcuccccucugcuuucaaaaucauuugacccaggacagaggcaaaggaugccagaccucaccuuacagggaagcaagaaguaagcggucucuagauaacuccagccaccugcugaaagccacgugcuggcuuuuuuuguuuuuuuuuuuuuuuaacacaacuaaugccaacauuuuacauuauggaugagcucacgugccauggcaagcaguuuaagaaugaugcuucucuuuaaugaaucuuaaaugguuuauuacugagggucaaguugcugcuugcagugggaaucugacauuuaugaaaacgccuggcauuaauuauuaauggggacauccuuucuggggaaaaucacuuucuggguaaucccagaagcuuuauauuccgggcugcaaggucugcuuugcuguuaauccucaaagcauuaauuaaauaaaauuuacaaugaguucaggaugcaucuacccucaaacauuaugcagaagacagcugaaugcucuuagauuucccccuuaguaaccagccaucacugagggcuauuuacagccuuccuuuuguucuuagcaaaaaccugguaucucuucccacugagaagaaaacuaugcuuaguaauuaaauuacaccacauuaaacuuacuuaacuuaaguucaccagcagggagaauucuaugccccuggguuuaaacaauaacuccuaaucacguuugccagccaugucuuuucugugaguugcuauaauuuucauuccuggaauuccauuaaaaaugguaaugucauuacuccuguuaaugcucaaaaccaacagcauaauccugcauuuuaauuagugauuauaauuaaucauuauuucauuaaugaaauguuuaguugguaauugucuuugagcaccuuacucccugggcuuauaagcguuucauaacaucucauucgcugccugcuucugauggaguggcucugucagccuuauuuuauuuuaacacuuucaugugacucugcaucucaggcuccagacacggguugcauauuuacacuuuggaaauguguggcuucuggcuguugagaagguuugcaggaagccuuacccucacaugcuucccugccaacuuaagaaggcgagucagcacgcucccagagagcagaaggcgugaagagaaauaaguccuggaacccuuacuuaauaauaaaugugggguccagauucauggcuuuuugagagagagagagagagagagagagagagagagaggcuagagcaaggauuuggggauauucuuuggaacaggaagguugauuucagagcuuaaagaauaagcugggaggguuguugagaauuugacaggaggcagauuuuugugauucucuggaaugccccaaauauucuuacuugcuggguugguuuggagugaggaggugggaagaaauagaaaugccauaaggccuaggacccacaguccaugguuccuuaugccguggagaaagaaacugauguaaaggaauucaaaaauuagguuggguuuuguaaacggaucagggcuaccaaacuguuaguuuguuaguaguccucacccauguggaugacugccuccucucagcaggauaggcaaagcccuccccccaccccuuguccuuccuugccuguauacuuagguucucccugaggccaggcauaaucaggacagacuagcaaaggaaggucucacaacuucugaaacacagacggcgcccucuaucacaaacuacaucuucaguaugauuuuucauaauuugauguagcaguuauuucuccauuaaaaaucuaauguuggcagcaguaaucauaguaacuuuggguuuauaaucccauggaauccucccucacuaugauuuagaauggaggaaggaacauucuuuauggugugcugaggucuuagaggaagugggcuacaggauccuaugucauguucauaaacauuuaucaaugggaacaaugaucauguggcauuacauacaggcuuuauuuuucuuaguggaaauaagaccuaugaaacaagaaaguauaguguaaauucccucuaaagaguuuggacagagauaaugaagcacugcuauauaugcagcaaacuguauacacuuccccaagguucaugggcucuguacuccaucacaucagcuuuaugccuuugaacuuuuucauccccucucuugaagucaauuccuuggcuaaagagaaaaguugcccauauucacauccauguccucuuuagagauuggcaaauugccuuguucuugggcaguauuuguuaauaaacacucuggggaucuugggaauagcagacuaucccaagcaaggugccaaaugcuuacacaagacucccagagauagaccgagggucucuucaguaccacacugcuuagcaucuggugaggccuugcaucgucuggauacagucgcccuggauucuagaagaaaaaggcuuugggggcagauaugcgcagaccgagaucuaucuccagacccagccuuucucucugcagagccuggcguuuuccaagaaccgaggcuuagcagaugguguuuuugaauuaauuuucuaaauugccaucuauaagaucuucuguuuccuacaauccaguugcuuaaaggauuuaagaauggaauuuagauguauguaucuuguuuguguaccuagauuguagguuugcuaucccagaggaguugugugccaggauucaaaggauaucauuggcaguaacccucagccuacaagacugcaguaucuuugcucucugccagauaaacagagguguggacuacacccucugucacauggguagcacaauuuguauuguuuccugcauuauggagauuguagcauuaaccuuuagggaaaaaaaaaaagcagggccuucagugagaacagaauauucugaaaacauguccuccagccuuuucaagccacuaauacauguugccucacauucucuucaguuuccaaagcaacuuugaagcugauuccauugggcucauucacaacaguuuuuuccuccaaucuaacuucucuuuuagaaaaggagagaacaaaggaauaauagcaacaucccuguuuggcuaggaaaaaaauaaggcuguacaagagcuuuggaaagucagugcauaucuucucuaagcugagaccgaauauuacugaaugauucuaaaauaggacaaaaggacaacaagagggagggaaggagcaagagagagguauggagagggaagacaaggagaaaugaggguggaggguggggagugggagaacccaaggacagugccuugccaugcuguuugagugugagacuggaggggaggggauuugcaauagggggaaaaaaccuggagugcaucaagaggcaggcucugcauuaagagcuuauaugaauucuggaaagaaauaaaaugaauaaauaaauaaauaaaaggaggcuuugauccacuccaaagagagagacaggcgacuucaaagcagaauaacaaccuccuacacuuugcccugcuuuaagaacacagggcauccauuauggaucagccgaccuucucuuccuaccaugcgggcugcagagcagccucgaucuagacccucagccuaagcagcuuuccuaaccacacagcaugugugagguuugaggcugugaauauuugggcugguggcucuuaagugagggcaauucauugauauagaaggcuucauaaaucuccagauccugcuaaauaguaacuucucacuuguacuucaaaaacaugggaugguacccagucuggcucuucaauccugucagacgcauaucuaaauaauagcucagcuguagaaauaugaccaacccaaagccucaaaauucucaaaaguaaguuuuggggggagauguacuuguuacuagaaugugcccugccagcccuuuguaagugcaaacuuuacaaagaccuuucagggagugccucagauauaguggaauuaguuuguacugcucucaaacaccugccaggcugcuagacucucuggauucuggcuuggucugugagaucacuuucagcucagguacuuggccucaaacugaacuggucaccugucuagaguucuccacaaauaaagcagucuuccccaugcaggaggcucagcuuuccaccuguccuugaucugagaacacugucaccuccuuuauguguggacagggcauuaguuccaggcugccuauugauuguaauugucaguuguugucagucaguaaaaauggcaaugguaaaaaaaaauaauaaaaaaaagauauaggagugagaagaggagaggagaagagaggagagagagaggagaggagaggagaggaggggaggggaagggaggggaagagagagagagagagggggggagggagagagagagagagagaggggggggagagagggagagagagagagagagagagagagagagagagagagagagagagagagagagagagauuuugauucuggagguuucuccuaguuauuuuuaaaguauuuucuuuguugauuugaagcacuguagaaauguucccaucugcuguguuucuucuuauucugcugcauuuuauagcuuaaacauagaucuuuuauuggguacagcuucuguuaacaauaugcuugcugggugagcccagaacuauucucuccuuaugggccccagauuaggccaccugucagcaagcagacuggagcuuccagucucuuguggaaaguaccaagcucuugggucuccugucucuucucuucugcagcccagguuauaagcugaugucaguggguuccugccugguguggacuaaauuaauuuccagaaguucuucccuucaucaauggucucucuuacucucgcuacuugaggccaguucuuuguguuucacauagcuuuguacagaccauaagcccuucagcuuuccaagucuucuuuuccuuaagcaauuaauuugcagagguuauuugcauauuuauaugggaaaaacuugcucauauaccugucugcauguggcuauauaugugcauauauauguguggauuuuuaugcaaguauguuuauaucuugcaaaaggacaaccuuggguguaguuucucagguguuccauuaggucucuuguuggccuggagcucccccaaaagacuaaucuggcuagcuaguaaaugccaggguucugcuuucucccccucaguaaugagauuacaggcauguaccacacaccacccagguugauguggguucuagagaucgagcuccgggcuuuuggcuucaacuuuaaaauagaaacacaaucauggaauccguucuauggagaugcuauucuucucagauugucucaugguuucccagaaaauuucccauagaauugcacaaaucuaggaagacugucauugccaucacagauggagucacaccgcaacaugaaugcuucauuauuuaucaauugcucggucaauggauuugcuaugaccuaaauguguuugccaaaauuaaugucacaccuuaaaaacaacucucauaguauuaagauaaauguucaaaagaacugauuaaaucaugagagcuuugcucucaguaaugugauuggagccuuuauaaaagggguugaaggaagcacccugaugucuuaucuguucuuucuuccuccaugugaggacacaucuucaacuucaugugaggucacaauaggaaugcagcaccuuauaagcagagugcaagcccuuaucaggccuugcaucugcagauacauucuucuuggaauuuccagccucuacaacauuaugauguguauuccgauuaauaauuauggaugcuaagacauuuuguuacagcagcaacaauggacuaagacaauaugugugugcauucuagaaagacaauucuauuucuaauauuuacuaaucauaauagccuguacaggagaaagucuugaauuuuaguccaauuauacuacuauagaccagguggccuugugagcuuacaucgccaauuauuuguuuaggccaaaguauuuugaugcuggggucauccuuaucagauagcacuaagaaugacuuccuucaacagacauaacaaucuaugcuuagaacuacaaagguuauguaggaaucauugaaagcccuacucagucccuacucagagccaauagccagugaacaguagagucaauaaauaaauuuucuccagaucacacaagcaaacuauugauauuuuugagauuucauagaagacaaugaucuucugacuucuaucaaaagaaaccugcauuuggcaaggcuauacuucuaccuccuggcauguagaaagcacagacucuaccagacuuugggaggagccugcggauaaaggaacugacccuagagacaacaagaaaaaggaccauucagaauaccauggagguaugaacccaagaaacugcuccauccaguuucuuguuagggcuucagcaucccgaccuuguucugcucugucuccccagcgcucucgaggccaucugaugcaccuuauccacucugacccgccauauccauugcugcuuauuugucugucuuaaccaauggcagcaccucaagagccaugauuuaugucuauuuguccugaucccaaucccaacauuuacagucuaguauaaaguaguccuucuaagaauacuauuuugauggaaaaaaagaaggaagaaacaagggaggaaggaagcagccaauagccagugcuuaguauucuaugccuuuuccccuugguauuuacccgcucuuagcucagcucugcugaacagaacuuccacaccaagagucacaguguaggcacugacucuuuccugcguggggcauauaaccugcuaggcacagugguaaagagaugcuuuggagacauccaugacagagcacaugacugaaaaacaaguggcuguggagauagcucagugguuaaaguguuugcuacacaaaugugaggaggaagagagcuauacuguccaguaaccuuauaaaagcuggauccagugguccacaucuguaauccuagcauuccuucuucuuuuuuuuuuguuuuuuguuuuuguuuuuucgagacaggguuucucuguauaucccuggcuguccuggaacucacuuuguagaccaggcuggccuugaacuaaaaaauucaccugccucugccucccaagugcugggauuaaaggcgugcgccaccacaccuggcuaauccuagcauuccuaaugugaaaugagaaucagugacugaaucaacagaaacgcauguggggaauaaaggggaaacgaggaggcaaauggauagggaaauuuuugagaagcccuaacaauuaagcauugaugcagggauaaacagaaguaucuagaaguuagauaaaaaacaaacauagauaugauuuuuggagccagaagcagcugauguguugccuucuagaaguggucuuugauguacucaggcauaaaauauggagacuagguaccuccugcuaauaucuucuaguagcuucuaugggaaaaaaaaaaucccauaacccuuauuugcagagaggcagcugcagcuuucccuuugucuggucuccucacaagcgcucacucucagaagucaguaugcuuuucccauggagcagaugggaugcuagcuggaguuguccugcuuuucagagcucugccucucuugagcucccacaguguguggcagugaaaacaaaucuggcucaccaguuccuggcccccugcagcuacucagccagcuuugcuaauauccaugcccaaagcaccaaaccauagacccaaggugagaacuucugucuuuuggauggaauuucuuuaacaguuguuucauauauuuggagaaagagaaaaaaggacagaugcaacaggaagaggggagaaggagaugaggagggggagaaaaggacagaguacauaagagcacaagcaauagaaguuaauuauaagagaagucagggacccuguccaaggacucagaugugcacuagcugggcagccucaggagcagcucagcagacuggagacaguggcauaugaccagagucuagcacaguuuuaacauguacagagcacuugguccaugccaguuauaguuuugcauagccagagacagccucugaguugauaggcucuuugguauucuacacaaagucaagcaacaauauucauaucaaacaaaugucuggaacucuguagcauaacaacccuccucuacauccacgagaugcauucugagaugccaguggauuccuggaaccacagacaguaccaaaaccuuuauagcccauccuuugcgauauucagaaaucaugugauggacuuucauuuauaaauuagauacaauaagaucuguucucauuguggguuuuagcaugcuaagaacauauucucccuucccccaaucaugaacuuucacuuuucuccuuucacuuaaagacagcuccuuagggcuucuuuuuagaggauguauguacauugaccaucuacuauggacuuggggccccuguuaagugagaggguaccuccaacaugcagucuaccagauaagccaaguagagcagccaguagguaucaggcagacagacuuagagugcuugacagagggauaauucaugcuuccauaggacagagugacagggcccucaugauuguguucaguuuaaaacacaauaaguuacccauuuaugaaauuuucuauuucauauuuuucgucuucaagaaaguaaaacuccuaaaacauaggauggaacagguuaggaaaaacuucaagaauucuuaaaggggagaguauuuagcuuuggugaaaauacuucuuaccacuugcuuaagggaaaacugagcccacaguguguuaacgccauauuagaagauucuaggucaucaaauaguguguugaaaguaauucauauguccaguucuacucuuucuuuugacccuccuccccgccacacacacacaccuuuucucaaugacuccugcccuaaugacuuccacuccccuaacaacuugucucuuuccuccccuucuguggccaacuacuuucuuguagauaccauuuaaaaucuucacauauauuuccuguagggaaggcuugcagguagcauucugcagcuaguucugcaaagggauuuucaaaggacuuuuugaaauccacagagcugaguauauuuugguaaaacaaagcacagguuuuguuuauuugccuggguuugcuguuugaagugcuguagucucccucuggggccuccuccccucuuccuaccagcaccuuggaagcaucccuuccuguacuguguagauucuuuuucaauagugcauaugcugcuguaguagugccuguuugcuuuaggucauauuucuucccgggauggauuuucuaugaagaucaacccuacuccuuugaucuuuaauuucagaucuugucauuuucuuucuagaguuccuuuugaaagaaauguuucuuuuuggcagaacaacuuucugugggccucaguggguguuaauggcacuuucauuuaucaucacaggcgcugugaguuucuagcaggauagucgaguccuguuguaauuugaaggagaaauaaauucugcaguuuaggccauuuuaguucauuuuggccucuauggagaaaagggaagcuaauaacacuggccacauuuaucugagaggaggucuccaucagcacguuguuuccuagccuaaugaaugcucagaaaagauguucauucaccuacaucacucuuucugcagaagaauaaaaccaugacuaaggugcuauguuuaaggguaggauuguaaaaaagccuucuucauuuuacauaucaggaaggcugacucuugacaugaauaaugguuccuacaaggucccugcaugcagaaggguuagaaaccaacgggucccaggaauuagauacucagucucuccugggccaggcuucgaaagcuacccucccucuacuaaaacuaguagccucaauucacacagugacuagaucccagcaauaaugaacauagauccucuaugcauauccaguaaugaaggccauuuucaugggcacuuuauaugcagauacccauccaucagucucuauauuugcaugucuguaucuauuacccaaaacuagcaagaauuucuuaagggcuguuuucuugcuuaaagcucagaauuuaaaaggcugaaagucauuuuacuaacuuuaacuugccaauguugaacauccuccccaaagaugagcacuaugguuauuuccagcuuaauuauauaccacuuucccauauccaaaacaaaaugaguuuauuaauauuuuauucagcuucaacccugaucaccugcugcaaacucuaaaagacuuuucuccuucugcaaccuuccucccuccagugcaucugcucauugccucauggcgcauuuuuguggcugggauguuugaagaccggaagcuccaugagggaaggaugucuacauagucaccgauguuucuuaagcacaugggaaggauuauuauaagucuguguuuuauuguguauuaggcucugggaggaaaugcuccuuuaaugucucuauuucucauucccaauaggcaccaaaggagcgacagcucuguaugucuccuauguaaguuggguucugacacggguggucauugugcaccaauugucacugggguccccuaucaucaguguaacuauuaaaauuucuccugcccauuucuagaaagcaugugugacuccaguaagagucugucuguaagguucuggagaacacaggccaaaggagcccucuacauaaaugauccagcuaccuuguagcauuuuagggaucccucucagagauggcacauugucuuucuaugucccauguucaacagagucaaaaguccuuuuacacaauuaaagagagcaauagucuaagguaaaacucagcaguauaggguucuuccuguauccaucauuaccaaauauauacacuaguauuuauucagugcuucugaacucagcuccaugcuuugcaaaacacgcuaucaaguaccaacaaugcccugcccccaugguugcaaaaguguaaacgcacucgaccucagaaucucagcuaauuuauucuccuguuuuggguagcaaguagguacuacacaaagagaaguuugacugguuucuuuuuacuauacuagucagucacucaauggugauggauuaaauuagagaaagaaagacaaugacaucucaagucagagauggcaaaaguggcagcuauuucuaugacaaaacaucaauaauuaauugcuaauagucuccuggauagauaaaaaguauugggcaccagcagcuauaauuaacauggcaccggaugucaucuugcuaggugacaauggauuacgaaggugaauaaugaugcucacacaaugcccauacugagaacagcuguacguaaguguuuuauaaguauuuccucacuaagcuacggaucccacacagucuuuauuuuucagauaaagaaccaagacacagacaagaaaagaaaaaguugcccagacagaaauuccugggacaaguguuuauacucaguuuggcccaauaccagagggccuucaucucuacuugauauauuaacuauucuugguugucugaaauguucagcuuuccucacaaauacaaggagguaagugggcaguguuuuuaugaguuuucauuaaagcaguguaugguggaguguucucugucacucaccccgaccuguuguaagccuuccgagcuggauccaucagucucuguagaacugacguuugaucaggcuggucacuuggaacugacuugucacaacccacauuaaggaagcacuuagcgagccagcucacucccaugucaagagacuuagguaagaaucccuuuugaucuuuccuaaaauuaaaaugaaaagccacacacaggcagcaucacagaauaacaaguguucaacucuauacaaaaaaaaagacagaaauagaaccaguucuuugguauuuaaccacaagauugucccauuugauauuugauuuugaacccuaccuacucucagauuuugacguuucauucuauauucaaaguuuuuuaaauuuagucaucaaaaacaagaauccgagugguaaaauuuuuguuucuuugucuccaggauugaagaaaauuucccucuggcauguaccauaaauaaguagagaaaauacagauagaaacuuuuuguguugguucaguaacuucuaagaaaucaauaauuuucgguuuuccgcuacaauccucagagaacauuugauauaucucuuauucucugacaucuuucuuuauucucugaagcaagaguauccuaccuaacaguuuaugccugcagaugacagaguaugcuggccuuaacguuauaccuuuucagagaaagacaaaacuuccccaacagaggcucuccagggcuugaucagagguucugugccacauuggagucuuucagcuaagaaaagcaaugugugaguuacucaaaaaccaguauguuugauuaaggcagauuuguggaaauagcuucccuaagaguuuaugcgauucuuucaauguagcagcuuguugaguaguguauguaauuucuuucuuccuuugaggcagagucuccuuuggucacuuuuguuggccugaaacucagaauucucauguuucagaguuucuaguacugggaaaauagguaugugcuauuauaucuauauaugucuucuuuaaagaguagaauuuuguuuaaagaaguggccaugcauacugcauauauacuugacauauaugcuaauauauauauauauauauguauauguauauauguauauauauauguauauauguauauguauauauacauacacacacacacauauauauauauauauaaacugugagacaguuaguaagcaagacagauuuacucaaggaacucauuuuguauuaugaaaacuuuccaagacagauaaucuguaguguuucaaaugcaccuuggcuuaaucacaaugcauauugggaagcacauaagaauaaaagacagaauuuuauacagaauuauguuuauuuacauguccuuguuaaccacuggaugccaagaaaaaggugauagcuaaacuacaauaaucucuccagauugccugaaaaauagagcuaguaacagggauaaaagauuuuaaacugugagcacaaaugagagguaaauuaaucuguucuaucuaucuaucuaucuaucuaucuaucuaucuaucuaucuaucuaucuaucuaucuaucuaucuaucuguuacuuggguuuugacaguauaauucuaaauaaagaguucauauuuaccacucaagauuuaaauuauuucuagguuucuacuuccccauauuucuguaccacaacaugaggaugugagagacuauggaauccaugaacuuaaagccagauggaggacuugcacaaagauucaacagguaguggcuaagccugauggcauauguuugauucccagaauucccugugcuaugcagcagcaugugugcacacagacauguaugcuccugguguuuuuuugcuuauuuaaaauagaucuauagcagaagaccuguaaagcguggccaggagacucccugcuuucuuccuucuaugcugacucggcuacggcacuuaaaacauccaugccugcaaggcuucacuauacuugccaaaugaguugaugaggcaguacagaacaaacacuuacuauucuaugaauauuguguucccuauuuccaacaccucugaagauaagugaauccacuuuggccaguuuuggccaagagacacugaauaaaaguauuacauuaagggccaaggcauguaggcaucaguaguaugucacaguccagcugcuucucugcugcagcuacaggaaagaggcugcauauagagaugucagaauugucuaccacaaaguucugcugcauugaaagggguacggcccuaaagggccauacauuguguggaaagggcaguagaugugugcauuguacuccugguuuggauggaagggauugcccaaacuggcauagaguauugggauaauguuuauaaacugucaguauagccagaguaagcugaaguuaaauggugaugcauaaguuaaaauucagauaguuuugugucugugccuggagaaauauuauaaaaucaaugaaguaauccacauugcaaaggagacagaaaguuucuagggaaguuuuccuuuaagaaagaucuggcaacaaauacaugacuuccaaagaaauguucuaagguaguaugauaaaucuguaaugcuaaacaaaugcaccaugggcuccccauuggaggaugcugaaaugugugcugucaugguaauccccugaaaacuuauauuugauuuagaaagcaaucagagguuguuggaaagucucugggauuucacaauguucacuugucccgagcagguaaaaaaggucaaaguaaaaauuaauuaaucaguauauagaaucaccauacccuaucuauagucuacacacuaaaugcacauuaucuuucuauagacacaaauguccucauuaucagggauaugguugacuauagcagguccagacaccccaggaugauucugagcauugccuuuugcauaggaauagagacauucucaaaacagauucaccauuaagaacucugggaaguuucaacugugcaagcauccaacguuuuuaauugggucauuggcucccugggugauuuacacaaaaugcauacucaggaaugauauucucauaacaauguaccucuuucccucaacugugauaggaaggcagggaggggacuggcauuaaccacacccuaagcaugcugauccccucaacccacuguuucagcuacagagcugcagugugacaucauaagaagcaauaguauuuauuaccuuuacgugauaugggugcuuaggugggaggagauacccacuggaucucuuuguaauuagguaacuuaacaggcucuuuuuucugcaccuucauuuguuccucuauaaaaugaggcaccaugacugaccuaguucuugugguucucaugaagauguuuccugcuucaugaaaggcacucaauaauugucgacuacuuguauuaugagucuuauuggcgugaguuaguuaccagugauaugccauuguucuuuuuaauuacuggcauccuaugguuaugucugugguaaugacaaucaccaaagugcucacuagucuaguaagugacuccaguggguuaccugagucagcauucagugcaauacuacccuagacuguucucuuaauaacuaaagacacugagacuaaaaagacugagaaguuuuuaugauuugagaauaaaaagcccuucccaggaccauauuacaagcccuuggucccagguuugucgcagaauuucaaagguugggaagacuugaagagaugggacauugcuggaagaauugagucacuuugggcaggucuuugaaaauauuaccugagucugguuccagaccaugcuguuuggugcuaucugagaugugaagaggcaugccuucaugcuucucuagcuauauagagagcaguauccaucuccaagucauugcugucauaaugggcuaaaaucucucugaaacuagaagccuaauuaaacuucgcuuaaggucugccagguguucuguuuuuugaguuuugguuuuagguuuuuugggguuuuguuguuguuguuguuugauauuuucuuuauugacauuucaaauguuauccccuuuccuucuuuccccucagaaaacucccuauccccucccaccucccccugugcaccaaccuacccacucuugcuuccuggcccuggcagcccccuauacuggggcauagaaucuucacagagccaagggccucuccucccauugauaagcaacuaggccauccucugcuacauaugcaucuacagccaugagucccaccauguguuuucuuugguuugugguuuagucccagggaacuuuggagguacugguuaguuuauauuguuguuccuccuauggggcuccaaacuccuucagcuccuuggguacuuucucuaguuccuuuauuggggaaccugugcuuugucuaguggaugacugugagaauccacuucugcauuugucaggcacuggcagagccucucaggagacagcuauaucagguuccugucagcaagcucuuguggguauccacaauagugucugaauuuggugguuguauaugggauagaucccaagauggggaagucacuagauagucauuccuucagucucugcuucauacuuuguuucuguaacuccucccauggguaauuucuucccccuucuaacaaagaagagaaaguauccacacuuuggucuuccuucuucuugaguuucauguguuuugcaaauuggauauuggguauuucgagcuucugggcuaauauccccuuaucacugaguacauauaauguguguucuuuugugauuggguuaccucacuuaggaugauauccuccagauccauccauuugcuuaagaauuucauaaauucuacccauaaucccagcacuugggaugcagaggcagguggguuucugaguuugagaccagccuggucuacagagugaguuccaggacagccagggcuacacagagaaacccugucuugaaaaaccaaauuaaaaaaaaaagaauuucauaaauuuauuguuuuuaauagcugcauaguacuccauuguguaaauguaccacauuuucuguauccauuucucuguugggcaacaucuugauucuuuccagcuucugacuauuauaaauaaggcugcuaugaacacaguggaacauguguccuucuuacaaguuggaguaucuucuggguauaugcccaggaaugguauugcuggguucucagauauuacuauguccaauuuuaugaggaaccaccaaacugauuuccagagugguuguaccagcuugcaaucccaccagcaaugaagugucuuagcagcuucugcugucaccugaguuauugaucuuagccauucugacuagugugagguaaaaucucaggguuguuuugauuugcauuucccuugcgauuaaggauguugauugauugauugauugauuuuggugcuucucugccauucaguauugcucaguugagaauucuuuguuuagcucuguaccccauuuuucaauaggguuauuugguuuucuugagucuaacuucuuaaggucuuuguauauauuggauguuagcccccuaucagauuuaggauuggcaaagaucauuucucaaucuguugacugccuauuuguucuauugacaguguccuuugccuuacagaagcuuugcaauuuuaugaggucccauuugucaauuccuguucauacaguacuagcuauugcuguucuguucaggaaucuuuccccugugcccauauguucaaggcucuuccccacuuucuccucuauaaguuucaguguuucuguuuuuauguggaguuccuugacccacuuagacuugagcuuuguacaaggagauaagaauggaucgauuuguaaucuuuugcaugcuaaccaacagcugagccagcaccauuuguugaaaauucugucuuuuuuccaauggaugguuugagcucuuuugucaaagaucaagugaccacaaguguguggguucauuucugagucuucaguucuauucuauugaucuauucuaucugucauuguaccaguaccaugcaguguuuaucacauuugcucuauaguacagcuuaaggugacuccaacagagguucuuuuauuguugcuaauaguuuuugcuauccuagguuuuuuguuauuccagauaaauuugcaaauugcccuuucuaacucugugaagaauugaguuggaauuuugagggggguugcauugaaucuguagauugcuuuuggcaagauagccauuuuuauuauauuaauccugccuauccaugagcaugagagaacuuuccaucuucugagaucuucuucacuuucuuucuucagagacuuguucuuaucauacagauuuuucacuugcugaguuagagucacaccaagcuauuuuauauuauuugugauguuugugaaggguguuguuuuccuaauuucuuucucacccuguuuauccuuuauguagagaaaggccacugauuuguuugaguuaagauuguauccagcuacuucacugaaguuguuuaucugguuaggaguucucugguggaauuuuuagggucauaucaucugcaaaucaugauauuuugacuucuuccuuuccaauauuuauuucuuugaucuccuuuuguugucuaauugcucuggcuaggacuucaaguacuauguucaauagguagggagagaguaggcagccuugccuaguuccuaauuuuagugggauugcuucaacuuucucuccauuuauuuugauguuggcuacugguuugcuguauauugcuuuuauuauguuuagguaugggccuugaauuuuugauguuuccaagauuuuaucaugaagggguguugaauuuugucaaaugcuuucucugaaucuaaugagaugaucaugugguuuuuuuguuuuuguuuuuguuuuuuuguuuuuuuuuuuuuuuuuuuuuuuuuuugguuugucuauauaguggauuacguugauggauuuccauauguugaaccauucuugcaucccugggaugaagccuacuugaucaugauggaugaucguuuugauguguucuuggauuugguuuaugagaauuuuauugaggauuuuugcaucaauauccauaagggaaauuggucugagguucucuuucuuuguuggguuuucgugugguuuagguaucagaguaauugaggcuucauagaaugaacuggguagaguaccuucuguuucuauuuuguggaauaguuugaggaaaauuggaauugggucuuuauugaagguaugauagaacuccgcacuaaacccaucuggccguguuuuuguuuguuuguuuguuuguuuauuuguuuguuuguuugggagacuauuaaugacuauuucuggguuuuuuuaggggauauggacagguuagaucguuaaucugauccugauuuaacuucgguacuagucucugucuagaaaauugucccuuucauccauauuuuccaguuuugcugaguauaggcuuuuugaaguaggaucugaugcuauuuucgauuuccucaguuucuguuguuaugucucccuuuucauuucugauuuucuuaaucaggauacugucccugugccuaguuagucuagcuaaggguuuaucuaucuuauugauuuucucuaagaaccagcuccagauuugguugauucauuguuuaguucauuucauuuucacuugguugauuucuguccugaguuugauuauuuccugccaucuacuccucuugggugaauugcuuccuuuuauucuagagcuuuuaggugugcugucaagcuacuacuguaugcucucuccaguuucuuuugaaggcccucagagcuaugaguuuuccucuuaagauugcuuuccuugugccccauaaguuuggauauguuguggcuucauuuucauuaaacucuaaauagucuuuaauuucuuucuuuauuucuucuuugaccagguuauuauuugaguagaguauuguucagcuuccauguguaugugagcuuucuauuauuuacauuguuauugaagaucagccuuaguccguuuugaucugauagaaugcaugggauuauuucaauauguuuguauguguugaggccuguuuugugacugauuauauagccaauuuuggagaagguaccaugaggugcugagaagaagguauauauccuugucuuagcauaacauggucuauagauauguguuaauacauuuguuucauaauuucuguuaauuucacugugucucuguuuaguuuuuaauuccaugaucuguccauugaugagaaugggauguugaagucuccuacuauuauuguguguagugcaaugugugcuuugagcuuuaguaaaguuucuuuaaugaauguggauguccuuuuauuuggagcauagacauuaagaauugagaguucaucuuguuagauuuuaccuuugaugaguaugaagugucccuccuugucuuuuuuuuuuuuuuuuuuuuuuuuuuuuuuuuuuuugguuaacuuuagguugaaagucucuuuuauuugguauuaaaauuacuacuccaguuuauuucuugggaccauuugcuugacaaauuguuuucaagccuuuuacucgagguagugucugucuuugucccugagguggguuuccuguaugcacucaaauguuggguccuguuuauauagccagucuguuagucuauguuguuuaaugguggcauuguguccauugauauuaagagauauuaaggaaaagucauuguuguuuccuguuuuuuguuuguuuguuuguuuguuguuguuguuauuguuagaguugggauucuguucauguggcuaucuucuuuuagguuuguugaaugauuacuuucuuuccuuuucuaggguguaguuucccuccauguguuagaguuuucccuuuauuauccuuugaagggcuggauuuguggaaagauauuguguaaauuugguuuuaucauggaauacuuugguuucuccauauaugguaauugagaguuugccugggagagcauuuguguucucuuggagucuguaugacaucuguccagaaucuucuggcuuucauagucucuugugagaaguuugguauaauucuaauaggucugccuuuauauguuacuugacauuuuucccuuacugcuuuuaauauucuuucuuuguuuugugcaguugguauuuugauuauuaugugaugggaggaauuuuuuuucggguccaaacuauuuggaguucuguguauguucaugggcaucucuuucuuuagguuagagcaguuuucuucuauaauuuuguggaagauauuuacugacccuuuaaguugaaaaucauuuucaucuauaccuuuuauccuuagguuugguuuucucauuguguccuggauuuccuggaugcuuugaguuaggaucuuuuuguauuuugcauuuucuuugauuguuguguccauguuuuccaucguaucuucugcaccugagacucucucuucuaucucuuauauucuguuggugaugcuuuuuaucugucacuccugauuucuuuccuagguuuucuaucuccagaguugucucccuuuaugauuucuuuauuguuucuacuuccauuuuuagauccugaaugguuuugcccaauuccuuuaccuguuuaguuguguuuuccuauaauucuuuaagggauuuuucuguuuccucuuuaaggccuucuaccuguuuuccuguguucuccuguaauucuuuaagagauuuuuguguuuccucuuuaauggcuucuaccuauuuaguuguggucuccuguauuucuuuaagggaguuaguaauguccuucuuaaagcaucaugagauaugauuuuuuuuuuuuuuuuuuuuuuuuuuuuuuugguuuuucgauacaggguuucucuguauagcccuggcuguccuggaacucacuuuguagaccaggcuggccucaaacucagaaaucccccugccucugccucccgagugcugggaucaacagugugugccaccacgccgggcugugauauaauuuuaaaucugaaucuuguuuuugugguguguuggguauccaggacgcacuguggugggaguacuggguucugaugaugacaaguagucuugguuucuuuugguaagauucuuguguuugccuuuugccaucugguaacgucuaguauuagauguucuugcugccucuggcuggaacuuguuccuccugugagucuguaacccuauguuagcacuccugggaaaccagcucuuuccuugcaaaaccagugcacagggggcugcggagagccccaucucuugggugaagauguaggccuauaggacccugucccagcugcucugcugcuucuguggccugugugcuccugaguagaccuaccuuagagugucaccaaagagauaaucuagguguucuguuaugaugauuagaaaggguguaauacaagcaguuuguauaaacuaaagaggcaccaaauccagaagagacaccacuucccugacuccagagccugcacacucagucacuggcuacuguuccagaauguuaucagauacaucgugucaucuccuugcucacacuaaucaacccucauaucagggcacuggguuuacaacuugcaguugcuuuaguguaaucuguaauagucucagagaacugcaaaccuggaacacugccugcucaauaaucuuaaucaguguacaaaugacuagggagguugcucagggauuuguauagacaugcugcccaaagguaaggaccagaguuugauuccugguacugauguaaaagacugggcaaaaucacauacaaccugcuacucgguacuuugccuggggacauaguuccgugggaaaugggcauugcugcuuaagcacaagaaccugagcuaaauuuccagcacccuuauagaaagcuauguguggccaugcacacaacuguaacccuagcauuaagggugacagagauaggaggauggcugcgccuuggugacugaaacagcuagcuccaaguucagugagaugccuugccucuagggaauaaggcagagagggacuaagucucugagaccauuaaugcugacacugaagcaaccucugacuccaaguaauaugaggagcccugagaugucaugcuguaugagaggaccuucuggaccauuaagcggggacuaaagguacaggcuuuggguuguuguuagcgcuaugugacauagggcaccaaauguuuagcucuggcuucuauaugucuauacacaggcauguguacauacaguacauauauacucauacgaaugguaggagaagagcuuacaaacucauguucaccauugacgccagaucuagaacuucauuuauggccaauagcuaagggacuaugcauuguucucagggacagcagagcaugguugacucuuaagcacugguccuacuucuucugaguagcugaauaaauaaucuuguuauuuguucucaugagugcagccuguucucccuggcuaagcuaacucauuauuuaccgacuaugugaccugcccucuuuccugaugugcacccuggauuucaagcuacuugguccauaaacuagauucucacagaguuuagcucucuccuggccucaguucuuauuugggugaagccuugaccuccuuucauuucaaagcccagugggcagccuucaccauuccacaugcuuacuuaacuccugucauuuggaagaaguggcuaauucaugaaaaccacuuuaugcucuaucauaauuagacuguuggacagagucuguuucaggagcccuauguacaaaucauaaggcuaaugcuguuucuaggucuuucugggcauuuauuaaccauuaagucauaggggcuuagcuucuaccauuuaaucucgucucuuguggcaagcuguauuucuguuuuuacccauuucucuggcucuaaguaaaggauggagcaccucucccuuaccugaaaugggauacauccuauugcuaaguuggcuguggaacuugauuuguucuuuggaauauaaauaugaguguguuucuucuaaggacucauccaaauuguuguacuauguccucugcaucaaggcagcaugaccagaggaagagauucucuguugacuugggacuguaaacacauaugaaucagauucaucaccaaucacagagcuaugaguaagaaguuacuacuuacuuuuucagguuguuuguugccauauccaacaaauucuuuagcacagauuauuuaacaaacaaagucaaugcuucauuuucaguugaaucuguguaaggcuauauuuauuauauuaaaugaaagccuauucaugugugaaguuacuaaacacugauagaaucaagcaaugcugugagguagcaaaaaugaccagcagggcaugauaauacuaacgaugcaacagugacauacauauauuggugguaacaaacaugucucuaguuagacuagaggcccacuuagcaggaaggaaaucaugccuagugcugaaaaccuaaccaacuaaccagggaucauaaagucauggaucuuuuuagagaacauauaacugccacuucauuaaaacagcauaauccccaauuacauucuaaauauuugcccuauacucacagauaaguauaguucucauuucucauaaaggaaacaucucauuacaaacuauggagacuaucacagaaaaucacaaggaauaaacauauagaguugugaaaccuagucucaacugccauggcuauaacacuacuucuggaccuaagguuugaguauuauucagaugaggagauagaaagauagagagagccagaggaucaggaaguuugcuuugauauugugucuuguagaacuaucagagaagcuauaacaaugaagucucagcaacauuacuuccuaaacaugaccugcacaaggaugacaucaguagaaugccaaagugaaaucacgagaccucagcccuaaccaaagaagucuaggcagcucaggaaugcugagguuggggaaguacucuuaacucagggaagaccacaccgauugguuaugaaauaccaaauggucagcucuaaagacauaugcauacaagaaacauuauacagacugagcacgcaagagaguauaugggagauauuggaguaaggaagagaaaugguguaacuagauuauaaucacucaaaaugaaaaaaauauaauaauaaaauagagauauugugaaguaaaaccugaggccuuggaggcccacuuguguuaaaagauccaaggaaguaugcuacaugaugcaagugaagauguacauuuuaccugacaaguggucugcuacaaaggcugggaaggaggauagagucauaagacagagaacaucguaugaccacgaugaccaagaucaaagcacuguugaugcagcuucagccaagaagcagcaaagguugauggcaacuaccaggagccagggggaaaggauagcucuccccauggugauagagggagguugguacuauuaacccccuaauuuuagauuucuaguguucagaacuaugaaaugauaauuuuguuucauuaagaguccgcuguaugguacuuuuuaaugaaaaauacaagaaauacuagggaauuuuaaccagacccccagguaaacuucagccagaaaucaauacaguaccucauaaaguguuucuaaucacaccucuguccacacaauguccacagaaacaagugaaauagcaguauuuuugugacuagaauggccauauauacuacgugagaacucaggaaguucuaagaugcugacucaguuuguccacuuucuuuuggugauuuuuguuaacuguuagcauuuacaucccaaaauaguccacuacagcacuccagauguccuagguaguuaaaugauaacgcauagagguaaaacugugccuggcaaaauauguguuuuaacacuagcaggaggacugguaagugugguagcauuguuguauucuguugaaggccuaucucaugcuagagauuauggaguggaguuuugacuucaugcucacuauaccaucagaggacagagaggaagcuagcuucccuaccucuucuuggagcacaagucucauuuaggagguucuauuaucaugggaaucaugacagugaaaaaaguguaacauaaaaacaaaaacuaggccuuuaggcccaagcuugagaaaugaccuuugugacucaaugcccuaagguaugcuaaucauaaaacagguagccacauuccuccacccacccacuuccuggguucggggaguguucauuccaagaaagucacccugaccugcccugaccacuccaggaacccacaaugcaaauaugcuauuguuagagacucauagaaacugucuugacucccacucccuagugacucuuaacugguauuuuugguauuuuccaacaacacccucccuacccccuugaguuuuaguuucuuccuuuaaauaaacccuguaccagcuacuuggggcccaugguccucuaccccugcgugguguacgacugugggucccagaaugugccuggaauaaaaguccucuugcaguuugcaucaagaccauuucuugugagugauuugggguaucuacucuccugagucagaauguggaggaguccucacauugugggucuuucaacagggcccagauuucaacauuuuucaacucauuuagagggacauaggcauucugucuguaacagaaaaauaaauacaaauaccuagaaagaucugucagcauacuguugcaggacauuuggucacauggugaacucugaaauuguuuugguuacuggaaaaaccuguuucuagauguggugugacucagucuuagcacacacuuuuaaucccucuggcuggaauacagacaugcccuuaguacacaucuuuaaucaccaacaaugaagguaaaguuaguuuguagaaagaaacacccauuuuugaaggugaugucuaacugaguggcagacaaaguggugaaucagagaacaauuugagaaaauaggauaugcucaacuuucacaagaacagagcucauagagauguaacuuaaaagagagcagcacagaggaggggggguuacugggauaauuguauagacacagauugaagagagaacaaacuagacacagaauaaggagccagaagauuagaacauauugccaaaguuaguaugaggcuaagcugagcaauucaggagaagccaaaagaagucagaucaaaucagucagcauggagaagaguuugagccaaaacaacuauguugcaucagccagcaagccagagcucagaaagaacuaggaaggggugaucuuauucaguagcuagucucagaggcugaaaauauucuaggccuagauuagauuguacggaggguagaagcuuccaggccuauguuagcagauggaggcaauaagccuuggagaggacaauuacaucaggugaauaaaauauaguuguacaauguacaaaucuggagacauacaugucuaaauuucuaucugccugugcaaauuuugaucaagugaaucaugggaaaucacagaguggauuuucucaacagauucccaaguguuuuaaaacuacucauacuuugugcccuuuucucaagcugaagcugaucaacucaccuuuacaugcauacuagauaccacaugcacacagacugcccugugaguccccuaccacccaugcacacagacugcccugugaguccccuaccacccaugcacagauugcccugugaguccccuuaccaucugacucuguaaagucaguauuucccuaagaguuacaaucuccucucaacacauugauuauguggaucaaaauccucuggcucucaucagcaugggccaaaauagucauuaccauagauuuucuacucuucucuuuuaauggacuaagcuuuuagguucuggguaauucuuuggaugucagacaaaacauaaacucuuuuuuaggugcagacaaaaagugagaauaguguuccuuugcucaucaguggagguuuguagccuuucccucuaucugugcugagguaauugugugcacacacaaagcucuccuuccuacucuucauuuggcuauuaaugaauauuuguguggaucauuccuucuguaauugcagugacaaaggggggaagaaguguugugcugaagcuagaauguuuuuaagcauuuuuucggcuauuacccaggacuaacauuagcaagucaauuccuaugggcggagcugggaguuuccauacacaaaggauugcauuccaaccuaccaaaagucaacagauaggggaccuugaggcuugaauaaaucaccuuugaugugucuuucuccuagaugagcucaaaauuccuccuuugcuggggugagauuuaacccccaucccaaguaucauugcuuucugugagaaagaaaacuaucuccuccuagcugcauuagaaacaugcgcuuacauaucugaagaccgcuggcucauuacacugauuaguuccuuguaauucuaugaagaaacuccugggcuuuaauggaucagauauuggaugauuaaauuuaguccugugguacauucacuuaagaaacagcagugaggaaaaagguaccuugacagcuugagaguaugguaggaacacaaaaguccccuuggggaagaugcguaccaaacacccaagcaaccauugucuucauuagcaccuaacucuuugcuacuaugucuggcucccuaucacucaagucaaauaucuugcugccauacucaagacagucuuccccuaaguuuaugaaggagguaagauuuucagguuaagacuuucaauauuagaaggaccugcucauucuuagcagggaaaagaaggguucuuguaggacauuaggcaaugagaagcuauucugcaggauucuccagguuucauaggcugacuccucugcacugccccauacuguuagacugggacuucacauguauuguaccugcugcucaaggaaggaaaugaaccacacggagacuuuucaaagcuuggugcugcccugacacauuuguacuauuucaucugauccaguuacagaucuaguaaguagauagcaacuggcuggcaaggauguuggaugccauagcacccaaugaacccacucaacauuuuuucuuucuuccagcugaccugugccagugccagaugacuuggcccucggguuuuccuguguguggauguggcucacucccuuuuuaggaaugucauuugaauucagauuauuauggaaugaaugggcucaaggaccugcugcuuuggacugucugcugaauucaaauuuuugaguaauugaguacaggcuguuaacacaugcagccacuuccuuccuuuacuaguagggagaaauagcuucugccacugccauaaguguuacacaguggcucagcggaagcugccuaucaaaagaaaugcagaaucgaagcuaggguauguauaggguaggugugugugugugugugugugugugugugugugugugugucacagcacagccaggucugagcaaugaauaaaugugacuccugcaaagacuagaauggcccaggcucauaauuaagacauguucuuuuccuacauaguaaguuuuuaguuguccuggggcuauuucuaauccuuaaugcaguagaugcuuauauaaccauuucugcaagcaaauuuugagcaauacuaauacuuggagaaacacaaaguaaguuuuuuaugagaaaagagguguuuccaaauuuucagccacuuacuccacuaaaggcaucucugggcaguuuucagggcauguuauucuauugaaaauauggcugagugguaccagagcacagaaaucugauuaacuuuaaguuaccaucucuagaacuaaaacauguggucaggagaucucuuacaaaugucucauggaauaugguuugcaauaguugguuuauuucaucuuaagagaacugacuuccucucuugaugcacgaccauggcucuagcuucuccuuucaugacacucaguuuauuuucuguccaaggccuugcaguacagugggugucuuagucaggguuucuauuccugcacaaacaucaugaccaagaaacaaguuggggaggaaaggguuuauucggcuuacacuuccauacugcuguucaucaccaaggaagucaggacuggaacucaagcaggucaggaagcaggaucugaugcagaggccauggagggauguuccuuauuggcuugcuuccccuggcuugcucagccugcucucuuauagaacucaagaacuaccagcccagggaugguaucacccacaaggggccuuccgcccuuaaucacucauugagaaaaugccccacagcuggaucucauggaggcacuuccucaacugaagcuccuuucucugugauaaguccagccugugucaaguugacacccaaaaccagccaauacaguggguaucuuaguuauauuuuauugcuaugaggagacaccaugaacaagacaacucuuguuaucuuaagcauuucgggggaugcuuccuugcaguuuuuguggguuagucuauaauuaucaucacuugaagaagacaggcaugacaugauacaguagcugugagauuuauauuguugugugcaaucagcaggcagagauaaggacacugggggcuggcauggauauuugaaacaucaaagccugucuccauaccucuuccuacaaagccacaccuacucaagcaaggucacaaauccuuccuaaacaguccacaaacuaggagcaaagcacuuaaauuuaugagcacaugggagccauuucuauucaaaccaucacugugggcaagagaaugaaacuuaaaggccaggacaguggccuguaucugcgagcaguggggucuucagugaauuccaaagccucuuugcacucugcuuaggcucccugacuucagcuucacucucuaccuacagucacauaucugguccccucauccuuguacugucagagagugauugcacagauucaaauuucuaggagaucccaggaucuggcucagcuccuaguggcccaugguuucuucaguuuucuccucuacaugagacacuaaugcuugcucuacuggauuuguauccuaacuccuaaaugcauagcagcauaaggcauuuaagugaauuguguaaccccuuccauguuaugguuuccuuagcuguaaaauagagauacuauuuauaaaauaguauauaaaauauuauaaaauagcuauaaaaguaacguucuuuguagauuguuucaagguauaaaauauuuuuguacacauuuacccccagaguuuuucugugcaucuuuuguagagcccuaguuuugauaaagguguuuauacagaagcagggguggaagagaaaauuuagaucuccauccagccuacuguccaugcuucaaccaaaucaaaacuaccuugacugauuuuccuuauauagcugugauuuggguaacuuauaauuuagagaaaagaaaagaaaagaaaagaaaagaaaagaaaaggaaaggaaaggaaaggaaaggaaaggaaaggaaaggaaaggaaaggaaaggaaaggaaaaaagauggucacugcuccauguaguaucuuucgcaucauuucaguguuauaugagaguuauuucaguuuuaaagaaagcaugcccaaauauuuuuaauccucuugaggagaaggaucacagucaucucuaaguauucagcacccagcccuuuaaaaacaauauacugggguugacauggaaacacagaccuuuaaucccagaacucagcaggcagaggucaguauaucucugugccuuugaggcuacccuggauuacacaucgagauuaagugaugagaccuugucuuaaaacaaaacaaaacaaaacaaaacaaaacaaaacaaaacaaaacaaaacaaggcaaaccaaaauuuauagcaaauaaggcaguaggucaccaccaacucagcccuguaccaccuaccucuguucucuagaaacuccucugaaaggucaaguucuggccuuuaaggucuguuuucaugguaggauucagaagcuaguugacauuagacaugaauggggauggggugggaaucugucaggacauuuuguccuuucuggcccaagcauuuucuacacaucuuccaggccugaguuaaaggcuugaagugacaaagccccauggagaguuguccccacugaaucugucaggaggaugauuuccuucauuacagcccagugcuucaccacugcggcucagcucucucuuuuaguuuaaagcuuuuuuuucaauacccagccuauagaacauggggcuacuagggccacaggcagaguuaccagagggcagagcuaucaccuuugggauuucuuguucgguucaaguaaucaccaagggcaggcucucaauuccaccuuucucuugaagacaaguacuugacccaucuuucagauucuuucccccuaaauucccuucuugagagccaaaacuauaacuuccaaaguuauuuucuuuauuuguauguguacauguuucuguuuaugcucggguguacauaaucuugcacgaccauguguguagcuuuuccauguuagguguuuuccacaaucauuaucaccuucauuuuuuuuuuuuuuaaggcagggucuguuagugaaucuggaauuuuccaauucacuagccagcuuaaacaucucagaaacugcccugucuuaccagcauugggauuauagguaugcauugauaugccuggcuuauuuauuuacuucaucauauugcuuuuuuuuaacuuuuagaagguguguguguguguguguguguguguguguauguguguaugcuacacucacgugugugcuauggcacauacauagaugucagaagacaacuuaugggaccugguuuucuccuuguaccaaguauguucugaggaucaaacucagcccauuggccuugacuauaagcgucuuuacccacugagcuauuucagcugcuaacuuucuuguugacgucuauuuguguggguguuggaaaucugagcucaagucuucuugcuuuuauagcaagaauuuucccaauggagccauuucccaagucaaaaauauaacuuuaugauaauaaaauaauggcaaaugucucauuuagcagaagagauuugggauuagcuagaucuugacaaugcauuaaaaagaaauugaguucauucccaacaauuaaaaauuaagagauuucauguugaaaucuugaauucagacuuaucuuuuuaauaaaaggauaaucuucuaagaguggugauauucucaugagauuacaguggggguaaguuuggugugggugguuaguaucugacauuccuaaaggauucugguagguaucuugagccuuuccauuuaguuuggacacagcugugagacacuguuauuauuuacuaguaauaacuuucaacaauguuccuaacauaauaaagggcauaucacaaacacauagcugaaaucacaucacacaggaaacacugaaaacauuuccuucaggcucuggaacaggacaggagugucagccucuaacaaucuugcucagcacaauauaaguuguggccauagcuaauauucaggagagagaauugaaggauuuucagucuagaaaugaggagggaaaauuaguucugauucuagauaacaggaacuaaagauucagucaagcauguguuagaacugacuggugaauuuaauaaaauuauaagauacaaaggaacaucagcugacagaaacuguuaauauuuuuuaaauuaauaaugaacugaacugaaacagaaaucacaaaauaauacuaugaaaaguagcuacagaagaaaaaaguagaaaugggaagaaugaaugguuucugcuaugccaagggccaaaguucuuucaaauuaacguggaauguauugucugaaccuuccacagagaugugagcccucauccuacacaguuauaccacacagcuucuaucagugugguugcugucuauggaaggacucggaauucuccuucuucccugucaguuauuuucccagaauccucuccucaguuguacuuuaacauauuucauuuaugaaggguugccaagaagauaaauagacuguuaaaccuuugauagguuucuagauuuuuuuaaaaacaacuucaauaauacugaaaccuuuuuguuuuaaauaauguugaaacaaugaaauuguuuuuaaaacuacaaaaauaauaaugauugauuuguguuaacccaguacauuugcucauggaagcuccaaaguacugauguuuaaggaugccuuagcaaugcuaggugaucaaacaggaaggcaagucuuucuaguuuuguuauuauacaguggugacuccauauaaccugauggcuaagauucuuucucagugugcugccauggaaacacuacccaacaguucuccaagagcagcaccauuuagaacaaaaucccuuccaugccuagugauaauaaaauacacaagagacaagguacagcauagagucuugcuuaucguucauccugaguauuuagucauaucugcaguucucuuuggaccuuguauuucugcucauucaaauaucacuugaucugaaauuaaauaaauccuguuaucacauggauucuauuuaggacagugaccuccuaugagcgguuaccuucaaguuccugcauaggcaaauucuccucggcuaacauggauguuugcuucuucagaacuaggacccucccauuuuuaaguauacaaaaagaagaugaaaugguugugcagggaacauacaaguggcugaaaagacacuuuuccggaggugaaauuagacuguuggccuauaaacugucuuuuaguuaugaaaguacaggaaaaauggagaagagaaaggccaacuagcaauccauucaccaagcaagccagcaguuacccugaaucugugugaaggaacaggauaagagacaaaugugucaggaaggagcugguugguuuccaguuucucuaccagcaaggcugcagaauauucaaaaugaaggggaauuauucugaggucaaucuauauagguauuauauagguauuaauuauaggcacauaccuauaauuccagcauggaagaagcugaggcaggaggauuauaaguuugagaguagccagagguauacagaaagacucugccuccacaaugaugggacaaauuggcaaaaagaaaauaauuugaauugaucccacagugaaugagcagcucacagaaugaaacgcaugguguuuccacagcgaagaaagaagcuuaaucaaacaaaugaacaaaacauagcauuuuuccaaaaauacaagguuggcaagaugguuuacugaguauaagcccuaguuguauaagugaguuuucaccauggugaaaagagaacacacaaguauuuguauagucuauguauauguguacguguaaguguauguauacauauaugcauaaacauauacacacccacacacacauacaagcacacacaaauauuuacuacugaacacccaugcauaaaaacaugcaaacacacauugguucuugauaguuuucuguacauauauaauuauauuucuguuuuaagaaaaucucuuugggcuaaaagaaaacaugacacccccugccuucuggucauucauucaauaggaauuagaagggugaaugccuguucccuggaaggggaugggcuuaacacaaagcauucauuauuucauuguaaauuacagaagcaaagaugauguauuuuacaccuaagugagaggaaacugucaucuuccguuaucaggggauggauguuuuaaucugcagaaugcccuagcagauuugaauuugcagcuuggccucuucaucaaugucaccauuaauucauaauuugcagauguguaaauauucuggagggccacuggcuuugagugauuuuuguuaggguaauggaaugcuacacuguuuucugauauuguauuguuaaaaggaaaucaagauucugcaugacccugaaagaccuaaggccuccauaaagaaugugguccauuuugccucuucaguuauagggcugcaauaaaggugggcccaucacacagagggaaagagggaaauguuaagccucuacagucaaugagacaaugcaagcucagguuuccucaacaacaaaguuagggacagaaaaccuggccaccacaggagucacugacaugaggaacaagggacuggaagguucaugcaugacugagaaaaggcaccuuguaggcaugacauaagcaagagacuuucuguaucuguauacugcaagcaggcagaaagcagacccacagaggaugacaaaggagguggggaggacaaacucacugucugaccagaucucuuaggcuacuggaggccccauuccugaggagagacuggcucauucucagugucucuucuaacacucccagucuuguuuacuaggggcuucaggacaaagcccaauuuuaaaggugggcucuccuuuauuugggauuagggcauugaugaggaaguugugauaaaugguucuugguggucuugggacaugauaguucugacugagugcaaucaaugagcuuuucaacguucucacacaugcaauguacaguugaggaugauugugggaggaaaggcugcagagauccucacagcacaaaaccuguucaacucacuaauuauucaucaagucaaacuuccauagcucauuagcuacuagcuaaaugucaguuaaaaagcaguccuuaauagaaaacauugagacuagacauauaaacaggucauuccugugggucagaacuguguuuggaguuucgcauggcuuguuauacuuuaucuuuacaacuuucauaugaggggccuauuuuaacaccauuuuaugaacaaucaaagccucugacaucuggaaagaugcgucagggaccaaaguacuugcugcuccuccacaagacucacguuucaguucccagcaccgacaguggguggcucucaaucagcguaacuccagcuccagaugaucagauggccucuuuuggccucuaagagguugcacucauguagacauauaucuucacacaaguauuauugcauaaauagaaguuuuaaagaagucaaaauaagcaggucugagaggcauaucaacuuugcugacuuuaaacagcuaauggaugagagaacugggguuugagcccagaucuaaccaacuucaagccuguucaacuaccauuugauacaaucugagaaaugcuuagcuuuauucucugugucucuacuacagagaagcccguucacaccaaaucacacauuaguuaguguugggagcuauuaaggcaaugcuauuguccugaucucugaauugggccucuccccccauccccagaagaaaaaggggucaaaagugggccacuggacgcaccgcuccgagaaagucagcaccggauguccugaccucaagauguacucugauaccacaaaguuccugcuuccccuuguagucgccaaaagaaaaauuucccacugccccaucccuccugcugagaaguacuuccucucuuucugcugccccaucccuccugcuaaggugcauuuccucugccccauuccuccugcugaaaggcacuuccccuuuuucuugugcauuuaaaccucgggccuggcuaauacauuuggggcuuugaugcauuccagaacgguuuccguugugcguuauucgcacaaggcccucgucucucucuaccccccccccaauuugguuauuaggaggagguccccucgagacccucgaauaacuggaccugcuggaugggucaaguuaguguucucaauggacaauuagugucuuacaaaaaaugguuuagaugucacucugagaacugcaguucucaucagaguuugucuuaacccaguggugccaagaccauuauuuuguuagugauuuuguacuucaauacugaggcaccuuuuagcuucuaucaguagucaucacuuuaaaaaacaaaucacugacuuuuccaacuaagacacaaagagcaggcacacaugccugucaacacagcucugauuuacaccuuuaucuuguuuuaaugcacgcuauaguagucuacauagucaaagcuaagaaucacacuguaaacugagguuaguuguccuuaaguguuuuaauuacaaaacuguuauacugggcagcuuuugaaaaucauauagaaucauuuaaugcagggagagucuugguugccaccauaugacccuccagcuagccacacuccacuuuccuagggaaacaaguuggagaucuuccauggagguugguuguaaacucuccuuuuguuguuuuguucuugggguagagaacagaacaagggaauggacuacuaaagagaaacagggccaucaguaacugggcaagcacucacaacacacuugggugcugagaaauaccgcacauucuacaugaauuuaacucacuuaaaacugguuauuuuaaaagaaaaguaacaguucauggaaaaauugagaaggugacagaguaguucauauaaacccugugcaccuaggcuaucauuaauguuccccacagagugggacaagugacaguuuaugaauccacauaaauacacuauuaucaggcagggcccagacuugguaauaggguccucucuaggugguguauaauuuuuagauuuguacaaaugacauacuucuaacacuauaguagcauaccaagcaguuucacugcccuuaaaauucugugcuguguauuaauccuuucuccccgaacacccuaguaagcauugaucuuacugaauucucugaaaaguuugccuuuuccauccuuaaaaucacauagcauguugccuuguuagauaacacuugggucauggagauagcuuauaugauaaagugcuuaccuugcaagcaaagggacaucaguuccauccucagagaccauuauacacacacacacacacacacacacauuaacaaaagaaaauaugcauuuaacucuccccuauguucuuucauggguuaauauuucauuucuugugagucuuaaguaauauuccauuauuuugaugaaucaaagcuuauuuuccauucaucuucucaggauaucuuguuuucuuccaacuuugguacacaugcacgagacugcuguagguuuugcagacuuaggucugugguuccuuugguuaaauccccaagaauccagcuguugggucaccugcuguggagccuuguaccacuuucuguuuccaccuacaauggaugagugucacuguucaucucauggugguuagcacaccugugcacuugugcuguugcuauucuggcuugggacugugauaguaagugcacagcaauaccaaccuguugucugaacaauuaugcuuagcauagaauaucaugaucucauucuacaguuggagaucuugagacucaaguagcaugcauaccucacacucuucccuauuugcuucagagccaaugucaaaugcagccaagccaaugagacuccuauugcucaguugcauuauacauucccuaugagugcuauauuaaacuuaugcuauuguaaaaugaaguguaaucuuugguccaugaaguaauccucaaauacuuccacauauaaauaaaaaauccuaaauauauagauaaauaaaaaaaaucaaagaaagguucaauauaauuugacuaauaccaucauggcagcuuauuauuuuauuuauuucuuguaugcauauuuauuuuuuuaauaauguaaaugcauuugcuucugugugggcauaugugcauguggguauaguugccuguggaaaccagaagagggagucagaucuccuacagcuauaagcagcugugagucucuaacugggugcuuggaaucaaacuuggguccucugcaaaggcaucacucaguuuggaaggcugagccaucucuccagacuugcuucuuauuuuaaacugggcaguguagaguuuauggcaucaaaguugagaauaauuuuuguggaccaguuuuuccuuuucaucccauucuaucauuuaucaacauguguggaugagacacagagaaacacaaaaccagagacguacacaaacacuagcacacacauggaugauuuuccuccaccuauucuaaaugucccaaaggucccacaguucaaaagaggaagcaauacuaccaccagcagccacaguccaaauuccaccaacagaucaagucaucaggagcuaauuaguccuuuaguaaaggagagacaaggaggaggcuccugaaaggugagagacaaacaauaaacaacaaaaacaacaaauugucugaacccuugggcagucugaguacaugaaaauugugaaggaaauuaauuagcuuugcauugauuaguaucaaaagucauuagccaugccauucaagaaaucccaagaagucccagaugugugaagggagaagucuggggaagugaucccucucugcuucuaagcuccaguguuuuaaagggucccuguuguaugacuagcucagaagcacuggggguggggauggaagacuuggauuuauauuggccacuugugccagugaaugcaaauacucugaguacauaauggaggguuagcaaaggagccuccuguuguucacgucacauguggaaaugaacugggaagagaggacagaagagccaggccucugaucuggguaacucucuuaccaauucuucuccuguccaucucugaaaguuaucagagcaugugucuuacauaauccacaugcuuacaucacagcuggcaaggcuggcucuucucucucagucacagccacagcccacucuccucagugcucagcucuguaaacaucuuccuuucauucuuaaaacauuuuuuuaaauuuugaauuuaaaauauacuuguuuugccuuccccuuuccugccuccaguucuucccaugcuaucuaucuucuaucuaucucucuaucuagguauacauauauguauagauauguagauaguuuuauauauauuucccuaacuauauaaauagcaccuguucugugguuugggggcugaguauuugcuauuggauugcuguguucuucccuggggauaacuuuuaccucuguucuucuuuauuugucuguauuuccuugccuagagucaggggcccuuuaagacuuccccuuuccauguugcuguugcccuuguuuagguauuguucaugcagccaugcugguaagacuucaugaaaauagauucucugacauuucuagaaggucuugcuuuauuuaauauucauaaccuugugauuuuguuuauauauagauuguguuuaaguuacaauaaaggcccacuaagaauaaacucaguaaagagaacagaauuucuggccuggguagagaccuaacauuucaguugagcuaggucaaucacugagccaaggguccacccuagaaaggagauuucacuuuaagucauccuaaacagauaggccagcagaauaccuguccuuuuaaugcuacaccaugagcccuccccucaagguuuccuguucuccacugcgguucuagaagauuuagcggggucugugccauucuggagccucaguuaaaaaggcacaacuuuucuauuuuucugccucuuucuaaagcuagccagaaucuaagcgugcguuuucugacucuugguguuuccugacuccucugaagcucuacccucugccacgugucugcuugucuguagugcacuggcacuaugagugccaugugucugcuugucuguagugcacuggcacuaugagugccaugugucugcuugucuguagugcacuggcacuaugagugccaugugucugcuugucuguagugcacuggcacuaugagugccaugugucugcuugucuguagugcacuggcacuaugagugccaugugucugcuugucuguagugcacuggcacuaugagugccaugugucugcuugucuguagugcacuggcacuaugagugccaugugucuacuugucuguagugcacuggcacuaugagucauuucuuuuuccccuauuguccucauucagguagcugcugagagucacagcuugccugacccguagagguuuucuuuuaguaaauaaaaucaaauuguccuugaaccuccaguuaaauccauucuuaaauuauuuuauuagugagacugagaaccccaagagcgguucuagauuucuucugcauuggguguggaagaggguaguuucccagguuaugggguuguauauagaguuaguauuugaacccaggucuaggaaucaguaauaguaauaauuuucccaaugagaaaugaggaagagacuagcuaucuggagaucuucaguaauagcaggaaagaggcucaugugucuuuccagaagcacuucucuguaaggggugagcaguccucugaaacauccccaacacagggagcuuccuaccucacugucguagucaaguuaugagugcugugaagggacacuggccagaagcaagcuggggagggaaagacuuauuugguuuacacuucgauaucacuguucaucaucuaaggguggacaggaacgcacaccaggguaggaaccuagaggcaggagcucaggcagaggauauaaaaugguacugcuuauugacuugcucuccuugcucagccugcugucauauagaacccaggaguaucccuacugacaauggacugaggccucacccaccaaucacuaaucacuugauggucccucuucucagaugauuacacuuggugccaaauugacaccacacucacaacugaaggccucaucaucaguaggcuucaccuugcauuucuaguaauccaacccaugaauccugcggcagcuugguuauuacucacugagcgaggcacuuguucugcacuaaaaucucaguaaacacuagucuugccuaugacgugcugcgacagaagcuaaugaauguuuagcuggugaauagcauguggugaguacuugguauuaggaaaaaauuccuuauuuuauuuaauuccuuauucauuaacguaugcuaaaugcuuauaaauaccacauauaaaagaaagcuaugcuaacuuuucauuaacccucucuuguuuugucuccugcccuauccauccacuaguacaaccaucuauaucccaggcuucuccuccuaugugggcuuacugugcauagaagugucauuaaaauguucuguaaccuaagcuauucuuaaacacuauauccauaucuccacaagcuuacuuaucuguuuaguauuuuauuacaaagaaauaaaguuacuuaaacugaauaacaauaaaaauuaauauuaaaauauaugcuuauauuagaagagaagauagccucaaaauuaguaaacugccaaauuuaaacaggaaaaacauuaaaaagaaagccuauauuuaggaaaaaaaaauuacagugaaaacaaaaccaagaauuaaugagagagaaaucaaagcauucuaaggaagaugaaaaagcugaaaguaggauuucauuuuguguuuuugagaaagggucuucuucuguaauggaggcuggccuaauauguacaccagcccagacuagcucaaauuuaaacuccagagugcugacaaagggaccugccugccucagaaguaaacuuccuaaucaaauuuaacaaucagauaaaccuuuugcaaacuacuaaauagaaaauaagaagagaaacaauauuuugaauuaaaaugaugguaugaauagaacuaaaauaugacaauacaugauauauauaauauaauaauaaaaauuauauauauauuaaagaaaaugccaugccagaugauuuugcagguaagauuuccaaaaucucaaggaagaaaccauuguuacagucuuauacauuuguucccugugaauucuauaauucacauuacccuuuuaacaauggcagacagaagcucuauacaagaggggagucacacuccagcucacucaggaauaugugugggcacaguccuuagaacagcacuucacaguaaacugugagaaguuaucccaauggacaaguagccgccgucaaaguagauugguguguacugugccacuggaguguuaaccuaacauuuuuagcaguuacuguccucuacugaaaaaucuaauucuccuagaacuaaacaaguaaauaaaagaaaacacugccuugggugucuaggguaacaccaagaaauagugagguaaacuuucuguuuaucaaguacuuaguuccuugacugaguaucauuuaagaaaaaaauugcccucuuucaauuucagaaugaaaaugaugcaccuggagagaaaguguccaugaucuucaguuaaaggauacagagucaauaggacacacccaacacuuacccaacacuuacccaacucacagacucucaaaacugagcaaaugccugaaucaugcaucauuuugggauaugguagccaaguuuaaaacccaaaauaauucuaauaccuacuguagagaccaagcacuuucucuggaagacacuggaguugcuucuauaaggcaugggauguauucucuuugucagaugagauguaauuugaguuuaggucucauuugccacaaguggaauuaaauugcagccucuguggugggaugguuuccaagggcagagcaggccuagucauuucuuugcucuugcucgagggcuuuggacauuaauggaagcaccgaugccagagcacuugccuuuacuuugcuauagacucagucauaggaggcuguucuuccauuccggucacuucccugccucuggggauggugucccaggcucccaagguagaagauuuauagucaucuuaggcauucaucugguuuuuauuucaaucaggcugccaagaauguugccaauaacgcaaucauaucuccauaggaucgcauacugacauaagcaagugaccugggaaaaaucaaaugaaggaagaaggauuucugcuugaggaagaggugaaugccaggagauuuaagacauggggaucuaagaagguuccaagccagugugccuucugagugugggaaagcacacaacuccccugcuagguuauacgguggcaucauuugcauggaacccugggaaggaaugcaugaagaauguguuucucaccauuugugucaacaguaauacuggaaacugugaaugucaacagauucuuuuuuaagagcuugaaaagaaaaaaaacagaugguagaaguagacauaaaaaagggggaugaucuagaauaaauauauguugaucugaaucucugagcuccacuuacugguccccugauacuacagccucuaacugcuagcuccuguccuuuucuuuaggcuuuguguccaacugacucagcuaaaugcuaugaaagauuucugugugcugcaaugcuuaaaaagagccuugaacugagguagaaaauucaagagaauagagaaaaaugaauggaaggcaaagaagcaucuacucauuuaacacagggaccaguguggugggaggucagcaauuccccaacuuuagucuauggcacagacacauaccuauacuucuccuucccccuccauccuuguuuguauauuccucaggacaagugacaguaucuauccauggaagccaacgguggaaguaaggcauucugaggaaguggguagugauuuaacaggcacauugcugaauguacaggacagcauggcagaagagaaaccguacagaagugggaauggaggugcaucuaaugucugcauaaugcuugagaaguaguaguggcaagcaaggaaugcuaauauugagcaaaugaguuuauacauacaugcaugcauacauacauacauacauacauacauacauauauacacucagagagagagacagagagacagagagagagaacucgagggagggagaacaagagagaaggagaagauaaugaagcuaauuucuuauuggcuucaguggguauuuguaaauguguaacaauggaaagacuuggaucugaauuucaaauauuuagaggaauucauagggcaaugugcguaaacaucuacauaaaacauaaagguagagaaacaacaaauguguguguuuuuaugugaccacguaugcauauuuucuaguguuggccuguucuagaaacaaucacaucacaggggcucuaaauacaccaaguacucagguauuuaaugucuaaaacaugcaccaugguaaggaauuagaguuguguccuuggugaaauagacaauuccagggauacaugaggaauauucauguaagaugccccuggacaucuuauuguuaagagcuaaaugcuuaugguagggaaacuuggcgaacaacaaucugacaauuucucuggaaagagaaucugcccauggagaagcaagcauucuaagauccagauaaggaccaaccuucaggaaaaggccacacccuuuuguggcuuuaugucagguugacauagaggaaaccugagauaaucuaucuagaucuaaagaaacugaggcugagucaggggcaucagcugcucaaggcuguucucacuuacaucaugaguucgaagucagccuuggcuacaugagaucuggagaucuuugaucuuuuuguuuguuuguuuguuuugguuuggcuuuuuuguuuguuuguuuuguuuuuucaagacaggguuucucuguguaguccuggcuguccuggaaaucacucugaagaccaggcuggccuccaacucagaaauccgccugccucugccucccaagugcugggauuaccacugcccagcugguuaugugagaucuuaucucaaaaaaaaaaaaaaaaaaaaaaaaaagaaaggaagaaagaaaaaaaaagaaaaaaagaacaaagaaaagaaaagaaaaaaagaaacaauugcaagauccugugauccugugaacuggaccagaagaagcguugcugucaggggccacugcagagugagaaugcuuccugagaaugccuuugaaucuacagacugagcauccucagauucagucaagaacacauaaaaaaauuacuggagucagggagcacauggacugaagagccucucucuuuuaaaauuccuugaauaggauaauaauuauuugccuggaaucuacaugaccuugguauuguaaguuaccuagagguaacaaguuacuagaggauaugcaugugucauguguuauuugcaaucauauuuuuuuuugcuuuuuuuaaaauuuaauguacucaccauugcucucuucagacacaccagaagagggcgucagaucccauuacagggcuggggagauggcucagcgguuaagagcacugacuguucuucuagagguccugaguucaauucccagcaaccacauuguggcuuacaaccaucuguaaugggauaugacgcccucuucuggugugucugaagagagcaauagugaaugcaaucauauuuuuaugcaagagacuuaagugucuauggguucugcuaucuuggaagauucuaugguguugggagcuauuaagacaacucuauugucucgaucucugaauugccccccccaccagaagaaaagggggucaaaagcaggccaccgaagcaccauuccgagaacaaccacagaauguuccagcacuaagucagcgccggauguccugaccacagauguacccugguaccaccaaguuccugcuuccccuuguagucgccaaaagaaaaauuucugcugccccaucccuccugcugagaaguauuuccucuuuugcuugugcaucuaagccuugagcauugcugaauacagugacacuuugaugcuaaucagacugguuaugcauaguucaucgcacuuagugucuguccgucucucccccccauuugguucuuaggagacgguccccucgauacccucgaauaacuggaccugcuggacgggucacuauggagaccuugggacaaauuuauaaggugagaagggugaagaagaauuguccauuauaaugcuuccugggaacugaguacugacaacacuagaaacgcuccuauguccuacuucccugcucucaaguugaaggccuaaggguauauauauauauauauauauauauauauauauauauauauauauauauacauauauauacauauauauauguguguguaugugugcacacuugacaugagacauauauauuuuauauauuaugaauauauuacauauaauauauaaugucaauauauguguuucucucuauauaauauauaaucauauauuacaugcaauaauuauauauuauuuuauauuauguuacaugauauauuauauacaauuauauuauauauauauacacacacauacauauguguauguuuuauuuauaucucucacaggaaaagacuuauuuucaugccucauuaaggaagauaaugucugaaagacuaaaaugcucaaggcaaacuuucaaacugcuauuuuucagacugcagaaacuuccaguuugguuacauucucuucaaaguuuucccaucaucauuagcacuucugccgaauaaucacaucccuaauaauaucccuuccuugauaacgcacaaaugaagucuuuuugcuaaggaagaacaaggaaaggaaggugaugaauugcaaauccaucauaauuuaugcuaaaaaccuauauucaucaucuuuucucaaagagcaccuuguguguuuuuuuaaggacaagaagucuauuaucauaaauuggaccuuaauuuauuucuuuaaucaauauauuuuaggacaaaaaguuaacuaguaaacucugcaccugggaaaggaauuuuaacucggccaugaaucacugcagucagaaaggaaaugaaauaguccaauauauuuccuacagucuuccuccuguuuuaaagugccccccacaaagaccaugcaauguaauugguccuagucaugaugaauaagaaacacaaaaauaccaaauuaucacaagaugcuuuuugaaaaagcacugcaauugaggcuguagucuaugcugacagcugcggaugcugugacuaaauacacuaacagugacauuuucagaaacaugagcagagcagcaaucagcuugcuaaagccuggaggccaugcaguaacacccuggacuguccggaguugcugcugucagaucucacuguuuugucuuagcuugcccauuguagagaaacagagacuguugguauucuggguagguaugcaaguaacccucccaccuuuuguccccuguaaaccaggucuucuuauaaaucccauucugaccucagauugaagacucucuugcaucggcuucuugaugcuggcauuacagguauuugauaccucaaccagcuuaaacaaaacagcauuaggugauuccagcaaucucuaguaaagcaauaaagcaguaacagagggcaaggagaagucuucagaaugugugcuaugagacaguucauaagaguaaaagacucucccucugggaagaaacagauacacgcuacaaugguuuucuuuagaccaaagaaguaaggguauuuagacacauucacuagcuucccuuaggcagaguagacaucaaugguuagaauguuccagaauguuuugggguuuaugaaggacagcaaggagcaguguguaaagugaccaucuagggauugugguagcccacugauaucaucuguuacagggcucuuucaagagauagauguccugagccagguugaccuuugacgccaccccgacccauucucaugugacccaggaaacaacuguaaugagcaguaaaugggugaguuggcacaguaguucuuaggcugcuccacuguucuguacaucucaaagaacaagucaccugaaagccauguaccuugcucuagugaucugacuaaaggacucagaacugugggaggucccuucaugggguugucaggguucugugaaaggagggagaaccaugaacaccuguggccugcuugcacacauccaaccaguagcauucacauuuguuaauucuuuucuuuuaaaguauuugucuccccugagagacccaaaucucaggaggccagagaccaugugagaugauucauagacauacauacuuuccauuucuagcgcauuccagggauuacaucaauacuuuugaaugcaaaaaauaauaauugaacgaauagaaauuauuacuaucauucaucaggcaaaauggauuacauggcugagggccugggcgguuaucugugagguaacuuccuguaauugaggcgaguguuuuucuuuugcuauauagauccauccuugagccaggcugcagugcuuacuaugugauugcagcuggaacugagccuauuacugaccagcgagguagcuccuguagucuucacuguacgcugauauuucuaguuuaucucaccccuguuaaaaggaaggacggcuuuccuaaaaugagaugggaccauguugcuuggcugccguuaucaaauaaaugauauaagacgugaacuacuucuugagggaagcauuuaagaauugauauuauacagcauacucuuuucucucugucauguuaaccaggaaaaugugagagguuagagcaugagucaucuuaaauaacagaugaagucuaccuacugcagaagacuuuucuaacauauacacaaauacaaaaccuacagcauaagguaggcauaugcuuuuacuguuugaaggccgagacaaacagacuaacuguucuacaauguaccuagccuacuguauccugugacuucuggaaaaaguuugugcuaugaacuuagcacauacuccuccaaccaugauccuuugaaagcacuacuucugaguagggaaggggccugagagaaugcuccugcccacaggaaauuguauaaagcaggaaaggaauccugaaauccacaguacacaugcuaauccuuuggaagggaggcccaagggcccugcccuccuguaaucuccagugcaauuucuacaacaucaaggcugccugccauuccccaggggcaagagcugcaggcugguaauuaguguuacuacugagccuaucacuguuaauuaauggucaacauucagcuuaaauugaaaaccaucuacuucugacuuguccacucuaacucccauagcuaguuccccauuugcacguugugcccucaucuuaauagcacaauuucaauuuuacuuuaaaaacaggaaggaaaaaaauaacuuaagucaaggaaagagaugacucuccauaguagugagucacauuaucaaaauuaaaagcauaaaaauuaaugguaaagaauucauauuauuaagaaaucauauucauacuuagauacuaugauuguuacagcaaggccaucacaguaaacguguuaauaguauuuaagcauaagguccuucucccugugaaguaagaaucauugugcgccacauuagcuggguuagucacuuuagagccgcugucugguagagcguuuuaacuaagccuugucaguguuaauccuaaugucugaugcugggaugugccuuguauuacuuuauguaacugaagaauaggaagccuuuauguuggauuauuggcugaaguaaugaccuccuccuggaaccaggccugggauacaaugaaguaucaaaugagauucugggucagcuccuccacaggacuuaaaggaagccagcucuuuuguuaagauucauucacucacuaacaggaugcuuuugccccuggccauccacuuaaggcuccuucaguaagaagugucuccauucacaggcuaacuugccagccgagcacacaggcagugguagacaauaguuaacaauguaucaagcccuuccucaaugcuguucucucuggacucugaucuagcugugugagcccgaggcuauguagcuuagggcuagaaagaagccagccaagaaggcucagugcccuguucucugcucuugcggcuuucaguggcucuucuugcauguuuuacacuccagugcucuguguaaggcaucauaucauauacauauaccacuguagaauagcucauccauucuacaacucuuuacuaggcacagauaacaaacccuuacaucaaugagaaaaucugagauaguggcauuugguacagaauuaaacaagaaacgauugugggauggaaagcauauagaauaagaacugguuucauacaagaaagucagggaaggccuggccaaggguuaaagucugagcugggacagaaacuagaauccuccaaucacaagagagagggagcaagucuaggcagaggacacuacuguugguccuaaggcuggggacaaguuugguauuuccaaaaauaggaaaagucaguguggguauaguuuagcgagugagcaaaguauaaaagcaugaggggucagaucaugucagccacuguaaugcaaaaugcaaacaagaggcuugguugucauggugagauaaacugaaucgagaagugugugugugugcuugcccuuguucgugaaagccagaggcccacccaccuugauuguuuuucucuaagaaguagaauuguucuuuaauaaaaaccgaagggccucaguuucucuauagaagugagacuguacacacauggucuggagagucuugguguuuuauaggaugaaaaaagggaaacucugagauggaacaguccaccugcaggucacuucucugaagucuugaagugagagauguuggcauauguacccaacauauaguguuaucaaucauaucaaauuuccaucccagagucucucaauccaccugaggcuuuuagguacuuuucucuccauucuagaccccaaggacagaguaaaagaaaggggcaauguauucccuuccugggaaggggucagucauuacguaaagacauagcaagacaggagucugaauccauagugaugaggggaagggacagcccagaagugcuggaccuuaguggacagacccaggauuugggugaguaauuggcauuaucuaccuuuaagagauuacaaauucuaucuaagagggauacccagcucucuuguggagugauuaaggugaaugguaagaguagagcauauagaaagaugguaacagggcaugggaauauagggcaaaaggaaggggcugugacuuaugaaaaggaaaauuagugagaacuuagagauggaggagcccccuaacaggagugaaauaaggguguguguaugaagccauccaaacccaaaaccaaaacaauaugaaagucugcuuuuuuucuccuucgucugauguaaaagaguacaguggccccagaaaacucugagccugaagguuauggcagcugccaguuugcauuauaccauguggucacauuaaccaagacaguugugaaaucaugugacauuuuccucuuuaugguauaauuuuagcaaaaaugaugaugaaguuacaugcuugccuccaucuugacgaggguccucagcugagacagcaaagcacaagguugucuucugcucaaggugaacucagccucaugguaaagugagccugucacccaccugggcauuucaagucccuguggaguccauuguuucucagauaaaaugucgauugugacacuguuuuucuuaagaaacacuaguuagauagguuagugugucaguaggaccagaugauaccuauggcccagacagaggccaaaaguagcaaacuaaggaaacgguaaggaauugcauggucucagcucaaggaagcugaguccauaaguagcugauagaguagcuagaaucacaguauaauguuucaguuuagaaaaauaacguccuaaguguugcuaccagcccaguuccaggauugggcaagaguugggcugguuugcccuccuguuccuagucacacagucagggagccagccugauccaggacagaaguuuggaggauaaacaugcaugagucugaagagggaaggccaaaucucauucagagccagcacacugccuuaaacagcacagaaaaauuaauauaacuuaauuuguucaguuucuaauaaggagggccuuaucaaccacauuagaguuugagcucauaaaaccuuagguguaaaagugaggacuugggcagaagacaggagugaagauguaaaagaaacuuggaugcagggaauaugucagcccuuuugcccauucuguguuaugaagcuuucugacucagugagacucugaauguccaaaguauuauccaguuuguaaugggucuagacaucauucgacagacauaauaauaccaaaagguuuguuuuaagauaagccaaaaguguauaggaauaaagaucuuagaccuguuuuaggcaauauaauggugaggcauguuucugguaauaaauuaucaccuauaaucugaaaguggccagaaauaagugaccagaacccuugggucuggaugagggugccaguuuaggacacccuuagauugaucuuggaccuaaucuuggugugagaauauugaaugugguauggaccaauaaggaaaggccucugauccgaauauugcaggauagcugguuuguggugagaauaagagaaagcagaaacagauaaaaaggggaggagaagaggacaaaucagggauaagacccaaagugaguucacaugacacaccaaaaaucucuagguuucaaguugaaucaggaaaccauuaagucuacagaacugcugaguucuuggugauaugagucucagaaaagaaaaaaaaaagacaaauauguauaaggggagagaggaaaguuuagccagcgagaggaguauacaaccuacaaagugcuccugugcuuuagcaccaaaauuuuagcuaggaauuaauggagguguuuuagaaauaauggaaagcagacaggcaucuccagaaacagaguugguccuuaaucagagccucucucuuugaagugagucugugcccuguccuuguuuuugaggcacuaucucucacuggacuacagaauagccucaggggucagggguggugguuugaaugagaauggcuuucaaugccucauguauuuguacuuuagucaccagauaacuguuggaaggauuaggaggcauggcauuguuggaugagguguguuacugggagugcacuugaggguuucagaagcacaugcccgggcccaguggcucucccugacucuguaucuuccugacuguggaucaggguguaaaguucuguuucugucccaggaccaauguaugcugccauaaugaaaauguaaacaagcucucaaguaaacgcucuuuuucuaagacuuaccuuggccauguugucucuucaucccagugcaacagugacuaagacauccagcuucucugccuuacuagccuggagcuacagaugggcacugccuggcuacauuuggucuugguuuuucaauggagguucagggggaaucaaauguaggccuucgugcuugcaaagcaaguacuuuagcaauuaaguaucaucaacccaaccaugcaucuaagcuuugaugaguuccgccacauggagaagagacucuuaugggcaagaagagaagugaagaagucaguaaggcaacugcuauuucccagauuaaccuauaagauuaugaagagggauggaacauugagcacaauggaaagguuugguucugguauguguuccgaagguaaaucucacauggccaauaacagugugaaucacugacuagugggcagaacagacuuaaaaaagacaagggucucugaggaaaugaaagaaaugcuugaaaguaagaaagccacugaccauggcaaagguuaccccuguccaggugacugaccaggaccaaccaauuaucaucaggcugaaccagagugaccuuuuacugcccugacagccacugcaaucuugcuucaagaacuggcuaaaaauguaaggguuucuguuauccccguugggcaucuguuguauauaauaucucauuaucuucuuuugcuuacagguagaaacagagccaacucuaaucuuaggauaagaguauguaaacuucauuaaugcagaggugguguuuuucuuuucagcuuauaauuaguuaagacuacaaacuauaccaucagagaaacuuauggcagaauuugaggguuucaauucucucaauauucagaagauccacucuugacccuaauaaaagaauauaucaccagugguggcuauaaagauuacccaaccucccugcuuuuauacaauugguccuuucugaacuaaaauuaagacauuugcuaccugaaccuagcacagggaaugguuaagaagcuacugaagcagcuuauaaguuauagugacuacauuaauuuucaauugacacaaucgucaaagaaauguagcagaacagauaaucaaguuauaacuucauucugaagacagagguugccucccuuuuuuugcacgcacacccagauaccacaagaggaauuuugguccugacccugaauccaucacugagauggugacuucacuugcucucaaguauuuguuguguuuuguugucaucuuguuccagucucuccuguuugucucuugcauccucugcuuuuugguaggcauuagguaaaagaaaaccacauguaguucaaaacgggcucacaacucaugaucugagauauauuacacacucauuagacucuaaauauauaauauagacagaaauccacugcuuuuuacccugcucuguggacucauaaaguaacccuguggucagacugcaggguggaugggcagcauuuaauacaguagauucuuaaauaaauggcaugaagcaaagagguaaggaugaagauuaugcacagagcugguuacaaaaucucgacgcuaaaucucaauuuaacauuuuuuuagguauagauggucaacucuuggggaaagcauuuaaaaccucuuuuucauguguguguuuuuuuuuccuauuaaaacugaacaugacccaaccacaugagugaauuucaauauuuuaaaaagugacauucucucaaaggauccauacccuccugaaguguccucuucucuuucugcauugcagagcaacaaaaugcccauuuauagcuucuacaaacuuugucucugcauuucagagcagagcaguuaguugucuucuguuuucuauucacaggauauuuguuauaaagaaaggagguccuucccaugcagaaaacuauugcuuccucuaugcaaccagcaauguguguguuucagaaugguaaggaggaaugcaggauacauaccacugcuccuugucaaaggacugagaaaagaaaaugguaucaagugccccuuacuauagaaaacagauaugagauccuaaauaagucucccuguccuuaauaaaacuuuauugaaagucagcuucugcccucaaguacuacaugguuuaccaugcauuucauacgacauagaacuucaaacagauauuacccuuacucccagugcuaauccauagggaauggaagcuagguuguucaacucagcaguauucagaaugucaggauguaggcccuuguguggucuucccaccucuccuaucugcucucuuauggaugccggcuuguuuuucugcucaccuuagcauuggcaagcauagaugaggaaguagaagguccaagccacaucuugaccaacuuauucuagcucugugagcagauuucaaaggagaaaaggagaaagaaggagggaaaauuuguucuuuccauucauauguaacaggccacuggagauucuaguuggcuccuuuuggaucauauguccauuuggacaagggaucauauguucacagauaggcuggucuaugacuuagggcuaauaucauaguacaucacccuaaaccauaggaauguagaagaaaugguuaucccauaaaaauggccauucuuacuacaaagaauuuaaguucagccuggcauacaggaaugccagagaucagugccauuccauagcaauucauuaugaaaugagaaauaugaguuaauuuucuaguggacuccuuuucagggaguaaaaauagcuguuauucuccaaccaauguagaccacgaguguccucuuucuaucagauuagugaagaagaaugcauacuguuccucuguaucacucauucugccuaaauuucauaagcacaaccuuaauauacucacuagcagugaauguacuggugcaggcaucacaccaaagaaauaaaaacucuuuucagagcugugcuugauacgauugcuguaagcaaucagguccagccaugaauagcugaaagugacuccuuggcaauaaggcaucuuuauagucaguuuuugagagacccugggacaagacagguaauuucuaggugcccaagacagaacucauugucucuccuguggcaugucgucuugcacaugugccauggccccaauaaaagucauggucucccuucucccacuccuucuuuccucucuuaucccagagagcaucuucaugccccuucuuuaacaaaaaacccuccuacccgagacuggucacauggugugauuuuugucaggacccacugccuagucccaucaauugcuccuuugcaugaacuaauaaccauccagucauccuuaaugcguuuguuuuucagaguuacuaguugaagcugauguagcuuugugcuccuguaagugaaggacuugggaggucaaggcaagaggaccaggccaccaggccacuucucuuacuuacucacacuaacugcuucuggacaccgagcacugagcauggaaucacaacuagcccuccaagaacuugguuauacucaagucucaucuagaagauaauucucauucauaugucggagguaaggaaacugagguuuaaggagaccagucaccagagccgguuagcucaaugacuacagaagcuguaauaaaacuuggggaucacaaccugugcucugagucagguccagucacucaccuucaguaagccaauuaagaggcaaauauaaaguagaaagcagagaagacagauucuuauuauuauuauuuuuuuuuuugagaagagagauuuaguuaauauggccacacuggaaaaaggaguaaagggauccaaauaacccccaaguuaugaaugagauuaaaguuuaagcagaaugcccgccaggcgugguggugcaugccuuuaaucccagcacuugggaggcagaggcagguggauuucugaguucgaggucagccucgucuacagagugaguuccaggacagccaaggcuaugcagagaaacccugucucaaaacaaacaaacaaacaaacaaacaaacaaacaaaacccagaaugccaaggauuuguacaucuaagcaguccccauaaagcugugggcugcuuugcauagcuccauccuugccugggcucagucucaccuguaagucugauaaauaaauuauuagauauauguaaaauuucuuucuuucugaguggugccuuuuccuuuucccagaaugagauuucaaggaaaauuccaauuucuuuuggaauuguuucaauagccuuguagucugacagacacaaaaaguugcuuuagaaacauuuuccuuuuuuuuuuuuuuuuuguuagccugucacaaaucuagacaauuuuuauacuauaaucucuguccauccuccucuuuucucucucccuucuuuucccuucccucuccaccucgcccgcccugcccuuccuuuugugcugucuuaaugaguacucuggccaucagacaacucauagugaugaaaugaacaacaugaccacagacagcaggagaagcacaacaguaacaaagccaucuuucgaggaccaaacucuucuguuuauacugcagcugacucucuuaggcaaugacaacugcuaugucacacucaaggaagccugccuugcucucucaggagugaaucugugaaguagagagaggcaugauaaacaaggaaggaggacccugcugggugcaaaugacuaacguccuauugccucugcucuuaguacugaauguguuaaaagucaaaauagggaagaaguccccaguaaggugugauucaaaaaucccauaucauaaaauuugaaggaugaagagaccauguacuuucccugcuuuuagaagaaacagacacacuuaugcauucaucuuuucuaucaauguuucucagauuaccuguaauaaaggacauguauguguccccaggcacauguguacaugugugcuucugcauguguaugcauguauguguguauguguggguuuugucgcugucugagucacgauuugauugaugaugauaauaucaaaccucauaucucgcaggugacuuacagcagaaauuucagcacaugccaacuauauuauuguucaguaggacaagucuacugaccaugcccuggaaugucaaauugcauaaugugaguggaagauugugugaggcuagcuauguggcuggcucuugugcauggugauucaaagucaaaaccugcaugacuuaaaagguuuuguguccauguucagggaggguugggacuccaggaagggagaaaacucacugccuaaaaaggucucagagaagaaauggcccuuucugagacgagcaaugccuauuaagaacuguagaaucggggcugaaugggcaguuuucuaccagauuucauaauguaaauucacacuuaggaaagaaaauagaaaaaucuuuuaggcuucuagacauuuccacuauacuuuucaugaagacagcugauuuuaggcucagcugaggauuuuagacucugcagcagaugggaucaugacauucuaaccugaagauuaugcaauuguacagaagacucccacuggacugucuuuccaaguucugaagccauuuuaccagcuucuugggggaaacuccaauuugaacuaacaacacaucaaacugagcaggaucacaugugaacauugccuuuuuccucccaguggagaccauuuaggaccagcuaucuucaggcaucuggacaacccugaagcaaccuagguuacuuccaucuccagcauaucuugaacugagucaaaguccacuuaaaacuagauuggacuuguuccccaggauggccuugaacuuaaaacauagcuuaacuuccuaagagauaauauccuugaacaucugauccuccugccucuaccuugugaaugcuaaaaguauagcauguagcaccauuccugcuuuacauagugcugggaauugaacccagggucuuaugugugcuuugcaaacauucucccaauugggcuaugucccuguuccuaaggagagagguacaguguggcccagaugagaaccacuggucaagagugaggcucaacucaugucaugggaaacuuugaaugauaccuccuuucacugucaaauagacccgaguuuggaaaacaaaguuuuguuuucuaacuuaauucucagaagucagcaaccuugcuuuguucuuaggcagauuccagagagggggaaguuaggugagcagauuuccucuuuaaagaacagaaccuccucuuucaauauaugcagcacuacaagguaucaaaagcuuuguuagccacugguugguuugcuucauaaaguuuuauucaguuaaccagaauaaaauacccccugacagccucuguguggcaccacaugagacucuaggggugcugcugucagaacaagauagaucuccaguacuugcuguuucccuucgcagggguggaagcuccuuuugaguucuccuuauuucuaacacccugauuucuucaucaccugcuaaucagcaccuucaaucuucacuccccaaagccuggaagacagugcccauucugcaagagcaaaacugaagaagccuggauaaccaaacccaagaaaaccugggaguucuaaaagcacccccaaacauacacccacacacacaguuuacauguuacacacauguuuacagugucuacaaugauuuccuuagacauccuuauuaacuagucccauccuuggaguaucuuuuuguuuacucuggaaacagguauguguauguguguguguguguguguaugugucuguauguguguguguguguguguguguguguauguguguguguguguguguguguguguguguguguguguguguguauguauguauguauguaaggggacugccgcaacagauuccccucauuuguuucagguccugaggagaaaagaaugcuuuguuugauguugauaaccacaucugaaguggccucagaauugcuuccagggaacaauaauucagacuaugauuuaggaugcuuccuucccucugucacugucaccaaggccugagggaaagcaaucuauguucucauugaccucugaggugccugcuggagguggcaguugcuuccuuuaacuacuuacuguuugcuuuccaggccucugucucccagggaagcagugguuggaucaccuuuucaucuucacucugcagugugaggggcaacgugggcuacagccauucucgcuggggccaucacgacacuugucuggugccaggaugcuuuuugggucuauuaucuuuguucagugaauaggggaaaaggccugugauuuauaaucuauccuuuccagugaagggggaagccuuucaaauaacuauauuccuauuuucuuacuuucaauugucaaagaaggaugauucaacuuuuuuucaugagaaaaaaaugguuuuuuagagacagcuaugugugguuuaacuuacaauuaccaggaaacuuauuggcuuuaaugggagauggggagcaguuuuggaauagacaaguguggaaauaugguuuaugacacggcuucauaaagucacaucauuaucuuaaacaucagaguuucucuuaagcacauauacccuuaggaugccaaacagcucucuuguuuggugagaauuuuuaggacaagaauuguguagauucuaaauuacaguuucuuccauccuguguugcgaaaacaaaacagaggcuggccauucaaacacacaacuuuucagguguggcucccagcagaaaaucagcucacaugguaguccuuacuuugucuaggcacuagugaguagugugucuuuguuuucuauaacauugucauauguugaccugccuagcaaggauggagauauucuaaagaaagcuauuuggaucccuguaaaacuacugaauaacaggcccugagacauugaaacacacccaggaaccucauucuuggagaaggaaagaccuuagguacagucagaggaggaacuuccucaaugggagaaaaauguauaacuugcuucauugcugucacaaugaagaacucugagaucacguguacauuauguauuguccucugccagcucuccauuuaaccuacacaaggucugagcuacagggaacuguagccauggaacugugagaacagguugcuauuuuaaaauuauucuaggaguucccuuuuagaggugaggucaguaucagaagacugaaauugcaggaaacaaaaaugugaccauuuuaauuuggcguugggcagggcuuauaagaauucuuaaucuggaccuuggcauuguuuacuuuuguuccaugucuuaguuaggguuuuaugucugugaaaagccaccaugaccaagguaagucuuauaaagggcagcauuuaauugggcugucuuacauguucacagguuuaguccauuaucaucaaggugagagcaugacaguaucuaggcacucaccaugcaggcagagcugagaguucuacaucuucaucugaaggcugcuaguggaagacugauuuccugguagcuaggaugagggucuuuuuaaaaaauauuuauuuauuuacuuaauguaugugaguacacuguuacugucuucagacauaccagaggagggcauuggaauacugaugguuuuuagcuaccaugugguugcuaggaauugaacucagguccucuggaagagcagucauagagauaggagaauauagugguuuucacacuaaaagccaacaaguucuuaccuaguaaggaggauucagaugauaaagaccuuguuuagagaguuagagcacaaggcuguuccacacaucacuaaucuuugagaaaauucaaaucagaacucauauuccuuagaaugucugauagaaaaauacaaagcaaauuauuaaaaguauuuuuaaagcaauugugcaaagaagagaagaaaucuggccacuugugcauuauuaguaggauaguaaagugguagagccacagugaaaagcaugaugauucuucaaaauguaaaaauagaauuaccauaugauucagcuaauucacccugggcauaagccuaaaauaacugaaaucaaggacuugaucagauauuuauauacccauuucaucacugcuauaagaaugauuaccaagguacagaagcaaaccaaugucaccaacggauucuuagaugaccaaagcauggucugcaaguagaacaucaucacacacugaaugggaaggagaaccugauacauggcacauaggugagccugggagacaacagcucaaguaaaacaaagcacuaaggagaagguguuuguguguuacuucacacucucacccccagagcagucaaacucacagagagaacagagcagcaguuaccagaggcuagaggagaaagggguccauauauaauggauuuggaguuucagguuuccaagaugagaggaauucugaagguugguauagcaagaaucacacacuccuaccuuuucaccauauaaucuggguuugugccauggcacuaaaucacguaccuucaagggucuagcaauuuuauguuaaauauauuuuuaccacaacgugcuuugaaauuuaaaaauauauugauuacauuccuaaacagaaccgugaucuugcacagacuguuuauuccaaaauagcacugugaacugcaugaggcuugaaaucaccuaguauggauuuuugguaagccguaugccauauuauuuaaagccaaacaucuuggaauagaagagaggcaucugccugaaggucccagcaaggaggcagagugagagcugggaaacugcagaugaguugggguggggugggggguuccccuccaaaacaaaacaauguaaccccugaggcuccacugucacuaaaucugaagcacaacaacagguuucaggagggaaggagcucuuagcacuuaccuguaggguaaauaggcugcugauccuagagaaaguagaagacugugugagaagcaggggacuccucaucaaguacacagagcugugcaaacaccucccagcccuccuguuggcuguguaccugcuucuucucaaagcuguucccauuuggaccagacugaucuaagccacuaggaagaauagucagauaacaaacuucuggucacugaccugcucagcuggcaaggaggcauauacgaaagaguuucuguccaucaggacaaacccuuggaaaaacauggaaaucauuuuuuuccauuugggaauugagacaggaguuugcaucacuauagauauuugugaccaugaaacgggcuagccuugaacaagaaguucagaaaggaaaaaugcaggcuaggacagggaaaaauaucuuuuauaaauaaaauuacugauuuuauugaaguuuuggcaauuuuaugcgcacgcacacacacacacacacacacacacacacacauacacacgcacacgcacacgcacacacacacacacacacacacacacacacacacacacacacaauguaaggcaaucauauucuccccaauucccucuuuuagccccuuccuacuccugcugaccuccuacuugauaaauuauauucuuaaugauuaugcuuauaugugaaaaugagguaaccaaccaugaagacaugguccucuugaguagaugagcucuuuaauuaaagauuuuuuaauggccuaccaaaaaaaaaagcauccucuuuaagugauucagaaaacuguaauuaccccaaguucccccuacaaaacaacauuuuuuuaaaaacuaaugauaauuuaauguuaucuaugagauuuaggcgggcuaaagacaccagagggaagaagagcuuugagaagagccugagggacaggaaggugugguuaccaacagcaagauacgauaagcaaggaagcccugagcagugacccagugacaaggacagcagagcuggcuuguaggacauaggacaagcccucagaggaauucauacggagacauugaccuuguucagacaugcaacauaagggugagcagcacagacaggcagggaaggggaaacaaaagccagcaaugagagaggaacggaguggggacagucaaggaccuccaaccucgggaaaucagaucucccgucacagcaaugagauuccuccuggaguucucaggccucaguccguauucgcuuuugaacacuagucaccagagugguaacuuccaaguaaaauagaagaaaaauauucccucuuuuccaaaaugagcuaugccacuugcacugugagucagaugaaaaagcaaagucuucacacauugaaaagguaaaagaagcuaaagucaagugaacagaaacaucauuuuuagcuuaaauuucuuaaacagagucuguguacaguuaauauuaagaagaaauacaaaggauauuuagugaguauagguuggccccugggaggcuaagguuggagaaucauagauucaagguuagccugagcuacauagcaagucaaugucucaacaaacaaacauauaaacauacaugaauaaacaaauaaguuguauuuuaggucaaaauuaccuuaucauuggaaaagauacagccuucgaaauuuuucugccuuuaaaauuaaaugagcuccucaugacaauugauucuuugggaugcugagucaggaggaucaggaguugcaaauaagcuucagcuacauaauaaauauaaggcccacuugggcuaccugagacacagucuuuaauaagaucaaacaaacacauauuuuuauauauauuauaacaaaagauauaauuaacuacauuuagcauaauuugucucuuaucaguuauuuacuuauauaauuaugaaaacauuauauaccagguggcauauaugguauauauaaguacauagcauauauauauuugguauauauauauauauauaacauuugauauauauauauuuuaugugaaagaaacauauagaaacaauaaaaauguuauuggaugcucuaggcacaaguagcagugaaguacauaacauaagagaagaaacugauguaccacccagagccccaucuuccuaccucaggcgacugccccaguggacuugugcugguuucaagcuaccagcuugucagauguucaaaugugcuccagcuggcagcuguccuuugcaccaauagagcucaucuuuacuguggguugaucagagcccauuucugacaaucagucaacaugacaaaauacugauuccaaagugggaugcuuucucaaacacauuguucccuuuggcaacacccagaaauuggacuuuuuaaaaguucuucaacuaaagguuucgcagcaaaggagcccagugcaggagaagaacaacaaugagaagacaauaucaucucccaugaggagcacagcacugaggcauugguaggcauuuguugaugaauguccauuacucaacauugauacuaacaacagaggguuucacagagaauuuagaagacccagggagaaacaaucagacucaccacuaauucucuaguccccagauuucugcaugcuguuacuuucauucaccuucugcaugccucaugcuguguuuaaaccuaaccugcugaugauaaaccccuuuguuaugucucacuaauuuacauaggcauagucuguucaucaaaacaucagcaaaugaaaaaaaaauuaaaaaggacacauccuaaugaagaaaaauuucagcuuucuacaacauauguauuuucuaguagcugagcuuuccauggaguaauuauugcacuccccccaaauauuacugauuacaucacacagagaaacuaagagagagcuguuuuaucuuucccgucuaucugugguucuugugcaaacuuauacuuguuaccaugaaaaauggcaaauuugccaugugaucgaaauguuaacaagguaacugucaaggagauggaucucugacugucacugcaagccagaacaugaggauacauugauauuucucaauacagccucugcuuccccaacguucacuaacaacauuuccauggugaggguaauaaaucacccagaaauaacaagcuguguaggaucuuugggauaugauagauuugucuuaaccgcacuaucugcaagguagaaaaccauugauaaugaucuaaagaaagcccuaaucaacugccauuugccauaaugggggagaugaagcaaggacuggaaaccuuaacagugugacuuacacuaugauaaaauuaaaccacuccccaaaaauccacaguaugaagcagaccacaaagagcuuaauauucuaauaaaauagauggaaaauacaguuaauaucauggcccagguccaauauuuacacuaacauugauaaugacagucacaucacaucaacugcuaggcucauaaauaggaagcagguuguucaugacacaucaugaaggaggaaagcuugucuuaacaccuaguuuaauggauucucuccaggauuuucuguuuguuuguuuguuuguuuguuuuguuguuguucuuaauuguuguuauuuacuuguuuauuguuuuuugcaugcuuuuaaaaggacaugugggcuguauuuuacuaagucuuuaauucaauggcuugacuaaugaaaaauucaaugguauaauuaaugaaauauuuuuuuucucauagcaagguagcaaaguauucacccaagggaacaaugagaaaaggagacauuguuguagaaauaaaagaaaaauauacaucaaacaaaagaaaagaaacuucuaugagaucaccugggcaggggcauguggccucucugugcacguguucacauggccucuaagaucaagaggcacuggagccaccuuagucucuagccucucuccccuugcuggcugguuuuuggucaguagucuuuuuugcauuauuaccaggauauuacaaguccuuuccauccccagggccuugaaguugcuuuucucuccauguuccauucuuccaucuuaaaucaaucuggaagauucuuuaccauccguuuguuucacacagccauccuggccuuuugauuccuaucacagguuucucucagggcacaagaaacaugccuguccagaucaaucucgcuucuacacuuuaugcacagccccuguuagagagcagcaguucuaaucccaugcaguucugaucccagguucucagaagcuaucuugcucacagugguaggacuuacuagcuauuuuaauccugaguaaguacagaauuucuaugucccucagguugcucaucuaucagauugggagaacaguaaugguuaugaaugacaguauugggaagacuaaaugagcuuaccacagcuaagagauuugggagagaugaagcaacagggaaucaucaaaauccauuagcuguugcugguccaauggcaaaaggagaagcaguuauggcauauuuaugugaaugguaggucaaugggcaucuucuucaggcugggucauuauuucaacauuagggacaaugacaggaugcucuagcuaguucuagagauuuacacuaagauggaaaggguagguacaguauauaaaaagugacaguccauugugcacuaacacuguagacuaucgguaggguaucauugguacuguuaggcacuucacaguacuucaagugaaagaaaggcauggauucauggaucuagucccuacacacaacagggguuugugaugcacaaauauuugucauugguagugauguuaauacacauuugauggccaguuuauaaaaacauaccucuuuaucugcucuauaauuaugugaauaaguggccaggugacacaaggcagggauaaaugauggaaagaacacagggacuugcuucuauagaggcugguugcaacuuacuacaaguuguugacuaugcauaugaucaauuagaucagauaaguuuuuuauuguuucuaaauuuuuguagggcuacagugaugacucagugaauaaaggguuuuguugcauaagcaugagaaucugaguuccaaucacauagauaaaaaaguggggcaugggcacauacaugccuguaauguccaugguagacaugggaguuggagagaggaggauauuugggucuuguugucugccagcuuauauccaggcuuagugaguaugauauuaugacuaggaauggccccauagacacauauguaugaaugcuugguccauagggagaggcacuauuaagagguguggccuuguuagaggaaauaugucacugugggggcagauuuugaugucuccuaugcucaaacuaugcucagugucaaacauaguccccuccuugcugcuggcaaauaaagauguagaacucuugacuccuucuccagcaucuccuuguaugccaccaugcuccucaacaugauaaugaacuaaauuccugaaaguguaagccagccacaaucaaauguuuuccuuuauacgauuuaccaucauuauugugucucuuaaaagcaaugaaacccuaacuaagacagugagagacccugucuuuagggaauaauacagagugggaggcagacacuagcacauauauagcacaugcauguaccauauauaccuucuacccauacauauauaccacacacauaauacacacacaugcucauacauauaccucacaccaauaccacauauauuacacacaaugcaaauauaccacaugcuacauauacaccacauauguacauauacuauauaaacaauacacacauauauacaugcacauauauaccauacacaugcaaauauuccacacauauacauacacucauccucuacauauacuuuacaaccauacacauacuccauaugcacaugaaugcccccaaauauccuauacacuuacucacauaccacauacacauacacauuucacauacauauauauuacacacauguacacacauauacacacacauacacacacacucauacuccacauacacaggacauauauacuccauacacauauacauauacacauguaccacacagacauaccucagacaucacacauaugccauauaauacauguacauacuccacacauacauacacauugcacacaugcucauguaccacauauacacaaggguacacacauacagacacacacacuucucacauauuuuuaguacuuauccauccauuagcuauaacuuugaaauaaaaauauucuuuaagagacuuuaaauuguaaaagaacuaauccaauaaaagucaauuuuaaaaauaacuaauucaauaaaagucaacuuuaaagauaaguaauucaauaaaaguugauuuuaaaagagacauuaaguaaggaaaaauggauaauaguuuaucagugaaaguccuuuucuacuggcauagagaguggguccuacuaucccuaucaggagguggagcuuaacuuuagggcaucacauguaccuugucuguaaacuaauguaaacugaggcuccuaaaggaauccagauagggauaaaugcugauuccauauuguucaggauaaaacugaauuauccuuacuuuuucuaugauuaacuauuuuuuccaggauaaauacaugaagaaaaguaaaauagagucagaaaggaaagguuaaaaagcagguuaaaaagauauuagaguuuguaagaucagugcuuugcuauuacuauacuaaggauauuccacaaauauauaaugcauaaugaauugaagucagaauaguaagauaaagaagccauguccuccuauaacuucugaguugguaauaauggggcuuguucuugcugacaaccaguaagaugggggcagucuuucuguuacuaaauaauaucauaucacaggauggaaagacgagcacucagcaucacguacuuucaaaacucugcccaggaagaaguccuauguggcuaccuucuuuuucauggccacuguacuuuuccccaguuucaaacaguguuagaugugagccgaucccugugcacugcuugaguuaaacaguucugacucccaagugcaggcaugcucacaauugccuucuuuuuaaaggccagcauccaauauagaaucauugcuaguaaaucuuaaagucuuaaaauuuugggggagcugauuggugauuuggggauccauacaaguaggauaugaacauugauguguuggaguuauagaaggcaaaauacagcaagcaguuuauacaucaguguucugaaacaaugaagcuagcauacuucaugaaaucauugaaacugguuauugaaauguugacauaaaaguauucaacuagguggauacaaggagggaauaauacuacuguuuaaguucaaaaacacguuaauagggaaaacaaagaucauugccauacaguuuucaccaucaacugagcagcaagagauugaguuuucagaaaucucugagaugguaccuaucagagaaaugcagccuuggcaauagaaucuaguuuuccuaccauuaauuugucucagucacaagaugacucauacccucacaauacaaacugauuaugaaaaggcuuacaagcagagcggguagaugggcagagugggugggaccuuccaagaacuucagauuauccugaggaaugugcagaaacacaaaccccacugggaggagacagacaggugcucugucugguaagaggccucuuccuccaaauguaugauauccaacuccccaguucacagaccaaggugucaugaauuagcccagguugucccuguuaucacugaacgaaaaaggcacaguucuuagcuucagauacacaagccuaaaacugauguguaguuguucaaaucaacaaaauagaaaaaaaaaaggagguuaaaaauaagaaauggacuuggguugugacugcuuuguaggggacaagauggaagcaaagcaaaauauaaaugagucucuuggauuuaacuucuauuuuauucuauucuauucuauucuauucuauucuauucuauucuauuucgagggcuucuuucugauuucaggaucuacauaaguaggauaggauguguuggaacuaucuuguacuagcucacaaaguuguuaguauaauuucagaaaaaucuauaagcuguuuaaaaucauaguuaauugaguuauggaaggcauaauugaauaguuacauagaaacugagaaaauacccuuuaguauucuaaacuaaauacuugccagaagagucacucaugcacugacaaaugaguuugguuuggcaaugaauuuuugccauuucacuuuugccuugcacguacaucaacaaagcuaucaguaaacauucauaucucgugcacacuuguuugucagugaugaggaagaggagcuaauuggauagacacuaagcuuuuaauucaagcugaauuuuccagaucaugguuacauuauaaccagauugaucauagauagagaaauucaacaucaacaaagcauugagugacaaucaaauuggcuuuaugaaacucacugaaaaggugaauaucuacuuuaugacuauauauaaauuaugugauacacauaguuuugcaccaacaaaauuuaagauaaaguuguaugugcauguugguuuauguguaccuacacacaugcauauauaaacaaaguuuggcaacauuaccugcacaccucuaacuauacauauaacaacaacgacagcaacaacaacaacaacgacaacaaaacccucacagaaaacauggucacacaacuuuccuaaaggaaacuuuauuuugauugaaauugggagagagguguugaugaaugaucauuaaaguucaacaaagucauuuuacauugcuugaauuuaguuuuuguuuuaauuuaauuuaauuuaauuuaauuuaauuuaauuuacuucacuuuacauccugcucacugcccccugccuccagucaccagucacccuaucccacagucauccucccucccuccucugcuucuccucugggcagguguggcaucccccaacccuaccccacacuucaagucugugaugcuaagcauuucaucucucacugugggcagacaaggcagccuagcuggcaguguaagacucugacaagccuuagcuuaucagggacugacccagacccuccccugcccacccaaauaaacaagguggagccagugaucaaugcaaagcaagaguaauuuauuguuccagcaugcuggggucaucauccugcacccgaaggagagguggggacccuggucagccuguuuggugaguuuuuauacaguuuccaggggcagaauagagcaucaguaaguaggcacaauaugauuggagaaauagugcauccuuuaaacugauuggucuuuagggaaugaaauagcaggggcuuaauuagccuauucuuucuggccuacaugugcucugaccugucucuuccaagaugggaggaauaccugguggaauuuucuaacagcucugagcugaccucuucauuccccacuuuccuuuguucaugcuuuaauucugaagcuauuguugguauucugauagcuauaggcaacagauuuugagauagccccugcuccgguuguucaggacccacaugaaguucuagcugcacagcugcuacauaugaacggagaggucuagguugagcacguguauguucuuugguuggugguucagucucugcaaguccuaaggguccagguuaggugacucuguugguuuucuuguggaguuccuauacucuucagaacccacaauccuuccucuuauucuuccauaagaauuaccaugcuccauccacugcuuggcuaugcaugucuauaauuuaauuuuuaauacuaagcuaccacaaucuacugaaaaaguguuaaauuuacauucuuuuccucuuguauugaaggaggguaguggaauugugcuguggggcaguaaguaaauccccacuucaauaagaggauaggaacgucaguaccuuauagacugccagugggcugccauggacauuacaggaagcaauggaaaaugcuaaacagaaaacaacaagauaaagucuugagaaagcucuacauuagaucugguucauagugauauuaaaaguuucugcuuaauauuuaauauuauauccaagagaguucagacauagagcucaaucaauuuuuagaauaaaauaaaagagcaaaauauuccugaaguuuuauuuuucagaaaauguaacauauuuuggcuaacuggaauuacagccaaacagaauuagcauucuaauauagacuugauaacuguuuuuugauguuccuaagaaaagacaaugucaggcaugccccucucuguuuuucuuucccuacucuuauguaccuugagaaagcuccccaauuggccauuaggauuaguuggagguuccccagguauauuuaguaaaggcacucacaagaagacagaaggugcacagugggcucagccacucaccucucagcuuccauaugccucaauuuaaccucuaauacuguuaauguacauacuuaucacugagagauucuagaaguagagagaagugcugugccuucucugcuugagagaguauagaauagaauaaucccaggaagaaaaauauucucugaacucgccccaguguuggcaucucugguaggguuugcaucaggguauucugagcaccuauagaugagccaggagcucaucuggauuggguuuggguuuuguggcgauugugacauuugaucacuguauuucaagaucuagccucuuguccugcaucuuccuagcaaaucuuuuguuacuuugaacccugauuuauguuuuccuuucuuugucucugaaauacauaugccuagagucuuaccaacagguauguuuuucuuugacuucucucucucucucucucucucucucucucucucucucucucucugagccuggagauauacaugaagggaaugagcauugcuuucauuaaaaaaaaaaaaaucaguuuucuacugggaauugcuggcaccugccauguucccuguaggauuucuuucuuuuuuuuauuagauauuuuuuucauuuacauuucaaaugcuaucccaaaaguccccuauauucucccuccucccugcuccccuacccacucacucccacuucuuggcccuggaguuccccucuacuggggcauauaaaguuugcaagaccaaggggccucucuucccaaugauggccgacuaggccaucuucugcuacauaugcagcuagauacacaagcucugggggguacuaguuaguucauauuguuguucuaccuauaggguugcagaucccuuuagcuccuuggguacuuucucuagcuccuccauugggggcccuguguuacauccuauagaugacugugagcuuccacuucuguauuugccaggcacuggcauagucucacaagagauagcuauaucaggguccuuucagcaaaaauuugcuggcauaugcaauagugucuggguuugguggcuuauuauaggauggacccccggguggggcagucucuggaugguccauccuuucgucuuagcuccaaacuuugucucugcaacuccuuccauggguauuuuauucccuauucuagggaggaauaaaguauccacacgcugcucuuccuucuucuugauuuucuuguguuguaaaaauuguaucuuggguauucuagguuucugggcuaauauccacuuaucagugagugcauaucaagugacuucuucugugauuggguuaccucacucaggaugauauccucuagauauauucauuugccaagaauuucauaaauucauuguuuuuaauagcugaguaguacuccauuguguaaauguaccacauuuucuguauccauuccucuguugagggacaucuggguucuuuccagaucuggcuauuauaaauagggcugcuaugaacauaguggagcauguguccuuauuacccguuggaacaucuucuggguauaugcccaggagaggcauugcugggucuucccguaguacuauguucaguuucccuguaggguuucuaaaaguuugcauccauucaggaugaguaucagcagggagguagaccuugguccagagaacauuugugacuuuuagaacucauccaauaaaagaagccaaugcuggcauuugcuuguaaggauaagaaaguuaugggaucaagggcaaaaaccuaugugggugcagcaagucuaucaggcaaacucuggcuacauuuucuauuucuaaauauuccagcaccccagagcuucccuugcuucuauaguugcaugucauauuacuaaccaaagaaagauugaaaaaaaaagaaagaaagaaaaaaaggaagagugcacuggagcaaagcguuccauauccuaccauauguguggcaugaaaaauacaaacuccccuaauggugaccaauuagggaaaaaaaaugggaaaaaacgcagugcccacucucaguagaggaugccaccacucucauuagcugggagcauuaagcaacucuucugacaggcugggagacagcauuagauaucuggaaagaaaauauguaguaccaaacacucacuaacuugucagaaaauaugguacagguuuuccagaaugggaggcagauaugaauggcaaguccggaaauaaaguccggcaugugaggaaagaagccaaggcugaguaaaagggaaagggaggcaggaaauaaaagacaagagagaaaaugaaauuaaggaaauuacugaucaaagaugguaugaacauaaacccugaaccccaacccaucccccauuacuugccacccucaccaaauaccauaguccugugcaugaccccucacugcugaucucugggaaagcuaagagagcagagaaggaccaccagcuccagacacucucuaguuucacacuuuguuccccagacucuaaaaaucaucuuuagggaggaacuuccauuugcagcuacaaugcgaauaggaacccaauuccagaugugagacaagacugagcacuucaggaugcagucugccccuuuaaauacccccuuauuacuguuuuccaagccuguugguaaucugaagguacaaaguaaggcucccucuggcugccacaggcagaacggccaaagaaaaacuguaugucauggugcccuauuauaauaacagauuaaaagagaacaaacagguuacuaauuaguggucauaaaaccuggaggcugcagacuguucaucuucauaucugggcaguaaaacuuccacaugugcagauaagauaggcauaaaacaccagggggcagaugcccacccauggagggcucagcuggcaggagccaggcugggggcuggguuuugcaguacaaaucucauucuccuaagcauccaaaggcauucagaugacugcccaagaauuaaacuacaggcagccuaaagcuaaucaggugccucccaacucuguuagggacagugaagaccuuacagacaucugguugaucaucugagagucccuuugcccaagauguauucugccuguggucucuucuaggauuuuaugcagaaggcuacuucugagaaaugagacgguuuauuagcauucaggggccaaaguuuagccuggaggagacauaccuucaucaauaaaaucuuuuuugauuaaauucagucuuucuucuugggucugcucagaguguggaaaauaagccgggugugcuuucuaacuuuuauccccaauuuguucccugaggauuucaaggauucuauugccaugagggaaaucucugagaagaaagagaggaguguuauuucauucaaaaguuggcuguugauaaauuuacacccagaaauucagacuugaaaauucuaccuaucuaucuaugugguaucuggaaguuacuaaucuauuauguuuaaaagcuauacauggugcauaccaagaggucccuuucacaaaaaucaaaaacaaaaacaaaaacaaaaacuuaaguuuuguuguuguucaguaaggagaaaaguguguccauauuacaugugaauugguauagccaucaaaagucugcaugaaagcacagaaauauuagaaaaaauuauagcacaaucacuauuaucuuauuuuauuccuaauuucauaaugaucucuguguaucacuuaaugguaaacaauguguaguauaaaguaucugaaguaaaaaugucaagguguguguguuuguguguuugcagcuaucaaggauuccaccuaggaccucaugcuuacugguuaaaugauuuauucaaagugcauaagacuuuauaaagauauguaucauguguguguaugcacacacauauaugcacguacauguguagcauaugaacacacaugcacguguaagggauagagggcauugaagauuaagcccuauuacucucugcauuaucuugaaacagggcuuuuugacaaggcuggaauuuauaauuuuucaguuagacugguagccagcaagcccuuguuaucacuugucucuacuccacugcaccaggguuauagacacucauggcauacccggcauuguguccuggguauuugaauucagguccucaaguuuguucaacaauugcuuccaccugcuuauccaccuucccaauccccaagcccuuccuuugcuugaacaugaauuucaaaauagaaaaaaagauaucugauccucuuuuuaacuuucuuggggggagugggcaaauaccaucaggacugaguugugcucuacucuccaauggugauauggcuuacccaauauaaccuuuuuaaagauuuacuuggucuauguguucuucauucuacucuuauuuuugaccucaguacgcuaccugagauaauauaccaagauuguccaaaugcuuggacuuuagcuagugcaaagucaacuagauagaagaucucaacaaucagccuuggcuuccuggcacauaccaccagacgcugcucauccgcaacuguucuuaagguuucugaugauaauauagggcacuucccaagaauuugcuugcuuaauugauucuuaagaaguuaauccaugagagucuaaagguaauaaaucuagcauaguaaccacagacuauuuaggaaaacuaauguuacauuaaauaaaaccuuuucauaccuccaauugaacuauauggauaaggccccaagaauuguguuuggcucauuagagaaucauggccuagccauuucuguucuucagaagaaccuacacuccuuauacaugaaacuacagucuucauccauccucugacuucccucagaguggagcugaaagguuuacuaagagaagaaagcaugaaugugccuugcauauuucaaaagaaacaugauuucuaaauaaacucaagucugaacugagugcuaauggaagcuuucucuuguacacaggcuuagaggacuuuuacugcacaccauucuuggugcucacuaaggagacauggauucuuuagggguugauaaguacuacguucacugagaagagccagcagccaucaugcaguaguccauguacaauucuaaugagaggacacacacuggcagagauauguguuguucuuuucccuucuccuggcaaagacaacauguuacauuuuuuucauagugcuuauuauuucuuucuuaauaucaucccucuuuuucauugaaagccuugauuagaaucccaggcaaagcuuuauacuuucaaugaggagaucauuaaaaaauaacauaucuaaauggcucucaaaauaccacauuaugguuaauuggcagcacaguuacagggcacugagacacagugauauuaaaugucagaaaacaaggucugaucugucaguuacuuuaugauuuccaaguagagaguuaacuucuuggagaugguagagacagugaaacuccuggaagugcucccuggucagaacaugugauuuucuugaagagggugaccaagaauuccuuggaaggaaucacaugggauucugucauugguuuucucucucucucucucucucucucucucucucucucucucucucucucuuucuucugucugucugucuccuucucugucucugucucucucucugucucugucucugucucucucugucucugucuccuucucugucucucccucucucuuucuuuuuuucuaaugaguuuuuauaauuuauucucuacacaugcugcaguaggauaauucuaaagauaauucggauccucacucuagaaguccuucuuauaauccaaucauuggaacagaaacugguguccugaauucuucuguuuucuaaccuauaggacaggguuaaagagagauuggacuuggcuuccugaauacccagugcuacaucuacccauuuccuaugaagaucugaaguucaccuuuuuguuucugugagaaaauguuuauguuaauucccaugucaagugggaacaaauuugaucagucuauuacuacuuugaaauuaaucaaacauguuuaugcaucuuaagagucuaaaucagaauuuguagguauggucuccuaaauacuauugccucaagggcucuguguaagagagcaaaugaaugaaagggaagagaauauuuacauaguuuaggcuacuuuuagaaaugcuuaucaauauauuccuccugaaaaccucaugaagaauccuaaggucucagaauuucuccaaauaagcccugcuuuuaacuguguuugagauuuuuuuucaguauuacuuaccuauagaguuuucuuaaucuaucuccuuggcccuagucuuucauuauuccagagaauuggauguguauauguuuagaagcuuccuuguuuugcacggcucucauccaguucaauauaaucacauaguauaaacucagcauuuauccaguaugaagucaccaguauguacaugugguggguugaauaagaauugaccuuauaggcucauauauuugagugcuuagucaccaaguagugguacuauuugaaaggauuagaaggauuagaagguauggccucauuggaauagguauggccuuggugguggauguaugccacuggggauuagcuuugagguuucagaagcccacacaagcccaaugucucugcuucucucuuuauagauuaggauguagcaaucagcuucuguucagcauuaugcuugccaccaugucccacccccaugaugauaaugaacugacccuuugaaucuguaagcaagcccucaauuaaaugcuuucauuuguaaaaguugugauguucauagugucuuuucaaagcaauagugucuaagacaguauccaaaugaguagggcauggacuaaccuacaccaaggacuuauauacauucccagugcuugauaaucuauaggcaaauaauuaacugaugauuccuccaguuuuccaagguaaagggcccuuaauggcagguuaacuguuggccccaguuagagauaaucucaauccgaaauugugacacucucaaggauaccaaggcaaggguauggacaauuaaccaaagcuaaaagauaugugauaugggaggggguugguguucuuuaugaagaccaaaguugguaaaggcaguaguuguugaguagguuccaaauagaaggguguuuguuguuagucaaaagaauacaggacaauauaaggggaauagcuauucuggguuauucauuuccuaauaccacaaagaaauaaaaaaaaaaaagcugagaaucccaugaauugccacgaaauuucaacuaauuccuucagauaaagaauccaccauauauaauuucauauccugcugcaugucagagacauauucaggucucuuggcuucccucacuugggcaacuuggccucuugggcuuucucagacaacuauuuguugggcaucagugucaggauacauuuguacccccaccuuaugaagcuaacaucuuuuuaaaugcuguauauuuacagguauuuuguacauaacucacauugcaugcaugacuuugaggaauuucauuugaaaaagaaaccucauaguaaaacagcuuugaagggacagagauagaggcaaaugcuggaaugcagacuuuaauauuuuuaaaaguguguguaggggauccaaagagagcuaucucaguugacaaagggcucccuuugcaagcauaagaaccuuugcuugauuccaagacacuauuuaaaaguccuuagauuuggugguaugugcuugugacucugugacagauacaaacaggcagaucccucuguaugucugggcagccauucuagacaaguuaaugaguuccaggcgaaagagagacaaagcacgcugauggcauuccugaggaggauaucagaaguuuucucuagcuuucacauacauucacauaugugauccaucuacauacuaauaugcacacacacaaacacacuauacaaauacuugcacuaaaaagcuauugggauaaagaugaaagaaagcuaaaaggcuacaaagaauacaugacaauaaucuguagucccaaguugauuuagccacauuccuucugggaucuucaaguuacacagaccaauucaucuuaaauaaugaacccaugacgggcaaacugaaguagaaugagagagaaaaacuacaagaauuuagauggucaaacaagcaguuggaugugaguaaaacaaagugagcuucgugccuccuaagcaaacugacaaauuguccucuggaguccaauuuccagcaucagcaccacuuugccacaauggccugccuccugccucuccagccuaauggcucuccaugccaagaagugcagucaguaugauuaaaauaaccaucaacaaaaugguccgguaauuaaccaucuucuuuuuaaaguauaauuguggucagcaagauugaugggcucuucuggucauuaacaaucuauuuaacaaccauaaauuuaaagucaucacuuuccugagccccaauguuaaggagguuagggggcagacagaguuaagagcuggauauuaagccagaaugugaaaagcaagauuuacaaagaaguauuccccuaagagugcuguggaccuaagugaaaauggguguuauuaaugcuacaggauguauuuaauugcuuuuuuaagaggaaaaaaaacuuaauugaugcccaugucacagaaauguaacuuagguggaagucgggcauugcuaaagauugaauccagacaaaaauaaagaguauucaaaaugaaccaccuaccaauauaacaauuaaaguagugcauuuugaaaucaccagcuguugauggaauuuucaaaugcuauauaaaacacaugcaaguguuagacuaccuuuaauaucauaucugagaagcuuccuugacugaaagaaauuucauguaugucugugaacuuaagguugugcuuagcugguuguguuauuagugagugauaccauugucauuaucacaccauauucugaccuaaggguuuuuagguuuuguuauuuguggcagugguuuguuuuguuuguuuuguucuguuuugcuuugcgugaagcuuaugcggguccacuuguccauucuugugagccaggcaagggaucagacagcuaaaucuuccacuggauuauuuucuaauaaucucacugacaagacugaacauuccaggaaagaaccaguggccagaagaaaaaggagacauaucucucacuacuuuugggcuuuggauuguuucaggaaacuauuccaaagcaagaaaaauacacacauacucuuauaaacacacacacacacacacacacacacacauguugggagccgcgcccacauucgccguuacaagauggcgcugacagcuguguucuaagugguaaacaaauaaucugcgcauaugccgagggugguucuccacuccaugugcucugccuuccccgugacgucaacucggccgaugggcugcagccaaucagggagugacacguccuaggcgaaauauaacucuccuaaaaaagggacgggguuucguuuucucucgcucuugcuucuuacacucuugcuccugaagauguaagcaauaaaguuuugccgcagaagauucuggucugugguguucuuccuggccgggcgugagaacgcguuuaauaacaauuggugccgaauuccgggacgagaaaaaacucgggacuggcgcaaggaagaucccucauuccagaaccagaacugcgggucgcgguaauaaagguucccguaaagcagacuguuaagaaggauucaacuacaugaauucagaacuuuucagcugggggaacgagaguaccagugaguauagcuuuacgagguaagccuggccuugaacuuucuaaggaaauucaagacagucuaucagaaguaaaguggaaaauggcuuuacaaguuauguuuggccuugaauuuuuucuaguguuagaagcccuuuuguuccuuuucacauguuaucaagugguuaaggcagggcggauucuggaugaaauucaggacaagcuaucagaaguaaagcggggagagagaguaggaacaaagaggaaauaugguacacaaaauaaguauacaggccuuuccaagggucuugaacccgaggaaaaguuaagguuagguaggaauaccuggagagagauuagaagaaaaagaggaaaaagggaaaagaagaaagaucaauuagcggaggucucuaggaaaaggagccugugcucaucgcuggaugggcucggggagccagcucuugguagcucugaaucagaugaugaauucuccucugaagaaacagacugggaggaagaagcagcucauuaugagaaaaaaggguaccagccagguaaagugcuagcuaaucaguuaaggaagccaaaagcggcuggcgaaggccaguuugcugauuggccucagggcagucggcuucaagguccgcccuaugcggaguccccgcccugcguagugcgucagcccugcgcagagaggcagugcgcagagaggcagugcgcagacucauucauucccagagaggaacaaaggaaaauacaacaggcauuuccggucuuugaaggagccgagggugggcguguccacgcuccgguagaauacuuacaaauuaaagagcuugccgagucgguccguaaauacggaaccaaugcuaauuuuaccuuggugcaguuagacaggcucgccggcauggcacuaacuccugcugacuggcaaacgguuguaaaagccgcucucccuaguaugggcaaauauauggaauggagagcucuuuggcaugaaacugcacaagcgcaggcccgagcaaacgcagcugcuuugacuccagagcagagagauuggacuuuugacuuguuaacgggucagggagcuuauucugcugaucaaacaaacuaccauuggggagcuuaugcccagauuucuuccacggcuauuagggccuggaaggcgcucucccgagcaggugaaaccacuggucaauuaacaaaaguuguccagggaccucaggaauccuucucagauuuuguggccagaaugacagaggcagcagagcguauuuuuggagauucagagcaagccgcgccucugguagaacagcuaaucuaugagcaagccacaaaggagugccgagcggccauagccccaagaaagaacaaaggcuuacaagacuggcucagggucugucgagagcuugggggaccucucaccaaugcaggcuuagcggccgccauccuucaaucucagaaccgcuccaugggcagaaaugaucagaggacauguuuuaauugcggaaagccugggcauuuuaagaaagauugcagagcuccagauaaacagggagggacucucacucuuugcucuaaguguggcaaggguuaucauagagcugaccagugucgcucugugagggauauaaagggcagaauucuucccccaccugauagucaaucaacugaugugccaaaaaacgggucaucgggcccucggucccagggcccucaaagauaugggaaccgguuugucaggacccaggaagcagucagagaggcgacccaggaagacccacaaggguggaccugcgugccgccuccgacuuccuauuaaugccucaaaugaguauucagccggugccagaggagccuauaccauccuugcccccgggaaccaugggccuuauucucggccgggguucacucaccuugcagggcuuaguaguccacccuggaguuauggauugucaacauuccccugaaauacagguccugugcucaagcccuaagggcguuuuuucuauuaguaaaggagauaggauagcucagcugcugcuccucccugauaauaccagggagaaauuugcaggaccugagauaaagaaaaugggcuccucaagaaaugauucugccuauuugguuguaucuuuaaaugauagaccuaagcuccgccuuaagaucaacggaaaagaguuugaaggcauccuugauaccggagcagauaaaaguauaauuucuacacauugguggcccaaagcauggcccaccacagagucaucucauucauuacagggccuaggauaucaaucaugucccacuauaagcuccguugccuugacgugggaauccucugaaggacagcaagggaaauucauaccuuaugugcucccacucccgguuaaccucuggggaagggauauuaugcagcauuugggccuuauuuuguccaaugaaaacgccccaucgggaggguauucagcuaaagcaaaaaauaucauggcaaagauggguuauaaagaaggaaaaggguuaggacaucaagaacagggaaggauagagcccaucucaccuaauggaaaccaagacagacagggucuggguuuuccuuagcggccauuggggcagcacgacccauaccauggaaaacaggggacccaguguggguuccucaauggcaccuauccucugaaaaacuagaagcugugauucaacugguagaggaacaauuaaaauuaggccauauugaacccucuaccucaccuuggaauacuccaauuuuuguaauuaagaaaaagucaggaaaguggagacugcuccaugaccucagagccauuaaugagcaaaugaacuuauuuggcccaguacagaggggucucccuguacuuuccgccuuaccacguggcuggaauuuaauuauuauagauauuaaagauuguuucuuuucuauaccuuuguguccaagggauaggcccagauuugccuuuaccauccccucuauuaaucacauggaaccugauaagagguaucaauggaaggucuuaccacagggaauguccaauaguccuacaaugugccaacuuuaugugcaagaagcucuuuugccagugagggaacaauuccccucuuuaauuuugcuccuuuacauggaugacauccuccugugccauaaagaccuuaccaugcuacaaaaggcauauccuuuucuacuuaaaacuuuaagucagugggguuuacagauagccacagaaaagguccaaauuucugauacaggacaauucuugggcucugugguguccccagauaagauugugccccaaaagguagagauaagaagagaucaccuccauaccuuaaaugauuuucaaaagcuguugggagauauuaauuggcucagaccuuuuuuaaagauuccuuccgcugaguuaaggccuuuguuugguauuuuagaaggagauccucauaucuccuccccuaggacucuuacucuagcugcuaaccaggccuuacaaaaaguggaaaaugccuuacaaaaugcacaauuacaacguauugaggauucgcagccuuucaguuugugugucuuuaagacagcacaauugccaacugcaguuuuguggcagaaugggccauuguuguggauccauccaaacguauccccagcuaaaauaauagauugguauccugaugcaauugcacagcuugcccuuaaaggucuaaaagcagcaaucacccacuuugggcaaaguccauaucuuuuaauuguaccuuauaccgcugcacagguucaaaccuuggcagccacaucuaaugauugggcaguuuuaguuaccuccuuuucaggaaaaauagauaaccauuauccaaaacauccaaucuuacaguuugcccaaaaucaaucuguuguguuuccacaaauaacaguaagaaacccacuuaaaaaugggauugugguauauacugauggaucaaaaacuggcauaggugccuauguggcuaaugguaaagugguauccaaacaauauaaugaaaauucaccucaagugguagaauguuuaguggucuuagaaguuuuaaaaaccuuuuuagaaccccuuaauauugugucagauuccuguuaugugguuaaugcaguaaaucuuuuagaaguggcuggagugauuaagccuuccaguagaguugccaauauuuuucagcaaauacaauuaguuuuguuaucuagaagauuuccuguuuauauuacucauguuagagcccauucaggccuaccuggccccauggcucugggaaaugauuuggcagauaaggccacuaaagugguggcugcugcccuaucauccccgguagaggcugcaagaaauuuucauaacaauuuucaugugacggcugaaacauuacgcagucguuucuccuugacaagaaaagaagcccgugacauuguuacucaaugucaaagcugcugugaguucuugccaguuccucaugugggaauuaacccacgcgguauucgaccucuacaggucuggcaaauggauguuacacauguuucuuccuuuggaaaacuucaauaucuccauguguccauugacacauguucuggcaucauguuugcuucuccguuaaccggagaaaaagccucacaugugauucaacauugucuugaggcauggagugccugggggaaacccaaacuccuuaagacugauaauggaccagcuuauacgucucaaaaauuccaacaguucugccgucagauggacgugacccaccugacuggacuuccauacaacccucaaggacaggguauuguugagcgugcgcaucgcacccucaaagccuaucuuauaaaacagaagaggggaauugaagagauuuuaccccgagcaccaagagugucugugucuuuggcacucuuuacacucaauuuuuuaaauauugaugcucauggccauacugcggcugaacgucauuguucagagccagauaggcccaaugagaugguuaaauggaaaaauguccuugauaauaaaugguauggcccggauccuauuuugauaagauccaggggagcggucuguguuuucccacagaaugaagacaacccauuuuggauaccagaaagacucacccgaaaaauccagacugaccaagggaauacugaugucccucgucuuggugauguccagggcgucaauaauaaaaagagagcagcguugggggauaaugucgacauuuccacucccaaugacggugauguauaaugcucaaguauucuccugcuuuuuuaccacuaacuaggaacuggguuuggccuuaauucagacagccuuggcucugucuggacagguccagacgacugacaccauuaacacuuugucagccucagugacuacagucauagaugaacaggccucagcuaaugucaagauacagagaggucucaugcugguuaaucaacucauagaucuuguccagauacaacuagauguauuaugacaaauaacucagcagggaugugaacaaaaguuuccgggauuguguguuacuuccauucaguauguuaaauuuacuagggcagcuaaauugucaaaaagucuuuuucaguauauguuacagaauuggauggcugaauuugaacagauccuucgggaauugagacuucaggucaacuccacgcgcuuggaccugucccugaccaaaggauuacccaauuggaucuccucagcauuuucuuucuuuaaaaaaugggugggauuaauauuauuuggagauacacuuugcuguggauuaguguugcuucuuugauuggucuguaagcuuaaggcccaaacuaggagagacaaggugguuauugcccaggcgcuugcaggacuagaacauggagcucccccugauauaugguuaucuaugcuuaggcaauaggucgcuggccacucagcucuuacaucucacgaggcuagacucauugcacgggauagagugagugugcuucagcagcccgagagaguugcacggcuaagcacugcaauggaaaggcucugcggcauauaugagccuauucuagggagacaugucaucuuucaugaagguucaguguccuaguucccuucccccaggcaaaacgacacgggagcaggucaggguugcucuggguaaaagccugugagccuaagagcuaauccuguacauggcuccuuuaccuacacacuggggauuugaccucuaucuccacucucauuaauauggguggccuauuugcucuuauuaaaaggaaagggggagauguugggagccgcgcccacauucgccguuacaagauggcgcugacagcuguguucuaagugguaaacaaauaaucugcgcauaugccgagggugguucuccacuccaugugcucugccuuccccgugacgucaacucggccgaugggcugcagccaaucagggagugacacguccuaggcgaaauauaacucuccuaaaaaagggacgggguuucguuuucucucgcucuugcuucuuacacucuugcuccugaagauguaagcaauaaaguuuugccgcagaagauucuggucugugguguucuuccuggccgggcgugagaacgcguuuaauaacacacacacacacacacacacacacacuugcacaaacacagagaagggcuagagauguaacucagcuggguaagaguaauugcugugcaaacuuaaauucccgaguuucaaucuaugcccagaaucaauguaaaaaucuagauauagucacauacaugcugguaagcccaagacuguugggaagugggguggagacaagaagaucacuggaguuugcuggcugccagucuagcaccauauuaagcgagagauccagucucaaggcacuaaagcagagaaugauagagcaugacacacaaguuccucuuauggccucugcccauaagcucaucuguuuccacccccccccacacacacacacacauuauaaaauacacccaaacacauaaaggcuauacauacacaaagcacacacacauacacaaagcacacacauguccuuucccauacuaagcacacacacacauauauacacagacauacacagacacacauaucacacacacacacacacacacacacacaagacacagagggaaauaaguuacauuuuauauguuuuaauuuguaacaaacaguccuguaaauuaucuguacaaagguauuuucccagauagagaccuagaggaaacccccuggugaagggcuaggauuuccuucagcaauguggcaacaucacagguuugcugacuucuauuaaaauaagggugcucugucugugugacuaaaagacaacugagcagaccagugcuagugcuauugauugaaguuaaaaggaaccugaaaaauuccugaggagccauauuucaaguguuuuccuucuucccuagaggcucacuggauauuaacucaggugucgacagcagccccauguuuggccucagaaaaccucacagcuuaauauuucaggaugaagaacugggucuugaugagaaaauaguuuccagcuaaaauaccaucccugaccacaaguaguaucaagcagcagacuuaaagguaaaagagugaaauggccaguugucagcaguuggagagggagcugcccagaggaccaagagaguggcuucugaaggcacaguguaauaugaauccugaccaugcuucuuaucagccuggugagauauuuagguucaacucucugaauaugaaauguuaaaaaaaucaaaauguugucauauuuuuaucauaagaauuacauaaaaauacagaaaaacuuugacaauauccagcaugugguuuuuaacucaguaauauucaucuuaaugcuaaauaauaaaugaaacuggaguucacuguguuaagaaaaaucaaccagacucaaaaagacaaauacauauuuucuccauagaguuaaaauuugugguagguguaggagcuagguaagaagaaauagacuagcaggaucaggaacagaggguaagauguaaagaauaggaucacagcaaauaggccuguauaauaacaucacaauguagucuauuauuuuauauaauuaauauuguaugauaacaaaucaaccuuagucuuauuaccuauggucagucauuacugcuucuugguaauacaaaauggagugcuggcuggagcuuugacuaucugacugccuguuuuagaauucaaucuucauuugauucauagagcagauaagcaccacacuuugagguccagauggcggucgagagcaacacaaaccacccugugcaguucauguguacgcaauacaugauuuugugaauuaggcagaucacuucuagagugaucuaauguauuuggaccuuggaagaucauaugauauuuuaaugauucagaauuuuaggacacugaaaauaauccaaauugauacauuuugaacucaaacaaucaaacuaccuucucuagguuucccagacugcuuaaaacaucucaucucacacuuugcuguccucagccacacuggaggaucaguaggaggcuacuucaguaccagguguuuuuguggcaaagguggaaguugacuaccucaguagcaggcaaacaaacacuuuagaaccaugcacaugaagagaacaggcuuggagauucugagagucacugucuuuaggcauuagagguuggaguucuuaaucaucagaugauacagggagauccuuuuuguuguuacaaaugggaucaaggugcaucagccaucgagugaauagauaccugggaugguaaugaacaucauaugguuucuagcuucuccucucccacucaaaacuccuuacaauuuucaguuaugaaguaccaccagcaccaaaguuagaaagcccugugguacacagaguacacauucauucugaucuuuuacccuacuguccugaaguuaggcacugcuguguccccaguggcugacaugucacaccacacucuauugggccuuagguaaugaaugcuugugaguaaucaggcuuccacagaaacaauagcauugcuuucauuucucuacauggaaaagcaagcagaucuuugaugucuaagucauaaaggaaaagaaaaagauuagagaucauugaacguaacuuugacuguuugguccccagcacauuagauaccacuaauaaagcuguccuucucccggccugucacuccuucauggugacugguauugccguugccuaagcaguauuaguucccuuagcaaaacagcuaggguacagggauguaguuuacuucacagagugguuaccuagaauacacaagacugguuuugauuuucagcuccacaaaaacuguacaaaauagcacaugcuuauaaucccagaacucaggagauggagacaaaaggaucaggaguucaagaagaccuuugguuauguagugacuaccaggucaaccugaacuucaugagaugugcugugaaaccugugucaaaacaaauauauccacucuauuuagaauccauuggcuucucucaugcuuaaagcuauaggcaggcacauccaaacuaccagccucaucugugauaggucacaucuuccuuuguucuuaaugucuaacugcauucucuauacaauaaacuuagcacuguuuaaaauguaagaagcagaucagucaaugucuaucuucaaucucuuccagaguccucagugugccccauaaugcuuggcacuggcaaugacccaacauugagcacacucacugucucccugcauaacaaaaauggcagugcuucuuucucauucuaaaaacuuugccauagccuaggaauccugguccuuuacaaccuuacagggaccaccugaaagugagcuuguccaagagaaaaguaucauuaaguuuccuagccauaugugacagauaugucacuuuuuaacugccuuuggacuuuaggauauagucugagaacauauugucaguaaauuguacauccuucucaccaggacaucaacucugucauugcagggagccaauuuucugcugcuccccagacauagugcugggcccaagagaggucaaaguguaucuacuggauuccuaggauuaaaggacugguuuguaaaugaacuguuaaggggaagcaucucaaaagaaagugaugugaauugccucuugcuaaagaguuucuuagaauuuccaaagucauucccaaauuacaugcuuuguuuaaaacaucaccaauuuaacaggagacuuagcaccgggacaauagagaagaaguugacauuccucaaccagcagcuguaacacagaaacucaauucacaagagaaauuucucucuucuuaagucuuguauuaaaguucauccugccuuuuaaaaucucacauaagagacagugaaauaaugaaagaacaauaaaaugaugucaaugaugcucaguauauaaccaaaagaguaauuuuguauuuuuccaauuaugguuagacugucaugguaugaaacuuaguuuuagucuguuucuuucauaauuacguuacuguuaaaaauuacuugacucucuuauguccagcaguguauaaugaaaguguacuaugucauagcuuguggaaaccaagaugauaucaaaguauauuguuacuuuuuggagaucauggcaugcuucugaaugcaagucaggcauguagaaaaagguggagguaaguugaggaugacagggaacuugguggauggugucacacagaacaagguagaaccaauagaucagguuuucccuacucuaaguuuugcuguguuguacuaaaauguuugcuuaggcuguugcuagcuuugggagacaacaucuucuaaguagcuuuugacucuauuuugaaggaaaggaaugacuaucacucuagauaagccagaaacuguacuguuugucagauccaacauagacugaucugugacucauuccugggaauggagcagaagccauucuauauguuaauuagggugaacugagacuauaggcauacauggacauauuaaaaucuuaucagggaaaccagacccaugaaccaagcagacaugccagacucaagggaaggguagagcuuccccaacugggucccauagagugaugaacccuaacauggccuuacaugaacuuaucaugugauaucugugcucauaccauggguggauaaguagaggacuccaugacuaucccuggagcugaagugcaacuuugucaccuauugcuugacaggacuacucaaacugccuguggcuggucuaccugguugccugaacugaacccacuauuuucugcacuaggacccauguucagucuuuaaccuuacagauggaguagcucuacucccaaauuccucuuaucugguaaguccccuucauauuccugcucauccauggcaggaugaagagacacagcuggcaucuguucaucauggauaauuuuagggaacguuggucuaucuuacuugaucaagaccuugaaagcagggcucuuuaucacauaucucuaauccuuguucggcgcuggacacaugaggcuuguuugacaaaauauuugauggcuguucaagugaauagugaagcugucuuuaguugagagcaaagguaaguccaaauuccuaggaaagugauuccccagggaaaguucauagccuugagacaaaauguugcaaacucgacacgcuggacuuuagauccagugcuauucugcaucaaaauaaaauaaaauaaaauaaaauagggagggguauuucuuuuuuguuuuguuuuguuuuguuuuuuaauggaaauaaauguucuauuugauuuugcuuccaauaaccuaaguugaauuuuuuuccagugucaaaauucaacuuucagccuuccuagaaauggugaugagaucuggugaucagaauuccauaucggggacugguaaguccuagccggaagggagaauacaauugccuuuguuagauaaaaagcacauaccacagacuuggcuugugcucgucucucuucucagcucuugucaauuauugacagccuuugucuuucuuuugcagccauuucaccuuacaacccacacagagaaagaagagccaggaaguucaaguucauacccugaucacuccucauucacuacagcacaaugagagcaguaacaugaaagccacaacagugacaauaagaauggcugcuacaguacaaugagaauuuuguuccaggugucccacgaggcaauuaaaagacauugucagauggaauuuucuacaacaugaaaaacauccuaggcucauucaauuaacacugagaccaagauggugagaggcaucucugagccuuuauucucauuccuucauuacaaagccaugagcaucuccucacccagcuauguucuugcuggacuauaucuugaugccaagaaucaucuaaagugugaccccagccaacuauaaaauccauucauauuuuguuccucuacuaacaaugaacguuaggaauaagaagcagagcuaucuacagcagaauaugugagcgcgagagaaauggugugcaugggacacugaauuguucacacaguuucccaaaggaaaagcaucuuuucugagaaggcagagcugucugagaagacuacaauaguuggaguacagcgggaaaaacuuuuauuuaauuauucaaagaaaaugaugggcugguggcuucuguuagcccccagcauuggacaucaaggagccuuauuuugggagagaauaucucaguauaaauaauaauagaucuuugcaguugcuauggcuuuaugauagaugugauggaaaagauacaggucauuggacagguaaagaaucagacauuuugacacuauauuuccuaccaggccagggauuggaaaacacuuucuauaaagguccacauagaaggagcugaagaaauggcuuacccaguaaagugcuugccuugcaaacacgaagaacugcauuuaguccuaagagcaugaguaaaaacaaaaagcugggcauuguaugcguuuuaauccuagcaucaggcaguggcagacagacagaacucuguagcuugcuguucagcuagccuccccugcuaauccauuucuaauccacuucuggccucuaacuguaugugcccucacauacacacagauacacacacacaaauaguaaguauuuggggauuucaggcccauauaugaacaaaucaucacaguuauuucccagcaaaauuuuaccaagguccaagcauguucagcaguuccugugcuggguaucauggaggcaaagaauggccuuucuacaaaauuuguagauagaaaauacagucucugaacaggacuuggucuuaggacuuucaaacuuaguugcucuuccucucugugagauguguaagcaucuuaugucugauucaccaagaaaaaacuaagaaguuguaaaguaagacauuucugguacugcagcccuucuaccaggcaguucuguacagaaggcaaaacaugaagaguauuucucuagauaaucccagagggguguugagcagguagaagaacauaaaugcugaagggaccucuuccaauucuacagcagacacaaaaaucuaacugaaacaaugaacacaggauaugaauagacauuucucccaauauaauugaacaaaaaccauggacaaauacccaacaugauuagcuaccaggauggaaaaucgaaucaaaaccacagggagcucacacuucacagaccuugggaugaguaaucuugagaaauuagaacagcugucuucaugacgacucggggagaugggaaugaugguuggaaauguaaaucggagugaugguguuagaaacgaccuuggcacaaucuuccagaauuaaacauggaguugucauaugacacaguaacuacauuccuaguuacuuauugaagaagaaugaaaauauauguccacaaaauaauuauaaaugaaaagagcuauucuuggauuauuauuaagaaguaaaauauugaaacaaccugaauuuccauucgacaagaaacagaccuacauucaguccuaugggagaauauucuuugacaacaaauggagagguuucugcacaucaggaagaaaaaaaaaguuaaaaaacacagaacuccugaauggaagaaauacuugcaauaugucuauaacauauuuaaaauaucuugaagcuuagacaauugaauagcaaauaauaugucuaaauuucaaagaugguaaagguguuauacaaaaaagcuuuuugcagcaucaaggcuggacacuaaauuguucugcauucugggcuuauguucuaucacugagguacauccccagacuuucuuuccaaagaaggaauacaaauagccaagagguuuaugauaaaauguuaaaugucauuaaucaucagggaagugcuaauaaaaaccacaggcuaucacuucauacuuguuaggccaaguaugacagucaguagaacaagaggaacacuuguagauuguugguggggauguaaauuagugugacuaucaugaaaaagcacuaguaggaguuuucagacauuuaaaaugaggaccauuauacaacuuagcgaucugaauucuggguauguauacaagaaaaauaagauuauuuccaagagauaugaagaucuccaugcuuacuauagcauuauuccaagauaaagaagggaagugucuaccuaaagacaaauggaugaagaaaauauguauguauguauguauguauguauguauguauguauguguguguguguguauacaugguacacacaaacauaauuuggucuuaaaauagaaggaaaauucauacugauaauaacauauauuaaccuagaggacauuaaaaauagaaagacggaagacgaauguguaccacuucacucauagguuauggugguuugaauagguuuggccuccauagacuaauguguuugaacccuuggcccauagggaguggcacuauuaggaaguauggccuuguuggaguggaaauggacuucuuggaggaagugugucacucuauagguaggcucugaggucuccuauacucaagaucuacccaguuuaagacagucuucuccuugcugccuuugaaucaagauguagaauguucaccucaaugucuagcaccagguuggccuguggccaugcuuccugcaaugcuaauaauagaauaaaucucuaaacuguaagccagcucuaauuuaaauguacuuuauauaagcauugccuuuguuaugguaucucuucauagcaaaggaaaccauaacuaagacauaagugggaucuauaaagguucaacuuacagaaacaaagaguggaccagcaguuccccagcucugagaagugaagaucugcugguaagguguaaaauuucagauauagggugacuaaauucugaccaucugguaccccuaauggugaccacagucaauaauuuauuguauauuucaauuuucuuaaaagauuauaucuuuuuccuacaagaaaacuaguaaucaccuguggugauaugcuagauauauuaacuugauuaugcuaauugcuuuacaauguauacaucacaugucaucauacuguguacaauguauacaucacaugucaucauacuguguacguagcgcacacacacacacacacacacacacacacacacacaaucauuccugacaaaacuggaacagaaguacuuguacauaauaaagauggucauccaugaaaauuugaaacuugagauuacuaaaaucucaguggaucacauaucauuaaacuauagaguuuaaguaaaagagcugcauaggauuugaaugauauuucaguaaaguuguauucaaaaagggaagauucaauuuaguggcugacaaagguucagccaaaaacaaugacaaaacuuauuuuuaguucagcugaggucaaaaauaaaugugacucuuuuauuacucaggugcacugagccuuucuacucucuuguucugauaaucaaaauguuaaaaugugugggaaggucuagagaacagggagccaucagggaguucuucagaaauauggacagagugaggacugggugaacaguggcagcauuuucaaaauuaccauaaacaucaaucugagaaaacagaaugaguugguuuucaggugggcacuuucauuaaacaaauggcgcccaaaugccacucuuaagucaagagagggcagggugacauuuacaagacuccuggaagcccaguccagacgcuggagcuuuccuagcucugcaguggagcacuuugcacuuaaggaaacuaacacauaaagugugugguagaaauucaggggacugaaggcagaaugcaggacuggguguuaaugauggccagugacaaccacaaggauggcaaggagauggggacaaugaagccuguuuucuucuugcuucccaugugaauguacagccccaugaacaaucaacaccauaaaauaguggucaaaaaugggguagauuuccuaugauguucuagauggagaauuaguacuuaucaugaaaaguacuuaccaugccuuaaaauuaagaagaaaaaaaaagaaaaaagaaaagcuggaagaaaaaggaagucccaggaaaacacuuccuugguuguauuuuagaacugcaucagaaucguccaucucaaacuucugggacagauuggguaaaagcaauaauuucauaaaaucauggaauuuucucuuuaauuaagagaagaugugggacaugguggcacaugccucuaaucccaccacuugagaggcagaggcgguaggaucucugugacuuugaggccagccuguuuugcagagugaguuccaggauagccaggacuacacagagagacacuggcuagauaaacaaacacacacacacacacacacacacacacacacauacacaaacacacaaaacaaacaaaucccaacacaacaaccaaaauaauauaaaacagcaacaaaaauacaaagaagaaaacaaauaaacaaugggcugaagagaugggucagaaguucagcucuuccaaagguccugaauucaaaucccagcaacuacauggugguucacaaccauucauaaugaaaucugaugcccucuucuggugugucugaaaacagcuacaguguauuuacauauaauaaauaaauaaauaaauaaauaaaucuuaaagaaaaaucaaauaaacaaaacugaagaacaaacugaggacaguauuuuggaaccuuguaaaaaucccagagagcuaucccagauauuuuuugaccagcuaaaaauaugaauuacauguagucuggcaagaaaagcuaauacaaucugguguguuacuuaacuuuuaacuuucaacuuugcauaaccuaggauuaccaggguagagaaucaaaauuaaggaauugucuagaucaggucagccuguggauaugucuaugaggcauuaucuuuauuauuaacugguaaggcaaggaccagcccacugugggcaucaucauucccuuuuaagggggauccugaacuguauaauagaggaaagagcuagcugagagcaagcagauaaaccacaauguguuauucucuuuuuguucuugacuguggguaggacuagcugcuugaguuccuguccugauuuucucaaaaugauggaauaaaugccagagcauuuuaucacaguaacagaaguaaagcuaggacacuugguaauuuugaaagccagugauaaaacucaaaaauucuaaguuuguaucauucagaauaggggcauuaucagaagcaauaacuuugaauaccugaucacacaauuuguaugacuggguuaaaccaacuaaugccugacauaucuuuuauauguguguucuaggcaguuucaacuuuaauuaaauaugaauaucaaaaggcuuaaaucuauaaaaacuuauuuuaguaauucuagguucagcuauaucuaugaguuuuuaaauuucucuauuucaaauuaucugguagauauuacaaaggcacaguuugaguccuuuuuuacuuaauuauuauggaaaguacauuaauggguaggaaaugcaauagguuaacuuacuuuacuaauagaaauacuauaaggacaaauugccaccacuuaagggauuaucuagcaacucaauaaauucauaaguaagaucaaagacaauuauuuuauauacuuggcuauuuuauaauaaucaaacacuagaaauaaaacucauuguuuuucuccucugccugucuuuauaugucucucugccagcaccccccucccaucaccaucacauacaugcaaaccugaaaggcacaaauaauaauuuaucccaguggucaguuuucuggaagcugcuguguaacuccaggaguggaccuuuaguuaaaagguaagagaucugggcaacagcuguguuuaauugcuggaucccugaagaacagugccaaagucuuugaggaauuuccuuugcagaagucuccccuuccucacuggauguccugacaguacaugugugacauuuacucugagaauaaauuagcacaauguuuuuuaauucagagagcuggagcuuagaaggaaaugcugaacccaaaggccaugcaugguauuccuugauuuuaggugcgcaugaauguguauaauugugaagaaagccagucuuaguauuaauaacaguuguauuaguuacuuuucuauugacaaaacuccaccaucaaggcacauuaaagaagaaaggauuuaugguuccauugggauagaaagcaugguggggaggcagguagcuggcauggacuuaaagcagcaguggagagcucccagcuuguauggcaaacaugaacagagggcaugaccuagaaauggcaagagucuuuaagcuugccuccagugacaaacuuucucuaauaugaccauguacaauuccuaaaccuccccaaacagcaccaacaacuggagagcaaacauccaaaugcuugagaugaggauauuucccauuaaaacuacaacaguaagcuucugaacuucaagcucauucuucucucuacugugcuggggcuuccgcaaguaggacuuaaacaauacugaaagaaagugcgaaauuuaaccuauauuuguaaguacguuuuaaagaacauacaacuaguuugguuuccaaaggagucuguaacuaaaaacgcaucaagagucauagcauguaggaccagucaaaaucaaagacacugaaguuugcuuggcagaugugcucgaaccgucuuugcugggagucuuucuagaaauucaggggcugaguuaugucucaguugccuucaugauuucccugauauuuucauauccaauugacuauucuuuuaauguuuccaucaaaaaaaguacaauuccaaaaauacucucaucugucuuaguaccaucuucucuccuuuggaaacaaacuauaguugucauguugacaacuguaaauagcaaucaggaugauauuuaauuuuaaguuugugccaacuaauuuaguggaaauggcuguguuuugaaauaguagggcgcucacacuccaucugguguguuuuccuuuuaucuuccacucuuggugaauuuuaaaagucaacugcaauguaaauauccuuucugcuaugcuaauguggccuccuuguggaaaucaaagggaaggaguccuugggacaagugguucuuuccugauugaacuuuuuagugucauagcaucacuaggaaucagugcugaaagcaggcuuugagaugaccaagauaaauccaucccaacugggacauaaggaagcugagcuggagacaaaaugaauggcccauaaucucaucagacacaaagcuagaauuuuagucucugugggaggacuuugagguaccccauuaccaagcagccauuuucuucacuagacucuagaagccuuuaucagagugcacuauacugggugucuuaguggccucuacuuccaauauagcacagucauuucagucauuuuucccuuguguagaucaggugugccauauaaggaccucucuugugucuaaagguaacccacugccuauggaagauuccuacucuacagcacuaaaucagcauucaacugcaagaggaaccagccccacaguuugaugguuauacucacuguuuuuauuugcugcuacagcaaauuggaaggaacagggugacuugucaaaaauuuuguguuuugugugugugugugugugugugugugagagagagagagagagagagagagagagagagagagagagaguuuccauggugauuuuauuuauuuauuuauuuauuuauuuacauuuuauuuuuuaauuagauaguuuuucuucauuuacauuucaaauguuaucccgaaaauucccuauacccucccccaacccugcuccccaacccacccacucuugcuuccuggcccuggcauuccccuguaccggggcauaugaucuucacaagaccaagggccucuccucccauugauggcugacuaggucaacuucugcuuuauaugcagcuagagacacaagccccacccggggauccaucccauaaacagccaccaaaccuagacacuauugcauaugccagcaagauuuugcuggcaggacccugauauagcugucucuugugagacuugugaaaauuuauugucugucuacugaagguaagaaguuucaacuggaccucuauaugcuaauaauauucaagguguugaccugucuacauauuccuuggauugucuagugguaaaucuauuucuggcuucugcuugguuggcuuuccuuuucauuugguuacuguuucuaucuuucaucauuaucagaaucaucaccaucagcaccauuaguauuggacuuuucuucuuucuaaaggauuucuugguuaggggcacacuucccauauucaaagucaguaggcagucacucuaagguaauguagagacuaugacauagauaagaacauuuuugagcuuagaggaugacagagaaguuucuacugcugguuuggcaggguguagacauccuucuaaguauggaagcauauguggauggucugucacugagagcauuggugggguucuuggagugggguggggcauuuaccaaauuacuuuugaaguagaugccagauaugcacuggggcaaagaacugccuacugggguuguuuugggaguugcuacucccacugauaucuaaguuaaggcuugguauuccagguuuaaauuuccauucucuucuggaaggccuucuggcuugaaaaagauguugucauccuuugacauuuaagaauaugaaauguuuugugcacaacugagguaaaaaaugacauuuuggcaugcugagaauuaugggggcuugcugcugauugacgaaggggaaacugaggcuguguguccaaggacuggggaaauaagauugaaauaacuacuguccuggaggaaccuggccuaugagauaguugagaguuuuuguuuugcauggcagacauagugaggaggagguaaggaugauauuucugguguuugugagcuaagcagcaaggagaagcuaggcuagaaacaggaaacacaaacaugaagcucaggucuguuuucuuauccucuguuauccuaaaaaccauuaugagguguaccugagaagaagcaacacaggcaaguggccuuuuggauguauuaacuuaucagauugcuaauaucaaaucauaucagcucacacuucuccauuugagagcaucacccggggaggacaaucuugccucucugcuuucucaagucuauuucagccuuaucccagaucagaagcugcuugcugaacccaauacauuucugaaauucucaguuuugagaugagaccggaauuaaaagacaaaacaaaacaaaacuaaaccaaacauuccaggaaagcuaugugcaugguagacauaccuugugcauguugcuaugcuaugugaggugaauuaagcaacaaguuuguuugcuuuucucugcuugagaaagaaacaucaacagaaccugggucuuaacacaaagggauggcuaagaucuccagagaagacaaucagaaaguucucaguguacuugacacagcauacaaugcccuucugauaaugaugggacuagucuaagaagaaacaaaauuuuuccaaaagaaaaguauaugcacuagaacaaggcugccguucagugcaaagggaauauucuaugaguuucuuaguuacuucuacuguaaggcggauuuccaacggggacuggagcagcuggccuagaagauauuuauggcccauugagaguuguaaguuucuuuuugagaaaaaauaaggcagcaauuuccuuuuaaauauuuuaguguguuaucaugacaugaauauacuauaaggcaugcaaaaguauuuaagagguuuggugcacaaaaucagcuucgaaagaaugaccuugggaacuguagaagcuggacuagaguaugcugaugauuuccuuguguuuacgcaaacaggaguuauaaugaaguuccuuagcuggcaaacucaugagcuauauccuaaaagcagaaaacaacaacaacaacaacaaccaaaaccucaauaaccaccacaacaacaaaacccaaacuguuaacauucuaaaaugccauuuucuucaguguuuuuacauacuuaauuagcagggauauauccaagacuuguagggcauacacgauaucuaagguauuuuuguguguguguccagaaaacacagccaagaaaauugcuuagcucacaaucuuugauuuuuccaugaaaauaaagaccaaagcaaagggugaaacaaagaucgaagguguacucaacaguucuggguauaaacaagcuuugccauuaaggaucuaaggaagcuggaccccacuuuggaccuguugcugcaacuuuuuuuccucagguuccucuauguuuccaucccuguaauucuuucagacaggaacaguuaugggucagaguugugacugugggauggcccucucucccucauuugaugcccugacuucuugcuggaggugggcucuguaaggucccucucccuacuguuggucauuuuuuucuaaggucccucccuuggaguccugagagucucucaccucccaggucucuagugcauucuggaggguccuaccaacuuccuaucucccuaggaugccuguuuccauucuuucuguuggcucucagggcuucugucuuuuuuacucacccaauaccagaucagguucucccccccuuaccccacccuccauccacuuuaccuuccaggucccucucucccuugcucucucuguuucuccuucccuccuuccuuccgucccuccccacuugugauugcuuucuuuucccucccaagugggacugagguguccucauaugggcacuugacacuauuacuaaggcuaaggagcacucacacaaagggacuuagcaugacugaacuugggaagacccaauaagcagcugaaagagucagaugcagacauuugcacccaaccaauggacagaagcagcugaccccuguuguugaauuagggaaggcugaaagaagcugaaaagggcaauccuguaggaggaccagcagucucaauuaaucuggacccccugagaucucccaaacacuggaccaccaaacagacagcauacaccaacagauaugaggcucccaacauacauacaguagaggacugugggucuauguucauucagagaugaugcaccuaacccucaagagacuggaggccccagggaguuuagaggucagguagggugggaguggggacauccauaugggucagggggugaggaggagguaugagauauggaacaguuggaggguggacagggguggaggauaaaauauggaguguaaaaaauuaauuaauuaaaaaggaaauaauaacaauaacaacaauaauaaagcuuuuucacaacuaaaaagaaaaaagaugcuuccucuugugagguucagcuucuuuccuugauguuuguaaaggcagggugauguaugugaauccccugacauagagcccagcucacuguggcucaucaaaugauaauuuuacucucuauuuauucuucaccacuucucuugggacaaaaaucuaagagcuagauuuguucauuacuggcaaccuaauccagaagcuuaaugaugcuggcuucuugucccuucuccuugucaaguaaaucucaugaaagacacugauguuuacauauugggaacuaaaaaggggggcccuguggaagaggggggaggaaaaacccacgccccagaauuuuaccuauucucuggucugucaagcaugggagagcugccauauacuuuccacucagcccugggugggcauucaagccuaugacccacucuucaggggguggccaaggggcagcccuaccuggggagcccuggagcuacuuugcuaaauccaccaggguuauaggagagagggaugagggaagagguucccaacaccugcaagagugagugcaguggaucuugacuggagcacaggaaggccuucuaaugggagauuaggagaaagcgugucccauccuccaagugcagugggccuugaugagcagagacauucuaugguuuuagagcuuuauuauagaaaggcaggggaaagggagggagagagagagagagagagagagagagagagagagagagagagggagggagagagagagagagagagacagagagagagagagagaggcagagagagagacagagagacagagagauagagacacagagagagauacagagagagagagagagagagagagagagagaaagagagagggugagagugagggguaagaaagagacaacuaagagagcaagcagaaagaaagauaaguaagagguaaaagagcaaggugggggccuaacagccccuuuuauggucuuuacuguugcuagguaacuggggaggaguuuagccugaaggucagaagcuugggccauugccuaugugacuacugaccaugcuucucuugugggagcuguggggagggggugguggugcaguaacuuaagcaggagccagaguuccaggagcauaagagaaugccuaccaugucaugaaggugaauuauuaccaccggugguuagaccucagcucuacuggagaccagccuaucugugcagagcccaaugccccauauuuauguaguaagcucaguauacaguuuagagauauauaagcauagccuuuucuucacccuuuucaauuaaaacaaaacaaacacacaaaccccggcaccucucaaagcguacuucuaaguugggaaguuguaucucaacaguuucuagaacacacugcuugccggucugugaagugaucugaaaguccuagaacaaacuucaguauuuucucuucagaagagauuuccuuuucguguuuaaauaacaggauccugcagguucccugcuugagacuguuggaaaguuaaugugcucacagaugauugucauugaaggcuuacauuccacaugcacaugguaacagaaauuucucagaugagugcugugaagacagaagaugaccucugaucugucaccuaccaaacucacucuacagcucuucacaacaggcucugucaggauaauaguaauacuauuaauggucgugcaaauuauuauagugaauauuuauugagcauuucuuguguaucuucaggcuucauacauaggaaaccauucgauuugcauagcaacccacauauauuuuauagaugaaaaaaaccugagacauggaaaagcuggcuuuccaaguacauggaauaugaacugagcaccaggcaaguuggaucuggaucuccacccuuaaucuuacaugauuuuacuacagaagaacauugcaucuccuuccaaaagugaaugagaaauuucagccaacuaggccacccauuucaaaggugauugucagcagaaauaaugacucaaacaaugccucuccuuccacaaaguccuuggaucaucucaugauuaucccugguaggacugacaacaaacaggcagaaaaaugaauguaccuuccauauaucaaucugacuugucauuucauuuuuaaaauucuaacaagaucuuugauaagagacacuaaccucuagcucaaucauuugauaugaugaaaaacacagcauggucuucuggauuuagauaggcaggaugaaauauaagcagauuuaaguucaucuucuucaucaucaccaucaccaucaucaucaucaucauauccggguuuaaacaacucuagaacuauuuaauuugguacucacccaccaccugugccuaauaugaacugacauguuuugggaauauauaauacauacagggcuucaaagacuuuugccacaagagaauauaaauauuguauuaguacuauuuuauagugucuauguacuaaaaugauagccuucugguuguuuuugguuaaaaacucuacuauuaaauuuaaguucacauccuuuuuaaaaaaucuuucuuaaucuaaaaugucuauaaauacacuuagaugucuccucuugagcacugauuggggacuggggacauccaugguggauaccaccuugugguaacaaaagcaaaacugugacagcacuaugaugccccugugcuggcaagcuaugcaugaauuccaacaauauauccaguuccaauaaagagguaauggcauugauuauaaagcuuauuugaaguauaugaauacuucaucaagagauugucaacugauagccaaaaagcaaaauaauuuauaaauucuuuaaaauauaacuaacuuuauuuucuccacucuccauaauucuugcucauuucuuguuauuucaagagaguaggucaaauacuugggaucuuuucucuuugaggccauaauaauuuccacuuauaaaaauauauuaauuauuaauuaaugucucucuucccucugcauuauuuaccuguuugggcucuuaaauuauuacuagagcaacuuuuucucuugccugaggccuacauucucaaucaucuaaauauuauggauucagaagaauuuuugcuugguaauuugccuuauugcaucauagauauccaaaaugccaaaauauuuaaucuuaagugauaauuuauuauuauuuauguaaagaacauugaauauaagccaaaugacuuuuuuauuuuuuuauauuuggaacacacauagcccauucuuuaggcaccauaccuuaugggugcuuaacuauagccaucgcagugagaugaaaggauugccuugugagaagcaugagagaagacagaggaacaccagcaacaagagugccucagagcaggcauuuuucaucuucacuacuagggaccuucuagcuguacuguaggguaugucuagggacugaguuuaccaugaagaucauaugggacucugcacagcaaaaucuuauucaggaaacgaugagggagcuuuaaagaagagcuuuugccauaaaugucauacaucaagugccaugugauucacauuauucuuguuuauacaugacuaacaagcaacugaagauacucaagugacauagcagaaaaaaauugagaaaaaaauugaccuuuugugacaucuauuaaaguaaauucuaauaagaaaaauaaagacuucauagaaguugugucuuuugcuauagggcucauacaugauucucaccaguuguguauccuguuuucuuuugaugaucugauccuuugauguagugaauucaugauugucuuuggagcuccuuguggugaucugaauauguuuggcccagggaauggcacucuuaggagguauggccauguuggaggaagugugucacuguggagggugggcuuugagagaccuuccugcuagcugccuggaagccagucuucucuuauuugccuucagaacaagaucuaaaacuuucagcuccucuagcaccaugucugccuagacacugcugugcuuucaccuugauuguaaugaaucaaaccucugaaccucuaagcuggccccaguuagauguuaucccuuagaagaguuaccuuagcuguguugucucuuuacagcaguaaaacccuagcuaagacaguccccaacccaucaucaucaucauaucaucaucaucauuaucaucaccaucaccaccaucaucauuucucuauuuugcuuuuuuacuaugcuuaguaagcacuagcaaacauaaagccaaccugauuuucucuaauauucguuuuuauaaggaaaagggagcagaaauaauuuuuaaccugauaaaucauuuuuuucuaauuuuaucuucuucugugagggauuauaaagauuuaguaggauaauaaugugacauggaaacguaguccaugccucuuaaguuagguagucaaagaacauucauagaagcauauagagagcauaugugggcguaucauuuaauuaagaaugacuaugcucuuauccuauucagauucuuuuaccaaagagugcaggaaaaacauaaaacugccuuuuuaugaucaggugccauucuaagguucucaugaacucagaagcuuagcgaucacuaggaagagaucaguaaacccagagggagaacagcuaauuaacugucucucugaaacauuccuuccucuuuacaaaaucaacuagggaauccaugggcuuugaguacaucaucaaaugaugugugaaagagauccaauuucaacaauaaauaucaucagcaauagaauguuuucuuaagcccucgggggccaaaugaccugaauuuguguaaauugauuuuguucaugcauuguguuaagccaagcaauuauuuuccaagacacgcuugaacucaugguugcucugucuauaaaguucacgguuacauuuuuugaauugcugauugcaauuccccuuugcuuuaauauuaagcacucuuuaaaaaacaaaacaaaacaaagcaauggauuuuauacauagcacacaaucauaaacauucaaugucacccaugaacaucugaugaauuggccaauccaguuaugacuuuugcuuauuugaaacacagucaggacaagucuuaacugagccaauucaaugauauaccauggcauuaagcaauaggcacuccccuauccaagaaacuauuuaugccaucaucauaaucguaaucaaugugucaagauaauagagguccugaagaguucagagaaggccuuauauucaaguucuaagaaaaugaaaugaagaguuuguggggugcccacauauguauggagaguaguaaaaguugggggaggucuauaugcuuuagaaaggguggaguuuacacucauuugaggggaaaggcucaugcucugaaaugugguagcuggaagggugaguaaaauauguaaggacaaguccaaggcauggaacuugagggagaagaaggggagaugaaucccaaggugauaauaaagucagaaugagaggcagaguggcucuccagcuugcuuuccacaaaacccacaacuauauauguuccaggcagacagaucuagguuucaagggggaaaguuccuuaucguccuugaugaagucuaccagacuugcuuagcaaucagaaaaggcuucuaauugcuucucagaaccuuucugguggacuucacuuuucaggccuucugcagcgcacugauuucugaccaaaggauucuguuccaucaaugccccaucaaauuagauggaugagagcaccauguuaugcucacauucaauguaauccggaguuaaugaaucaacacccugaaagcaagauacccucuguguaaauuauguuucaacuuguagggaauuuugaguucuuuaagugugacucuuauccugucauaugugcaacuaguuaagagauauucacuguggaaccacccuauaccagacuaggucccugaucccaagguuuuacaaugcacucgagagaugccaguguugcauauaaacuaauaauuaucuugagugaguuuuuaaggauguaacaggcauccuaauaagaaggagcuacuugaguaaggacagaaggcugguuauuuuagcuauauauaggaagagaaggaagaagggcucuuguaggaggugagcuugaccuaugauuugguuaaacacacaaaccuacaugaaggggaccugauaucagauauuguaagcagaaaacgauuuguacaaaggcucugagguaggggaaccaaugcuaguuuggcaaaagcaagcuauaggugaaggagacuuuuugcuggcauagaagugggaaaagcccaacauuguggcugaagaaauuccuuugggccacaauauuguaaauaaacaaacaaacaggaaagagaaacagauaauacagcucgucugcaugaagugcugauccuggcggguguaccugagagaaguaacacuugaaugguagagacaagagauggacugggacaggaguucaaacuuaaaaggcuuuggaaccagcccuguucauguugaccucucucauucuguauuuauggggaagacuuuaaugcucagugugagggaacccuguaaagauacauagacauggcccaugugagggaugucaguguauguaagagacagaauugucugaguucugcugaccuacagcaugagugacauguguagcaacauuccaucucauuaaaaaguacuuuucagacaaacacgaagcacagcauuaaaaaguacuuugcagggaaugacaaaacacacucaaggaagcaagccagcucacagaucaucaauaugcaaugcugaguuagaaaaggaaggaagaggcugcaaguggaaaaaaucgauagaagauagucucauaaaagucaaaaaagucuacuucuucuauuucuaagaacuaaacaaaagaggaagguuuugugaggcacuugcucaaaugccacaauacuaagaaaaagacacuauuuguuacaaagcuugaagcaucuacaaggggagauaaaugagagaagaggccagguguagaaagacagggaugcagaaccauguggucucuguaccaauugcucacaugauuccaagcaaccaugagcugaacugauccacagauaggacugguccuuugaucuauucuuuuuugguguucacaccugccuccuugcagccugauucugcuagaucuuuuccuuagagacugcaugagacauauuaauuccacauagagcaugauuagugcccuuuaaccuuuuuuuuccagaaugcuagauauuuagaaacagugucuuugucuucuuuuacaaaucuuccucaucaacuuuccucccuuuucucuguuucuagaacuugucaucuugcaccccuucuguggagcuucuccagucaucacuggcuacauuaaaauugugcucacaaagaauauaauuuuaugacauaaguuaaucuaggacuucuuuagggaagccucuauaagacugccguaguaggaguacaauacguucacugagcucuuuuucuugcuguuucuauuucccacccaucugccuucaagacagccuguuuguuaugucacugggauauacauaauccacagugagugauuucaucaguauaaaaaaugucaccccucaucacccuaucauuucugauuaagaucacucagucuaauguauauuacaucguguaccaauaaugccugcccagugcgucaugcuccccgugccucuugcuagacauugcuuuauuauguacuuaagcgagagaagauucucaaacaaagaggaagauuaaacugagucugaguagcuaagggcagaaagaaaauuggaaacacuguguuuuauucacucuggaaaaugguacuaaaugaggacauccaacaaccuggcuugaaauugggguuuucauuacuuacccucuauauauguucaaaggcaaaauuaacacgugcauaucaacccccaaaucugcuuugaggauauguauaucaaauaauacuugagcccagguuuugaaggcauauacacuauccauuuuaaagaugagaacauuaagacauggaagccaagugaaauuauugacugucaccuccucaguagguugcaauggacuugauucuguuguucaggcgcuuucuagucuuguaccucuaucucucuauauuauaagcuacucuugccugaaaauccauuuuuauggaaauuacuuuuucauacagaggagauacauggaacauuggcauguguauuguuuuauuugugagucaagagaugccacuagagcaugcaggaagggcaaaggaguauuagaggagagaaaggccaugugcugugcaauguuagccauugugucuucuauagaacugaaaugcagccacacagcuucugucaauagcacauuuggagcauaaacaagauucaaggugacugaucagccuaaggaagcaguguuuucaagcacuuuaaauacuacuccagcagcauacacuuguauauaaaucaugugguaacuuauucauuaagauaaccuguacuuggcaacauuuuauuaaccuugguuuacguuaauaugcuuuauacuuguguuuuaaauauaucucuguauacaaugauccuguaacucugauuuucuuaccacacagacuaagucauuaucaaugcccaaccuguguucuacaucugcuaaaacugacuuaauauuagaguguuuagagguuuuugggaagcugggguuuuagacagcaccugcuccuacacauagaucugcaucagaaucaccugagacgguuuuaauacauguaauaauuguucccugugccuuuuccaucuacucaaacacaauauaucacagauaacccugagaaauaagaguuucagucacuaggucacaaaccaccacacaaaacgacuggcuagaggguguccacccuacacaagucuacugcaaguauuagaaaggucaucaaaagacccacuaagucccaggagagucauggaagaauuuucuuauuuaauaccaacuuccuguuuuuguuuuuuuuuuuuuuuaauuuuuuuuuuuuuauuuucagugcuaagguagccauuuuaaugcccaguuaaucaggaaaaauccuaugaauguacacagagauguauaauauacaugcucccuagggaccagcuagagaucuucauauaguuagcagaaacacaugauaaacaaccaaaauuagagauaaaaauggaaauugauuccaaaggucuggaaguagaguaucaaauauaugacuaaaaucugcuuguucuauuugacaccaaggcagacauuguuaauugauccauacaucuuuccuuguuacaaccaaagugcuuuuaauacaaaugcucuacagcacgggcacuaucugaccagauuuuguauucguugguuauagguaauauguaaacagacaucauuuuacauuuucuucuaacuuauucuaccauaggcuguguuccacacagcauaagcagacacuggaaggcucuccuguggcuaggacccuagaggugauugcauagcccuugaugguucauguaggauugauuugacauugguaucauuggauggauagauccaaaaaucacacaacuucuaaaauguucaggagauucaagacacacauauguuauuuaaaucaauguaguuucuguuaaggauaacucaaaguuucacuuugaauaugugcucuuuggagagagucuacaggugugcuaagugcaaaggcagaauguuuuuguaauuguaugguguauauguguguaaauguuaguauacuugcauauguauguacauaugcuggagguuggcacugaauaucuuucuccaucacuuuuccauuuguuuuucuucagcuagggucucccuggcccuggagcucacugauuuagcuacaguagcuggccaaugagcuccagggauugcccaucuccuucauaaccauuucguuauuaguuaauuuuguuaauacaugcaugcacugcuauucuuaucuuuguauacggguucuggggagccaaacucaguuucccaugcuucuaggacaaguaaguuauccacugugccauuucuccagcuuccaauguuagcauauucgucuuaaagaauuauaugucccucuguuugauuucuacuuuuaacaguuuguauugucuauggagauucaggauuaugucuuuacacagguauuaagugcccuaguaaccaugacagagcagaaaucauaaggccacuuggcuugauauuggguuucacuaguaguaaaaaaauaauaauucauuuauuuuuagauucuccugguggucacucuucccuuguuagcuucuacugucacuuuccaaguuuuacuggguagaagaccauuuaagauuccaucuggggugacauaugguuaauuggguugauuuuauccauugacaggccuugugaucaaauaauaaagucacaaaagacagacuuaccucaucauagauguugucauuccgggggaaguccccugccuuccugggaagaacguggacauguacaugcugaaauauaaaagaaaggaaaaaaauguguuuaauucuacuucuauauuuugacuugacagugaugcuuuccuggaggccaauuacuguccauugcuucuugcuggauuauuuuucagaagaagaugauguucaccuucagaaauuacaucugaaaccuguugagaagaaagaagcacaaagcaagagggaacaacuuggaggcauaugggaguuugagggaaaugccagaguccauuucaggcuccauggaauuacucaucacugucagucuggguuguaguuaaccugugcuuugaaaugacaauaugucuucagagauggcugcugugccucuggaacugacaagagagaagaccuggucagcaauggagugcauaaguaauaccaaauuagugaaaggaagaaguagaaugggccaacucaagaacaauggcauugaauaacaauuacacaacuauaauacacaugcuuucauuuauucuuauugacugugacaaccaaugcuuguauuaguacccaauagauuucuauugaguacuccuagaauugcuuucugaaguguucuccauuuuacagaaggagaaacgaaugcucagcucagagaggacaggcaacaguucuacagaaugugguggaauccucacagaaaaugaugccacucucucuuauucucuuguucuuuaccaacauacccgauaauucugucaauacaaucuuuugaaaaaaauuaaaaauuaaauuguguguguguguguguguguguguguguguguguguguguguguagaucagaaaggcaaaggacaacuggcagcaugcucucuucucccaccuugcacauucuugggauuaaacucagguuguaaguuuuggcaacaaguaccuuuaccugcuaagccaucuaacugaccugcacuugaucuuuuaaaucccucauuucccuaaucuaggcuacuaaagcacugcugucuuauuaaggggagaucauuaaugaggacucagagcauaucuaauucaacauguauacgacaaggcuaagcugauaucuuaguuuuauucuaccaacggcaucuauuuuaucucucuaaaccuaaaccuuauucaugcccuugagcaacauuccuucauuuauuaucaacugcagagauuggaaaguggaaaagcuuacaaaaagcaaguagagaaccaaagcacauugccagucaugccuacuguacagugauuacuguguuugggcuguaaccauggaccuccagagaacagaccaugaaguguaucuguggcuuuguguaucaggaagagagaaugauaaguuauugcaggagaggcagcaagcaaggcuauccauguuggguguaauaaagaggagcuuaguguuagucccucaguagaguuuucccaaacugugacauguuucugccuauaugugcagcagucaguggggaagccuggcccaaaacccuucagcaacugggacauaggcauacuuaagucuccaauuaugugugugaagagagagggagacagacacaaagaaacauggagaaguaugugacgaacuacccaggaaaaauuuuaaaaaauaaaggcaugcaacacaagcccaaguggaaauucacugugcucagugacugagggauuuagucaucaaaccagagaaggcagggagcagaaaccgcugaggacucagugaaagcccacucaaucagcagcagcaaaucuugcuguaauuuuuucuuccuuuccuccuuuucucccuuuucaagacuuccuuuuccguacugucuuccuugaugucaccuaccuguucucuauaauuuucuuuacauauuaaucaucacaagcuccagaucaguggucuguacucaacgugcaagaggauauggauauaaaaguaacagcuuuaccuagaguacaguauguccaauacagcuggaccucccaugugcuagcuguguuaccucuccacagcaguuaccuagucuucuuuauaaggaggacugcaguauucccaucucacaggucuaaaguaccaagucaucuaagcacauguuugucauaaguuuguuaugcugcuuagcacgguguccugaauauaucuagacacagugagagugucuuuauuguuaaaaaacuugcaaucugaagaccagaggucacauucaaugacugguucuuauauuugcaagaauuauacuucccaagcuccuuaacuggugugcaguuaaagcaucucuuucugccagaauguguuucugaugcucugacaaguguuucucaaacugcauuaaaaagcuagcucgugcuaaaaauuaagagccuccuaacuuacuuucuaauagauucccaaguaaugcuggucuagggucauacuuugagagacauugacuaaggccuaccccuaugaaaggcacuuauguugaacacugaguuuaacacuuuguuuggacugcccuguaguguuauguagacaccuauuuccauaaguugcccaggcuuccugaacugcuuuaugucuguacuuaagacgaugccagugacuucggaucuggauuugucucugauuccuguucuauaucuugcucuccugaguucacucaucagagcuauuucuauaugcuguuacuauucaguucuggaaaugacgcucuugaucauuggcaaccauuugaaacuugcuaugacaccaaagacaguaaacaacucacugucuaggugauuuuucccuaagggcaugaucucagcucuuccugauacacgauacagugauauaaccucuuaagugacagccuaauuacaggauucugacaauccgcucagucucccaggacagagaaaucaugacagagccaacucaguucuuguaaagaaggauggcucaaccuaccaacaugauauguguauaaaccaagagauggcaaguuccagaacccuagaaaaggaagaauucaagaaagagggaaucaucaauaguguucacuguuguugaaugcuugaacugguuucagugaaacuggaaagacaacuaugcaaagcucaugauuacucaaugguauuagucauuagugaaaugccaaucaaaaccacacagagacaccacuucacauccacccggauggcuuuaaucaaaaggauagacaagggcaagugugggggcgacuauggagccauagaagccuagaacacuucugcacagagugcaaaaugaugcagcuguauguuugaaaaacagcuuggcaauuccucaaaauguuaaacauccagccaccaaaugacccaaaauuauauucccaguauauacacaugagaacugaaaccauguaggcacaaaaccuuguaauguauauuuauagcaauauuauucacaaucaucaaaaaguggaaacaauccaaaaugacuaucaacugaugaaugccauacuaacaagacagcagaagaugauugggcauaaagacgaauggagcugcuaaggaaagcauuaugcuaagugaaagggcucagauccgaauggccauuuauugcacgauaccauuuaugaaauguccagacuaggcaaauucacagagaaagaucaguguuuccgggagcacaaugaagagugucugccaagggaaaugggguuuauuuggggagugacugauguuuucuuuucuagugucacauaguagugauggucucacaacuuuuugaauauauuaaagcccacagcauuuuuuuuacuguaacagugugaaguguaugaguucuaucucauuagagguguugauaggaauggcagaaguggagagacaacugcaauagcaucaccuuuucugcuguacugcuccuuccaucauuuucccacacaagcauacaucacgugaggauugucagugcaaucaaaauaaugugccuuuuucuuguuaaacuauaucauaauucaacugcagggaaaauaacaauugcagagaaaagguucaugagaggcauaagagggauagcauccuuucuacuuggcuaccugcacccccccccccaguugugagaacuugugugaaccccucucuucaacacuagccuaugaauggugauagaaggaaaacuuggguuguaaagaauaauaaaaauaaugcuguaggguguaaccuccuucagccuagauaggcugguucagaccauacaccacugagauggggucaccugcuguacugcuucucaucacucuccuuugauguuacacugccugccaccugcccugaggcugaacugguucuucaagauuuuccgggaguuuacuacagacugugaauuuggcgaguuucugcuaaaaggcuguucugacaacuucacaucucuacaucaagaaacuuggugugacugggaaugggcuucccucuuuauaagcgcaaauuuuauuauuaaacauuugaaccuugagcagacuagcuugucuugguuccauuauuucucuacccgacuagauucccucuucuuuuucagcuccaguugccucccaggcucgaaccccgacaugagagccacaggcuggccccaaaaguagggggaaagauaauaucuuccucaaagaugcuuacacuuuaauccugguccugugaauauaguagauuacaggacagggaaaauuaaggaugcauaugaauugagguugcuuacaagcugauccugaauagaaaaucuacccuagauuaccuggcuuggcucagugucaucacaggagacauucaaaggagaagucacuaaauaucaucaaaauucucaccuugugacccaaagaguguaauuaagaaaaugagaagccaaaccacagaugguagaaagauuuucauaucguauaucugaaaagggacuuguauuuagaauacaugaagaacucuuauaagucaagaguaaaaugaagauaucuuuagcuuaaaugggcagaaaauguaaacauuuucucaaaaaagaaacauaaaaaugacgaggaaaagaugcuuaacagcuucaaucccaaaccacaaugagagaccacuuccuucucuagagacagguaacuuuaauaagagagaggcaauuacaaagagugggagggaagaugagaaauaggaacuuuguauaaauuggugggaauauaaacuuugauccugcucuggacauacuauggauuuccucaaaaggcugaucacugggcuaccaaauuacucauagcaguaaucuacuaccuugguauuaugguuugcauaugccccaaagcucuugcauuaaagacucagcaaauagaaaucuuuuuucagaguuguugauuuacaagggcuaugacuucaucauuggauuaauucauguucuuaugauauuauuaagaagugaugaauccuuaggauuagggcauccuuggaggaaguaugucacugggagucugccuuuucuugucccaugaaagucuuugcugcuaauuccuagcuuccaagaagugaacaauucuacagcuucauaaccucuucacauuaaguucuuucucacuaugguccagaaacagagggaucagauuacuauggacuaaaaucuuagaaacaagaagagcaaucauuuuuuuuucuaacuuguuucuuuaaaguauuuggucaugacaaugaaaaaaucaacaacaaagaaacaaaaacaaauauguuguguauaauuguaaaauuacacuagguccuuccucugagcuguguucucaccagcccaugcuccaccuauuuauuucuuuauccugacuggauuugccaagcaagaacaaugagaucgaucuccugacagccugugcuccacuugguuuugguuuaccucuacccuguagcucuguccuuugccaaauccucccauuccaaagcccccuaaauucugccccaguuguguuuucuuccagcccacuuuaaugcuguuaaugaaaaauaccauacagcuuuaauauuuaaagcuagccagauaacucaauggcugggcaaagaaucuauugcucuaaacucaucagcuaucuuauaucagaauuucacugcuggcagaggccacuaccaguucuaaaugcucccaggccauacaucauuccuguuccucuucuaaaagccuggccgaaccccucccucccccaucuaucuguccuuuccuuuuccuccugggauccagaagucccacauuuuccccuucaccaggcaauuagcuuccaccaucuuacugauucagucaagaaccaauuagggaaaugacaucuccaccuacaucacaccuuuuuuguccaauaaaaaaaauuaaaaacccucuucuuaaaaucaugacaaguaaauuauacaguaugaaauacaaaugacauccaguccaucaauuugucaauuuagauaaaguacucuaccauauuuccuaacugaaagaauuaugauuccaucccuagauuauguuuagaauuuuugccuguaacaucacuugaaaaccaugucuucuacuguauaaacucuauguuaagcuacuugaguuugauuaugagacuaaaacuagucuucaaccccaucagaaaucauagaaugacaaaauauuaccuaaaaauauaggaaucacuaaacauagcuuccaaaacuaagccaauguaaagauagcugacuaucugaacagucccccauuuuuuagaauccaagagcaucuaucucuggcauuauggccaaggaucaucuaucugacagacuuauuaugcagaaaguugaagggccacugucccugucuugacaaaaccaguagcugacuauucugcaaaauaugucuuacucugguggaccccccaacccccaucccaucuugucccuaucucuuccuccugggacccagaaaucucaucuuuuuuccuuacccagcaauugcuagcaauuggcuucuucuucuucuucuucuucuuuuuuuuuuuuuuuuugguuucucuguguaguccuggcuauccugguacucacucuguagacuaggcuggccuagaacucagagaucugccugccuuugccucccaagugcugggauuaaaggcaugugccaccacugcccggcuuucuuccaucuuuauugacauaaucaagaaccaauuagggaaauaagaccuccaccuacacaaauaaauagccaauacaaaagaaauauacaugaccugaauauauaugaccugauuuucuagacacuuuacauauugguuuuuuuuaucaguacaauauuucuauagaguacaacaugagucuauugauuguguagguaaaggaggucagacaaguuuucuuuuauuuuuuuuuauaacacuugucucuuuuuuuaaaauauuuuuuauuacguauuuuccucaauuacauuuccaaugcuaucccaaaagucccccauaaccucccccccaccacuucccuacccacccauucccauuuuuuuuggcccuggcguuccccuguacuggggcauauaaaguuuguuguccaaugggccucucuuuccaguuuuggccgacuaggccaucuuuugauacauaugcagcuagagucaagagcuccgggguacugguuaguucauaauguuguuccaccuauaggguugcagaucccuuuagcuccuuggcuacuuucucuagcuccuccauugggagcccuaugauccauccauuagcugacugugagcauccacuucuguguuugcuaggccccggcauagucucacaugagacagcuauaucuggguccuuucagcaaaaucuugcuaguguaugcaauggugucaguguuuggaagcugauuauggguuggaucccuggauaugacagucucuagaugguccauccuuucgucacagcuccaaacuuuuucucuguaauuccuuccauggguguuuuguucccaauucuaagaaggggcacaguguccacacuuuggucuucauucuucuugaguuucauacauuuagcaaaucagacaaguuuucuacaguaagauuuagguaaggcuucauguauauuauguuucucaugaaacuugaaaaaucaucaaacgcucucaaaugggaaaaggcaacuauauuuacauaauaaaguuuuucaauuuuuuugaucaucaaacuaacacauuuggagcauggaaaauacagagaagacagaaaaacucucagaagaaaaaaaaaucaagaguauccaguuauucucaugauucucucagugguaaaauuucauuuuccuuagaaacaacaauauaaauacuuuucuuugucgcuauggaccugaaacauacuuaggaaugggguggaauuacaaguggccuauuggaaaagugaucacuaaacauauaagucagggguugugguaaaaaagauaggaaggauagccaguaaaugaaucauuaucaaaugaauuacuucugugagugacaaguugugucccaugggagaacuugaggacauaguauaaaucauguauacaugacucccacuccaagggugagagaagcaggcuauuuacauauugguugaagaguguucauggaugcauauaaauaguuuaacacaucuguuuccuuugccuugaggguaaagagugacaccucaccccaagcauuaucucaauagaagucuagcuagggucagcaugacaucaccaagagccacuucauugaaaaauaaaugucacuagaaaugaugucguucacagagcuugcagaacacauuagcaugaccaauugaggagucaaagcagugagcugucaaaacucaaagguguacaugaagacauauaaauggcuucugagcucuacugcccagagcucuuucauugagaauauggaugaugcucagacagcuagguugccuuuaacaaaacaugggauagagaguugucuauguauuccaacugucucagucaaacugagaaacuuaaggaaaaaggauaaagaaccaauucaguuaaaaaagaaaauaagcaagcaaaaaaaccuugcaggauuuguggagccccuauagaguuuuguggcuuaacaauuguguuuuuaggcuauacaucacuagccgugcuccaguggugaguuauaaucauacaucaugagagggauggcacucucuugauauaugggcucuguacaucaucugagcaccacagaugcgaugauguauugcucugagccacaaugagcauuuaaaggagcuuuuagcaacccgacaguuuuaaauuucaaauuuucuaaaaaucaaggucuuuucaagccagauaaaagcaaggcagggaaugugauguuauauagagccacccaaguccuagagccugccaaccugccauugccuuuugacuucaagcucaggaggaugaaugacuggcaagcucucuuuuuuaaacacuuguccauaagaacaaaagucuaggguccccaaaaaacaggaacaagugucagugcaucuauuuugccaaucaauuuccccgucuuccauauuguaagcacaagccacucaucaccuuccuaaucacugccuagcaggagaugccgugauggggcacuggcuaaaucuagggagaucguuucuguuuucuuugcuccaagaagcucuucugaaaucuaaaacaaagcaaagcaaaaagaacugacaaaaaguagagcaacuuccuaaacuauuucucucagucucuaaacaggguagaaauggauuuuuuuuuuaaacauuugucuguaagacauaagacguucugacagugaaugagagcacuaaaggagaauaauauacagacuucucaucuagaggcagacaugggagcuacugucgcaguucugucaccuguccucuuuuaauauguuaauaagauaguaauacagcuuaugaggaaguaauguggcuuuaugagaaugcacccacuuagauuaagaccuacgugcucuuggggcgugugcucagaguaauuacuaucaauuaggaaaacagguguugggagaacauucucuccccuugcuuaaauuuucaucgcaauaggcagaacaauaugaaaaucucccuacuguuugguaauagacacuaauggugacacugaaagacaauuauauuuccaguggcauuuucugcauuccuucaccauguauauuaaaggaccaagcagugguagagauaaugccauguggagaggaacaucuggguguaagaaauuaacagucuccuuucuuauuaucuugccuccaguugaucauuugcuugucuuccuucaguggauucuaacucucaaacuauuauagauuuggcaucuacuucuaaccauugccuaucucaaaaugguugaggcuccuuuuauuuuauaacagaggacuaauauguauuaggagucauagacucaugguaaggugcaucacuuauuacuuugagguugccaacugaaugaugugaaugaggcagguuuuacaucuggaaagacuggguucucgcacaagcuauuaaaugaagucaucaaaucuguaucuuuucuucucuauagagagguauauaguugaaaauguuccuucuauuagguaaaaaaccucaucuauacaugcguaggaaaauuggaauucauauauccaucauucaaaauuacuuuuauuagcuauuauugaaaugggaagaauuaugcuuagucauauauauauauauacauauauauauauauacauauauacauauauaugcauauuggguuaugcucaugugacaacagagguagaaucuggguaagauauuuuaaagagucucccuguucagccagaacgcauacgcucacaguccucuguggcaauaugcucuguuugcuuuuguggaaggucugaguguuaccauuaggagagugacauucaagaauccagagaacaugacuucaucacuugacauuguaaucacuguauuucugaugguuuugaguuuugguaauuaaaauuaaaauuccaucccuguaaaaugccuuucuuaucccuucucuuccucuugcccuaaucuuuuaagagcccuuccaaauuggccuccaauucaagcuuuagauucucuagggcuccucagaugcuuuuugacucuccuuggauccucugauacuauccauguggaugacagcuuuaccuauagaguuaaaaaaaaaaccccacacaucauuaucuuccauuauuuuccauuauuuuagaauucugggauauucgguauugcaguuuucuucugaaauuucccugauucccauuccaugcuccuacauuaaagaacauauuuauuaaguauuauugggauaggucaaugugagauagauuaauggagggauaaauaaaugggaagagugguagaagacaaaaggaaaaaugaaugaauauauaaguagguaaguaauuagauaaauggaaaaauuaauaaggcuuacuacaguacuccugacuucuuagcguauauaaaaauuaacauauuuaugucugaauuucuuggccauucauguccuucccucuucuugagaguuccugaucauacaaggauauggccuaaagaaagccacugugaagacaauacacauaucauucauuccucugugccaaagaacauuuacccaccaaaauaccacucugaugucuuucucugugcaaucuuuuuuuaauuuaauuuuuuauuuuuuaauuggauauuuucuuuauuuauauuucaaauguuuucugcuuuccaggucuccccuucuaauaccccaucccaucccccacccccuucccugccucuaugagugugcucucccacccacccaaccacucccaucuucccacccuggcauuccucuauacuaggguaucgaacaccuucaggcccaagagccuauccucucacugauguccaacaaggccauccucugccacauauguagccagugccaugggucccuccauguguauucuuuggcuggugguccaguccccagcaucucuggggggccuggccuguugacacuguugcucccuccauggggcugcaaacccccucagcuccuuccgucccuaauccaacuccuccaucgggggacccccacccccacccugcucaguccaaugguuggcugagagcauccaccucuguauuuguuaggcucuggcagaaccucucagaagacaguccuaucaggcuuccaucagcaagcacuucccagcauccauaauagcaucuggguuuggugacucuauaugggauggauacccagguggggcagucucuggauggccuuuccuucaguaugcaaucuuuauuuuuagaacuccucaugcaugcccugugucuggagcaacaccucauuccauaaucaguaggacuacagucuuauaaucaagaauugucaagggaccuacuaauuguucagcaccgacuuuccuaacaucuaucauggcucccuuucaaaacauaagaaaaccagcuuguuucugaccuucaaagauuaacucuuuaguagacagaauacuaaaaccauguaaacaugccauauagaagcauaaaucuagagaguuaguuccuccauuuuucugcugagguuacaauaaaggaauuggaugcaaaugaaagagggacgacauuuuuccuugucucacucauuuucuguucagauucacacugcuuuacuguuugcccugcaccuaauuacuguucuuuaauuuauguuucaauaaaacauauaauaauaaacguuuaaugcucaaugaauaaacauucagaugaagccuuuaauggggguuacauguugugaagcagcacuguggcuuucuagaaaucucgcccucuaguuaaugaacaacauuuccauaaucugcacauuauggcuuaagucucaccuuagaaguauuuuaccaagcaaaaauucaugaaauaccucuagucuaaaggggaaaauuguuaaggggauuaauaaccuguucauuaaagagacaggacaaguuuucaugucccuccagagaauguaacuuaguaauuaugauuguggcuuucccuaauuaccccucuagucaggugcaucucuccuauagauuuuaccucuaaaauuugguuuaaaugaaagugaugagacacacagaaaggccagcuauaaaggucaagauuggguaaauuccuuuccugugcuaacaaaaagaccgagcaagagaaccaaauauuuaaggaauaucaagauacaggcaaauggauacuuguggaaauagaaucagaaaaaugguuugaguauuauacagacacuugggagggaggcaucaagauaaaacagugguaaaggugcuuguugccaaacuugacagccugaacucaacucccaggacucauggcagaaaaggacaacaugccucucacaaguuguccucaaacuucccauguguguucugguacaugcacucauguacaugggcacacaaaaguaauuuucaaauaugugcugacaaaacuauucaugaagcugauucaguguuuaagggcacuugcccuugcagaugacccagguuugguucccagcauucaaagguagcucacagccaccaguaauuucaguuccagagguuugauacauuccucugacucuguggaccccagacauuuguguagugcacauuacauacauguagauauucaaacacauaaaauuaaauaaaucugaaaagaauuuuauuuguuuugcuuguuuuguuuuguuuugguuugguuugguuuugauuuuuucaagacaggguuucucuguguagcccuggcuguacuggaacucacuguguagaccaggcuggccuugaacugagaaauccaccugccucuaccucccaaguggugggauuaaaggcgugaaccaccacgcccaccugaaaagaauuuuuuuucuaacuccuuuuuuuuuuaauuagguauuuuccucauuuacauuuccaaugcuaucccaaaaguccccuaugcccuccccccaacuccccuacccaccuacuccuacuuuuuggcccuggcguuccccuguacuggggcauauaaaguuugcaaguccaaugggccucucucuccagugauggcugacuaggccaucuuuugauacauaugcagcuagagucaagagcuccaggguacugguuaguucauaauguuguuccaccuauaggguugcaguucccuuuagcuccuuggguaauuucucuagcuccuccauugggggcccugugauccauccaauagcugacugugagcauccacuuauguguuugcuaggccccggcguagucucacaagagacagcuagcuauaucaggguccuuucagcaaaaucuugcuaguguaugcaauggugucaggguuuggaggcuaauuaugggauggaucccuggauauggcagucucuagaugguccauccuuuugucuccgcuccaaacauugucucuguaauuccuuccaugggugauuguuuccaauauuaagaaggggcaaaguguccacacuuuggucuuuguucuucuucaauuuuaugucuuuuacaaauugucucuuauaucucggguauacuaauuuucugggcuaauauccacuuaucagugaguacauaucauuugaguucuuuugugauuauguuaccucacucaggaugaugcccuccagguccaaccauuugccuaggaauuucauaaauucauucuuuuuaauagcugaguaguacuccauuguguaaauguaccacauuuuuuguauccauuccucuguugaggggcaucuggguucuuuccagcuucuggcuauuauaaauaaggcugcuaugaacauaguggagcauguuucuuucuuacuaguuggaacaucuucuggauacaugcccaggagagguauugcgggauccuuacagaaaaguagaccaauggaauagaauagaagacccagaaaugaacccacacaccuauggucacuuaaucuucaacaagggagcuaaaaccauucaguggaaaaaagacagcauuuucaacaaauggugcuggcacaacuggugguuaucauguagaagaaugagaauugauccauucuuaucuccuuguacuaaggucaaaucuaaguggaucaaggagcuccacauaaagccagagacacugaaacuuauagaggagaaaguggggaaaagccucgaagauauuggcacaggggaaaaauuccugaauagaacagcaauggcuugugcuguaagaucgagaauuggcaaaugggaucucaugaaacggcaaagcuucuguaaggcaaaagacaccgucaauaagacaaaaaggccaccaacagauugggaaaggaucuuuaccuauccuaaaucagauagaggacuaauauccaauauauauaaagaacucaagaagguggacuccagaaaaucaaauuaccccauuaaaaaauugugcucugagcuaagcaaagaauucucaccugaggaauaccgaauggcagagaagcaccugaaaaaauguucaacauccuuaaucaucagggaaaugcaaaucaaaacaacccugagauuccaccucacaccagucagaauggcuaagaugaaaaauucaggugacagcagaugcuggcgaggauguggagaaagaggaacaauccuccauuguuggugggauugcaagcuuguacaaccacucuggaaaucagucuggcgguuucucagcaaauuggacaugguaagaauuuuaaaguaacccagaaguaauuuauacgaacuucuaggcugaucuucauguugaugacauuuuacauuauuuuuaugugaguuuuuuuuaaaguaagcuuacuuaacagaauuuaacauguucaugauuccaaaauguuacucuaaguaacuuuugcaaauuacuccccccuccccccucucuugacaaggucucugugcagccuuggcugugcuagaacucacuuuguagaccuagcuggccucagauuuggagaucuuccugcuucucccuuguaaauggauuuaacuaaauagcaguuaaggguuguaccaccacacccuaggcugaaaauuauauucuuaaaagaagguaccuuuaaaaaaucacuauagcacaaugauauauuuucuccucugaaagagccaagacugagcuauuuaacagaagagaaucaaagauguagggagaaauaaaggaagaaagacucuugauggugugacaugaaccaggucacacuaacucagagcaaugaugaaacaugcuaagugacagcugucacuccauuucuugucagacugcuuuacuaguagguuggaacauguuauauaaaugacaucgggaaugacucauugucccuuguaggaagucauguaucuuuaguacaacugaguguauccacauugugugcaacauuuugaaucuguggcgauauuuucccccaggaaagagcaugcacuuugaguuccuaacugaaaguuaugaugccacaaccacuuugugauguguaaugauucauuccccacugguuuugacuaucacugcaaaaguuucccacugaagacgaauauaagguuuucauuauuucuauauugucauuuucacuuauaauuucaacagaacagaauaucuggcacauauaaaacuuaucaugauccaaauuggauagcauuucuccagugaauuccacccucccacauauuccacuuuucuuaugguaugcaaguuuuuuuuuguuuuuuuuuuguuuuuuuuuuuuguuuuuuuguuuuuuuaauucucuaauguucuugaauuagaaagcauaaaacuagggacaaaguggccaagagggcaggcagacaaacugguagaauuaaguugacucaucauuuagaugguuuugcuuuccuuguaacucaaggaagcacauguguuccagagggaaguacugaaagaacgacauucuuuucugggauugaguucaauggaacaaacuaugaaggaaacuacuguaucuugcauuguaucuugcagaggucuaaacaaugugucacaagaucguaugaccuugguaaucaccaccucauaaagcuagucacacuucuggcucauuacagaauuuguaauauguggggcuugugaagacauauauauauauauguauauguauauguauauguauauguauauguauauguauauguauauguauauguauauauuuauuagaaugccauuugcucaguaaacggaggcacugucuuuugccauaaugcuauagaugaaccugaaguccaucugccaaaacaauauaaugcaggaacacaaaaaaaaaacccugaaucuucaguaucucacuuaugcuugagauuuuuuuaaaaacaaugacuaaaaauauaggauagagaguaaaccaguagaucaugagauuguggaagagggggcacaaguagacagauauagaacagaggacaugaagcagcaggcauggaggaugagcuguguagagagcuaacauggagacuggucccacaguccugguggguaucacaaucugcaaaugcuuuaagucuuuaaauaaaauaguguuuaaacauauaaagcccccuacaugcuuuuuguuuuuucaagaaaacuuacaaaaccuaauuguaaacacuauauaaauauuugucacacaaaaugauuuagaagauaaugacaagaauaaaguuucucuccacuuuuguuuguucucacuuguuucucaaccauaucuauuuuguauuuaaauuaaauuuauauauaauauauuauauacaucauacaauaauauauacaaaauaauauuauaucacacacacaugcacacacacacaaaaccaaacaaccauggaauauagcuuuaaggacuauuuuugauccuuucuugccugaacccauguaguaccuucaggcaugcaaauuaaauuuuauuagauauaggauuccugauaagugaugagauuuuuaauauccuuugccacaaaacaaagaaaaacaugcauaacuauaugaacugguauauaucuuaauuuuuuucuacuuuagaaauuauuugauuauauaugaauauacaauaauauccauguugcauaccuaaagucuacacagcaaaguuuucuuaaaauaugccaaguauacauuauuuccaugagugagaauuuuuucaaaauaguuauuauauaacccauugaaaacaaacauacauucucaaucaaguccccacaacauggaagugccauuuugguagcuuaagacagaacuaaugccugggauuaaaccaaugauccuauucuauaagaaccuccuaaaucaggguuagaaugauguuuggggcuagaaugauggcaacaggaauauucagaggggagcacaucaacugagccagcucccacacuggaagcaagacaaauuuguaggacccaaugugguagccccaagucacaaacaaugaguccugauaagguaguaacaauaaauaaaaaaaggaaacaaggcaccagggaaaacccaggaaccaauccucacucaucuuauuauaaacauuguuauuaaauguggcagagugauugccuaggcaucccuuuucugggcgauuuuagugacuaagguaugggguuuauguugauucaagucccugguuacuguuggaaugcucacuuucuuugguguccccacacagaacagaccggccauuaauggaaggaagaagaaacacagcagauucagaaguuuccuuucaaaaaggacaaugcuguugaggaugagcagaaaauccaauuuauccgaaaucuuaccguaucacaacaguauuauagaacuacauugguuaagcccucuuaggaacauuugguaugaacaaaacuucuaaugcugugggucagaauguguugagcugaagccuauaugggguauagaagucaugauucuuuuagaucacagugguucucaaccuuccuaauaucucaauccuuuaauauaauuucucaugcuauggugaugccagccauaaaauauuuuuguugcuauuuuauaacuguaauuuuucuaguuauggacuguaauauaaauaucuauguuuucuaaucauaucaugcaaccccuguaaaaaaguuguucagucccacaaaggguugugacccacagacugagaaguacgguccugcaugguuuuuaaccauuggcauuaacauuuggugaagaaaccauccaaaggcuaugccuuucacuuaugacaaaauaagcauguguucuuagcaucaacuuaugacacugcuauccccuggcuacuguuaguguuggcuucauucauuaagaugagcaagcaacaguuaguuugccaaaaaaauuaguuauauaaaacagcuaugucagauccaaggauaucaguuguaaauugaauuuuccuucuaaguaauauuauaucaccaacaauacucagugagacucagaggagaggcuugaagagaaauaacagguccuguagguggcccaagucugucaugugcauggagaugcacgugacauggggaugccguugccaagguggagcauuuuauugacucuaacuuuuaccuugagccuagugacaugaaauauucaacuccccauuuuuaggucaagagaugacaguacgcagauucuggaacccugcagcuuaggcuuaauuccuggucuuguggcuuaaacugagacucucauuccacaucugggagcuucaagcuccucauuuggcagaugaaccuaucucguggggcugcugugagagugaauguguuaauauugcaaacugcucaagcuaguauuugugaacaauguguccuugcugcuuucauugcuguuguuauggacagaucacuuauaacaacuccuaaagcaacuuucuuagugauacucaagucccacacaagucugcucugaauguccuagaagaguaucucuaaaaauucaugccaguuuucaacuuuacuguaaggaguucauaauucuuacacaaaauuacucuauugcagacuaauuuauaaaucagaagcagguagaauuauucucuuggaaaccaaugugggauuacauacacacacagccuggcucaaaggagcucugaggcuuccgcagagcacagugaggagcccuuuagccucucucaucccauagggaaagaggcugaaugcagagcgcugggauuucucuugcagggaaacaggucacaggauguggcauucugagacgcucuggcuggaaugcucaggcccacacuuauuuccagcacaagucugaaaaagcagguaaacaucuccaagcuuuggcgcccacauguauaaaauacagauaaucaagacacuucucaaauggcgucugagaagaucagcuggguggaggucuuuuaguacagcuccuggcauaauaaagugaaugcuaaacagaaguaaaagggucagugugucuggcuaugucacuugugaaauguuccgucagagugauaacuuccuaaauucuucauauaaaugaauccccaguuuaauaagccacucccauuccccaucugaaauuaaauaugcauucauuuacucauuuacuccuucuuuccauuuuccuuccucccuuucuuccuuucucucucucuuccuaccucucuccucccucacucccuuucuuccuuccuuccuuccuuccuuccuuccuuccuuccuuccuuccuuccuuccuuccuucuuucccuccuucuuuuauuuucuuuuucgucccauguguagcuguuauuguagcauggagcauaauaaacacaaaguaaacacagaguagaugugauauaaggaacagauuaaguggaaaaggaugaagaaguucacugaaugagagacuaagcaaacccugcuggacuuaaaauuaggagauauuauuuuuuaaagcacuaugagaaucagacucaauaguguguguaauagcacgaggcaauagcuccuaaugccucauaacugcaccucugcuaugaaagcauggacgaagaaagaggagauccccugcacuccgaggaagccauauguagugaagcagaaggagcagcagugugcuuggaacagugaggacaucauugucuuuccccgcagcuucugaaaacuguucuguagugugaugccucccucccucucaauccacccuuccaacauccauguacauacauggucuucugucaaaucgccauauuuucuuuaucucuaguuuuuaacccaguccauagccuucuguuacaguuacacaagcauauaugugagcauuuccaaugcacguauguuuuuuguuugaggacagaucuaacauuugcauuaagacuauggccuuagagauuaaagaucacaaaugggucugagaacuguaccucagauaucaagauaucaccagaugauccuucagccaagugcugagaaaagcauagaugucuauggguagguacucagggggaaaugccugcgacucucucaaauguaugagagcauuuguuagcaugguaaaugcugaggguagaaugaaguagcagaauugggagggucgugggcuguuaaaaugaaaacauaaagagaagauacucuacuuuuucuuaagauuuauuuuuauuuuuaaacauguguaugucagaguaugucucuguguggguacauauaugugugagcauagauauuuguagaguucaaaaaagcaugucagaucccccuagagcuggaguuacaggagaauaugagccacuugauguuggugcuaugacuccaaaucaguccuuuggaagaucagcguauaguuuuaaccaagacagggaacucuuuaggccaaagaaacuaauuuugaugagugauuacuccuuguauugagcuaacauuaccccucaacaauugccuucuuaacuaauagacuucuauggacccucucaugaucucugcauugugacccuagugaacuggaacccaagaggauccugguaucuguucacaccauuauccugggaaggugacaggccuuugacacaguaccucuagcugcccugcugaaaggccuuccugcacaaugcuccuuuacccugucuaguugccagccuccaucuugaucuuagcuguaugugaauauucucugagccucucauccuggaccuuguuaugugucuuuaacacugauaagguccuugaguacauagcuccacucaaacccacuguucuagaguucuuuagaauccauguuuccugccucauuuauaugcuugucucuuugauguugccaaaccgguuuuaagaccagaacuaagguuagugauuugugacacaucugggcaggacuugccagacugucacagguucaaccagguacuggagugguuaaaguaaaucaugucaccugaguagaacagaagucucuccuucaaguucuucacauuccaugagacauuccacaugaugaaaauguuugcaaagaucccaguuuguccauucccucucucauucauagcaaaacaacucucuaccaggacuccauguagcuuguucacauuaacgggucacccaacugguuccagacagaaugcugagcccccuguuuugagaauuguucugcuguucucauaggaagaauaccaaggcaugugugcuaugggugcaugcuuggcagcauguugagauuucaguccacaaagaagaauccuuuacaaaacacagguagaagucagaaaguagaaaggcuuaaagagcuuaaagaggaaggcagugaacacuaggcguuuucgacaugcuugacaaaaggggaauggguaacuggauggaccacugacaaaagacaugccuucaauuucaaauauucuagccuggaaacuggaggaagaagauacugcauggaggaagaacgcuaacaauuccuuuauuuucagccccuucucugcauacagugcaaagaaaaucaaucuccuucuaugagcaccauugacuacaaagggcaacaagaagaacccagucuguccaagcuaauuuuagugaccuccucaguacuacuuguacagggggucugagcuaugcuuccuagaucucauacagacugggucagaguggcaggaagcauucaguuccuccauggauagguguguuuaucccaacauaaauccuuaguuacacagacaucuuggcucaaaugcaugaaugcugaaaaagagagugguaaugagaacuauagcuuuggagguaaaugaccugcccacaucugucucuacucuauagucuuacucacugaccagagcaaaaugauuggaauucuuagguuucuccugugaaagucgucacaauaaugcuuucaacaauuccuaucaucaugccccuuaguauuaaaaauaaauucucuaguagauacucucuaguagauaauguuaguuuuauuauuuucccaauaauuaagacaaccuucuaugccugugccacuuugucuucuuaaaugauuaauauaggcauaggaaucucaagauauagaacaauucauugcaacagaaucagccuugugucaguucuagauacauuuccugacugcucucauacuuuuuccaccucugcuuaucuacacuccaucucaaucauuuugucaguuuaagaaaucuauauauagaagacuaugugauguuugaccauuagacaacauuaauacccuugagauccauccaaauuguaugcacacagaccuccuuggucacuggguaauauuuugagguauggauguucuuugccuauacacuuauggagggauauguagguuggcuguaguuuugaaaaucaaacuacacuaaguacuggcaugcagcuuuugugugacuacaucuguucaucucucugugauaagagcucagagguaagggagaauuguugagucauacaugcaauuuauauucggcuuuuaagcaacugccaagcaauuuuccagaguggcuguugcauuuuauauuucuaccagagauguuuguuuucucuuucccagcagcaucugauaguguggcuucugaauuuuauguuuuaauauauguagugauaaaucacugugguccuaauuuacauuucccaaaggacuacugaugcugaauauuuucucaugucgcuuuuauagucucucacccucuucauugagauauucuuuauaucuuauguccacuuucuaucuggauucuucucuuuuccuaucacagaaucauagaauuuugcaacuucauuuauauagccuagauaacauucucuuaucugugacugugcuuguguguugggucagaugggagaauguauccagaaagaaacacaaugguaugaguucagcaaugaauugaucuauaucuugaaucugagcuucucacacucauacaaauaaauuuuauauguaagauguaguacacaacccaggcccuuguuaauguuggcaaauuguuauaguuccugugaguuacaguuuuagcuuugggaauccuucucuguuccuuucauguagaagucaccuuuuucugccccaauuucuucccagauacucuaguuaagacauuugcuccccuugaucuuuaauucuauggucagcauuucuaaucuacaucugaaucucugagcaggaagcacacaugauuugaccaccuucccccacagccuuuugucaggcuuuuguuacauaacagcuauucccuuaauguccuacgagcuacugagucauucauacauggauuugucuuuuaguuacuauaagacuuuggcauggagagaaaaaaccccaccaaaaccauaguuaccauggauacaggggcuuggaaucuaaauaaaucacuuaauacccaggaaaggguaacuaauuauaagaagaaacacauacacacacccagauguguuagugauuaauuucuucucagcuaccacacuucuagcuaaugcugugacauguugcuguuuauugaggaguaucuauuuaugucaacccgcaccucauguuuggcuaauuaaguacacauacguuucaaagccugugaucugugggcuauguuuacauaagaacaccauguuccauacacaggccauuguuuagcacuccucaccuuuuuccagucucauauuuaauuagugaguguugcugagggggaaugugggcuaugacuuugaauuaaacaaauagcuacuucccauacaaaucacaacaaugcauaauuaaguaaugaggcaccugagcucugucagaguuuuucuuauaaaggaacuagggcucugagaagggacuaaaucacagagacacuuuuaagagugugggaaagaaugugcaggcacaaagucuagcuuuaugcauagccgcucuaggccugaguguccucucagagagaugaagaaggggaugcucuuucccuuucccucucuguuuccucuuuccaggcaugcuuuaaacaucucauggagcaauagaagcaagccucagugcaaagucaaaguaggauauaaaaugcacauaucaguaaaugguggccaucaguuuaaaagaucgcaguaucuuggucucacacaagaggagacauuaccaugugacacuaugcccuuccugacaccaugagcucucuuuucucacuccuaggugacagcaugaccugaaguagaaaauguucaucaacacaucuugcuuaguuuccauuacggacuccacucuagcaaagcccccaaccccuaaccuguaccuaauaguagccuuuccuucaugauuguuaggugaaacugucaccugcuugccuuuuacaucaggccuuugaacucauccaugguacuucuccuuguaugauguagcagggccucuucauuuaccugcccacuucugcccuccugcaggccccacugccuuccacacuagaaugggaaacagcaagcugagcucuccauuucuguguuauaaacucgugaguucaccaugguucccaggggaagaauggguagaauuuucucugugacagaugucacaggcaguaggugauauuuuaaaaauucuauguaaguuuggaagcaucuuugagucuaacacugaaagucaucauuucucuauuagauucucaagaccuguaaggcuucugaagucuacagaugagaugagcaagaguaagcaguggcgauaggagcauaacaagauaacaacacacaaaaugccucauggucccuuccuugguccuaaccacuugccaaaucugcaucccagaaugaaacccuguaaugcacccuucugaaacagccugagagagucucuauaagagcacccauuauguaugucaaguucaccagguauaauggucacgaugcuguccuaucacuaaugccaucuuucuagaccacccugaagccuuucauggccauuuugggauccccacacuccagucugcaaugagacaccuugguaucuuuaccuucccuaguaaccacuucucagucacacuaggguaguagguauuuuuucucucccacagagguauggccuuucaauggucuuuguuucuggugucaccauguugaguuuuuuaugucauguuccugcuuaacaucuagauguaaccaugucaaccaaucccuuauguaaaagagcagcuuucugaagucagucaucauuaaacugcccuacaaggugucuuuagaucaguuguagauuacuccucaacaaagcuaaaaaguccccauguuccuucuuuggaacaaaauacuagucauacaacucagcccugguuugaguucaaggugaagagguaacaacaggagcaaaaauuuaaagcccaaggaucacacaacauagcaauaugcucaccuacaagaggacugaggccacuggaaaagaccacaccucuuccaaagugcacucucaugaagugagcuagcccauaaccuaacccuggcuauuguuucuucucucccuggaguugucucucuuuccacuccuuccuaaagugcauaucucgaacuauucucugccuuucugcucuucucugucuaucugucugucuuuccuguucuccucuaaauauaggucacauguuuguucaccuauauguggaagcacgucucuguauuucugcagugucucucucugugcucacucuaguaucuugguguauauguguguuucugugucuaucacuuugugugugugcauguguuuuugguaguugucuaguucucuacuuauucuugacauuucuccaugaaaaucucuguuugauggccugcuguugagugggcauugggucugugucuguguuuguaugcucuucucuugguacaaacaucucccuauguuugucaaccauuucuaguuguucaacuucagaugugugaacuucacaagauucaaggugaaggccuugaaucuuguaaaguucacaagucuuccccugucuauauccccuuguguauaucuaacucucuagggucaugucuaauuccuuaauaugaccugcaacaucuucuguauuuuaucuccucugggugcgucagucuugccaucuucuguacuucuacaugaacuauaucucuaaaccauauauuagacaugauuuuuagaaaauuaaccuuauuuuccccuagaaacuuacacaugcugaaucucuguuauucauugcaaugagauugaaggacuaagggucauaaccuacaaacaaauguccuagaggagacaaaguguuggagaaacccuucugaggccaagaauacuucaacuguuuaggguuugugacucccucaucauucucugugcauuaaaagccuuugcaucuucuagguugagcacauacacaacuuucaacagagacucuagccaucugcaucuuuccagccaacagcauuguagucucuagagcauuuguaaugugcuguugcuguguucuucaccuugacagacuuggcacaccuggcauuagucaaacugugugguaaaagauuuuugucucugcuuuggagaacaaaccauauaagcugagccaauaccuuugccuucuuuuguaccuaaaugggaauauuugugaaaugaaugcauucugguuuuaaugcucaaguugggaaaugguccuacaagaaaacagcacuuuaauuuuggaguaggggagauaccaaagaagcaaaucagaaagccauagucuucuaggggaauuugugcagcugguuacuggcuccaugaucaugaaagggaaccaaguauuuuuauaggcuuuguuuuguuuuguguucaugucucuguuaaaacacaagcuugauucauuccaaguacagggcugucaacucaacaaagcucuucucauuugcacaugauuuaacucaaccaacauuugagcaaaggaccuugccccagcuucuuccagaagcauaaggaagauccauaguuccugccuuauggagauaaacuguuuaaaguauaaccccaaccuauuccauuaaucuguaugcaaagaggacuauuauauaggccucaugaaguggacaagccauucucucugagacacccuaugagaucuaaaggagacaggacuuuaaagucacucuugguaggacaguuacaugaaugccuuucuuaggcauuucuucuguaccauggauacuuuuccaaaaagcuuuacuaaccaaaugcauauuugacauauuaaauuaauuggcuacuauuguaagcugaaugaggauuucuaggcaacuauuugaagcuguggggcagggauccaaaggacauaugucuccugagggucuauaagcagagaccuuuuuacaguggugcagccaaaguaaggugugcauguuucuauaagcaacuacucauucaugucccucuaaacaaaccuaaugaggcucauuagggcaucuucacuccacaggaaagaaaaauaggacauaaaaggaagacuaguucggggggagaaaaaggaucagcaaguuagaaauaagaaaagaagauaauggggggcaaaauacauuauauauauuauauauuagauaugagcaaaauacauuauauauuagauaugagcaaaauacauuauauacauggcugaaaucauaacuaaacuuguuaucaugcaugaguuaauauauaccaauaaaaacauggaaaugaaauaaaaauaagaggaguaguggauugucuauuuuagagagcaaaauucugaugcauucaaacccuuagguagccagccucaguucuggaacgugaacugugcuacagagcugugugaccaccacuagaaauauauaaguaaguuucaggccucagcucuguaagacaggaaggggaaucagcuguccugauggcauuuagauggcacacugacugugauacugaaguacaacgcaauuaguuaugagugucugaaacugagcauccuguagcguguauaagagucuauccaugaagccauauuaaaaagaaucacuggcugccauauugacaaucccaguagacacguuuuucagacaaaagcaugcaacagguaugaccuccuuucuagaacuccucccuuugccccugucuccuuguauggcucuacucccugguauuagucuuccuauugagagucuccuuugcuggcuuaucuucuaucaaauuuuccaaugguguucagcccuaggacuuggcucuauagccuauuaucaucuccagcaguacauauuggcuagcugauccuauuugguggcauaggcuugaauuucaacaaaacauuggugacauauacuuuucuuuccucagacuggguuucucuccugaucagguucaacaucuaaauaucuccuugagauuuccauguaaguuuuuccaugaggcagaaucucaaucuaaagugcuaaagaguguauagccucauuuacaaaugcaacuguucucuauuuuggcaggcagcaucuucccucacacccugccuuugcagaaaucugaaaugucugucuugcuauuuuuucacuaaguucuaaggauuucauuaugaaauagauguuaccacugucuucauuuucuuaaagaucuacuccagcaccaugguaauaccagcuuucucucuacuuguuucuggguauuugccauuuuuuacauucauuauuuauauccuagccaucaacuucuuccuucaccuaaugguuaagacuuuaaucucugaagucuauuggacuuccuggaugugugauucacuaaacccaaguaaaagugcaucacuuucuaagucaauacaauaggagugaaaacacuacucauguuacauauacuuaaauauuugaugaaauaaaaugaguauugaaaaugauguuaggcauacaggaagcauuuaauaagugauguugacaaagccauuuuaugcuugaguucacagcuuaaauacuuaaguuuuauuuagauucuucaacccuuaagucccucagguuaaauccauucuauuuuauagaacuaaucuuaauugaauauugaauacugcuuuugauaauuauucuccacuucagucuaucaacauauccuguagaauauagggaagcaugucugccuuugccuucacucaggaagccuagcacaguagauaaggcacaugagagucauucuuuuauauaggcugaacaauguccccauccccuaauccauagauggaagccucaccccaauacuucucaaugugagauucagacucggaaagacacuaaggugaaaagugacugaaugggguugucuuagucaggguuucuauuccugcacagacaucaugaccaagaaacaaguuggggaggaaaggguuuauuuggguuacacuuccauacuguucaucaccaaggaagucaggacuggaacucaagcaggucagaaagcaagaccugaugcagaggccauggagagauguucauuacuggcuggcucucccuggcuugcucagccugcucucuuauagaaccaagacugccagcccagagauggucccacccacaaggggccuuugcccuugaucacuaauugagaaaaugcccuacagcuggaucucauggaggcauuuccucaacuaaagcuccuuucuuugugauaacuccagcugucucaagaugacacaaaacuagccaauacaggggucuaacauagucuuacuuuucucuuaaaaaauuguggggaaugcaauaagacaccaggguguuuguacacacagaacaggacaggugaagacacagcaaaggauagucauggaccagccaaagaggcauccuuuggagaaaccauacccacugaugccuuaagaauagacuuccagucuuuguaauuaugcaaaacuaaauuucucuuccuucugucuguuguauuuugcuauguacacuagcaaacuaauggaaucaguaugcugcgaaugugucaaccccauacccaauacaggguaaggauaccacaaaaacuuacuuguuacagugagguaacauuaaggagaauggcaaugccuaaguagaauagcaauguccugcucacugugcaagcaauaggcugcaccuugacugugaugcuaagguguaaugcauuuauuuaagguguaauguaauuaguuaugaagauuuaaaacugcccuuucugagacaucaguaccacucuuaggacaucucucuguuuacaaauguguaucuguuggaacuugacuauguuuaugucuuuugaaugaauagccugaaacaugaggcauuuuauacucaguaaaccaauauuuuucagacacugccgcaaaacuagacauaaugagcagaauaucaaacuccccaaacacuggcucugcugguuucauaaaugugucccugaacauguuugcauucauuuauaaguaucuggagaugugagggaugccugcguauaguagauguaugacuaauuuauuccacagaaaaauggccauaaagcgcaggaccucaaauuagauagguagcuaguaaaggcagccauauacaaaagcucauguuuagcugggacauguaccugauucuagaaaauagauugugccuaagaucauaacaaaaucgguacaucuuuauauucaaaggcgccaucuuuucuguaguacccuaguaacaaagcuuuauuaaagcaucaaauuuagaaaaugaucgguacauaauagagagcagcauguccaaugguucuucuaauggauuccagaacuaacagguauggaccuuuaaacaguuccucaggaaucacgaaguagaccacuucgcaguggggacuuacugaaggccaguguauaguaugaaagagagauugccauuugucgaaaacacuccaucuuucacacgacuuuuugacugaggaaaaauauguaauggggcauuuuaauuaaauauuccuauguaagaggaggcauacaaauaaggaauaacaaauugguuugcuacggaauuuuacccuauucacuagcucuugcucucuagaggaauguacugagaagucugauguggagaguugaacauaccuuuuagaauaaugguguuuagcaucaaugcaagauauauacuagaaaauguuugcuaggguuagaaaggucgcucagugaguaagugcuuccugcgccagcaggaggaccuagcacccauguaaaagcuaauaaagcaugguugaauauguugguugggcaugguucucuauaauuccaaagguaaaggguuggaggcaagugacucacugaagcuugcuggucuccuaugucuaaacugagacacucuaucucaaaggaauaagaucagugguagagaaagggaaaaugucaucccaucgccuuuguguguacacaaaggugcauguacuccccauauguguacauaccacauucauauaccacggucacauuugcaccuuuauauacuuucacacacucaugcaaacaccaucuuuuuuuuuuuuaaaaaaagaaagacaagaccaagcaaauggcugaguggcugagugugucuuuugcccuucuagagaacuagaauucaguucccagcacacaugucaugagauucauaaccacuguagugccaaauaguucaauauuuucuucugaacucuaugggcaaccuuccccauggacacauucacagauaaaaauaaaauaggucuuaaagagagaaggcaaauucaauauauaguauauauauuaauacaucauauuaauaagauaucaaauaucacuauauauuaucuauaaauauaugauuuaugauuuacuuuuauuauacauauaacauauaauuuguugaauauauaaugauguauaauuuauauaauuagauuaguuuauaaauauacauaaugauguaugauauauauaacaaguuccucggguuccugguguuaaucucccauggccuacaccuucuuuguccucacauuugcucugauaggugagauaguccuccacugggaagagcuauacuuugcauuugaaaaguuucucaaaggcguacauguuuauggcuuggucccuguccauggcauguuacauuggaacuuugagaaagaggaccuggcuagagaaguuaucauuaccagcuugccauuaaagggaauauggggaauuaaaucuuuucuuuuuuuucucuuugcuuccuaguuucucaauacaagcaacuuugugugccauauguuguuguuauuaugcaucuccucacugcagggaucaaaggacaguggacaaaauaaaccucugaaaccaugggccaaauucacuguucccugguuuaaaagcaaauaucucaggcauuuugucacagugauggaaaagugagugauaucuaaaucaggcagccagacucagagucuauguccugucucaagacaacaacuucuuuucucuagcaaagugucauuuuaauuauguguggcuuuggucuguauacugagggacuuaugcugaaguccugacagucacugaaguaauuagacuaaacuauaacaggcaaaaugcgguaacugcuggauaguggauuuguaaguggcccacagggucuucucugacagaagauggauagaugaggcauucgcagugcaguacugugugcaugaauaaucaugacagacagaggacaaaguaaugaugaugguccauucuguccugugaugcagucaucacugucaaagguuccaaauucucuuugcaauucuuugacaguucucaaucacugucauagcuaucauuuaauuuagucucacuaggaacaaacagccucucaacauauacuucacagggaauauuccauuucaucccuucacugacaacaccuaugaggcaauauagccucuaguugauagaaaaaagaagcuaaaggauauuaaaugacuuacagacagaucauuauaacuaagggguccugcuuugaaggccaugcucuuaauuccuuaggacagcaauauaucagugcacgaaguauccagcuacugggggaggcuaaggaucaacacaauauauuuuggauauuagucuucuauugaaugugggguuagugaaguuuuuuucccaauccguagguugcagauguccuuugccuuacagaagcuuuccaguuuuaugaggucccauuuagcaguucuugaucuuagaucaugaucucuguucuauuuaggaaauuucccccugugccaauaaguucaaggcucuuucucacuuucucaucuauuagaugcaguguaucugguuuuaugcugagguccuugauccacuuggacuugagcuuuuuuuuuuuuuuuuuuuuuuuuuuuuuuuuuuuuccauuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauggacuugagcuuuuuacaagguaacaaauaugggucuauuuucauucuucauacagucagccaguuagaucagcaccauuuauugaagaugcuuucuuuuuuccauuauauauuuuuggugccuuugucaagaaguuaaucaccaaaaaacacaaucaaaaaaugguauauagaacuaaacugagaauucacaacugaggaaucuugaguggcugagaagcaccuaaagaaauguucaaagucuuuagugaucaaagaaaggcaaaucaaaaugaccuugagauuccaccugacaccagucagaauggugaugaucauaaccucaggugacaacacauguuggagaagguguggacaaugaggaacacuccuccauugcugaugggauugcaaacugguacaaccacucuggaaaucuggagguuccucagaaaauuggaaacagaucuaccugaagacccagcuauaucacuuuugggaauauacccaaaagauggcccaccaugccacagggccacguguuccacuauguucauagcacccuuauuugugauagccagaggcuggaaaugaccuagauggcccacgacagaaaaauggauacagaaaaugugguucauuuacauaauggaauacuacucagcuauuaagaaagaggacauccuggcuuuugcaggcaaauggauagaacuagaaaauaucauccuaagugagguaacucagacuaaaaaggacauccaugguauguauucacuaauaaguggauauuagcaaaaaaaaaaaaaaacccaaacaaacaaagaaagaaacaaacaaaaaaacccauacagaauauacaagauacaguccacaaaauucaaaagccucaacaagaugaagugcccaagugaggaugccucagucccauuugggagagagaagaaagcgaucauaagugggguuggagggagggacuuggaagggaaagaggauguggagggaggaaccucaucugguacuaggugaggaaauaggacugaagcccugagggccugaggaaagaaaguaaacaggcaaccucaggaaauaggagguuggcaggaccccccagcaugcacuagagacuugggaggugagagacuuccaggacucacagagagggaccuuugaugaaaugccaguagggagagagagcuaauagcccaccuucagcaggaagacaggauaucaagugagggaugggauugacaucccacaaucauaucucugacccauaauuguuucugucugaaagaauuacaggaauggaaauggagaggaaccugaggaaaagaagguacagugacagguccaaagugggauccaggucaaggggaggucccaaggccugacauuauuacugaggcuauggagugcucacaaaaagggaucuauccugacugaccuaggaaagacacaacaagcaacugaaagagucagaugcagauauuugcauccaaccaauggacagaagcagcugaccccuguuguugaauuagggaaggcugaaagaagcugaggagaagggcaauccuauaggaggaccagcagucuuaaucaauguggacccccgaaaucuaucaaauacuggaccaccaaacagacagcauacaccagcugauaugaggcccccaacacauauacaguggaggacuuccgggucauucagagaugaugcaccuaacccucaagagacuggaggccccaugggguuuagaggucagaugggguggagcgugugggcauccuuguggagauggggugugguugggaggaggugugagagguggagcaguuggaggguuggaguguaggggcagggaaugaaauaugaaguguaaaaaugaauuacaaauaaaauuagauuaaagaaaaagaccuacacuaaaggaaauuugaguuucuuauccucugacguauuuauuugcccacucauauauccaaucacuaaugucuucauugauauucauuauuugauuaucuuucucugugauacuauauuaaagugccaaauccaacaugcuaggcuacugcccucagaucugauaguccaauggaaggaagacacaaguugagauaauauuuugauagaaaaaauauuaaaugugguccugugauagaagauucaaaauuuggaauuaguauagaugaugcugagauuagaaacaaagggcaagucacugcugggaagauaauaacaugcagaaaaauagaagcaugcauugcugaggagagaccugaauaugcagaagagugacuugauagugugacuuauuuaagagguucggaacauguucaucuggaauaguucagagaggaagacagugcaaggaaaccuagaaaaucagacagguacuggaccauguagagagaaaugaggaaggauuugaugaagagaaacuuugauguguugaagagaaggcaacaaugaugcguuuucauuguuagugagagcucagagggcagaaacuaaaaggaacacaagaaaaccagaauagcaacauagcaaugguaaacauguaagucauuugauggauuaaaggagagaauuagaccucauuauuagguggugacaguggugacaaggggaaauggagugcuaaagaaagcauuuagagaucaaacucuaaaguacuuucuggacauauugaauucaagaagaaggggaugcaggaagagucaaguuuaccucuagauucugauuugaacuauucaguacugacaggaaaccuaagcagguggguguuuucaugguuaggagauauauggcauucugauugagugucccuagaaaguacuuaaaguccacaauuuaggagguaacacaagaguucuaggauuaggucuaggacuucagaaucagucauauauguaguaauacuuguuaagacuuuggagcccagaaagagaggagugcuauuggaaacagcacucagaacaaaauagaugggacacaauuaucaauguccacugaguaauacugucuacauagcauagcauagauguuaccauuaauuugagccacuguaauccccuaugcaagacccuugaagggacaggccuguuguugaucccucaugaaaggccugagaugagcauuaaccugucagcugauaccccagccacucccuccauccucaucccuucucccagccauaugucauuuuaucucagcuguucauggucucacgggguuccagaggacucaaggaguggaagauugagaguagguaagcccaccucuacugcuuuugagagauuuucacugaggcuggggugaaaucuuuuuugaaauuguuuggugauucacccagguuucuguaggcccaaugaaccaaacuggaguuggcuggaagcaacuguugauuugucacucaugaacgcauccguuggucuaucauugguacucuaucugaggugcauagacauuuauucacaucuccccaggcaaaguucacaugagaauuacuguuuucuaccaguuuaugucuuucuuuugguaugaauaucucugccuuucuuucucucuccuuccaauauagcauccaacuugcccugauccaauuuuaagagguacuuugucuaucuauuuuguaccauauaucccucccuauagccacucaugcuuuuauggcaugagaggagagcuggaucaaagauaagcuuucuucagaaccagaugggagucuaaaaauucagauuaucccgacagcucauacauacagcaagcaauggaugaaauucacuccacaauaguaugugcaaggagacugucacugagauugcaaaaugauuuuugauucauguauuauacaaagucaagauauuuguaagugauaguagugaggaaugaagacugaguccagaauuugaugcccaguggguuucccgauguucaacugcagggugggucagauccauuauucauaauaggaagauucaaagguauuggaacauucuagcuguuacaguucaacuucaaauucauugcuuggcugauuuauagcuagaacugauagauauuauugaaagaugaugcaucuuuuuaugauggaaauguucaugggcacggaaguauauagacuuaugcaccaagcaaugacucaaugucuucuuggacauuauuacacauuaagaguucagacuuauacaguagucuuuccauguucucacaacacuccacugaagcucccuuuuuuucauucuuuuuaaaaguaugugugaagggaaaagcugccuuagagugacagaguagacaauagucuccccucucccuuucccucccuugccuuuuaagaauucucuaggcccagcauagugccggccauauaacaaauguacuaacagccuccuaugcaacucuucccaguagagcauaaucaguucacaaaaugaauggauucauuugguuuaaaaaauugaaaucauauauauguucaaccaaaagacucucugagccaaaacauuacauucagcaguucuggcuacauccauaaccaaagagacuuuaucauucacaucuuccugaaaaaacaaccauauagcaaaauaauucauaaugaauauuaaaauaggaaauggagucagccuccuuuuuugaugaaaaaauguuaucaguuaugguggggcucugagaagaaacugauauugcuucucacaauuuuucuucuucaacguuuaguuaguguuaaaagaagguacauuguguauuuucuuuaguaguaccuuaacuuauucuagcuacaccuggguaucaaucaaaauuccgagaagcaaaauguccuagaaaggaaauacaagccuuccugugagggugugcugaagggcuaagcuauuauuaucgccugaagcaaaagaaaguucucaaguacaaggucaauauugauuuguggaccacaaagucacaggauguuuuucaugucuguuauuugaaaauauuuaaaugugaauaucucucuaaccuuggaagggaacgaauaagcaauuauaacuguuuuugcaguagaauuucacaucacuuucuguguuuacuuaauuguuaaaccccaacuuaaaacuacuucucacauuuauauaaugauuacaugggccacaaacuaggaaauaauuuuagaaaaaggagaucuaccuacuucuaacuaucaugcauuauggcuuuacugcauaggaugcaauaccauccaucuuuucuauauaauuucuauauaauuaauaagccagggauaacaagaaaagcaaugagguuaguguugaaggcauuauggcuuaaaauuugacccuaaagauucacgacauaugcauauucuaauuucaagucugaagucuauggguuaaacaguaguacagucaguuuccuaacuaucacuuucuuucuuuguacucuuauuuauuucuaaucaacccggggauuaaaaaaaaaggaaggaaacuaggcauugguggugguggugguggaauauggauuacaggauuaguguucauauguuauuuuuaaaugagugggaaaugaccuucacuaagcauuuaccauauuucaaguauccgaguuucauauuacaaauguugauauuuguauuuaaauuuacuuauaaaauguaaguaacuggguucagaaaaugaagcaauuauacagagauguggugugugugugugggaggagguauauguauguuuguguguguguaaaugauagaauuccagauucaaggacagaucuguuugacucuaacaauuuuuuuucuuaauuaugaauuauaaauugguagaguuguuuaacuuuaaaggauuuugugacuaaauaaaugaauaaaguuaccauggggacaaagagagaacacaauuuagauauuggauaugaauugguaaacagauguaugucacuaaaaagccauaguuuucauuguaauaguguacugucucuugccaaaaaccccaggaaagcuguuuucauacugcagaaaugcagcugguuaaaaggggaauaaauguggucaaguaccuaagacaguuaauucauucauugccaagaaccugcaugcaauguuuauaaaaaggaagcaagcuacaagugagcugacucauaagaauuuguuuuuaauaauuuuaauaguuuaaagacuuuugaugucaauaacuucauuuugucaauuucucuacuaguagucuguauuccugcauuacuuaguguucuucugccgugauaaagcaccauggccaagacaaguuacaaaaggguuuauguggccuuccgcuuccgaaaggaggagagagagcccaucccuaucauggcagugaggcacagcagcaggcaggcauggcagugaggcacagcagcaggcaggcauggcagugaggcacagcagcaggcaggcauggcagugaggcacagcagcaggcaggcauggcagugaggcacagcagcaggcaggcauggcagugaggcacagcagcaggcaggcaugacagugaggcacagcagcaggcaggccuggcaagcugcggacucagauuuuuuuaauuggguauuuauuucauuuacauuuccaaugcuaucccaaaagucccccacaugcucccccacccacucccccacccacccacucccacuucuuggcccugucauuccccuguacugaggcauauaaaguuugcaagaccaagggaccucucuuuccagugauggccgacuaggccauuuucugauucaaaugcaguuagggacaggagcuccagggggauacugguuaguucauauuguuguuccaccuauaggguugcagaccccuuuagcuccuuggguacuuucucuagcuccuccauugggggcccugugauccauccaauagcugacugugagcauccacuucuguguuugcuaggccccagcauagucucacaagagacagcuacaucuggguccuuacaagaaagaagcagagagugaacuagaaauagcaccaugagucuuuaaacucucugagcucaccccagugacauacuugcuucacaagcucacacuuccuuauccuaugcaaauagugucaccaacuggggaucaaguuuuuaaacaucagagccuagggagacauucucacucaaagcaccagagcccacaaaauaaauacaaaguuucucuagacccuaaagauuuccuucauacagagguaugaaaaaaauaacauuugaaauuuggguguaguucauaccauccuagucauacucauaccuuaugauucaugaaccauacauugcauuggguaguauucaucacccauuaguccauacucuuuauauaaugcauaucaguugauaaaguacuuucacaugcauuacccuauaugaugagauagguaauguuuucagaauauuuaguaauugucuauauauucucuucuuugaaggcuagcaacuuaggagagauuuuaucaguauaaacaacuuucccaugauuacaaacaaauuauucuaaacauguccccaagaauccuauacagauaauuaccaaagauaaaagacuucuaauacuuaauauuuuggaaauaaugaaagaagucauacaucucuaacuuuucucaaccaguauuacuaucuucaauagcucuuaaguugggcacuuauaaauuaauuucaugauauugaacauaaaucuugauuuucagagcauguaaauagaaaaauuagguuguauaauuaguguuauuaguuucagauauuacauguauacauacacauguauggaugcaugcaaauguaugcauucauuauacaaagugguguuaauacaaaccaucaggcacagcaccuuaaauucugcauggcaccuacuaggccauaaaugagaagagaacgaauucaauaucaguuccauaaaucaaauuaacauuuggauaaaaucauuauagcaaaaccucuuuuucaaaagaaaauuaugucaucuguuuaaaaaaaauaauugguggucuucuaugguauuuauuuaaaauguuagaaaauaucuaauuauuggagaguuuaaaggcaaguaagucagaauuaggaaagcaaugcuuauuguuuaauaaaaacccauaguguagauuuuuauuaaagaauaaucuaaacuugugagguuuuacaaugucuagcacagcauaggaaaaucugaucugugcuuuuaggcaucuauguguguuuauguauacauaagagagauacaucuaacauuacauauguacauauguacauauuauacauguaaagcaacccacauaauucacugaucuccuaugcauuuacuucaagagacuauuauuuaagagaggagaggcuuuuaaaaaauuuugcagaacuugaauuauuuugucccuugcugaguuguauuuccuuauaucuagagaauaaagugucuucauaggguuacacaucaaagauuuuuguguuagcaugccacuuuuaaccaguucucucucucugccaacacaggugagaaucagacuuugucacccgccagugcuuggugugguucuuaagagggaauccugggagaagacuaguuaaagucaauguccagccugcaagguaccagugaucaaaauggaauuuauauuaaaauugauauuugaaacuaacuguaaauauuuaaaauucuuuuaucaucaaaugcaacuagaccaguggagaggaaguugagauaugaauugagaaagacccaaacaaauggguuucugagagaacugaugaccaaggcaagcuggaaagugagguagcugggaguauggaaauguuggagagaccuuuuuagaugggaauuugaaccaugcaaaaugccagaauggcagagcugaucugagggccuuuugggaaacacugccaugguaaugggugucugaugagaagucuugagcuuacagaaaaggugacauacuacuuugggagcaugugaggacucacugaaacuaaaaucaguauguguagagacaauucugcaguaccacagguccucuuggacagagagcagcagauggcucucaaggaaaaagcuuguucuccaagucuacugcuugaaggaaaucugaaccugauuuuaucccaaccccuaguuuguccacugaucuacaaauaggcagaaaccugcacaaccuguacagcuaucauagaucuaaguacuguauaagaacucaugucccuuuacgaaaaugccagacauaguagaagcugggaaaaaaaacuauaauccgucauuuuaauaucacugguuagcacauggcaagauguucucugagaagcaucccacugcugaauguaccucugcuucuagcuugcaggauaagccuuguccaauucaaggaauacugcaaacauuguaugaaauuuagagauauaauaauggacuuuaggguaaaaugcagaagaaaggaaagaaugaaaagagcaguuaaugagagaagaaaggagagggaagggaagaaagaaugagaaagaaauaugaaagaagagaauacaggaaaaagccauuugagggcauaaaaaggaaggaaggaggacauuggaaguguauaugauagucaugagguccuugugacguauuucauggucauccaacacaucagaacugagcaacagaaauacuuaaaguaucuguacaaauugggucuuuuacaucuucaccaaucugaaaggacuuugaaccagaaaagaaccuuacuucauucuggauugucuuaggaaggcaacugcucucagucccagcuauuggagacccuaacuauaaacccugcaguauuguuggcugcuauaagugagaucacaguuuccauucaguucuucaguaugaaccuaagaauggagguguuaauaaagugaguaacugccagggaagggagcagggagcucuaugaacuuugggcaacuccgaaagcucaguuuaagugaaaaucugguggguucaagguaauaaguuaauacauuaguuacuuuuguguucucuaacaaaacacugaauauaagcaaugugaaggaaggauuugcuuuggcuuagaguucaucuucauaggguuggcauuaugaaggagggcaucucaaagagcuaagaacaaggauacacggggcagggggcagagaaagauucagccaucaagagcagacacccauugacuuaccuccuccagugaggccuaccucccaccuuucuccauaggccaauaaugucaucuuguuaugacuccauaaugaaccugcagcuuaguuccaagcccucaugauuuaauugucucuggccacaaacucaaagacacauccagaagcaugccuuaggaguugaggcauuucucaguccagucaaucuacagucaagaucaucaucaucaacaacaacaauuaaaaucuagacaagaaaauaaaaaggaaagaggaaggaaggaagaaggagaaaagagaacagagcugugccuuuaagauuggucuuggaggaaaaagguaguugucucagauggaacuagagcuaagucuacuaucuuuaaucaaagcagguugaaauuggucugaccuuuccuaucugcuaaccuuuauauggcuccuuucccaguuacuggaugguucuucacuuuaucauccucuuccucuuccucuuccucuuccucuuccucuuccucuuccucuuccuugggggaagcuaaguaaucuaauuucaaagaucagacagcacccuucccaugacacccagcuguaguugaucuucuaucaacagucucugauucaagugggacguucagccauggcaccucagcacuucugauccauuaguccucaugcaguggauuaguuacacaagcugaggagacaccacuguaggguagcauugacaaaguguguuuccauagcacacguguugcuagaugcuaaaacacaugcugaacagaagggcuuaugugaaggaaacugcagcgaugcuggaguuaagcaaaguggaagguacauauugaucacuugcuuucccagagccucuaagauggcaagguaacugugagugggcagguaaaagcuccaggaugcacguauauuccaaauauucccaacaucucuuaauccucuaaaauugccaaguauuuuauagacauguauucugcugaauggaaaaagagcuuuguucaggcauguagagugacaaaagaguucuauccaucuacuguauuuacuguguaacucuuccuacugucuaugaaccagaagcacaauuagagaaaagucuucugccucaaaacuaucuaagguuaccucuucuuuugcagucuuacuuugcuauucaaauugacacaguuuaguaauuuguguguguguguguguguguguguguauguaggucagaggacaacuuuguauaguugguucucuauuucaaccuuuguguggguucuaggcuuugaacugaggauccagacuagagcaccaaguaccuugcccuugcagagcucgcuccagcccccgaauguauaaauuaaacacauuccaagcauucagauucccaaaagguugcauguaguaacauucccuaugugaaauucuuuaaccauugugauggauuugucaacuugacacagugagaagagagaacguaaauuggagaacugccucugugagacuggccuauggacaugucuguguggcauucccuugaauccugacugauguagaggacucaaguccaaugucaguugcaguaccuuucuaggcagguaaaccugaaucauguauaaaacauagcugacaauguagccucagacccagcaaugaggcaacauucacccaugacucuguuuuccugccuugcuuccauccuuauggacuaugaucuguugaaugaaaugaaucuuuuccucucacaguugcucccggucauggucaugguguuuaucacagcaacaguaagaaaaccaggacaaccaugauuuucaaagaaaguucugauucacacaaaaccacccccuccauagccccuuuauuuuuagccuccauugugcacuccacaggaaggaaaacacaguuucauuuguccuaacccuugaguuuguuccacccucugccuugucauuccgcuaaagagcuuauuuguguuucugcucucugaaaagcaccaguuaauaaauaugaagcuaaugggaacagcuacuguguuuugaauaauuuggggccauuaccagguauuuuaugcuuuauuuguguacuuggucaugcuaaauguuauguucaccuaaggaugcuucccucagugggaaguuuccagugccuagaaagugaccacaguaguagcacagcuuuauuguuuucaugaauaauccaagccaccucucaaaaauguggcauuuccuauaugacaaaauguacagcaugccugauauugcagacauaaugcaaaugaccuagaacagccugugaaaagaacugguggaguuagcuggucuugaaaauucuagcuaccacacccuuugauagaaucauuuccaaacacuggugcuuaguccguaccuaucaacuaaugccauuacuuacugccacucagccaaguuuaccucuggggaggccaaaaggaugguguuuaugaacagaugguuguucgaggagagguaguuacauuuaaaugcugauaaauguacuguaaauaaugguuugaaaagaauguaggucuuuaaggggaaaauaugagagcacaagauccuguucuuuaauuacaugaguuguuuuuucccccuucccuugaagacaaaaccaauuccuaaugaagcauaaugcaucguaaagcgccaccacucucauuccaacagauguuuauugacugguguugacugcauacaaacaaccagcacagcucacugcugucaguaaguggugcgaagcgugcagcucccccgaguuauuuuaccuucaaagacaagcugacaaauuuauuuugucaugagcagcuguguucugauuuuuaaaggguuggcuuacaacuaagaaagccagagaagggaacagccuuuugguguccaauguguuaucuggcaaggacagauuguuuuagggugcaaugaaggagauuuuuaaugaaacccccauucgaaugagcagcauaugcuugacuuucuccuucugccgcccauccugccauucguuaauuuugcuuauuguuguucuccgggacucguaaauuuucauccaagcugucucguccagcacuaacccagcuggagguggacuguugcuggggaugcaacugucugcacauccuauucgagccuuugauuucuuucuuucuuccugcuuucuacagacagccagaguucacuggugagccagcugacugaacaaccagagaaggaaaaaaaauccaauccaaugcaaucuccauuucuguuaguccucagaaucccagagccugacagugugguuucagaguaugcgcagcuugucaguagcuaggucgaguacaaucaugggggucagagcccggaacagagguaucgagaaacucugaaauugggaauuaaggggaaauuucuuucccuuuaauacaguaaugccacguauuaauuuaaaugauucucucagaaugauucuguggccuaguuaaauaaaguucaaggaaaugaauuuccgccuucagcauuuugaguuauauuugaaagugggcaguuuuacaagcuuaagaaauuacagggaauggaaaaucuuuggacagcagcugcguagauaaguguaauaacuuuuuuuccuuuagaaaaugugaucacacaugggagcaaggaaacacuguuauuaucuuugcuaggagguuguuaugauggggauuccauugugucugaggacuagagaccgaggagcuaugagcaaaggaaugguccuacauuaggaugggggugggcugcccuuucaccugcgcuugugucuccuuucaccguugaaucuggagcaguucaucugucucuacagaucuuagaaacuacgauacaaucuuugauaaacauuaaauaugggcaaucugugguggcuauucuuguuugacaaugugacuauaucuggaaugaacuacaguccagaaauagagggcacacauguaagagauuuuuuuuggaggggggggcuugguuuaaaguggguggauccucuucuaguccaaacauuugaaguaggaagauacacaccuuugcuccagaucuugaggugggaagacaccuuuaaucugagucacaccuucugcugaagccagaaagauacuuuggcguucccugcuugcccuuccuugguagcaaguccauuccuucacuggcauuauacucuccccuucugcaggauuccagcauacacugaagacccacuucaacauucagcacacagacugagcaaguucugauucuuggauuuucugcucauagcuaauuauuuuuggauuaguuagaccauagccugcaugucauuccaacaaguucugcuacucuggaguacccagacuaauacacaaccuucgguucauagcuggguuugcgacuuacaaggcccagagcaagcuauguaaguucuuucaaauucaauuuguucaucucuaacaugggcaugacuguggccaucuuaagagucacugcacagaggaaaugagaugucacugaguuucuuauaugcagcaaguacaaucaaugguaguuccaguaugaauuucugucauucucauuuuuaccauccaaucuaucuauguugggagggcugacccccuucacaaagacucugcucagauguaccagguucucuugcaugcuagccuugcauugacaaaucuguauauggcuuggucucuguuauagaacugucaugucaugugcuauuccuguauaaacaguggaccauguuccacuaagguuggguacucagaaauagcaucuuguaugcuuagcuaugauauacauuuaaggaaagaacucuagaaauucaaaguaacauagugggaacagguaagaugcuaugcaagcuucagaugaugcuuucugaaaccuaaggaccacuuaauucucagcauugaguuugccauugcuucuaagucguguaucucuugugaauaacuggugagauccagagugaccuugagucccugaacaucccaagcacacuuccugacacgacugagcugcaaaugcccacagggcacgcugugacauagcuuaaccuguagugaguucuaugugggcagggugcucccucauucuuacucacccuccaaaggaaaucacagaagagaaggucuguuuucuuggcucaccagcugcaaugcugugccacucagucauucucuagagagcccauuugguccccaauucugaaccgugacccacaguguccagacccugugaaaccauagcugaaaucuugacaggaagucaucucugccacuggcacugucugcuccuauaggcgccaacagguuucagggcaaguccgucuuguaugucuguuucugcuugaccccuuuaaguucuccacggaacaagcagaaacucucuauuuaccucuaccuugggcuuugaucgugucauugcugauacucugcccagcaccaucucugccuuuguuuuguuucaguuucucuuuccuuuuuguucauuugcaaucccaacacuucuaccaaugaaaccucaacaaguugagcauucacucuuccuugagcucuagccagaggcuugucuuguuccugucucauaguguccucaguuccuugcccugacacuucuuaggcuuccuguaacaguauuaacuaguuugucuucucauucuguuuaaacaccugccuucccaaagccuuucuuuucuucuuauauuuaauuuguuuuccuucuacagcuucacugaauuuauuaaaacgcaagucugauucuucuguuucuggacucuucacuauaccugggauaaaaauaaccuaaauucuaaacaugauccagaaggcauuuguugucucaguuaccuucacaaucucaccccaugccuuuggucuucucuagucucauguacauuuuccaugacucuucucuaccacagggccuuugcauauguucuccccaccugcaaaucuucauguguuuuuacuuacacaacauccaucaauuuguuguaugucaauuauguugugagaccuaaaggagacuccuuuaauuauucugagccagaaaauuuuucuaugcaauaugaucuuaaagcacaaauauguccuuuuaucuagaacacaccaguagaauggcuuaagaguccuugagauuaguuuccuacucucucacuauagucuacucucccugauuguaguaaccaggcaagaucuggguuuucuucucauuccacauugcuugcuucucacaaguucuguaauugucauccccugaccaaaaugugggcaugauaucuaaaacuuuacuguuacuuuuaguacuucucuaaaucagggcucaagaaguaaugcuucacagcacuguuaugucuucuaagaaguauaaauauuuuggggggagaauucccccacaaauccaaucuauguuaucuauuaagaagauguccaacuugggccauauggaaguguucaacaauugauauggauuaaccccuaacuauauaccucagcaaaaggcuguaaagguggccuaaaaggguugccaggacaagaaccuugacagugccaagcugguugcccaaaugguacccaugaacucaaacagaugcuuugauauaaaauacucaagggaagaaaggagaauaaaacaguaguuguguuauuaggcuuggguaaaugacucaauagauaaggguauuugcuauuuaagaauuaaggccgaagucuugauugucaucacccccaccucaaccuaagccaggcauggccacauacaccugaaaucccagaguuguaugaggggaaauauagcuagccuuuguacugugugggcucuucuuucuuucacccuucuccaccuuuucccuacccuuucaacaaccuaacacuacauaugagaggaaaagaacagagaggaaaggaacgagaucucaaaauaaagucaggggaugggaagggggacaauauuaucauuugaccacauucuguugauuauaggcacagaguucuuuggggcaaguuugaucuuuguuguuacgauaucaaguuucuucuuguuguuucuucuuugcacaccacuacuuaacaaacggcaauacuaacaacuaacaacaaccaaagcccccuccucccccagucucucagggcccuagcauuuauauacagucugaaaagacuccagaguuucaaaugucacacaaucacagaaacaaucugcaucuggcaaaaccacgccccugccagaagcaaauuauagccagcuguuguggacaauuucaagcagccccauaucucacgcaugggauuaaauugaaaacauguacuuauauuucuguguuuuucaaagaaaccauaauucccaaauucuuaccacagggaaggaauggagaaaagaggauggcugagguuguuugaccuucaaugagagacacuuucccaaagaaguaagguggauauagauauaaaaagaccugauauccuccucugggcucccauguauucaugcauguagacauaccugcccaucggcacagacacaugcauaucccacacaggcacacaaagguuuauuuuagcuuugcgcauaguuggccuccuugauugcaggaagccgagagacuuucuuuuccaaagggaaaaauggugaacuuugccuuuugaacuccguuucuaaggaugauggauacagacuucacuucugcaauuaaacacuucagugucagguguuuaugucacuguccaaguuccacuggcaauuccagggcauauacaacaccucuacccagaccaauaaucaaacacccucuauuuucuacccuuucuaccuugcauuucuucaugcauaauuccaucccguauuaaacagcacuaacaggaucagaagccuggugaaggaugagccuguguaaaagcaacuguguucacacacacggaguaucgacuuuacacauaccuaagugacugcagccugcugagcagcugaacccaauaacugcuaaaucacagagcucacacugaaagccccacguggcuuuagguggggguaggauucuauuuuuauguugaaaagcuaauacuaaaaugucgaggagcugaguauagaaguagagucaaucugugguucagaguaaaggacuacaccaacuuagaaccugccagcaaucagcguuaauugaacaugaagagcaggcuuugucucucauaugguuauuuaucauuuuguuuauucccugggcaaacucccaggauccuuuaguaccuguccugcuuugcuuuuuccuccugcauucauuacuagaaaacacacagguauuguuuacuucuuuuguuugcuaccccacaaaagggcagcauacucuguuuuuguuguuguuuuguguguguguguguguguguguguguguguguguguguguguuguuauuguuuuguuuaauacagugucuugcuaugaugcucguagugguuugaauaggaguggccuccacagacucaaguguuuaaacccuuggccuguagggaguggcaguauuaggagauggggucuugauggaauaggugugggacauugaagucucaggugguuaagcuaggccuaaugugacaguuuccuucugcuuccugcagaucaaaauguaaacucucagguccuucuccagaaccaugucugccugcacaccuccauccuucucuccaugaugaugauagacaaagcuucugaaacuguaaaacagccccaaguaaauguuuucuuuaauaugaguugccauggucauggugucucuucacuuaacuaagacaguguucauccugaucaaacacacagucuuccugacucuaccuccuaagggcugagcuuucagacaugugcuaccaugcucagcuuaugacagacacacacagauacacacacacacacacacacacacacacacucauuaguuucauuugcuucugugucuccagaacauggaacacagaagagacuuaagguuauuuguugaauaaauuaaugagucuuuuaucacuuguuaggcaccauuuguuccuauugcuuuacuuaaauuagaaggcaccacagacaaaugguugagaguuagaaacuaaugaucagucacugaguucuaaaccuuacucuugggaaaaccucuuccuuuccaugcucuggguggacaugucuuucauaagagaugaugagaaggagucagugugaccagcauugaguggaacuucaugcugugaacauggcagaggcgcccaggaagugugcaaaacauggcugcacuuacacucacacucuugcuauuauuuucauuauuaucaauaaugauuaucuucaaaacaagccuaaaguguagacaauucuuuuauucuauauaauuaacagugaaaugcaaugcuuuugcacaauguuguaaugugguuacauauuaauauauguuagggagaaaagggggcaggggaauaagacaggagugucaucagaagaaauaauucagaaauaguaguauuauaaaagugagagggaugacacuggagaauguggugugcacauucagugugcauguggguacgauguagaacaaaaagauacuucacacagcaguauucacugcugauacauccaggcagucaaaugacaagggaacaagcuguuugaagggacccagcuaaacggcuuugaacauggacucuauggcaucacuuuuauuauucugagcucuaucucuucccacuguucuaagaugaccugccaccucccagggaauugugggagaauaagcccaugcagacagacuuaguucgcauacaacuucaaugcuuguaaacugagugaucucauuagauuuaaccccucuuacccucaguuucuuuacuuccaaaauagagguaccaacugccaaacccacuuguuugccagugagcuaaaaugagacauuuugagaaggacaggaugcuacaucaguggcagaaggaauuuucagaaauaaaacgaugccaacagaaacaggauugaauuggccuagcaaaagcuucugguagugucaaagugggguuuguuugguuuucuuaguuuuaccuugucccgacugcccaggcuaaaggacuacaugacacugacaacucugaaaccaccucccaacaccaugucaacaauuagcagcuaccauucuucagcaucuuuaaaugcaacaucuuuaaauauaaaagaaacucuccucuaauaaagaagaaacuuauggaaacaaguugagaaaguuuucagaacuuuuggcuaagacccauaaaagcacacacacgacauggagaccagagugcucacgugaaaggagaacagagggacaugaagagagaaauggagguugugaaagccuauuauccaugcaucuucauccuaaaacagccagagaacaacccacuaacagauuuaacuccauaucaucaaaauuugacucaucacauucuaaauaccucauuuucugcuucucauuagagauacagacaagggagaucuaaauauaguugacuccaaggucuagcauuucaaaaugucaaguggaaucccaucucugcugccucugcuaugcuaguaagcugaacaacaaagagguccugacccuaacagguuaaccagucaagauaagauaucaagagguagucaggacuguugaggcuagacaugacuuaaagguacuugguauuggaggagcucuucauugaagugcuaucuccagccagcgugugucugagugcacagaccggugcaggaggacucaugagagucuggugugauugccugggagugagauucaucuuuaacauuccgaugcagcuucuuccaauaauaaggaucuacaguauuuuuaauccuuuuguuuaaaagacagcauaacugaguccugcguaagauaagauguuuuucuacaccaugugccucaugauaguccacauuuggcuacuagaaaacacucuucucagacuucaagucagccguuucuucugucagugacucugucaagccacauguuagggcaaggggcucuacuuguucagaagucaaugauuuauguuccuuugugacacuugacuuuacauuuaaugaaaacacagacauuucagaagcaccuauuuaaaauaaagucagucuuccacgccacgauauauaaccccagaggaagaacccacugcagaccacagcuauagcaaauaacaaugaaacagauuccagccucucucugguuugcuucuuguaacugucagaguaauaacaaaaauaaguaauacuaaugauaaugauaaacccacaucauccucaucaauauugugggaggguuuaagaggcucacacucucaggccacauucuaccacugagacacugagggaaauaaaggcagcaagcuggaggcaguaaccgaagaaaacaccaugaaggaguaugcauccaagacuugauacuucuggcuugcaugcccaagagcaucaccuuccucaguaggcugggcucuuuuacaccacuuagcaaccaagaaaauuucccauauacaugccugcaggcuugucugagcuaggcaauauagcaaguugaaacugaaaguacucaagccagcuuuuacacaugaaagggauuauuauacacaacggcagcgaugggcguuucucuguguuuaagguaagcauuucauuuuguauuuugccaaccucaccagagauacuaucacuguauaaguuaaaaguucuuguguaugcaugugcaugugugugcaugaaugagugggcacaugugagcacuaguguguggaguucaaaggacaaccgugucugucaauuuuuaucaaguaguccauguucuuagccacucaucagccuggaguugaccagcaagucuguauuagcaacaguaaacccuaaagaugguccugucucugccucccaagcaccaccauauccagcauuucuaaccuaacaacuaagacauggacuaugauagugcucccuucccccauccugcuuagcaaaugaaaaacaaaguagaaucucucauaccuugcuuaaguacacuuauaaauauuuaucuucaaccccaaauuacaaggauguuuaaaaaugccaaauaaaaccaaggacauuuguaggccacguuucugauaguuguagucaccucagguauuaauugauaaauauaccaggucaaaugaaagaaaaugaucauuagaauauucagaagugggugaugauguuucauguucuuagagagaagacaauuauggaagugcaaguuuagacuagcauccugaaagaauacaacauuaguacauauaugucguuaauguuuaccgugugccagguauccucuguguguuuucagauaugaucucugagaauccuuaugauuaccauuaauccaaauuuauaguuguaggagcagagcccuccaaacagccuaagugacuuaaucuaguuacauggcuaauaacauucaagcuagacucaaccccuaaaaccugcuugguuuuauaagcugugcauuuguagaccaggaauauugaacuccugucauuaaugcucugcugccagggcuccuaaaguaccaacuaggacuuaguuuaaaauuugaucugcuucauuucuucuugaaaaagaaaauaaagcacaaaguaucuaacuuguauguaaagauauacauauguaucuauauguauguauauauauuugcaugcguguguguguguguauguaucucucucucucucucucuuucucucucucucuauauauauauauacauauaucauaaaaacauuuacaauggaaaucuuaucaauuucauaguaguugugggaaaggagaaacuuuugcaaaacacuagcuaugggaauaaaagauuuuaaaaaauauaugcauagauauauacauacauguauauauuuauauccauguuagauucuuuuuguuuuauuuucuauuucagaaaaauguaacaguucaaauacauaaacauauguguauauguagaaauuucauauguauauauacauauaaauuauauauauauauggagagagagagagacauauaauauaauuuuuuacuuagggcuuccaaaacagucauggauaauuagcuacauccaugaucugaauauuuaagacaucauugaaagcuuuacuaucaacauuacagauugcaauaguuggaugggcagucaacuuauccaucuuuucacauuccuacugguugcuuaucugaggaaacagagcuagcaucuaaguagaaacuuagaaacugugccuugauggggaaggacaaugggaaagguagaaacuuccuaccuucuaaaaucuuuaaaauguuccauuaggaaacuguaaauuacucucaggggaggagguuccaagcaugucaaaagaacaugugacauaaagaagguugaaacucagaguguggccuagaauuugugagauugccuccauacuacaguccagauuacauuugcuggagcuuuguuccugcaaggaacaguccuuuccuaacuaagagggggagggguagugagacuagagcauaacucugacagguaacugaauauuccugcuguuguuguuacucucagugugggaugaaggcagagguucuuucacucauuuguuucaugcugagaauuccuacucuugucaccuggguucacucacuuauguguagaguaacccacugguuccuugguuguccuuuauaggagcacacagaaguuccaccaugucugaggcauguagggcuucaguguggcucauuggccuagaagacucuaugacaguugcugccagagagcaggacucagaagacaggugcauccaacccacaaugugugauaaucugugugcugauuuuuuucugauaauacuuuguuuucccacugaacaugugacaacuguuuaaugugggugacuaaaauuaucauacuggcucugggaugccucaagcccaggaugcccacagaccucaaaaucacuucuaugaaaaucaagaaaaaucuggaacuuugcuuguagacccgaaacacccuuagguucauuuuagaauauuucagauucauagauagacaacacaauugagauauaguuagaaauacauuuuauagguuagcauuuuccacauugcauuuuaaucacauauuuugauguguuccuguuucuaagauuugaggcauacaggauauuuagugggaaacauuuguggugaagaucuuauaaacuacacuguagucaugagaaaggagaaaacauuuuauaaaauaccaguuaugggaauaaaagauuuuuuaauccucugauaucauuuuauauuuuauggauagcaaaauccuuuguaaauaguaaaacucagcuggauuuugcagucucauagaaucuucuaggucaaugagccacacuaaagcccuagcuagacucagacaugaugaaacugcugugugcuccuauaaaggacaaccagggaaccaguggguuacucuacacauaagugaaugaacccaguugacaagaguaggaauucucagcaugaaagaaaugagugaaaggaccacugccuucaucccacacugagaguaacaauagcagcaacuagaagguucaggaaacucugcaagauggcaugauagcucuucucagcccuucuugacacauuaaggucagcuagcaacacuguuccagggagaagacuuaauacucugccaaauggggaauccauuguguugagucuucucccuaauguaaugaaucggaaucuuccaucagugcucuuucucaagugaaauaagauuuuauuauacuacuuaugcucacauuguaugcucacucucucucuccucucucugucccugucucucucugucucucucugucugucucugucugucucugucucugucucugucucugucucugucucucucucucucucucucucucucucucuguuugacacagucuaaaagaaccaaacccagaucacuggaugaacuccauaguucagcucuaucaauaacuguccugaaugcagucaguuuccugagugcuaauuccccaauuacucugugaggaaaccucucuucaggccagggaaauuaacugaaagacugacagaugcuucaacuccuacaaaaguagguaccuggaggcagagagaagccugcugccccagaagcucagcauuccugccaucacuuucucaugguccuccgugugaggaugugagaagcuucacacagcaggaguggacccuaagcugauugauaccaacaccaagaugccgugaucuuggacucuucuucuuucaaaacuaugagcaauaaaucuguaaucuauaaaccaccuacuuuuucauuauuuuauauuauagcagcugaauaaauaaagacacuguuuuccugaauuucuaguaugcacuaaaacugaguacauuaacaugaaccugaaauucuuccaagcuugcaaguaacaauauuuucucuugaaaaucuuaguaguuauaggaccuauauaccuuugacaaaucuuuagaauuucaacugcucuauauaagcagguacaggagaaaaaaagauaccaucaccaccaccaccaaaaccaauaauucuaugguuaaauuaauuugaaauuguuuaguuauguaaaacaaugauaauuucuucacuguaacugaaugaaaauccucagaauauuucacggaguggaguuuagcaggauacuauucuuuagauuugauuccuaaauccagauggauuuauuuuaaauuuaaucauuccagauuaaaauuuccauauaugaacaaaguaccacugucacugagauaagaggacuuaacauuucucauuuuaaguguucuuuuuaggugcuagguuauuccugacucuaugugauucccuugccauuccaacagaaggcaaacggccucaugagaaugggccaccuacacugugcaagauuuuauauccaaauucucccgacguccuuggacugugcucucugauuuugugcuacaaauaaguaggccauugguguggacuugaaaaauccuuucauuacacucagacucccacaguggcaguguccagcuaaauuaccuaaccuauagauaacaugccaguaccugacaccuggcccacauuuccucuguuccagaguaaagaacaaaucgaaaaaucuacacauuauggcaaagagaugcccuagauaaugaauuguucuugugcaguuucuggucugauaaaugacugaauaaugauauuaaacaacaagguauuuaaugugaaauggcccaaauauaugaaauuaacuuuauaugaacucaaagaccuucagcucuggaaugaacauuaaucauuuuccagaacucacguaaaagccugaugugguuaauuuuaaauuauauuuuauaaagggagcaauaacaccucacagaauucaagguaucuauuaguuuacauucuugcuagggucagcaaaaaagcccacuauugauuugggauuaaaacuuaguugaccucacaucuuuuugagaagguauucuaugacugcugaguaccacugggcauucuucucucuggugcuagcacagggagauaaaugaucuauccaaacaaagcgcuuuacauugcauuagcugaauaaauaguacaagauagaagagaacaaaguugaugugacauaaauccuauuagaauguuuaagcaaagacuaaauaaguucccucaacaucaagggcuaaauaaaggaaaguuaaaaaaaaaaaugaaaauuucgaaguguaauuuguagcuuuguagaaccaagaaaagggccuguaguauauauuugagauugacauauugagugaaaauauagaaacauuguuuuuugcuguucccugaccauauauggggggaugggaucaagaccuuugguacuuugguaggcgcaaccaacuuagccaaaaugaagagcaugccaauaccucaauacaauaccauuggaauugcuucagagugaauacuugcucuuacugucugcuucugggaugcuguguuuuaccuccagaguagacaaguucuuaaagcauuggaagaugcuacgguaagucccuauggcugagucccuaugggaaagucccuaugccugaucacauauccaggcuagugacaugguucagugggcaaaggcuuugaaagucagacucuugaauaaugccaucccucuaacccuuguaaagguaaaagaagagaaccaacucuauaauacuguucucuggcuuucacauguaugccauggcacauauguguguguaucccuauauacauaucacauauauaccaauaauacauuuuuuaaauuaaaaaucauauaaaaaggauuccaaaaggucuccuggcuacuugguaacacuacaaacaggaaggcacagggucacacuaggacaauagccauggccccaguaucuuaugacugauuuuuucauacuucaauggcuucuggauaucgcuaauauuauuaccaaauccagaguuucauauuaguaaguuauagucuauaaggaagaagaauaaaauaugaaguuuuuaacguauuauuuauucacagaaagaagacuacauuuauuguuucuuauaaacacaccucagaaaagaucaacaguacagggacaggcugucuggggcuuaguucucccacacuaaagauaaaaaaucuaacuuggggagauagucucagagugucccaaccucgugaucacugaugauugagagagaaccacagaagauccauuugagucagaagagcccucuacccuccaaaagacuuggcuguaucacccuaggagccaaagaagauugacuuacuaucauaacaaugauugccuagcaaggaaaggaugcuggguagauugaugucaacagagccaccacauacugagauagaaggucaaagauucaguuuauguauuauguucaauugaaucuguaccauaugaaaauuuuagacuauuugacauuuaguaugaauaguucuuuaucucuuaaaaaguagcauguucuucuuaauuaaccauuauaaguaggauggguaugugucuuuaugguacugggaauugaacucagagccuugagaauguuaagcaagcauccuacucuuuaaccacauacucagcccauacaacaagaccgcaugcaucaguagcuguaaggacuacaagacauugauuuuucaguuguaacugcagaaauaccagagacucuucugguuccuucuuacuuuacuaugagugccuuuuagaguggauucucccauagcagacccuacaaugugaauaugaguucaaaugaauugccugagaaaugguuccaggaaguaucguuaggaggggaagagaaauaauacaggagagaagaagaaagcuacugugagaugucuguguuuagguuacuuuuuagaguaacugaagaccccagugagggccucugggagacugcauagaauacacauuucagauuuuccucacuuacaggaagaaacagugggaacuucaucuccacauuccaugugccauuggcuaaaggcagcuucuauaguacagcacuuuaggucugcuuuuugcaccagugagcgaaagcccuaguaugcagagaaggcuccuguuauauaauagccugagcaaguucaugaacaugagucccauaggauguagccaaagcucagagccacgucugacaccaucgacugccauuuaccaaagcacacauucacuuguuaaucaagugcucaccuagcuccuauuauacguauuuuucuagguguugggaguacaggaagggauggaacugagaauauggucuucuuauuuagugccuaacauaacuggacuagguagaagcugauuauuguaggugcuacauuauaaacuaguucacaguuucagcuucaaagaagucccuuaauuuuaagaguuagaccggagucaucaacauuaaagucucugacccgacauacuagagucauuaacagaauaaucagaugugugauaguaguuucucucauggacaaguagguugaaugccacuuauaacauucuuuggggacaucuucccugcggugaaugugcccagaggcacugcagacuuaccuguucgcacucugacagcugagugguggaucaagcuugaagacaugaaaaggacuacauuaauucacccacauggggacugaacuggcaucagugacuucaaaugugcccagcagagaccagaugaucuccauuucaaacacagagugcucugccuuccaaacuggacagaauuccauguuaucuacauuggucauauaaaugggcugcuuuucaaagcuguagucacagaggguuaucuguaaaaucugugucuuauauguugcuuuaaauaaacuuuugcacucacauaaaaaaauaaaccauacaacuugagaaaagacuuacguauaacuauugugaaaacuacccauuaugagcagauauagcauuuguuaugcuuauuugaauucccauaguuuguaguuagcuaaacaguacaccaucuguuauggauaugucugucaauggcauuucccaucucaaggaauaaggaucacuaagcuaugaggucucuaaguuaggacuuaaguacccagaaaauaaaauaucuuugaaauuggaagaagucaauuuaagagaagaaaugugguguauacccuuaaaaggcguuguugcuugauuuuuuuuuuuauacuaagauauuguugauaacuccgaaggcugugaggcguuacuacgacugagcugaucaggcaguuucuguucucaguguguaagugccugagcuguucuguauguagauaucguucccacucuaagaacugucggggcugugagucaaagcuucccaguggcucugcuaagccccucuguuaacuguggucacuccugacucacuccugcuuccuuugcuguguauguuuauggccuaugagguuguaucuguuacuucucuauugugguuuuaccaguguccaugccaaauguuaguugccaagcuuggagugaccuaaagccuuuuucagagcaugccuagauuuaauggacgauaagguuucugcaaaccagaauugaaaagccacagugucgguugucacaaaacgacaagcugccauuccugguugcugcucagaugcaauggaaacuaugcuugauuacaugugaaaaucuuauuaaagucugugucucaguagaaaaaaaaaggcauuguugauugacccccagauuacucuccaagugugucuagauucuagacuuaaaauauuucaauucgcaguucuccaugguuagaacuaaaauaaagugcacuugauaucuaugauaaauguauguagucuugcccccuuauugucacaccaaccaugaaccagggagacaaaucaagagggauggagaggagaagagaggagagagcaaggauggaggugaagaagagcuagacaaggauaaagggaaagaagagggaagaaauugaaauguauauuucucuuuguucccuguguuuugccuaggguaaugcuaauaaaaauauggcaaauugaguauuugauuuauagucacugauaauaucuugggaaaccucagaaucagccuucccacaagaauaaggccagucaugcauauuuuuacuagcauuacuguaggcaacacacauggaacaaaauuagcagcaaucaguuguccuggucacauucuagaauaccuucuauaugaaaggaaguuuucaaacaaggaaagauuacaguuuuggcagcagcaccuucucuacaacucuugaccuuucucucccaucuacaauagagauuuuaaagaauaaauuccuggguuguaucacccagaaagcaguggcuaggucuccccagagaccaggggacaaugggcaugaagaaguacuccaguagauguuucuacuuuccccccugaaaccuggaagacuuucaucaugccagcuacuuuaugugguggccucaaucaucauucacaugguauaaauauaaauuacacuggcuuugaagaaggugaagaaucagggccagagaugacguauuagauuuaauugcuuauuuuguagucuugaaaccacaguguguaucuucugacuccccugccuuuugagaccccugguaauuagcuauuuuuuacauuuuucacugugcaacaauacuuagugugaacauagacugaacuaacacacagcagaguccagcuuuucucugccagcucaucuccaagcauuauuuguuuucauaaacucgagccgagaugacucuuucuuuggugccuuuaauuaaucaggaaagcuuaauaugcacuuuuuuuguuucaucaaucugguacaaaaaauuugcugaauugcuuuuguagucauuugaaagaagaguguggggcuauuagaagaaauucacaucaggcuuuucucuccauggccuacuuauaaucuucaaagcacagggacauuucaaggaaaaugcaaaauuuggggugcuagagaugucugggccaucucaaguucuauuuuuuuaaaauuuucuacacaaaggcaccuuauggugcauuuuaauaaugcaacuuaaaauauuuugaaagggggacaagucacaaucugacccucacagaauuauaccucaugcagacccaaaguggguauuugaccauagggguccuccucuuuugucuccuggguaauuauuucacacauuugggagguuuagaggcaaugcauaugugcuuuuugaguaaaaauuguaaggcucuggcuacuagaaaucuggaaaagacagagacuaagaacuuaccagcuggccuccgaucccuaauaagagauccugcagccaccuuccaggcugaauauuccaaaguuaucuucguuaaaaaugcagaaacagcuugagaacauaucugacuuuaccuuuuaaaaguaggauuaaaaauuuaagaagauucaugaauuacuauccuacuuaucuauccuuugguacuuuuaaucccuuaagcuaugaaagaauccuuuguugauucguauauagaaugaucaaauaaaccaaaauaugaaauugugauauuuuuaaaaugagaaauaaaacuauauucaaauaucauaauaacauucuggccucaucaccuucagcuagccagcuagccacugguacacaugcaugugcaugcacacgugcucaugcacucucucucucucacacacacacaaauuuaugauuuauuuauuuggguauuauuuuguccuguuuuguugcauacucaauguaucaaauacccucaaaugagcaguagagacacagacaaucuacuggggaagauuaauuuguguauuuguauguauauaugaagcauguguguucaugaagcauguuuaugucuggucauguagacgucagggaacagcaucaggugucagccuuuacugccuccuaccuugugugagacuaggucuguauguugcuugcugcugagaacaauauagccuacaaacuucuggagauucucaugacucccauuacaccaaaacaacacugggugauaggcaauuaacauguucagcuuuucauggcaucuagagauucauaaaggucuccaaaugcauagcaagugcuuuacacauugagcuaucacaccaguacugaagaaggugaauuuugcucaaauaacugccuauguacaaaaggauuucgaagaaccuugggagaaaagggucacagaguuacuucuguaaagaacaguuaaguaaguagaauagggaggaugucauuucaaaauggaagaauggaauguguugaguaaacccuacugugggaagaaacgggaucaaaguccuaaaagcaaaagcaacuuaaauauucucccaccuaggcuggcaguaauuuucaauuguuaagcaugaauaaaugguauaagcauauuuagaucagucuauuuucagaaucugcaguuagguauaauggagagggcuuuugucuuagaucaagcuuugagggguuucuuaugaaagcuuguuuucaugguaauuuucuaaaugucaucagcaaauauguaaauuuaaccauaaguaauuguauuuuuuuuacauugauuuuucugcauuuuccccauaucuuuggugaacaaggccaucuuuggagccagaagcaaaagaguaaaagucucccaaaugagaucucuaucugucugcuuucaggaaauguaugugugugugugugugugugugugugugugugugugugugagagagagagagagagagagagagagagagagagagaacuacaguggauuacaauucuauuuccuauagaauuuacauuaguuuguaguucauuaaagucugcaauuaaaggaauaaaugugagaucuuaaaauacacuuagaggaaguaugguaaauaagcacucaguguuucaaauuacaugcaagcauaugaggaaguuaagcccacucuaaaacugcuuaccccucaacuuuccugccuaauuagagcauuuuaucuuaguggcuacauaucauuauugcaucaugauaacucuuggcuaauacucugugaaaugauaauuaauaguaaucuacaccagcagaaagcagauggaauggugugugcaaagugcuaagcugguguuaucuauggucacuuggggggaauaauggaggggcuuuacugaccacaguggcuucauaccuauccuugagcugaucuaacagcuuucucacauagcagaaagacaguucuccuacguaagugauaucaauagauacuauguucuaucagguuuugcagcaaaccuuuagcaaaugggaugcuauauuuagcucuucuguaacauuucaccugauuugcauucuaccuugagaacagagauaugauggaagcuguggucauuaugguucuaucucacaaauaccagagauaaugagcuuaaaaagagaaaagguuuaucugacuuuacacuucuagaacuuuccauccacuagcaguugcaucagggucucagaugacuagaagucaaugccucaaagcugcuggcuucaugaauaagaagugagagagaagaguugcaaggguucuacaaucaucucccaggguauuccuucaauggccugaaaauacacaccucaauaaaugccaguuucaugccugaguucaugccugugcuuuggcagggaaagaugaaugcagaggcaguaaagaaggugcugaguccugagucucuugaucaagauacauccgagggcaggugauuuccuuggacacuuuaauuaugugauccaauacauuuccauuuauucagccaguuuggguuuucugucacuugcaacugauagauagauguaagaaaaagggcaugagggagaagaaacugcaacugaagcaaaagggaaaaaaaauguccugaauuauauuccaucuuccugguguugcucaucgaagaauuucuuucacauuuaagcuuuucaaaugaauaggagcaccaacuuuggagaaauacuagugcuaaaauuaaauuguaggacagcugaguuggaucuauggagagggacaguccacauugugccaagccauuuuccugcuagugucuuuuagaagagaauaucaacacagaaugaggauuuuucaggaucugccccaaagcacuugucccagaaguuaggccaaauaaucaaauacccauacacgagaugaaaaaaaaaguuucauccucaaacucagaguccuuaauuccuuuaaaauaagaaugaguuuucucagagagaguaguucucaauuugugggccauggccccuuugacaaacuucuauuucuaaaaauauuuacauuaugauccaucacaguagcaaaauuauacuuaugaaguagcaaagaaaacaauuuuauggcuggaggucacuacaacaugaggaaauauauuuaagagucuuagcauuaagaaaguugaacaccauagaugauauugucuccugcuuacugaauucuuaaacucaugaugcuuugcuaagaggcucaauauuagugagacaaagacagaggaagcggcugucaucuauaccauagccaccacugacaaugaagagagagagagagaaagagagagagagagagagagagagagagagagagagagagagagagagaaagagacagagacagagacagagacagagacagagagacagagaauguaaaaccuacuguccccacuuuauuauaucagcaacaaaagauucagucuacaaccaggaagacaggacugaucuuggcuucuggguacccugcugaguugcagccagcccucaccaacugaacuaaagccacuggccagccucuucaaagacuggauucaaugacgcuacccaugaaggaucccucaauaauaaaacacugauuugugaagcacugaaaaucuuguguggcguccuguugcucaugcuucccucaugacuauauuuucuccuuuucuuacaaaacuacuucccuggggaagaaaaacuucugaaaaacugggaaaugcuuuaaccacucaagcccacaccucuugcuugucccuuucagccucaguuugguuuuaggacauguuagaucguacuccugcuuuuccauuacuuuugacccucaccacagaacugaaaacucuaaaacuaugacugccauuaccugacuucuccaucugugucuacuaacagucacugacaaaacagacaaucagcaaugcucagaaauguucucugcauacucauauagauuaauaaucuagauuuuuuuacaauaaauaaguaguuauuugugguuauauuaauguaaugauauuuaauauucugaggaaaaugaaauguuaccaugaacuuuuuaaaaaauuauaguagagauuuuaaccuacagaaauuuaugacacuucaaauguuguucuuuuacuuucugaagucuuaaaacuucuagaagacaugccuucucgcuacaguacacauccagccuccaccauccucugccaacagaguaaaugccacauguugaauguuuuugcuuugagcugaacuuuuuagccaaaugcugaugaggccgagguugcugaaaccacccuguucaccaauauuuccuugaguaaaguaucaugggccuaguuugcuauuuaauuuugccucugaugaaauuguagucaaugagcaaaucaggauucccuuuggaaugcugguuaccucacucuuaagcuuuaaaguaagaguaagagcuggggauggaagggacgcaaggugcuugccuagcaggagaguaagggcauggcggcguuuaucucuaauuauaacucggcgagguggugugagagguugaggaguuuuagugucauccuugcauauacagcaaguuuguaaccugccuuagcuacauacaauccugucucagaauaaaauaaaauuagguagcuaaauauccuagaaucauaccuacuucauacaacaucagggauaauaaugcucauguauuccuaaucaauggacaaaaagauuccccaaguuaccaagugaagcccuaagcauucuugauuuuuaugauccuuauaagaacucuccaagucaggcacuauuaacauccucauuguauggacaagcaaauuguguucauaucuagcaaaggggaaagacaauauuugauucuuuaaauuuuauuuccaaagccugacucccuguguucuucggcaccacagcagcaaguaaaaccaugggagauaggagcuuggugaccuguaaguuauaaggugguuguaaaguaaauacaaagagccacucuguguaucccuugaaagauuaaauuacuaacagccugaucagucaaaauucaugcacauacaugucuaauacagcaauauaguagcuccuacugacuugcaaguuuacacuccuuggguucaguuacuaaugguugaugugauaugaaaauauuaaaugaagaauuccagaaacaguucauuaguuauaaguggcaauuuugauauaguuauaucucuccuacuuuacuacucuuguuaaaucucuuacaaugcauaacauaaaauuucucacagguauauauggguaggacaggcauacuuuuacugggaaugguacuauauguguugccaggcauccagcugggaucugggaacacauuguguaaaacaaggacagauuacuguacuaauaacauacuacuagaggaacaauuacauuuuacaucacaucaucacacgguaaguuacaacagcaacauuucuagcaaggaacucacucuucuuuggaguuaaauucugaaaacucuaaauaucaucuaacaacagagacagacucuucuugcugcucuaaccauauaacaccugugcuaggccacagguaagaauauaugucugcauugguggcugucucacugauguguguagugacugaaaaccaucaguaugucuagcagagacuaaagaaggaauucaugccacaaaacucauugcugucuaacccagaguccaugugucuuuuuuuuuaaagcaaguggcauuaaaccuagauccuaaacugguuaccauggucuggcugcuguuaagacaugguccuuuggaucuaggcaucaagggccaaagaugauaaaguuugggacaugacacauucuuuucuaagcccugaguuccacuugucuacucacuaaauugcuuugacaccacaccuguuuucuguuguguucuggaagccugggcuccacaacggaugacagcguaugccaaacacauguucucaugggucaggcggaggagcugacuguggggagugaugcacuugggaaggaaggaggugggagagcauucuucucacuaauuuccaacuuggcuguaaaaccugcuccucagacaaagcuuggaaacagcucagcuuugaauauuccacuuccugcccuugccuucugacagucacacccaggauaacuagagucaacagcugcuaccagaagugacagagagaauuuagugugagcauggggagggggcaucagggggcucuaucaaaacuucaaaauucaguccuaacuaaaucuuuaauaaagcuugcuugaaucuaauguaagauuaacucucuuuacuagacaugugccagcucucaaauucaaggcuuaauucuagaauuuaaggcuuuuaauucuaacuuaaacagcauuuugaagaggcaacgaucaaaagaaagagagagagagcgagcuaacuuaaucuucaucugcuauggauuccugugacuugguagucagcuuuaccauguuauuugcucaucagagguuaagagugucauuauuuucuauaaugaaaauuuaaccucagacucauauucuguuuccacuggaguaugggauaguuucuuaaucacuuuuuauuuuauuuuauuuuauuuuauuuuauuauuagauaguuucuuuauauacauuucuaaugcuaucccgaaaguucccuauacccuccacccacccuaauucccuaaccacccacucccacuucuuggcccuggcaauccccuguacuggggcauauaaaguuugcaauaccaaggggccucucuucccagugauggccgaccaggccaucaucugcuacauaugcagcuagaggcacgagcucugggagugguuaguucauauuucuuaaucacuuuuuaaagaauacauuuuguaaucucacagaaaaaaaguauauucgauggaaccaaaauucaaugggccaaaguuuuacagacaacuuauguaucugucgagaacacccucauaccuaccaaaaggcucccagggaaucugguaacugcuugcaauaucaaaucauuucuauacaaaccauucaaccugauucacuugccuugauuccuuggaaagcaaccugcuuagcauuaauaagcauuuucggccccauuaagaagauacugaaaacaaaguaaauccacuuucauuccucaccagugguucugcucauugcucuggucauaggagcuggaauauaaacuagcaugcaauggguuucuccauaaguaauuggggaauaacgcauaauaugucaaacauuauacaaagaccucccauaaucucacuuacuacaaaauucccaucuagaaggaguaaugcuauucugguuuuauagacaugaaagcaaagaaaaguaaaagccauuuaauccuaaccacacagauaagaagagugaaggugucugauuuugaaacugcaauauuaugagucaagaagacuuuugcaacaucuaaucucucuugguagaauacgguuccuuguaucgugggaagaaaugcuaucuuuuccuaaguacugaauugaaagguucuaaaucauguaaacugagucuaauaauucaugguuaccuagaccugaaugaucuggaaaacacugaaauuaaugcuauauauaggugaauucuccuguagaaaauuuucauaacuuuaaauauuuuaaguacguugaaagccuuucaauccacagagauaaaugaguuagccaauuguaauugaauuuaugauuauaauugucaucacccaagaguucaaggggcuccacauggccuauguaugccaguuagaaggggaacaccuagauaaaugguuggaaaguguaaaaccugagaauagccaugcaauggaggcaccucaguuauugaaagcaacacuauuauagaucaagcaccacugagcaagaauauuaguucagaaugcauuacauuaauggaauauguacucaguuagaauccaccucaucuccuaacaguguuuuccugaugaugaugacaccacagaauuuuaguaguaauaaccagacuugacugucuucagaaaacagaaagaguccucuauguaaggucuaaacuaugacaaagaugcaaaugcaaccuuuuuaguaacuuuaucuucuauaaaaauaaucagcucugaaguccagcaguuguuuauggucagccauguaucugaacauccacaugugaucgaaugcagugaguuuaaacugcaguagacucugcauagaaagcacuagaugugggaccaguuuagugaaagagcaaaagccaucccauguacauaguaagucacugacaaaucuuguguccagggcuuggggggagauacaucuuuuuccagagucuacaaagccucuagcaaugaacaguaggauaaugucaauauagcauguccaaaauguuuagaagaggaagaaagaaugaauaugucagagacaaggaauaggaagaaaggaagagggauagagggaaaaaggaaagaaagaaaaggaagaggaaagggaagggagagaguaauaaggaaaagagagagaugggaguaagagcagggacccugacaucaccuggacuuauggaugcuauugcuggaacuugaaaagaagacagaaauagaaaugagggaacugacuauuguuccacauuguuguauaauaauugcacacauuugaaaauaagaccugaauuguaucaauguaauuggaaauuugucuuuguagagauauuggggaguuaccguagaagaacaggggauuuuguuugggggggaauaacuuuucuaacuaagauuauuuuaucauggaauaagacagguggucagaaaaauuggugauaaaauuggacauagguugguacacuggaugcauuaaagcuaagacuacgaagcauauagaagacgaguuaauacaagagcuaaaauacaaagaaacaaauuucaucacugcccaaccuuguaaagcucugcuuguguugcuuaugcuguuuacagggagaaagcaaugcuacagaucacacacaucucacaucuauuaaugcaaugaccaugggaaaugacuuggagucuccuuucaccuaaugagcauacugaguaaaaucaauuagguugcaauuaaaauucccauucaucuacugaauucgucugccauucccucucuuuacaaggcucuggagacuugacagaacaugguucuucugugauggcuacuuuaaaaccauuucuguuguucauaauguauucaacuuuaaaaucuuccauaugguucauuaggagaucuccuucaucuuuguguaaauugcuuugcugucuuccugaagugugaugauugaagagcagauccauuccugaaacccuagccacugguguggcugugucugucaucagagggcaguuggggccagaacugcuggugaacuuccauaauugcuaacugggaagacagagcaauagguagcuuuacucuaggcugccauacguaaggagcugggccuccaguuauaucuucagaaaauauucauaagccucuaggaacaugcuacuauaaguuccaccaaacagauauugccucauaauccaguaaagagaagaagcaugacuaaggcagagacaauaguucuguaccagcucugccaaaaagaaggacuucauuaagcuugagccaagaugggaggcccuccuguucuuuagagacucauuuacuagauggugaaaaacgagugcuguggguaauuucauuuucaauugauuuauuucugaauggggguaaauugacacuuggugcagaaaguaaaguccaagucuagggaagcgccagcuagucucaggauaauccaauuaucugaacacagacaauaagaacacagaaggaaaugggucaaaggucaaguuaugccuuauucuucacaaugaauaucuucuugcccccccaccccccgcccaaagacucuccaaaaaccauaagcugauccauuauuuucuguucuuuucugacaccugaaacuaaucaaaguucacuuuuuagaaauucaauaguuauucucauuuagaucacccagcaaauuaaaucauaaauuucucucuccuagcucucuuucucucauuccuaaaauacaacuuuccucccccugcuacuuuauuuaacucuccaaggccagccuccagagaaaauuauggauuugauaauuugcuaaugugaccacaguaauuguuuugaguaauauuuaugguuuuauuguaucuugcaacaauccauaauaauccacugaugugccugacucugggguuuucucagcaucgacaaauggcauaggaaauucauuuuuaaugcacucauuuagggcugccucccagagagggagaggccugcauauauuaauaaaggccaagaaauaaauggcauagcuguccauacuucacccugaagaguuagcuggaggagaagauuuaaugcccaaaacagagaggagaauagacuaacagaguccauuuugugcaggcgaaccaucauuaaaguuaauggaauuaccguguggucaugcaccagagggaacccauugcaaguuaaguucuucuagggccauugauuugcagacuucugcucaaagaucccccuuggcaucugaugagcacuauagagaugcacaagcacuuuagaaauuguuuacgcaaacugccaguuaagcauguuaagaacuaacaauaauugauuauuuuagagcagauggucuaguugagcaugucuucucuugauacggguaagagucaacucugccuagcuuuaacagcagagaacuuggugagaucaccuaacugaaaaugcuuauguuuaggaaaggccucaggacuggcuaaggaugagauaaugucaccaagacuggagcuuuagucuauuuccgccauuccacucacuguaggaugacugccagcugcucucugaaucagcucuuuucuugacagucaugaugagaauauccacuccuauaccuaaugccuagaagucucugugaugaccagaagauggucucucaaaccugguaagccuauaaauuaugcguacaaauuuagacagcuaauccuuuuauaaauaacauuuuauucuaacacauccagguccguugugaaaauguauuuucauauauucugugauggcuuuuguguuacaaaagcaaaacuguauuuuuguaacagacugcaucuggcacucagagucuaaaaaguuuacuaucuggccuuuaacaaaagaacuuugcuaacuuuuggauuauauaaagugaaagugcaccuggcacuaaaacaaaagaaaaaaaaauucaaccaauuuuuaacuccuuguaugcuaaccauagaauaugcauagggaaaaaugcuagugaaaaccaucaaguccauaauaaacacaggauaauaauuauucaaauucuagaauacuacacuuagauauuuaaaugugaaucuagauaagaugaucuauaguaggugccuugcaaauaucuuuuguccucauaguaucugaaccaucaaauaauacacuuugaagagaauuaaaauuccuuacuuccaacaaugcacaaggcuucuugauaccuuguguucaucuucuaaaaugugauaacuucgcucugacugcuauuuucuuaguccagaauguucuucaacacucagguuuggguucugucauuauccaaucuauaauuuucuacuauagguccuuucuuuaagaggcccuuccugucucugcaaaucaagcauccucaaggcuccuacuuuuuucccuauguguuauuccauuucauaacaccuuguuacaucugcagugauuucuuuguucacuuggucguuggaggaacagaugugaaacuaagaguauuucuuggcugaccuuccuugcacucuagcccagagacuagcaaugacuguuauaaaguagggucuccauagauacuuacugggaaaggaacucaguaugaacuacaguccuucuacagcuucucagcauuccacgacugggccauuuacuuccaaggcugggcuuaaagggugaaugccaaggagguggacaggagaggcaaaauguuucuuucccuucgaggcaggaaugggguaacucggaugcugaggcaauugucagcaucaauuccaaaugagagcugugcagaacuggaaacaguccccucacuguacccuggauuacaaaauguuucucccucucuuucucugucucuguguaucuauauguguguauguguguguguacacacacacacagaugugcacacacauuuguuggaagagggagauuguacuauaaaagaaaauaucugauuuccaaggucacuaggccucccagaauucucuaaaggccugugcuuugagugucuucuuuaagaauaagauucgucuauggccaguugaugguggaucugaguuuagaaucacaucuaugcuuuucaugacugaacaguaacaucaaaauuguaaugcuagaaaaugauugcauuuuggaauuuauaccauuuacaaccaacagaugauuugaaacacaaauaaaagccccucuugggccauuuuuucagagcaguaggauagauagcauuagaagccauuucuuuuccauggaacagauauauaaacccagagugagagaucugaaugugaacauuaggauaaauggauuuuauuaugaaguaaaagaguauuugguuguuuacucaauguuguuuauuuuccuuagccauuuaaggcaaggucaacuucuuaaagaaccccauguuugccuuuucuauaacauuaggagggagaaaauccuauugcaagaaaauacaucagaccaaagaaauggcaacuucuguauugggaaccaaguacauuauuucuauauugauggaacacaagauuucaaaucacuguuugucuuuucccucuaaaguugaaauauuauauuggcauaggguuaaauuucaaaaacacccuuucccagaacugacaugauucacaaggaggugggguguggauauuucacuguauuuggugugaggcucaucagagucucaaaaaccucauaugcuuuuagucauuagggaggacaucccuugguuucuacauaucuguggcucaacagcuugacagggcuauaauucauuauccauauucccucuugcaccaggcucaguccucaaauccuuaccuuuaccagcagcuuuuugagucuuggggauuacuuuauuaaugguucugguauaaaagauaaagagggaccucuggaaggaacugaauaauccaagaugaauacaggguuaagagucaagucaggucauuuagggccagauucaaaaguguauuuauaaaaauaaaugagagcgcagauuauaaaucuggacaacaucuaacuguggcacugaagaacucugccaugauuccugucaucagagauuuggauucaggguaugaagagcauuugcaugcuauagauaauaacucaaaugcaauaaauuauaauacacauagcuuggugaaauaggcuuccgaugggccccaugugaaacaaaaauuacuaagauaacuauacauuuuucuuuuauauuaauaaaccauaaaauauggauauuuaaaaacuggaguauuaugaucagcaacuggagauacauuacugauuuggaaaugaacugcuacagauuuaggucaccugaagagcccucaccucccucugugagucccgucuacugucuccacccagaggcaauuucuaagcaauauauaguuuuaaaacuuagagagguagcucuaggcaaucuugucuucuauuuuauuauuuuuagcuauuaguaacucuugagauaaaaucucauaacaucuggacuuauuucagcugagugcccaguuucuaccauagcacacauuauuuucugggcucucauugagcacugaacaaucauagaagauucaugguaacaaagagcuugucuacugagacuaaccuggccucuugcauuuaaauaaaacuauugagcauuuuucacuugacuaacugggcacaguuaacuuauuuuagcuggucccagaguucugcgagcccauuguuagauauggcaagcuuaaaaauauaauguuggaaggagcugauuacacaggguuagauaauuuaaaacaaaauugucuaggcuugaaauauaagauggugagaaucaaugcuuuaauggcuauuguuauuuuguacauguguauguguaugucugaguguuccugugugucaugugaguguuuacauuugcaugaggcuacagaaaagucucagagucuugugggugguauugucaaauacaauucacuuuuauuucuugucacagggucucuuacuagccuagaauccucacauaggcuaagcuugcugacccaugagucucagagagacugccugucccugcaucucaaacacauggacgugccaccaggcuuagauuuaauaauagaauuuggugggcuaaaacucaggcccuuaugcuuuugaggcaaacacuuugccagcuucaaaaccccuucaaugauuguuuuuggagcaccaaacaucuaucccacaaccaaaaugguagcagugaguaacugaguuuuacuguaccaacagagguaaaggugacucugaguaauaagguuuuacaguuguuugggaucuuagagucuauauaacaucucucuugcuugagacauuguuuuuccuagugauuauacaggaauccccaaucuaaacuucaggggaaagucuacugaauacuaaaaaacugacagucagagcacaucuguccaguuugcuacaucugcauuacagaucucacaacaaaauuagaacacucaaugccgacuccgcuguaagucagggccuguaauuacugguggaauuuguugggagcacuaaugaaaaauuaaacaccuaaaacauauaauucuacuuuaaguggacauacagcaaugaagugauguuuugcuuuguuaaucuucaccuguauaaucuagucaaagaugacaguccuugggguauuuuuggguggaagccaacauuauucuaagccaagcaaaaggauauagcaucaauuuguguugcagugaaaauaauauuuauacaaccucucccucuucucgaauauugaugguuguacugauaggaugacuaaaauuuuugaaggaacacacuacccacaugauacaaggaggauguaugucuuuccucuggcauggguuugauuuccuaaucuuguuaccuguuagguaugcauuuagguaagugaauuuucucuguaaaccucagcuguuccuguguaaaauauuaaugccuaccuuugagagcuacagagaaauucaaguagaaauuauaaaagcuuauagcaucuuuuugagacuucacuaugugcaaggcacaguuuuaagagcuuagauacauaaucauucauuugguucuuacagaaucccuagaaggcauugaaaggccagugaaaccccgauuugaugaauguguaaauggauacugggcuuuggaaaacguagcuuauagaggguagaugcacuuggcaggugaagcaucuguguuugaaacugggcagucugguccuggagucaucuccucuaauuguaucucaauagccuugcauuucuuuccagccagcgaaaaccccugcuucuauccuuuccugguuagucaccaaauguaagacauaaaaaugacuaugccggggccuagcaaacacagaaguggaugcucacagucagcuauuggauggaucgcagggcucccaaugggggagcuagagaaaguacccaaggagcuaaagggaucugcaacccuauagguggaacaacauuaugaacuaaccaguaccccggagcucuugacucugcugcauauguaucaaaagauggccuagucggccaucacuggaaagagaggcccauuggacaugcaaacuguauaugccccaguacaggggaacgccagggccaaaaaaaugggaauggguggguagggaauugggggggaggguaugggggacuuuugggauagcauuggaaauguaauugaggaaaauauguaauaaaaaauauuuuuaaaaaacgacaaucuaaaaacguuacagcaugaaaauaucucagaucuuggauuuccuuuguuaugacccaacagacauuaugcaaauacaaguuagucaaaguggaaauggagaagguuugaaucuuuccccuucucuaggggaaugaaguauaccuagaaagagggacauucauucuagaucacuacucugggugagaagaucaaauggaaacaucuggguaaggucugggugauagaagaagcugcuaaagcucagaagagaaacagcaggaaaagaaaggaacuucucaucagcacaacaaacaauguuccagaagagggagagguuguauaaauauuauguucucugcaacacagaauugguucuauauccuugugcuugccuuagaauaaugaggacucucauugcuaacuagguucuucuacagccuuccuugauuuccacuuccuccucugcguucaagcuccaccucucuucugcagaccagguaauugcuacuuacuacuugaggcuuucucugcagaaacacaucuucgccccugugccuguccuuucuauccuucuugccuuuucuuugccagccuuuuccuacucugccuuagaauuccugauugucaaucucaaucacacccaaagauuguuuucauugcuaucuccuucguaacugccaaggggcacagauccucaaaacgcucuuccuucacugcccuuuuuggggguaaauggaaggacagacauuguaagaggaagguaacagacacauugauaaauaaaaaccacugugcugaacacuaaacaaaaagaaaaguaaaauuuuacucuuuugauaccuacuuaggaagaaacuugaagguuuaagaggaacaaaaguguuuccuaaggaggacauuggugucuucuuuggccaggagagcuaguguucaaggguuuggggggaaagcaucagaucaacaggccagagggccuggaguucugccacuuuucaaaguagccagucccaguaaguacacucaaaaugucuacugaauaucacaacuguguuugguuuauugagcucagucaaauuagauuuacucugggaacagaugcaaauuauaaggcaauucuacaagauaaaagcuaccgcauccugaagacacuaauucuuccggcaguaaauacaugcauuagguauaaacagagacaaggcaacauucacgguggcuuucaucagaggauaaaagacuuguggcagauugaagcucucuggaaauuucauuucaaaugaaaauaauaaauaacagacccaaaucuuuuucauuaucaagcuauggguuuccccacccugagcacacaacaucauccuuuacaauacgucugggaugaagaugcugaguccauggacaaccuuccaugucuguuucucauuauccuuucauagauuugccucaggauguaagaugccucagaaucaucaugguaucugucaaaacaaacuucugcauccucccccacugaugaaaucagcacaggggacaagguuuucuaguggaaacccacuuuagacaaguuuucugggcacuauugaucuauucacaggaaauaaucagacacaccaauauucagaacagacaaugaauaaaucaagauaaauaaucauuuuccaauuaagaauguacauuuuugaauuuucaaauuguuucauauaugauauguguguguuuguguguguauggaacuguguaaguguggauguguguucaguguauguauguccacaaguaugaagaggcgggggcaagggagugaaaaagguaaagccuuacuuuuuaauucaagugagucuugaacuugcuucucagcuucugcuucccaaaugauggaguuauagugugucaccauacccagaucgagugucauuuaucauaacaaauuuaaaccauuucuuucaaaaaccccaaguuauaugaucagaccaaaagcucuucaaaaauuuaagcuacugggcaguaacuaguugugagaaaauguagugcauauuaacaaagucagcguggagccacaauucccaugucaggcucacacugcuaagguccaucuauauccaagguuaaauaaagguuaaaaaauacuagugaaauuguuauuaauuuaaaaauccaguuuuaguggugcauaccuuuaaucucaucacucagcagaaagaugagacagaucucuuugaguucaaagcuagccugaucuauauaacgaguuccagaauagcuaggacuauauagauagauacucucucaaacaaacaaacaaacaaacaaacagauauuaaaauuuuuaaaaagaagaaagcaaaacauauuacagaaaauaauuguugagauuugguauuuugcuaguuauuguaaugguaaacacugauacccaagaccugguuguccccagggaugagagaauuggcaaguaaacccaagucacacucuauaaccuuguucccaucccaaguuaucuugauuggugcauaaauaugacuccagucucuagcuuggaaaaagagauauaggugggguuuuggguuccugggcuugauguuggaggcaggaggccacagggaaagagaaagagaagacagagagagggcaagaagacacggggcaggaaucaugaaaauauggcacaagggcuggccaguuggaguuaagagcugcccagauggaacauggcaaauugcaacuugggcuuauugauggaaaaauauauucuaacagcuuagggggcagauaucugcccaacuccaguacuauaaauacuuauuacaagaauaaagguuacguguuuuuuuaucugggaacuaaaugaucuugauuugagauuaaauaauuaauacaacaaauacuacugguauacacugguguacuggugcugggaaauggaucagugggugaagauccuuguuacauaguauaaggaccuauguuugaauccucagaagccacguaagcaaugugcagcagguacaucaguuaucucacuaugcuacagagagaugagagauggagacagcaaagucucaagaagcucauaggccagguagguuuaaguuuucauauggaguuggaguuggagagggaaaaggaaagggagagggaaaaggaaagggagagggagagggacagagacagggacagggagagugagagagagacagggagaggcagacagacagacacgcacacagagagagacagggagagagaggcagagacacagagagacaagacagagacagacagagagagggagagagagacagauagagaggcagagagagagagaggcagagagacaagacagagacagacagagagagggagagagagaccaauagagaggcagagagagagagaggcagagagacagagagaccaagacagagacagagagagacagagagaccaagacagagacagagaaaaagagacugagagagauagacagagagacaaagacagagacagaaagaggggaaaagagagaaaaggagggagagggaggggagaaagagagagagagagagagaaccugucucuaguuagaaggugagaacucuuaccaaagacuauacucugaucccuacauaugcccugugcccaucugguuugaguauaccaggauucacaaacacaaaugucaacaugccacauacacaaauaggcauagacaaauacaaaaaagaaaaacaggaccgugagauagcuuaaucaguaaacggcuugcuagccaagcauuacgaccuggcuucuaugacuauaaugugcauguaaaaaaccuagauauaguauguguacuuguaaucccagcauugaaauagcaagacaaaaugaucacuggggcuugcuggccauguagccaauuguacuuuuugagauccaggucaaugagagacccugauucaauaaaauccaaguuagaaagacacugaaaaaugaugcccaaaguuaucuguagcauccauuaacaaacacauacauacucacauauagauacacacacucaugcacacaccauacauacauacacuuacacucacauagcauucacuuauacauauacacaggcauacacaugcacacacacauaucuacaaauacaugcacacacacacagagcuacaaguacacacaaauaccagcauguggugagaaaucugggauuuaaaggggguuaucuggguucaaaucgcauauaugugaauaaauccuacccaguaucuaauauauuccuuaugcguucaugucagccucuucuuaucaccaaacaauucaauaguuuccguuuagaaaaugagaaaaucagggcucacaguuuugagccuguuccagagaggcaaaguuaucgagcucaccuuuacauggcacuucugacaugccacauuacaucaagucucucauuuuauugacagcuaaguguccucuuugugcacuaaacuguaagaugaccagaucuccaugucauguguaggacaugguccaggaaacaaaaagaggcuacaggagauuaaagacaguuuuugauaauauuucuuuaaagaacacacaccucuuuuucugcuggagcaaugucagaaguaauuccuaauauuucaaguuauuaagaaaucuuuucuaccuuaauaguauaaaauuaaaccuucaagugcagcacccacauacuauaaacaggacgaggacgaggaccugcaaguaucugagauucugauuacccaucuggaauaaaucgcuuuccuuaaugcaccuacaauauccucuacccaaagacggucaugcaacagcaucaagaagaugcuucccacuaagcuaauuagaaaggaacccuuuugaaggaaugaauaagcauuagggcuucugguuggcuagaauuacacucaggauuuggauuuaagaacauaauuuauggaaaauucacacaauaccauguauugugaugaccacaauacauggggaauauuucauagacauuucaggaaaccuggauguuugacugcacaaaggaaaacacauauacaacaacaccaacuuccugaugacuaaagauagaaacaugggaguagauaauugucuccacacagaaggucacagugucuccguuaaaauggcaccgcagcugaaguauggagagaaguaugcuuucaguccuauuacucgaucaccacagugguggcucagauugugaagggaaaacuguugcacauucaguugagguaaauuuucuaggcugaggggagcuccagauacaaacagcaaaagaaacaggacagaguaucuuuacagacaggaggaagugacaggaagagaaaguagcacuuggaucuaacagugauaagcccagaugacucaucaaggccugcauguucagccuucacaguaugccugcaaaaggcagucacuuucugaccuuauaccuccuuuggcgcaaguagaucagaucauucuuugauuaaugauuaggagaacaguggaauaggucuaaaaaaagaccuucuuccucccaguuuccccaguuucauucaugguaaaccauuccagaggccaagggcaaugcagucuaaguaucauccaaaaucacaaaguguauauauacucccuggagacaaaagaaacaacagggaacaaaggaacauacguaaacaagccaaugugucagagauaaugaaaaauuccuugagaggaauccagcuagacaacagggcagcuugggugggugucagggaagggcugaguagcagagaagagaaagagguuaguuuucaaaccuguaggauagccacaucacugcaauaaucacuccaugcccagaaguguucuauuuuuaaacucgagaagaaaaccaaauaaucaauuaugaaauaagagaucacuuuuuacgucaauauuuuccuuuccuuguuccaagggucuuacugaguaagccaggccagccugugcauugcuaggcagaauuuaaagucucgggaaaauauuucccugaagcaccauccuguucaagaggcuaacucaguggugugcccucauuaacaauagcaauacuugcuucagggaaaaaggccauuaguaggcuuauugcuauuacuaccuggcaugagacaaaaguggauuagaacccaggaaucagacauaagacagcacugagaaucucacgcucaggcuaaggaaaaaaagaaaaaaggaaaggccccauacuuuccaugguaggcugaccaaccucccuucaaaauguguagcugugugaauuuuaaaacaugaaauacuuccagccuugacaagaacuauccaacuaggacagcuggauucugaagguguugcuauacucucuggagaagcugcuagugcggcagggcuggauuccauacauccugcuuacaagaacaccaucuaugagcuacucugucacccgaaaguaccaaggcugagaaauagaauugucuggaaaaaaaaagagaccagguauauuucuuaauaauaaugagggcucccuauucugcccauggcauugugaauuauuagauucuauuaaaauaacagcugagaggauuugucuuugugguagugacuauuguuuagcugacucccagguaaaauuucaugcaaggugguauaaagaucaaaauuugauaacuuguagauaggaggacuuaggguaacaguaacaaaaguucacugucaagugcagguaagaugugugugugugugugugugugugugugugugugaugaauuuuucuuuauguauuauguuccaaaagggaugugaguuaaccccacaacacauuuauacugaggaacugcugugaccagucuggaaacaacaacaaauuuucaaaauguaauauucuuauuucuuuuaaagggauacaauuauuuacagaaauuagcuuaagcuaaacaguguggguuauaguaagaacauccaguaauucacacauuggugcuuuauauuauaagucaaucccuuaucaccacgauuaaagcuaacagaaacuugacaauuuguucagguaaguaugaugauacugcuauuggaaucugaaacucuauagccauggucuucaguccugcuggacucucaaugcuuauuagguaauuuuuuuuuuuuuuuuugugauuuuuuuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucaguaaaaucuugcuaguguaugcaauggugucagcauuuggaagcugauuaugggguggaucccuggauauggcagucucuacaugguccauccuuucaucucagcuccauacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucucacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguaugcaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucuguuggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaagaauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugauuguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuuuuucuugaaggcacucauagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccaugugaauguuggcuuucuguuauuuauuuuguuauugaagaucagccuuagugcauggugaucugauaggauacaugggacaauuucaauauuuuugaaucuguugaggccugauuugugaccuauuauguggucaauuuuggagaagguaccaugaggugcugagaagaagguauauccuuuuguuuuaggauaaaauguucuguagauaucugucagauccauuuguuucaucacuucuguuaguuucagugugucccuguuuaguuucuguuuccaugaucuguccauuggugaaagugguguguugaagucucccacuauuauugugugaggcgcaaugugugcuuugagcuuuacuaaaguuucuuuagugaauguggcugcucuuguauuuggagcauagauauucagaauugagaguuccucuuggaggauuuuaccuuugaugagaaugaagugucccuccuugucuuuuuugaugacuuuggguuggaagucaaucuuaucagauauuaggauggcuacuccugcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggcgaguugagaccauugauguuaagagauauuaaggaaaaguaauuguugcuuccuguuauuuuaguuguuaaagguggcauucuguucuuguggcugucuucuuuuagguuuguugagggauuaccuucuuguuuuuucuagggcguuguucccguucuuguauugguuuuuuucuguuauuauccuuugaagggcuggauucguggagagauaaugcgugaauuugguuuugucguggaauacuuugguuucucccucuaugauaauugagaguuuggcuggguauaguagccugggcugcaguuuguguucucuuagugucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuagugcauuugauguucugacuauuaugugucgggaggaauuucuuuucugguccagucuauuuggaguucuguaggcuucuuguauguucauaugcaucucauucuuuagauuugggaaguuuucuucaauaauuuuguugaagauguuugcuggaccuuugaguugaaaaucuucauucucauccacuccuauuauccguacguuuggucuucuuauuguguccuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguuccagauuucuuuccuaggguuucuaucucuaguguugccucgcuuugaguuuucuuuauugugucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuucuuuaagugauuuauuaaaguccuucuugauguccucuaccaucaucaugagauaugcuuuuaaaucuaggucuagguucucagguguguugggguucccuggacugggcgaagugggugugcuggguucuggugauggugaguggucuugguuccuguuaguaagauuccuccguuuaccuuucgccaucugguaaucucuggaguuaguaguuauaguugacucuguuuagagauuguucuucuggugauucuguuaccgucuaucagcagaccugggagacagauucucuccucugaguuucagugcucagagcacucucugcuggcaagcucucuuacagggaaggugagcagauaucuuguauuuggaccuccuccuggccgaagaagaaggcccaaaacaggaccuuucucagacaguguguugcuuuggcaguucccaggugguacagacucucaccuaaacagacuaaauuccuaaguuccuuggagucccgggaccaagauggcgaccgcugcugcuguggcuuaggccgccuccccagccgggugggcaccuguccuccgguccggacgguggcuggcuguccccggcccacaaagggugcugccucagcgccucugugcuucugccuguuccagaagcugucagguucucuggcgcacccucucaccuguucagacuaauuuccuaaguucggcgggucccggaccaagauggcgaccgcugcugcuguggcuuaggccgccuccccagcugggugggcaccuguccuccgguccggacgguggcuggcuguccccugcccacaaagggugcugccucagcgccucugugcuuccgccuguuccagaagcugucagguucucuggcgcacccucucaccuguucagacuaauuuccuaaguucggcgggucucggaccaagauggcgacccgcuuauuagguaauuuaaaaaaauaauaaaauuacaaucuccaucucccaaauaacauaacaucuaucaaccacaagagacagccauuagcagucacugucucguucauccuucuggacuuaacaacuuugaaguuacuuuuuucuauucaagcccauuuuuauagaaaauaauguaaaugccccuuuagaauuuugaaauaaaaucuuuagagcacauaaucugccuguucacacaaauuucagcuauguuuaauaugugugcuaccaauuuguguguuguacuauacaguugugcagccugugccacugccugccuccagugcagucaguggcuucagaaacugcaccaaagagauauuuuaugcauguuaacuaacucagugcauuuuaaauuuacauuugaauucugaguuuuagaacucugguagccaagcuugaauaccuugacauuucaagaaucaguuucaaagccaaaacacugauuuugcauccucuuuuaacaucugccuaacauggggggaggggacagaggaauggaugaaaguugaaugucccuauccuuugucaaguuuuccaugucauguguuuggagaaauuggggucacucuuuugguuauuuggaauuuccuagcuuucccuuugagacauucagucccaaugaaaauucccagaucuccuauuugcaaaguuucacuauaguuauacacuggagccaauacaaacuaagaucagaaagucaccauauuuaguugguaugacuuggcgucaaguuaccuugucaaucaaggccagccaggaaauccaaaagcucuauuuccccauguaugacaucugcagcauauuguaacuugcuucuuauuguuaccaccauaaaacccguccuucucuaucacuuaagcauugaaccuaaccacaggaauucacauuucugugaaagaagcuggauucuugcuucauaacccgccaggauuuuaguuuuacuaugaucagaggcuaucauaauaaauccuccuucccucucgagcacacuuuaaaaccauuuugaacuccauugaucccauuaaguuugaucuuugguauuuaguagcuagagagaagagaacggugugugccuaaggagaagaccgguggaaagggaggcacuugacacacaccaggaugccccuuuacucagaaggaacaaauaaaauuacauugugcuaagagcuaaagauauaccaggugccuuagucuauacaggacccauauagcccacaggaaguuguucuacccugcccuguuauguuuuaggacuccucuguuuaguuucuguuuuagcaauugcacaguaauaauuuuacuacaaaggguaaaugucuuguaaacuaaugggaaacauacuguuuggcacaguuuauaaugucaggauuuauggcucuaacaccgagggucucucugaccucgaagauaacauaaugaaagagcaaugugcugcaaauggcucggugugguuuuuuauuaguucccauaaucacuuguauuaauuugugugcacauaauaagcacucaccuucacagucugcccagcuucaggaccauccuagaaaaagaggaagaaaaaagaaauggaguuggggugagaacugaaugauggcauugccugcuuauucagaaauauugcccauuaauaauuuagauccaauuucauuguguguuaauuuguaguagucucauggggaccauucauuucaaaugugugggaccagacagguccccauuucuuucugagugaggaguuauguaaaaaaugauaugaauuauccagcaggccacuccuuucuauuuuccaugcucuuugguuucaucuaugguuuuaaucacauuaaaaauaagacugaagauguuuggggaggcaaagugucaugguuuauuuaucuuuaaaucagaagucauuuaauuaguaucugauucaguuucuccucaagaaauccuuuuagcaagaagaugaaguucagaugaaacagucuuuucaaguucuccugacccugagccagaaaaguaaagugacuguuguggguagacccccuugcauguaccccuuccuccuccuagcuucucacagccaauaggauuauugucaauugucugugucacugcugaaaauaagcacacaggcgcagucuccaaguggaguaaaacugaaagcagguguucuaaagagaaggcagcaaacuucuuugcaacacaguuucaaaauagaauuacugcucagugguuuuggcuaaauauacuucucugugagcaugacaggaggaaaggauacaugcccuuuuaggacauagguuaagcauaugucugacauguacaucaaaccuuuucaaauuugaaccauaaaucauuaguggcuucuaaaagcaaucucauaguucccaacuaauacuuaagaagauaacuugacaggaccaaagcuauuagauaguggaggauuaagauaagauuagauaagauuacuguguaaaaccccaguucuuuguccuugaaggugcauguguacgacgagggggaaaggguacacaggaucaugagauacauacauauguuaaugugaaguaguuuucaaaccauuucacaagacuaaugaacaauacagucaggauggauaaaggugaccccaaauaaaccaaacagcaagauaucugcuuaugccuucuucaggcagacaugcaagaaagaacauaagaagcaaaacccagagguucuagucaauuuuguggaguuuuucaagaagugcucugagagguggaaagccaugucuagcaaagagaaaucaaaguuugaugaaauggcaaaggcagauaaaguccgcuacgguuaggagaugaaagauuauggaccagcaaauggaggcaagaagaaggaggacccaaauggccccaaaaggccuucaucugcauuuuucucauucugcuaggaauucugccccaagaucaaauccauaaaaacuggcaucaccauuggagauguggcacaaaagcugggugaaauguggaauaacuuaagugacagugaaaaagcagccuuacaucaccaagacagcaaagcugaaggaaaagaaugagaaggauguugcugacuauaagucuaaaggaaaguuugauggcaccaggaguccugcuaaaguugccuggaaaaauguggaagaagaggagccacaugaacagaaucccaacucuaacaacaaaaauaacaggaagcaacaauuauuuuuccuuaauaucucuuaauaucaauggacccaaugaaaaggcauagacaaauacacuggcuauguaaacaggacccagcauuuugcugcauacaggaaacucaccucagugacaaagacagacacuaccucagaguaaaaggcuugaaaacaauuuuccaagcaaaugguuccaagaaacaagcuggaguagccauucuaauaucgaauaaaauugaauuucaaccuacaguuaucuagaaggacaaggagagacaauucauacucaacaaagguaaaaucuaccaagaugaacucucaauucugaacaucuaugcuccaaaugcaagagcauccacauucauuaaggaaaguuuaguaaagcucaaagcacacauuucaccacacacaauaauagugggagacuucaauaccccacucucaucaauggagaaaucauggaaauagaaacuaaacagagacacagugaaacuaacagaaguuaugaaacaaagugauuuaacaaauaucuacagaacauuuuauccuaaaacaaaaggauauaccuucuucucagcaucuaaugguaccuucucuaaaauugaccauauaaucagccacaaaacaggacucaacagauacaaaaauauugaaauaaucccaugcauccuaucagaucaccacagaucuuccauaauaacauaaauaauagaaagcccacauacacauggaagcugaacaacacucaacgauaacuuggucaagggagaaaugaagaaagaaauuaaagacuuuuuaguguuuaaugaaaaugaagccacaacauaccaaaacuuaugggacacaauggaagcaguccugaaaggaaaacccauagcucaaagugcugccaaaaagaaacuagagaguacauacacuagcagcuugauagcacaccuaaaaguucuagaacaaaaggaagcaaauucacccaggaggaguagacagcaggaaauaaucaaacucagggcugaaaacaaucaaguggaaaugaaaugaacuauagaaagaaucaaucaaaccaggagcuuguucuuugagaaaaucaacaaaauagauacagacuaacuagaaggcacagggacaauauccuaauuaacaaaagaagaaauaaaaagggagacauaauaacaaaaucugaggaaauacaaaaaaucaucagauccuacuacaaaagccuuuacucaacaaaacuggaaaaccuggaugaaauggaaauuuuucuagacagauaccagguaccaaaguuaaaugaggaucagguugaugaucuaaacaguccuauauccccuaaagaaauagaagcagucaccaauagucucccaaccaaaaaaggcccaggaccagauggguuuaaugcaaaguucaaucagaccuucaaagaagaccuaauuccaauacuccucaaacuauuccacaaaauagaaacagaagguacucuacccaauuaauucuaugaagccacaauuacacugauuccuaaaccgcacaaagacccaacaaagaaagagcaauuucagaccaauuucccuuaugaauauugaugcaaaaauauucaauaaaauucuugcaaaccgaauccaagaacacaucaaaaugaucauccaucaugaucaaguaggcuucgucccagggaugcaggaaugguucaauaaacagaaacacgucaacguaauucccuauauaaacaaacucaaagggggaaaaaaaaacaaacacaugaucaucaaauaaugagaaagcuuuugacaaaauucaacacacccauccauaauaaaagacuuggaaagaucaggaauucaaggcucauaccuugacauaauaaaagcaaucuacagcaaaccaguagccaacaucaaacuaaauggacagaaacuugaagcaaucccacuaaaaucaaguacuacacaaggucaccuacccucucccuaccuauucaauauaguacuuggaaucugagccagagcaauuagauaacaaaagaagaucaaaugaaaaguggauacaaauuggaaaggaagaagucaaaauaucacuauuugcagaugauaugauaguauacaugaguaaccccaaaaauuccaccagagaacucauaaaccugauaaacaacuucagugaaguagcuggauauaaaauuuacucaaacaaaucaguggccuuucucuacacaaaggauaaaagggcugagaaaaaaguuagggaaaaaacacccuucacaauagucacaaauaauauaaaauaccuuggugugacucuaacucagcaagugaaagaccuauaugauaagaacuucaagucucagaagaaagaaaucaaagaaggucucagaagaugguaagaucucccauccucauggauuggcaggauuaauacaguaaaaauggcuaucuugccaaaagcaaucuacagauucaauguaauucccaucaaaauuccaauugcauucuucacagaguuagaaagggcaauuugcaaauucaucuggaauaacaaaauaccuaagauagcaaaaacuauucucaacaaugaaagaaucucucuuggaaucaccauccuugaccucaagcuguacuagagagaaauugugauaaaaucugcaugguacugguacagugacagauagguagaucaaugaaauagaauugaagacccagaaaugaacccacacaccuauguucacuugaucuuugacaaagcaguuaaaaccauccaguggaaaaaagacagcauuuucaacaaauggugcuggcucaacuggcaguuagcauguaguagaauacaaacugauccauucuuaucucuuuguacaaagcucaagucuaaguggaucaaggaacuccacauaaaacuagagacacugaaacuuauagaggagaaaauguggaagagccuugaacauaugggcaaaggggaaaaauuuacaagcagaacaccaauggcguguacuguaugaucaagaacugauaaaugggaccucauaaaauugcaaagcuucugcaaggcaaggacauugucaauaagaccaaaaggcaaccaacacauugggaaaagaucuuaaacaauccuaaaucugauagaggucuaauauccaauauguacaaagaacucaacaauaaagguauuaaaaaaaugggauucagagcuaaaagaagaauucucaaccgaggaguacugaauggcugaaaagcaccuaaaaaaauguucaacaucuuuagucaucagggaaauucaaaucaaaacaacccugacauucuacuucacaccagucaaaauggcuaagauaaaaaacuccggugacaacagauacuggcaaggaugugaauaaugaagaacacuccuccauuguuggugggauugcaagcugguacaaccacucuggaaaucaguuuggugguuccucagaaaauuggacauaguacuaccugaggggccagcaauaccacuccuaggcauauacccagaagauguugcaacauguaauaaggacacauguucuacuauauucauagcagccauuuuuauaauagccugaagcuggaaagaaccuagaugucccucaacagaaaaauggauacagaaaauguaguacauuuauacaauagaguacuaugcagcuauuaaaaacaaugaauuuaugacauuuuuaggcaaauggaugaaucugaaggauaucauccugagugagguaacccaagcacaaaagaacauucaugauauauacucacugauaaguggauauagcccagaaacugggaauacccaagauacaguucacaaacacaugaaauucaagaagaaagaagaucaaaguguggauacuuugauucuucuuagaagagggaacaaaauacccauugaaguugugaaguaguuacagagacaaaguuugaagcagauacugaaggaaugaccauccucagacugcccuaccuggggauccaugcuauaaaccaccaccaaaaccagacacuauuguggaugccaacaagagcuuucugagaggagccugauacagcugucuccugagaggcucugucagugccuggcaaauucagaaguggaugcucacagucauccauuggacagagcacagggucuccaaugaaggugcuagagaaaggacccaaggagcgaagggguuugcagccccauaggaggaacaauaauaugaacuaaccaguaaccccacagcucccugagacuaaaccaucaaccaaagaaaacacaugguaaaacucauuucucuagcugcauauguagcagaggauggcuuagucagucgucaaugggaggagagucccuugguccugugugugaggguucuaugccccaauauagagaacugccagggccagaaguggggguggguggguuggugagcagagggagcggggaagggauaggcaaaaagaggauaacauuugaaauguaaauaaagaaaauaucuaguaaaaacuaaauaaaacaguuucacaauaguacuuaugcaaaauuucuccaauucuacccauaguuagguaucauauuuauggaauuauuuuucuuaacuggcauuuccugguacauauucucauuaauuuucuguaccuggucuacuugaaaacaguuugucacuguucuauaaacuguuuuauaaacucaucccaagcugaaguacugucucaaguuguauuucuaggaaugcuuagauagucuccauaaagacaagccggaauuuguguuuugagaaagagaugaagaucuuuugucaaagccuucaauauguuggcuucuauaucuguugucuuuggaugucuauggcaacaauccaaggaaaguguguaaggaugguguggugacuaauaauuaguugucagguugacucaaguuguguuuucgaacaaaucucuagauauuaccagggagauuauagauuagacuaauugaggacgaaagaucuaugcuaaauaugggccucagcauucccugggucaauguccuggugcuaaaugaaaagaaaaaaacuuuuccuucugggcuuccugacugugaauacaaugugacuggcaacuagagggaauaaaugauguagguauuggacaugcugcugagugugaagagcugaggauacaguucccaugugcuggagacacugauuuccuaccaguggagaagugaaguuagugugcaucuaaacacaagggcccuuauacaugugcuacuguccccaccccuauccauagggaucugaaggggcucauggggucauugacaauguacugagcucccaacugaugacaaacaucauggacauccuucucacaaccugaagagucugauggaaguuccguuugcagaucucuagugacugaaaaccugcugucuucauuuuguaguaggcuauaugcaauaaacucacuguagcagccuacgacccaucaaugcaguuugcaucacuucuggagaaaaguaagcacuaugaagaggaggcucacacuagcugucagaucacugcucuccuaggaaccacagaagggcugagccugugcaugcucaaagaauacuuaccacaaagcagaaaaaacaaaaacaagaacaaacaagaaaacaaaauucucuugcucuaguucucauguaaauucccagugcugguuaguuuuugucaacuugucacaaccuagaaacaauugggcagccaaaaaucucaguugagaaauugcccccaucagauuugucugugggcauggccuguaggggcauuuucuaguuugcuaauugaugggagaggaccuagcuuacugugagcagagcuaccccugggcagguggucauggcugucuaagaaagguagguaacugaaugugagcccagaagcgagccagugagcagugcuucccguggucucugcuucaguuucugucuccauguuuucuucaauaauuggcuuuaguguugacaaacaagccaaagaaaccucuucuuccuccacguugccuuuggauuguaucucauuacaacagcgaaucaaacaaauucaauccccuuaaauuguuugucuauaacucccaccugcuuuguaaagaacauugcagacagacauuugcuacaagaccauuccauaguccacuuaugggccauggacagaaaagcugccuuucauuaauaacauuuuuuuucugcuguuauauaaaugcagaccacaaaaaccauuucucuguuaacauagcaaggauacagagaagaaagauuaaagauuuaacuugaaaucaguuuugagaaggaaggaaagaaacaguugugaacaaucugugaacucacuugcauggagaaggugauggagguccccuggaaaugcuucuccaccacugucccaacucucugggucacuugaaacaaaucggccacuucaucaggauguaggucacggaagcgcucuacuggccucagcgggcacacgaggacaucugcggugggguagguuaaggacaauuuggcuugcuuugaguugcauucuuaugcaguaguuuguacaugaagccccgaguuccauugacuuggggccuggaaucuugcagacuaugaaaugaaaaaagaaauacuuagcaaccaaaagcuuuaaaagauuguugguuuacuuugagggagaugucuugacacacaggagaauuuaagcaaagaaaugauaaugggcaaagugauaccagcacuugcugagauaauuacagcuggaggcaagaucuauucugggccaucaucaccugaccucccacuuccccagcagcuaaacacacugcaguggacuagccauugggauaucuugguguuuugcuaguuagaacaugaugauuacacugucaaguuuccuuugagaaaaaugauaggaacauaaaaaaguauccaauauuagaugauuuaggagggcugaaaacauuaggagaagauaccuugaaccuuguguaugacuaacagauguuccacaugaggguuccuacaauugguuauguauaacccaacauauuucaaguuaaaucuuuaaagaaagcagguguuucuuacacacauacaaaaguuguaauguauucuacaaguuagcaagguagcauauuuacauuucuggccugagaaaauaucaaggucuagagaaaaggaacugaaauuuauugggguuuuugguagcaaacuuauaguaauaacuacauggauauucuauguccuuuuuguacuugaaucuaugguauacacacauacauaugaauuauauagauaaauuaguacuguguaaauauauacauauaugcuucugaacuuguggaugguauaucucaauaaauccauuaugaguuaaaaauauucauuuaaaaauuuauguaauacagcuaagcuaaggaacauuauguuuuagccuagccuuacuuaaacguuagccuacugaugggcaaaacucauucucagauaaacuguugaaaaucauaugcaauugauugaaggcuauaauguaagugaaaaacagaaaggcuagacuggaauguucucugacuguuauaacuaagaaauuaauguuaauccacuagacauagagauuguauuacuuacucaguuucuaaauacuugcuagagauaacaaaacuguuauuuuuuuucuuuaaguuuauucuccacuucaccccaccccuuuauuuuuucuuauuuuaagaaagcauacuucugccuagagccaagaagcaaggggaucuaaugaaaccacaauccagcaauugcgagucucaccagaauacaaagcacguaaacccaucacacaguuggacucaaggccuuagggaagugugcagagcucagcuuggcaggccugauuuuuuaugagaaagggacaaggagagauaaacagaugaauguggcuuauauuccaagaauugacaacaacagaaaacuaggagaggagguauuucuuuaaucugaguucauuuuucaagaggugaauggugaaugaggugaaugccccacccacccacagggcaucugauacuaauaaagauaauuauccucuagcaggggaguuugauuaucauaggucaacaaaacacuuagaaauaaagaauuugcuuucuacuuuuaaguagauugccaaaaucuacccccccaccccccagagaugauuucuguucaucaagagggaccuuugccuaucuuucuccucccuauuuuuccagcuuaguauuuuuacugauuauuugagaauuucacacauugcacccugaucacccucauuucacauuuaucccagguccguucucccaccuuugugccccauccccaaaauauaucaaguccaauuuguguugcccauauacucauuggagcauggucacacuuccaguggcuaaacaccccauuauccgguaaaaauaacugaguccuuucccaugcccccaucagaagccaucaauuguaaacagcuacacuucagcaucucucaaaguuuuuaaggacucucuuaaaugacauucuguagagacugcuucuuucuguuaggggcagggaagaguuuguugaagaaagcuucauuauuucucauuuccaagaaugagucuagagucaucaauaccugcaacagaagcuuucccgaccauaacaggaagaucauggacuuccauaugguuuccuguggaccacuggacaaccauauugucuccaguugcaucacagaccaucgagaucauuaugacuucaggauggagcccaggccauggagauccacauauccucugguaguaguauggaccacaaauaucaacagaauuucagguguuagcacagaccacagcugccaacaagaccccaagcagcaucucagauuaugggcauuaacaugagcucagauggcagcacagaccacagacauuaacaaggcaauaguagcaaugguggacauucaaaugaccucugauagcaacacaguucaugggcaucaacacagccuggagcagcagccagaaccccagaccauguacagcagugucacaguggguagcauagagauuuuuuugaggaggccauaucuagaaaaugagccauucuccuucucagacauccugcuguugcucacagguaggaaaaucaugggguuauaacaaguacauguuuguaauucuccaacaucacauccauauacaagugcucugaacagccuuuggacauuacugugccucuugagagaaguucagugucauaucccagauaugaacaaacccuaaggugcaauuaacagagaagcauccguucuuccugcuuucuguaucaggaacaaagacuagaaccauucuggauccuuugcuaccuucuucucacucuucaccauucagggcuucacaggugggcagaucuggcugagcagugugagaccuugaagguuccaaggccaccaucugugguuuccaccacuguacugccuacugcugaccuucccaggcuguuuaugagcauuuucacauccccugaucacccagcugaaguuuuccauaucuucuuccauacuuucucccugagguacaagggagaagccuccuuauauuuuaaauuauacuauccuguaagccuauuuaucaaacaauagccagauaacaacaaugcaguuuccagcaacugugggccuugucugcauggaucaaccagcuagaggaagacuagcaucucauguaagcaacuccucaaaguggaaacuagagagacagagcuguaauacuguagcacacaagucuuccuugucaaugccauaaaccacuauuuaucaacuuugcuuuucaaaugguaacaaauaacuugacccaauauuuaacaagugaaaagauggagggaauuuaauaaaaaugacucccaaacuuugucuuuuguauaccuaaccccaggucauguaacauauacauucauuacuuuuaagaacuauuaauaguaguaauacaucauuaaaaagauaaauaggcuuacaccaaucucauuuggugaagacccucugccacagcagcuaugcaacaccauuguauguuuguguguauauguguauguauuaucccuguacacaucauuugcuaaugagccaccuuuuuggcauacaucacaaacacuuugaguaugcucagaccaacuaauuguuaacaacuucagcuaauuuacugcauaaugcuagggaacauggcaucucagcugacugcuaacaccaacuuucaacgucuaucacagacuaucuagccccaagauagccaugaagugauuuuuuaaaugccuauaacaaauuucaacuacugcaugaaauaugaccugggaagagcuuaguaucacuugauguuccaggauuuucacuguccaauuauauuagggcagcaggaggccuaugacuggacagggaaaaggggggcagaguuaagagacagcaucucaggagagaggaggaaggccaagaugguaguggacaugaacuaacgugacuuucaccagucacagguaguuaugcuaucauaaguuuagaauaauugguauaaagcuuuuaaauuaucaacaggcucugaaauuauuguauugguaucuuguaaauugagaauguauggauacauaaaucugguugguuaauuauaagguucaagaguuuugcuuuacucaggaucaagugagcagaaaucugugggggcuaucuggagagaguugccaguggcagaagugugggggcagagucuggccucaccagggaguuggcagguugagagaagcaggaacacggagagcuggcagguucauuuauuaauauuucccacaacagguggcacccaacguggggugccaccuguagccauccaguggccauggagacuggguuuaccugaaaagggggauggaaaugaaaaggacgggguaugagagaagaaugaagccaagacaaggcucugaucaaggcuccaaguuuaauauucagcacuguguuuauauagggcaagcccacagacccuaucauuuguuucagcuggauuauguugcaaagcaagcucagugggaagucuaguuuucuaaguuccuauaggaaguugcaggugcagcaaggcagaugacuccaacugggucaucaagguucauuguggaaagcacugaaggucuguucagccugcugaaggcuggggagggcacaacaugagauggauauauuugucaccaugauucucuaugugguuuuugcuuuaagucuaaccugcacucauugaugucacuauuugauuggaagaugacuggcauuggggcaaaguuagucuuuuaauuuuccuugauacuccauucuaaacaagauguagacucucuaaggucucuuaaggguuaaauaacuucacauugggggggggggguaaaucacaagccaaccagguacaaugcagaaaauaaaaucaguguuaauaaaaggaguggaaagaacacagugaacuugagaacggguuugaggagacaugcacauugggcccauuacgauaaucaacuaccuacuucgcuagggucacugaagguaauuucuggaaauuugauuaaauuaaaugacugcacucaucccuucaauaucuuaguaggaauucauaauuaagacaagacaauaugaaacauuaauuacuauaauaccuguuuuguuggaugccaacaugguguuagauacuggagauaacuuacuaggaaaauccuauccagucaugcaugaaaucuugguucauauucccagaaacuacacaaacuugcauaagacagcaugaaucuguaaauucaucacuccagagagauaggaggcagagacaggagaaacccuggaacuucaaaguucaccucgcaugagguauucacugguagaauaguaagagacccuuucucaaauuagguggaagggaaggaccauuacccaaaauugucuuuuucccucaacauggguaccugcacauacagagagagagagagagagagagagagagagagaggagaggagagaaaaauuuaaaaauaaagcuaauugacuucuucaaagucacaaaguuacugaggagcacaacgugcacugaaauccaggauguucaacuuugcagcccaaaccucuuuccaugaaaugggaaggagcaaaaugcuacaacucugcgcccauuucuacugcuaaaccucagcagaugucaacagcagcgaucucuucucaaagcagagguacagaaucuuauuaacaacauccuguagccaauugcuaccaauuacuaugggcaccaagcaugaaaacuccacacuauuucugagaccucuucugcuguuuccaaagcuacaaaaaucagaggucugucuggauugagaguaaaggaaaaaaaaaugcaaagugagacucuugguccagagauaucaaaugauuguuauguugcuacauuuggaauaaauuuguuaaguuugaauuuugcucaucaaggcuaauuacugauggauuuaagaaacuuuucgaaggcauuucuguaacacauauuuaaauauauaaucacgauagaaaaauuaaaauauauuaacugggauaauuaaaugggacagcaaacauucuuaacaguguuuagguccagcuccauuuguuuauuuuuuauuugauauguucuagagauuaaaaauguaaaagucaacaauuaaaucaaauuaccauaucacuaguguuggugaggcuuauuagcauguauacagaugaaugugcagcaaggagguguuaaauaauaugauaaaaaguuauucuuuggagccaauaaaagaauuaguauucauuaauacuacauaccucauguagguuaauaauaagcaagagguuuucauccuguagaauuuguuacuuauccucaucuuugcauucccucaccccaucuucagaggucucucuuccuuucuucuuucuucuuuucuuccuuccccaccuuuuucuuucccuccauuccaucccaucuguccuggcuggaauugggacucaacacuagcuagggucaccagagaggaaaagacucaguugaggaaaugucuccauaagacccagcuuuaagacauuucuucaauuagcgaucaaauggggagagcccagcccauuguggauggugcugucccuaugcuaauaguccuggauucuguaggauaucaggcugagcaagccaugugagucaagucaauaaacagcauccucuaugccuucuucaucagcuacugccuccaagauucugcccuguuugaguugcuguccugauuuccuucaauuaugaacagcauaauggaaguguaaaccaaauaaagucuuuucucuccaauuuucuuuuuggacaugguguuucauuggaucaauagaaacccuaacugaaauauaauuucuucccuuauccaccuucccucccucucuuucuaccuuacuccuacucuuccuuccuccuuuccuuguuuuugagauuaugauggaugugaaaaacaguuaaggcacuuuuucacugaccuacauauccaacccuuuauaauuuuacuuuagucuuuuuaaguuacuuaaguugcucucaaaccuuugugggucugugguucuccugccucagcuuucugagucauugguauuacagguacucaccauuaugcagaguuucuugcagagguauuaaauuaaucuuaaugacacuugaaagaacacacccuuuuaaagagaagaaucaaagcacuugguuuaaguagcacacuuacagagcuuugaaacaaaguggauaauaugcucuuggcaauccagguacuucagugaauuuucaaauuggaaaguaaaacugguaacuaaaauuuaauaaauaugauuacaugcugaaaugaaggagugcagcauguugaugauuuagaccacaccuuuauugaacaccaacauaaacauuacaguagcucaaugaagaauuaacagcacacucaauggcaguagacauaaaugguugacauguaacuuagagcaaauggauguguagaaugugaucaauugagaagauugugauuaaggucaugauauacugcugugcacacaucaggguaagucauucacaaguaucuauuaucucaacuucuguccugggacaaagauaaaaugaggccacagucauguggacagugugaagauagccuugucuaauuagugugcuuugugucagccucaaacuuccacauggcucugaaggcucaaaagugagaaugacguucgcagagaaauuaagggagcuuuaaauaaaauagaaauggcaggggaaaguguaccuauauuacauucugguguaguauuuggcuuaaauuuuacaucuaugaauuuucaacagaaaggaaucuuauauugacugaugugcuaguaucacauuggggaaauauguguacauuaaacuguucagcugugaaaaagcaaacaauaucagaaguauguacacuguguguuauguccuagggacagucagugauagagguagguacuaucacaaccacuuuucuguuuucauguuuggaagccccaggaguucuaaugaauguucaagguauuaagugaaaagcaugacaggggccaugaagcacaauuacuuauugcaucaccauguuuccaacagugagcaggucuacauguacacacugugccccuacuacaguguuauggaaaaauguuaauuccucgauacuuuucuugauacaaauuucuugcaguccaguaacacuguaaaacacuaguucuaauacaauauagcuuuccucaacgucaucaggagaguuaauuguguucuuccaaaagaaauuacacuaaguaguauuucucaaauuugcaugacuauaaaauuaaaauuauuauuuuuacuaauuuuguguguauguauguguaugcuguggaaauacaggugcauugguaccacuguacauguggaggucagagaaaaaugucagagucaguucuuucaaagaauaagucucaagaagauaggcuauugggcaguugcuucugucuacaaaguuacuugccucucuuaaaccuguuguuucauaaaugacuuaacgaacacucuauaggacaaaucuucuaaaggaaaugcuuuagauuacacugggcaugguggcucaugcuuauaaucccagcacacaggagguuaaggcaggagaucuagaacagaaaacuguauggucauauagguguuauaauagucaauaagaaccuuggaguguccaccgauuccacacccaaggugaccugguacuggcgccgaccagaaggguuaucaauuguugauacuagagcuugagccauuguaguucuauuuaggaaauuuccccgugugccaauuaguucaaggaucuuucccaauuucucuucuauuagauucacuggaucugguuuuauguugagguccaugauucacuuggacuugagguuuguacaaagugagaaauaugggucuauuuuuauucuucuacauacagacagccaguugaaagagcaccauuuauugaagaugcuuucuuuuuuccauuguauauuuuuggugucuuugucaaagaucaagugacuguaaguguauggucuuauuucugggucuuugauuuuauuccauugauugaccugucugucucuguaccaauaaaugcagguauuauuauuauuauuguuguuguuguuguuguuguuguugcucuguaauaaagcuugaggucagggauggugauucugccagcucuucuuuuauuguuaagaacugauuucacuauucuggguuuuuuugcauuuccagaugaauuugagaauggcucuuuccaugucuuugaauaauuguguugggauuuugaugaggauugcacugaaucuguagauugccuuagcuaggauggucauuuuuacuaugauaauucuuccacucgaugagcaugggagaucucuccuauugagagauaaugagggcuaauauccaaaauacauaaagaacucaagaaauaaaucaccuaaaaaacaaacaacccaaucaaaaaagugggggauaaaacuaaaccgagaauucacaacuauggaaucuggaaugaaugagaagcaccuaaagaaauguucaaaguccuuagugaucagagaaaugcaaaucaaaugacccugacaacccaccuuauaccaaucagaauggguaagaucaaaaacucaggugacaacacauguuacggaggauguggagaaagaggaacacuuuuucguugcuggugagauuguaaacugguacaaccacucuggauauuaauuuggagguuccucagaaaacuggaaauagaucuaucugaagacccagcuauaucacucuugggaauauaccccaaaaaugccccaccaugccacagaggcacauguucuacuauguucauagcagcuuuauuugugauaaucagaaacuggaaacaaccuagauguccgacaacagaaaaauggauagagaaaaugugguucauuuacacaauggaauacuauuuggcuauuaagaacaaagacauccugaguuuugcaggcaaauggauggaacuaggaaauaucauccgaagugagguaacucagaaacaagagaugugcaugguaugcacucaauaauaagugguuauuggcaaaaaaaaaaaaaaaaucaaaaagcaagauacauuccacagaacucaaaaaggucaacaagaugaagugaccaagugaggaugccuccgucccacuugggagagagaagaaagcagucacaaguggggagggagggagagacauaggagggaaaguggacauggugggggagugguagggagaggggaaccugaucucauauuggguaagggaaaggcacuguagccuugagggcuagcagaaagaauggaaacaggcaaccucaggagauaggaaguugguaggacccuccagaaugcacuagagaccugggaggugagagacuuccaggacucaaagggagggaccuuaaauggaauuccagacaguaaggagagggaauuuauagaacccaccucuaguagggagacaggacauaaagugaugggguugccaucucacagucacaucucugacccauaauuguucuuguuugaaagaauuacagggauggaaauggagaggagccugaggaaaagaaguuccagugacaggcccaaagugggauccaggucaaggggaggucgaaaggccugacacuauuacugaggcuauggagagcucacaaaaagggaucuauaauggcugcccucagaaagaccuaacaagcagcugaaagagucagaugcagauauuugcacccaagcaauggaaggaugcaacugaccccuguuguugaauuggggaaggcugaaagcugaggagaagggugauccuguaggaggaagcagucuuaauuaaucuggacccccgagaucuuucuaacacuggaccaccaaacaggcagcauacaccagcugguaggaggcccccaacacacauacaguagaggacuuccaggucucuguucauucagagaugaugcaccuaacccucaagagacuggaggccccagggaguuuagaggucagguaggguuggggauggggacauccacauggagacaggggcauggggaggagguauuggauguggaacagucagaggguggcuguggagugaauaaaacaugguguguacaaaauaaauuaauuuaaaaaaaauaaaauaaaauacccauuugcagauucaaaaauaaaaacaaaaaccauguauguuucauucauuuggaacuggaaagaacguaaaugaaaauaaaaggaauaauuuccuguuccaauaaagcuuaaugacgauuaagaaaaugacagacagggaucaaaucaggacaugaaccuggauggguggccaagugugaaaauacagacucaagguuuuagucggcacuggucacuaauguagcucuaaacaauaugguaaaaucacuaguuuacaaaugguugcaaagaguuuuacugaguagaggaaagucuuugguggaauuuauuuccauugacuuaaaaaaaauagccauuuuuuccagcuuuuacuuuaugguaugaaauauguuauuacuuagcagggaguggguacagagaccauacccuaaugaagcagguauaacuaugaauccagcuuuggaaagacaauuuaagguauuugggaaagugagcccugcuuaagaaauagaagugguguuucuugauuggagcccagaauuagugaccacauuucuuuuucuauuauuauuuuagagaugguggugggucacugguaauuggcuuuauuaggagaaaacuauaagcauguagcaaaaccacuguuguugucuuuccauuuacagaccuugaagacuaacugguaagugaggagcuuuggucacccaaaagcugcuguauggaggggccugcuuucuuccauuccgauagcauaguucuuuccaagucagccccauuaaaacauucuguacucaaagcucccauagugacauauagacaccauuuguuuccucuuugggaaauauuuggaaauaauucacugcugagaguuuucauuuuguuugugucugauagaauauucuacauucuuuuuguaaaugguauaguuuguucuuuaguuuugaacaauuuaaauagucaucguuuuguguccagcuggcuuuucuuaaaggaaaaguauccuaaauuguucacuauucaaucagauuaaaaugucuuucguguuaguccauuaaaauucuacugcuugccuuuuguggaggggucaucugguuggauucuggcauauggcucacacacagaaagaaccuuuuccuuccccuuauuuuuugugaguagcucuauuagaguccacaucaaaauucugugccuauuuguaaauguuuguggauaaacuggcuuugccaacaguuuugcgauuggggcaacuggaugauaggaacugaaugcaggaccucacuugggagcaacuggaugauagggacugaauacaggaccucacauguucuacaacugggcucuacuccaaauuuaagcuuuuuaaaucuugacuaauacagauggugaugcuugcagccaaccauuggacugagcauggagcccccaauggaggaguuauggaaaggacuaaaugagcugaagugguuugcaacaauaucaaccaacuagacauccuccccucccaccacuccccagagcuggcauggagggacccauggcuccagcugcagauguagcagaggauugccuuaucuugccucaaugggaggagaggcccuuagucuuuggagccuugaugcuccagcauaggggaaugcuaggguagugaggcaggaauggguaggugggugggggauuacccuuauagaaauggggaggaggaugagguaggguguuugcagaggggaaaccggaaaggaagauaaaacuauauccaggaauguagauauauaaaauaaccaauaaaaaauuguagagggagguugcuaaucuaaaucaaugagacuuagguaggcuuugguggcucugauuuuuguguuuuuaaacaaauuguaggucacaggaaaacaauaaacguauauacacacaugcacacagcauuucccaaacaguuuuaaauauuuuauuacauugugugugugugugugugugagcacucacaaguaugugcacacacccuguaugaguugguuuuuuccuuuuaccauuuggauuaugggaaccaaaauuggucauaaggguugacagcaaacaccuuuauucaaugagccauuuugauggccuccaaacauucuagaguugaagaaacccuggagccugucugcagauucaaguuaggggagucuacauuaguuacagcugaggaaaucaauagauucuguaaagaggaauuguguguuaaugaagccuucauugcagucugugcuuaaaccccuauuuuacauuacucaccauucaaauugaagcucaaauccuuaaguccucccugaaugaugugacaacuuuaccuguuagcuccuaccucagaagugugccccagauucccuaugugucuauuucccaucaccacaguccugcuuucuaucucuugccuuaugucccaggacgacacgcucaauggccucaugaaguuauccuuguuuugcaugaaucuuucuaccaagcauuuagaauaaucuuucuauaacagaacccagauuccccagucagccuggagcucccacugccugaaauguuuuagcaguuucugucugcuuauaggauaaaugcaaacaauuggcccaggcugcugaaggccuagacucuuuuaagaaucaaauuuuguauuuugugagccaaauacacuuacagcuuagcaaguuuagcuuugaauguguuuucuucugacacauucuauuuacgcuuucucaucuauuauuuauucuacaauaguuaauuugcaucagggcuggagauugaguucagugguagaagacuugcccaucuuggcaagcucuggguucaacuccuaacuuuauagaacuccaaaccaaagcaaaacacagaagaaaaccaaucaacaaacaaaaaaauauagucaggucuguuuucacauacaaguaauuccaacccuuaagaggcuguugaggagccuugcaaguaagacaggcaggcuacauuggcuauauagcugcaugacaagccugagcuacaaaugagaccuugucucagaagaaaagcaaaagacugaagagaaagcacuucaguagagcacuuggucaggauguacaaggcucuagcuucagucuucaguaauacaaaaaagaaaaaaagaaagaaauuucauuugaauguguuacuuucuuuucuucuggcucacugucugaaauuuuugaucaaggggggaauauauauaguauguguauaauuguauuuauagucuuuuccuuuugucucaauauuucccaaauaauguuuuuaguuaaugaauauuuauugaaugaaaaguggaacaacacaaaauucuuaaagguguuuuggcuuuaaucuguucucuugacuuuucaguuuauggauuuuuauucacuaauucauuuaaaugcucauuuauagaccacuuguugaaaaacucucgguaugaaauguucucacaucauuuacuuuagguuguaugggacugaaauuauugagcauuaaguagacauugauuugaauucuguaagaaagaaaaauuaucauaauuaugacucauuucugaaaauaaauuuuuacuagccuuacgauuugucacucaaagauuugaauaaugcuacacugggaacuuucaaacucaggaauuaagcauccacagguuucccccuaagaaggcaugaacuuuguucuugaaugagugaagaauaauggguuuaucugguaauauauuuuauuuagauuagggauauagaacugcaauacuuauugcugcugguguuguuguugagcagaguacauuuucauuuaguuacuuauauuuaaauaagcugaguccugacuuguugcugcuuucauaagaaaccccacacucuuggaggaaauauucuucacaggggcuguggcucaguggcagaaaagcuuacuguauaaugcuuacuauacaagcccugacaggauaugcccagcacccacgugaagccugauaugguaccucacaucucuauugcccuggccugcauuacuuaaacaacaggguucuugagggaagggggcuacaaugacaaauuuugggaucagaaaacaugaaggaaggaggcaagacaaaaguuuaguucaagccuuguuuauucaaggaaaauggggggcuuuuaaagcugaaaacugcgagcagaauuugcucagguacacagaccaaacugguagugcuagcuaacacguuaaggucaaaggaaugcccccauuguagaaagguccugaaaggagugcccucauuauaaaaugaaagcaaugcccucauugugaaaugcaggagucaauuacagaacagaagcaagauaguggaagaagcaaaagaauguuagauaagggcccugggacaggauuccaggggcuuccgggccccaacacuguauauccagaacaccuucagcaacauggaaggcagucaggagaaucccccaagguccugggccagauagcauggauuauguaauggagagaaauccagacccugccucaaagaauguggaaggagacuuccucagguccuucccaccccacgcgguuguuggcgccagacucaaacagggaggcugccucgcgcagcaugucaaagaaaagaggacugaguggggaggaaaagagaacccggaugauggagauauuuuuugagacaaaagauguauuccagcugaaagaccuggagaagcuugcucccaaagagaaaggcauaaccgccaugucagugaaggaugccuaguggaugacgguaugguugacugcgagaggaucgggacguccaauuacuacugggcuuuuccgagcaaggcucuucaugccaggaagcacaaguuggaggcucugaacucucagcugucagagggaagccagaagcaugcagacuuacagaagagcauugagaaagcaagaguuggccggcaagagacgcaagaacgaaccauguuugcaaaagaacuuucuucauuucgagacuaaaggcaacaacuuaaggcagaaguggaaaaauaucgagaaugugacccacagguuguggaagagauucgugaagcaaauaaaguagcuaaagaagccgccaaucgauggacugauaacauauuugcaauaaaauccugggccaaaagaaaauuuggguuugaagaaaguaaaauugauaaaaacuuuggaauuccagaagacuuugacuacauagacuaaaauguuggugcuguacaaggaucugggagcuugugaauaugucaagguuuaaacagcuaacuaauguuacccaguuaucaucuaucugcuaauuguuuaucauuuuguagcuuuaaauaaaguauacaauaaggaaaaaaaaaagaagguggaaggaaaggacucacagcagagauauuccucugauugucacaugugccaugcuuugaacacaucugcacuuacauuacauguaccuguguauguacacauagcaaacauacacacaacaaaaaauuaaaauacuauuuaaaaguauuucuuuccaggagugagcuaugaaaaggcuacauuuauucuuucaauaaaguaugacugaaaccuuuuauuaaguguauggaacagaaaugcuaguugagucugucuuuauuugggguguuaccccaguuuuaggacaucugacugccaccccugcccccaacucucaucuucuuacauugugaccucucauuuucccauuucuccuuccacguuauuaccugucagcacagauccuuuagauagugugggggauggggagccuagguugcuuugaccagcuuuacugaagaucuaaugcaaaggggcucuuuuugugugugugugggggggggggcuuuuuaaaaauuacuuuuuuuuuacaguucccccucaugguccucccucccacaguuccucaucucauuccucuucugcccugucuucaagaggauguucucacacccacacacauacccuacucccugccaggccuucccacgcccuggggccucaagucucuccaauguuaggcuccucuacucucacugaggccagaucaagcaguccucugcuauguauaugucaggggccucagauuaguuccuguaugcugccuaguugguggcucagugucugagagaucucugggguccagguuaguggagacugcuggucuuucuaugaggucgccuucuuccucagcuucuuacauccuuucccuaauucaaccacaagggucgccgacuucaguccaaugguuggauguaaguaucugcaucugccucagucagcuucuuguugggccucccagaggccagcuaugcuauaagcacaucacagcaucaguaauagugucgccuugaacucuugcaaaggagcucuuaaacugaaugaaaaaaauccuaaaguucaaauccauuuacuucucugaauguaaugaagaacuaugacaaucgcuggaguugggggucccacuucacucugacaggcucugagcuuagcugcucagggccucuuucuucacgcguguggugcugguacgacaguauguauagacaugucugguuacuuacaaucuaugugacagugugcauaggcaugucugguuacugacaguauguauauacuguauguauauacugacaguauguacagacaugucuagcuacugacaauccauuuuuauuacauguuuuauuuuuagaagcucuccaguaaauuacaaauucuuaguauuacucucugauccacauuagauguaaaacuuauuuauagcauuuuggaaaugguuuuuacacuaaauacuugcugugguuauuaaacuucuuucaucagugaugagucuuaaaacuuucagcuguaagguauaugauauuucuucaaucccaacauucuccaagucuuaacuucugagagcauuuuuauaacauuuucauauuuugugugucccauuuuugucuuuauguuugauggauagacacauuugagugacaguucaucuucccuuccaacauucuccuaaacagaaucauccaaaccacagauauuguugucuauacuuaguacaauaacaauaauaauagauuuucuuaaugguuacucagagacauuauaagacccagaaaugacuucuauaucauuaagaaagaggaaaagggaguccuugagaaaauauuuuuauugcuuuaucauugaauaaugucagauucuugguaugcacacuaauauucuauuuuuuauuggauauuuucuuuacuuacauuucaaauacuuuccccuuuccagguuaccccuuuggaaacccccuaucccauccucccuccccugccucuaugacggugcuccccgacucacccucuccuguccucccaccauggcaucgaacacccucaggcccaagggucuuuacuccgacuuuacuccgaugucuaacaaggccauccucugccacauauguggucagcccaauggguucgggaagugcuugcugauggaagccugauauggcugucuccugagaagcucugcuagagccugauauacagagguggaagcucucagccaaccauuagacugagcuugugggucccugauggaguuggagaagggaacugaaggagcugaagggguuugcagcccaauggagggagcaacaaugccagcaaacacauuaauuuucuugccuccuucauggcagucaaaacuaauauauguuucccuggcaaggccugagaaaccccuuuaucacagugcucuaaacaacuacugcacauuggauggagcuagcaaaagaaacaaaaagcuauuuagcacuaaacguacucuaggcauugugguaaaaaauaaaugcugcccaugauggguaauccagacaccagacuuccaggucagucauaccaugguacagcaugaugaggaaagaaaaaaaggaggaaagaaagucauugagccuucagacuagcaguugggacucugaccugguagugauggguaucauuuuugcauuugacauauagaacuacaguccuaggguauuacucaagugccagcagccaaggcagcaucuuacuauguaucuggacuucuuuuacuuauuuauuuuuuuggagagaggguuucucuggguagcucuggcuauccuggaacucacucuguagacuaggcugaccuugaacucagaaaucugccucccaaugcugggauuaaaggugugugccaucaccacugccccacuuuuuuuuuucauuuuuguauuggcuauuuuauuuauuuacauuucaaaugguaucccaguuucaccugaauauauccccuccucaguccugcugccucuaugaggguguucccucaccugccuacccacuccugccucagcagccuaguguuucccuauccugggucaucaagccuccauagcaccaaggggcucccauuccagggaugccagauaaggccauccucugguacauauccuguguacucuuuggauggauauuuaguaccugagagcuuaggugggucugguugguugauauuguugugcuuccuaugagguugcaaaccccuucagcuccuacacccuugccaucacuccccauugggguccccaugcucaauccaauguuuggccguguacauccacaucuguauugauucagcucuggcagagccucucagggaacagcuaaacugaggugcugucaguaagcacuucuugguaucagcaauagugucuggguuuggugucagcagauggaaugcaucucuaggugaggaagucucaggaugggcuuucuuucaguuucugcuucacucuuuguccccguauuuuuuuuuuuuuuugacaggaggaauucuggauuaauacuuuugagguagguggggagccccaucccucaacugagggcugugcuuauccacuggauauggucucuacagguucuaugucccccucauuggguauuuuggcuaaaguccucccuguugggccuuggaaacucuugggucccuggcaucuggaaaguuccuuuguccacuacuacacaccuacuuucuaauuccccacccucuguacuucucucccauauccucccauaccugaacucgcccccuuuucccuccgccuccucucucccugacagaucccucucuugcucuacuucccagagauuauucuuuucccacuacugaguaggaccauagcauccacacuuugcugugaucuucuuucaucuugggucucauauggucugugacuuguauuguggguauuccgaacuucugagcuaauauccacuuaucagugagugcauaucaugugaguucuuuugugacugggaaaccucacucaggaugauauuuucaaguuccacacauuugccugggaauuucaugaaaucaucguuuuuaauaacugaauaguacucuguaguaaaaaauguaccacauucucuguauccauucuucuguugagggaaaucuggaguguuuccaucuucuggcuggcuauuauaccuaaggcugcuaugaaaauaguagaguauauauccuuguuauauguuggagcaccuuuuggguauguacccaggagucguaucuggacuuuuaauaauucaaaauacuuguccaagaaacuuuuuuaauuuaauuuuuaauuuauuuuuuacacucaauauucuguuucccaccaccccauacaugcugugacugcuccacaucccacaccuccuccccaucccaaggucuccauguggaugcacccacaccccaccccaccugaccuguaaacucccucgggccuccagucucuugaagguuaggugcaucaucucugaaugaacacagacccggaaguccucuacuguauguguguugggggccucauaucagcugguguaugcugucuguuuggugguccaauguuugagagaucucagggguccagauuaauugagacugcugguccuccuacaggauuacccuucuccucagcuucuuccagccuuuccaauaucaacaacagggguuagcugcaucuguucauugcuuggguacaaauauuugaaucugacucuuucaguugcuuguuaggucuuucugagggcagucauuauaggucccuuuuugugagcucuccauagccucgguaauaaugucaggccuugggaccucuucuggaccuggaucccacuuugggccuucuuuuuaugaggcuucucuccauuuccauccuguaauucuuucagacaggaacaauuaugggucagagaugugacugugggauggcaaccccaucccucaccuuauguccugucucccuacuggagguagguuuuauaaguucccucucccuacugucuggaauuccauuuaaggucccucccuuugaguccugagagucccucaccucccaggucucuagugcauucuggaggguccuaccaacuuccuaucuccugagguugccuguuucaauucuuucugcuagcccucagggcuucaguacuuuucccuaacucaaugccagaucagguuccccucuccacuuucccuccuaugucucucccucccuccccucuuguguuugcuuucuucucuguccccagugggacugaggcaucuccacuugggcacuucaucuuguugaccuuuuugaauucuguggacuguaucuuggguauucuaguacuuucuuuuucuuucuucuuuucuuuucucuucuuuucuuuucuuuuuguggcuaaaaaccaguuauuauugaguguauaccaugcacauccuuuuuggucugaguaacuucacucaggaugauaauuucuaguuccauccaucugccugcaaaacucaggauguccuuguucuucauagcugaguaguauuccauuguguaaaugaaccacauuuucuguauugucggacauauagguuguuuccagcuuugggcuaucacaaaaaagcugcuaugaacauaguagaacauguaccucuguggcaugguggggcauuuuucggguauauucccaagagugauauagcugggucuucagguagaucuauuuccaauuuucugaggaaccuccaaauuaauauccagagugguuguaccaguuugcaaucucaccagcaauggaggaguguuccucuuucucuacauccuuuccaacauguguuuuuacuugagguuuugauuuuacccauucugauugguauaagguggguugucagggucauuuugauuugcauuucucugaucacuaaggacuuugaacauuucuuuaggugcuucucauucauuccagauuccauaguugugaauucucgguuuaguuuuaucccccauuuuuugauuggguuguuuggcuuuuuugauuauuaacuucuugaguucuuuauguauuuugcagauuagcucugcauugguugugggguuaguuaagauuuuuuucccaaucuguagguugacaauuugucuuauugaguauguccuuugccacauacaaaaguucaauuaagagcagguaaacuaucuaaacaggcccauaucacacaaggaaacagaagaagucauuaaaaaccucccaaccaaaaaaaggcccagagccagauggauuuugugcagaauucuaccagaccuucaaagaggaccugauaccaauuguccuaaaacuauuccauaacauauaaucagaaggaauacuaccuaacugguucuaugaagccacaauuacucuaauaccuaaaccacacaaggacccaaccaaaaaagagaacuucagaccaaucuugcuuaugaauagugauacuaaaauacucaauaacauccuugcaaauugaauccaagaacacaucaaaccaucauucaccacgaucaaguaggcuucaucucaggaauacaagguuguucuaauauaugaaaauccuuuaauguaauccacuauauaaacaaauucaaagaaaaaagucacaugaucaucugcuuuauauguagaaaaagcauuugacaaaauacagcacaccuucauguuaaaaggauuagagagaucaggaauucaaggcccauaccuaaacauaauagaagcaauuuacuguaaaccaacaaccaauaucaaauuaaauggagacauacuugaagcaaucccacugaaaucagggaaaagacaaggguguccacucucccuguaucuauucaauauagcauucuaaguauuaacuagaacaauaagauaacaaaaagagauaaaagggauacaaauugguaaagaagaaauaaagguaucacuauuuucagaugauaugguaguauauauaagcaacccaaaaaguucuaccagagaacuucuccagcugauaaacaacuucagcaaaguggccggauauaaaaucaacucaaauaagucauuagccuuccuuuauacaaaggauaaacaggcugagaaagaaauuagggaaacaacucccuuuauaauagccacaaaaaguaaaaauaucuugggguaacucuaaccaaacaagugaaagaccuguaugacaauagcuucaagucucucaagaaagaaaucaaagaaaauaccagaaaauggugagaccgcccaugcucauggauuggcagaauuaacacaguaaaaauggccauccuaccaaagguaaucuauagauucaaugcaauccccaccaaaaucccaacacaguucuucaaagacauggaaagaaaaauucucaaauucaucuggagacaccaaaaacccagaauacugaaaacaauucuuaacaauaaaagaacagcuggaggaaucaucauuccugaccucaagcuucacuacagagcaauagugauaaaaaacaaacaaacaaacugcaugguauugccacaaagacagacaaaucaaucaaugggauagaauuaaagacccagaaauaauaucacacacuuauggucacuugaucuuugacaaagaggccaaaaauauauacaauggaacaaaagaaagcaucuucaagaaauggugcugguuuaacuggcugucuguauguagaagaaugaaaauagacccauauuugucaccuuguacaaagcccaaguccaagugaaucaaggaccucaacauaaaaccagauacagugaaucuaauagaagagaaagugggaaagaaccuugaucucauuggcacagcaggaaauuuccuaaacacuacuucaauggcucaugcucuaagaucaacaauugauaaaugggaccucaugaaacauacauguuuuaaaaacauaaucuguaguaauuauaaaagcccuaugugcaaaagaaauauaugucagcauacuuaguguauucagaaucuuacuggauucucuuuagugcgugaagaaacaaacccaaagccaaaucauucauguugggagaaauaauauuuuggaccuugaaugguauugauaaucauagaucuauaauaauuugaacaacuuccauuacuuccuauggggcagugcugacuaaaggacuuucugccaugcuggagagguuccauaacucaugcugcugaguccugauaacucagugugacuacugaggcaggaagcaguugcuuagcuauuuguuuguucucagguaaacuggaagcuuauuugauauuugcaauuuucuuggaaccaaguucuacagauucagggagcccuuacuucccacaagcucagcaugccuaauuucaacuaccacaguugaguuaaauaguauccuggucccaagagcaugguucaguuucaguugcuaugaaagaguaacucugagucacugcauaaaguacaaacucugccacuaggucauuuucaguccacaaaucauaguguauaaaacaggcacagaaucagcaguaccuacuaacauugcuuccuuucaaauugcuagugauuauucacuagguaucuggaauucaguuacgcauagccaaugagguggucagcaaaauauauguuguccuguggcauccuacugauaaauucucagaacaucucacuaaaguaaccaaaagagagaccugggcauaaacuacacaaaggcacagcagagaaacuaaauguggcaaccugaaauguggacacugccucuaaacauaacuaaaguuauagggaaaaaaacccaaaaacuacagaaccccagacuuuguuguuguguuagcagccaggggagcuuggcaaauucaaacacugucagacaggaggggagcagcuaccacagaaaguuggaagaugugccagaagaaaaggggccagcaaaaagaaucauucuugaaaauucucauguuucauagugaccucacaaaggcugaaauacuggaaggggauccaugcuaucuucucagacuccaucauugauugagaaaaugaaagccaggaagcaccauucaaguugcucuugggaagugcuucaacaaauacaaugcccauuauuuuucaauguaucuauaguuuaaacgcagagugugcuaccuauguauuagcuuuacaauauucccagaucuaaauucucauauaaacuauggcaagauuguuuugaauguuuaugagacuuauuugagauucaugaaaaagucauauauccaccauagauuagcuuuacuguauaugauuuccuuuugaauggucagucuuuacagccacgcccuggcaagcaaggggaagacuucuuauacuuuggauaagguaaaagugucaccuuauacaagcaaaugcauggcaauaucgccauacacuuaaaagccauugagaacuuguaucacacccugccaaaguaccuuucgguaacagacaggauuauauauaaaugacuguaagagacacaaaucucuauaauggaagaauaucacuguuuccaucugcauucaauucucccaacacacuauuuagcaaagauaaagucaacauaagacucuuccccaggcuaccaagucuccuguuccuugacuacaucaucaaaugugguugcuaagcacuaagcuuccuucuucaucaaauguccucuuguagaucaccagagggagacuacucagccagugccaaugagugggugguagauggcuggacaaacauguggauuccuuaagcagaugucugcuucagugaauugcuauuugaauugcuaaauugaauuccugcucaauuaagaaaaguccuaucauauuuuaaucagugcaaguuuggaaagaaguaagcacuguacuccaaaacaguguuucacauccacauucacacaucccugggcugccuuccucuuccugcucuagaccugcagaugagaauucuuccugugggugagcucccagguccagcucaccaugugcucaacaagauggaggaguuuugcuucacagcagcaugugugaaaacagcuugggauuauugcugagaauaagcucaagaugagucaacacagagcuguuguuuccacaaaacacauuuuaucucagacugugacagaggggaauucucacucugaucuuguuggcaaggcugcucuguagucuucggucaauuuggggaggcaccagggacagccuauaauauauucaccaaagccaccacuuucccugaggaaguagugaggaccgagggccagacuuucugggguaacacuggaaaggcuacuguccugggaaaauggggcagugaaggcucaucaacuaauaaauguuagaagagaaugugaaucuaguacauagacugaggagugacacagaucuguguucaaauuccaguucucuugccuuuuaccuauuugauguuaggcaaaugaguucuuagaggaccaauuaggacuccuuguucagugugaacaacucacacugugauauagcacacaugguggaaaauucuugaaaauauucuagcucuacaaggaaaaggaauaagagauuuauuaacauaaacacuauuuauaaccauuaaucaaaugauggauucauacaaaauuauuauugaauggguuuuuuuuuccuuuaaaaaauuauuuaauuaucugcgaccauggaacgaaugugaacauacaucagaugccaauuugccgaagucaguuaucuccuccuaccaagugggcccugggaaccgggcuuaggucaucagaguugguaggaaguggcuuagcacccugagccaucuuucuagcacaagucaagggugguuagccugaagauacuaagaggaugguuaguggaagaaagggaaucuggacacaggaaugaaaacaacugaguauuuauuuauaguuaacuauuaauuaaaauauuucauguuccugaaucacaaaugcaauaguaugacaaacuacagcaguuagcaaguauccgaaaauauauuugaagugguaaugauuccagcuaucuugaaaugcaauuuauucaauaauuaucuauuuucauuaauauaaaaauacaguuaucauuauucaugcuaccauuccugguuuaauauauaauaaagaaguacaaucuuuuacuaugucaugacuuugcuuuauaaaaacuacacacauuugguaaauauuugguaucacacuuaacugucuuaauauaaaagcauagcuuuugagacagaguuugauauuucauagacaaggcuagcaucaaacucacaaucaucuugccucagccuccugagugcuugaaucauggguauauagcaccagacacgguuaaaaacaaggcaugaaagaagcaucaacucauaaaagaucugcuuaugaaauaugaaggacuacugccugagacaaaauuucauaaguuguuacacagcaaaaguucaggcugucagcacuuaaaucaaauaucucaaucacagcuaagagguugugcuucccuauacaaauguuaguaucaaaaaaccaaauugccuguggugguuugaauagguauggccccagagguuccuguguuugaaugcucagucacggggauggcacuguuaggagguauagccuugcugaaguagguguggucuuguuggaggaacuguaucucugugggugcagguucuggggucgucuaugcucuaggucugucagugugagagacagucuccuccuugcugcuuacaggucuagaugaagaacucgcagauauuucuucagcaucaugucugcuuguaugcugccauacuuccuaccauuauaauaauggaccaagucucugauacuauaagccagccccaaugaaauguuuuccuuuacaggaguugccuuugccacgaugccuauuacaguaauaaagcccuaacuaacacagaaauuugugcuagagacuacgauauuacugugguaggccuaaccauguuuuuguugggaagaauauggauuuggggacuuuggguuagaaaagcagugguaugcuuuaauccaagcuuaauaggcuauuugaguuuggaauauagaagacauguauggugucuuccauauuacuagaaauaagauacugagggugauuugaacucugugguccuggcuaaagagguuuuugaagaggauuuuaguaugcucucuauagaucuuucuugugauauuuuaaugaggauguggcuucuuuuugcuauuguccaaagaguaugccugaggcuaagaugaaaaaauuuagauuaauuacauuaguaaaggaagucucaaaauagacuaguauaaacuguucuauccuaugguucacccuuaugaagagcauuuugaugaaccaucaaacuuagaaagaaaaaagacaaaauguauaauucaagcauuaaaggggcaauaggacauaaaugcagcuaaaugcuguguucaaggauguaaacguauuaaagauauuaaauagaauuaagggggagguggucuuugaccaagaucucacccugcuaaguuuccauuuugugaaaacaaauuaaagaaaagcuuagguucuggcauggugguacauacguuuaaucccagcauucaggagacagaggcaugcagcucucugaguucaaggucagucuacagaggagauucuaggacagccaaacuuuggcagugaaggaaaccauugaaaacaaaaagcugugaaaacauaacacaacaagggccaucuucuagccccagcaagcagcagagcuuguagcuuaaggcacaugguucuggcuuuagaaucaaggauagaggaaagggguuacagaaucacccucugagacuagaauaaacuguuguagccaggcaugugucagggcuuucccugcauggaggcccagagaagccauuguguggagaugugaaggugaagccuagcuuucuuuggagaccgccaaggguuuagagaggccaaagcuauggaauuccugccaaggaaagcugcuaacaggaaguggcccaaguccaagagaaagaaacaugcucuagucaacaaagcuggaaggaguuggagaucugaaaaguaccgugacaccagauauuagaggugaagaguuuggaguuugccuggaugguuuucagucuuucuuugguccaggaacuccucggcaugcucccuuucuuccauuuaagacuaauguguauccuauacaauuauagauuggauauaugauauacuucuuuauuuugauuuugcagaaaauuacaguuuagagauuacauaagucucaaaugagacuuugaucguuggaauuuuuauuaaguuuaggacuuuuauagacuauggggacuuuugaaguugaacuuaaugcauuuaggauuaugguguagcuacaagcuuaugggauccagagugaaaugcaguagguugaauaggcauugcacaauagacucauguguuugaauacuuggcuauaggaguggcacuauuaggagguguggccuuuguuggaguagguguggccuuguuagaugaacucugucauugugggggaaggauuugaggacuccuaugcucaagaucuacccuauguggaagacaguccccucuuuggugccugcagaucaagauguagaacucucagcuccuccagcaccauaucugccuauauguugccaugcuucccaccaugaugauacuggacuaaacuucugaaacuguaagccagcuguuuuccauuauaagaauugccuuggucauggugucucuucacagaccauaggggucuauuacaacuucugcaaaaaagagaaauauucuacacuuacacugcccaaguagcagccacuagcuucaugacaugggauuacagcaaaugaccuguggaaguguccauuuuacuugguuuuaacuaauuucuauuugagcagcuacuugcaggcaacuucuacucuguuagaaagucuaacuuauagauaaauuaccucauggcaaacacaaaggcagaguuaaaauguuauaaauuaccaagagaaacggguauauacugcagaacacccuguaggaguacauuauaaaauucauggcauagcacuggaucuaacacuagaauaauuaucaaguaauaugugcaaguguguaaccacuucacaugcccacagcacugugcuauacauggacauuucacacacagauugcacauugaccacauuccuccuaucuuccccuuccuccugccucugcuagucccaccuuuucuguuuauuuguuuuuuguuuuguuuguuuuuguuucacauauacuuuuaguuuugaccaaaguagcauaagaauaguuuaaauaaugcaguuacauaaccuaagagucugcugcagcucccaggaagcugagacaugguagcccaaaaaaucaggcugccugucuucuuucggaaagucaucugggcuguucuugagucuauaucuggaugguccugggcuacuuuuuucuacuuuggguauucuaccuggaccuguuuaagcacacaugaagauucugucucugaccauguaucccccuacaagaguacugugaggucugaugccaagucucuucacaaaaguuuagaagucuucugccuaccagcuuuaaguguauaguccccuaauauuccccaugaguuucccaggaaggaguacucuuaaagucaaaauacugcaaucagcagaggacuuuugaaaaugaugacuugagguauauagaacaauugguagacagcuugcuuaguauuugugaaacucaggguucaucuacaagccuaucaccaaagcaagauuaaugccacaugucuaaaaucccagaaccuggcaggcaaagguaggaggagacauaguccaaagucaucuucaaacacauaguauuuagggcugcagaagaaccaaccuauuucucucucucucucucuuucucuauguauauguauauguauauguauauguauauguauauguauauguauauguauauguauauguauauacacacauauauauuauauauacacacacauauauauauuauauauauguaauguauauuacauauauauauuuuuaaaguguuuaauuuuccuuauugccaagucuugauguuuccuugaaacaucugccuccugaccuccccucuuuuucuucuuugcuuuccuucuccuuuugauacugcuaauaaccuuuaucucccuuucuuuucuccuuccucuuuaaaauauauguuaccaaaaauauagcccuaauuuucugaggcugugucuuaaaccuggcucccaccaguuacucucacaaaaguggguaacaccucagaucuuuccaauuccuccagauuccuauuccaaauugcuauuagaugagacauuuuggggccaucacccaccuuuucugauaccuguuauucaggguuucucaguucauuucuaggagauucaaguagaccauaccuacauaucaucuacuguauuggaaacuucaaaucucuccuguuuuuaaggacauauauugauaaguauagaguuccgguccaagucuuuuuguaagcugaugaaauauaauuuagcaaaaccagaagugaauaaauaaaucacugugaaaaaaaaaucuagauagcaacugauuauaguaugauuaaacaaacuuuguucauacuauuuuuuauuuuuuuuuuacuuugacuacagcugagauguguauaaaugaauucuaaauguucuuguauacauaguaaacccucuauaagcuuuaaguagaaacuguuaccaucaguagugucccuauugaucacaggagccacaguuaugaucucugaguaaaagagguaguuuuggacucaauauaaggauaagguuuguaacagagugaguucugggagaaugagagcaucuccuuucccagugccacagccaacagaauauccagaagaacaguaggaaaaauguuuguuuacagagcacuuacaaggugcagaauacuccuaugcuugucccaguuacaucucauuuaugcuucugcucaugcuagaaguaggcucugccuguccccauucgugucuugcuggcagggacugacuauuuagugaagauucuggagaagaaggucaaaacaaauggauuuggugguuauccuuuacugucuuugauauuccugaacuuugaacuuuauugagugaaugucccucaaugaacuaugcaagucggacuccuggcuggccaacacucagccaauagaaugucuuucuuuauuucacucaucagaaaaucauuacacauuuucuuucccuuucaggucgaaggaguaaacgucacaagaauuuaauuaucuguaggcaaggggaugauacgaucaagaaaauguugcauuucaaugacuccauuuauacaguuucaaauuucccacaaaucauagggauacaucuuccccaggcugccauuugaccaagaaaugucuaugguauaucuuugucaacauguuucagaauauaaauacaaauuacaaaaaguaaaguggguauaaaggcugucgucauauauuauaucacuuggaaagaaauauuggugaccuuauccaguaugacuguuauaauaguaauaaaauugaaucuuggaagauuacacuucuggucaaaguaguaaaaugugaccuuauucuauucaacauugacauuuauuauauuaauucauauguaaaaaacugcauuaaaaugauauuaaagcccugguuagaaaugagaauguucaagaacuucugaaauuagauuuaacuuuaccaaccauucacgcuauugagccuguuugaugcaaaucaaacuaaauuucuuucacccaucucugauuccguucucauuuuauuauuauuaccaucucauucacacagaauguauuucaucccuggugcuucuucaaacauuguauaaaccuaaauucauuuucaucauacucuggagggaaaaagauaacccacaacaaugaauauacaagccugacacacaagagcuagccaccugcucaugucaggaaaauuccccucaggccaauaaaauugcacugagcacaguacaacaucaguacucuaucaggucuuaggcaggcuacugaggcccaggggugaggaauccacagaaugguuggcccugguggaaaaagguauuauuuggggcuauuguauagauaaaguauuugauacuguugucaguuuucuuuuaagaaaccugucaagguuuuauugagaaauucuuuaucuacauguaauugggugcacuuucaguauggggugaguuaugaaauaacggaaggaaccuaaggcaaaacccauccuaccucaaaugaugguuuacuguuaaccuugguuugagcucgccaucauaaauccuuucauuccaaccacgugauaacagucugguuuauuucguuguuuuuuguuuuuuuguuuuuguuuuuguuuuuuuuuuuuuuuuuuuuuuuugucuuuuugagacaggguuucucuguacagcccuggcuguccuagaacucacucuguagaccaggcuggccucgaacucagaaauccgccugccucugccucccaagugcugggauuaaaggccuguaccaccacgggucggcaacaaucuguuuucauacuaugacaaaauaccaaugaaaagugaaaggagggaaaaaaaaucuguucucaccauggaagacuugaggcaagacuggagcaucauagugaaauaucaugcuagauggauaacucguaugcuucagagacuggagguacacagaaagaaguuguagguaaaauagauccauuuccuaugccuuggcccaccucccauaguuccugcuauuucucuguuguccucaggggacauuugugacucaaaauauaacacacugcuucuugccauucccacugucauacucagaaaaaauuaguaucuuuucuauauauuuccuuaucuaucucaguuaauacuauucucucuaaacauccuuucccuuuauaucucuauaugaagcuaagcaagaucauaauaauaugcaaucucucuaucucagucacuuacaauaaaaagguuaucuuuugcuugcuguuuguccauggggaagccaauagaucuacccuucccaccccuguuacauaggcauucagcuugaaggugcaaucaucaguuucaacacuguugagagucaggcuugggggaaagaaacucuucaugaccuuguauagaagcuaggagcuuagaucacugggucaguauugccacuucuagucagguagagcugcaauucucuugaagcagagagaacuaaugcauuuggacaacaccauaaaugacucaucuccauguguaccaaauaugaugauucuguccaaucuauaugaggcagguucuaccucuuccuaaaagaccuuugcugggaugaaaugguccauguggcugauguauagauuuuccucuucaggccauuaugucacuaugagaacaguguccccaaugggagucugugcuucccacaauccguuagcagauuaauauugccugagugauuggacaaggcugucugaauaaugagaguuucaucucugaagacuucauagacccugaagaccuguaauccuugauaaguaauaaaccauuuuuacuuuuucucuuauuuauaucauaaagaugcuuaaaacaacauuaaagugaucauaaagaggaaauaaaaaugagccauaaucccacuaccuuaaaacaacaaauguuuucauuucuuuucaauuucugccuguucaaagggcauuuauuugcuuuauggggcuguauuugcaauacacacagugggcagaggacuucuaaauggaauacaagucagcaagccucucaucuucccccaggcaaagacacaucagcuuaugacuuaagaccagacuguucuuugguagaauguaagugccaacaguuuuaagacucuaaagcugcuuaaugcaaucaccacacugggagacaacacuaggccuuuuccauuuuauccuugucuuggauuaguuuuagaagaagcugcuuauagaacaaggagcuuuggguucagcacaagaagggaaaggaggacaugcuaaauuuuggacaguuuuggagaagucauggaaauugcaaauuuccugcauugucugucauucaggaauuaauaaacacacauacauuaacauaacacaccucaaagcauucacuugacucucccuuucacauucuucuuauuguccuauaguuccacuuaguucauccaauuguucuuuauuuuauaacauauucuuacaauuuagguaauauuugaguuaaaacguuuucugagucaaggugaacacacacacacacacacacacacacacacacacacacacacacacacacacacacagcacauacauacacacgguauauuuuccuucuccuauguuaucaaccaagccgaacgcagagcugauaaacaauggcgagcaccacccuacucacugagcucguuuacuaugaaaucuuaaacugaguccucacagcuguucuaacacaagaaagaacaauccaacaccuugcaaucauauuaaauuucagagugaugacuucucaccuauuuucuauuuuaauaagugauagaauuuaagauuuucaagcucuaauauuuuaacauuuuauguucgguuucucagguacugccacaaauucauauaauuuauauucuuacauuuuugaaaggguuuauuauuuuaugugccaugguuauugaucugaaucaaaucuaucuuaccugauucaacagaaucgagugggaauaaaaugugacuauuuacaaauuuaaaacacugcuauaauucacauggcacgugccaagccuacuauauuauggauaguauuauuuauuuuucuaagagucuaauaauaccuaccuaaaacauaaacauucucuagaaauuugucagaauaagcacucaucgacaauauuuuucugugacuauagacaguugcuagcaccuuucucuucaauuuuuaugcugucucaacaaucaugaaacacucaugaguucaacuguuguuuuucugaguugugccuucaccaaggugcaaagcauuaaacaccuugaaugcugcucaaauauucuuuagggaggaauugugguugcaaaugaaagggaaacacuuucaagcagaaaaaguuacuugcugcugauaaagaauuuauaucagaauguguucauuuagaagaagaaaacaauaugaaaaaaaaucuaauaguaagagcuaguggggcacaaaauaacuauccuacccccaaaugaucauaauuauauauaaaauaugagacauguauuaugcuuugugcuuauguacccauuaucaaaugcccuguagcaaaugaccccaaaguccagugaccuaaguaacugccaucauguaucaccuauugugaugguugagggccagcaauuuugaaaagaaaaaaauguguauaagcacacacacacacacacacacacacacacagagagagagagagagagagagagagagagagacagagacagagacagagacagagagacagaaagagacagaggacagauauagaaaauaaaccaagcaaagucaaauuuccuuaaggauagagacuuuaaaacucugauaacuuuacuuuugccauauuccauuuauagaaaaccaaggaaaaucaagcaaaaacuaucuaugcuucaccucuuaaugaaagaguaucaaauagcacacuauaaaaggaacauguaggauaggcauguuagggugacacacuuuaguaaauucccauaugcaaaagcaguauuauuuacagagaaagggcacuauccaggcuucaauauuuacuagcuaucuaccgcaagccuaacacuaugcaggacauugaagaaaaaaauaucuccuaagauaccgccuaugugcccaacagcucucuggaaaaugcuuccaaccaaauacauuuucuagcagcagugcaaagagaaggaagcuuaggguagaaccugaaggaacuguggaaugauacagaguaacuuguguuaccucccaaggcauccaaaugugggcaggggcuugaugaugugcucaguccacuugcccacuuuaucuuugagaaaacugcccugaacaagugauauauaaacaucucaaaauauccagaagagggggcaccaguuuccacucagugagccacaacucaaucccacaaacauacauauucaaaacagauauucacuuagauaugaaaaaaacccaccauuuugaagcucaccacaaauacuggacuugcgagaauacagcaaaacauccugugaauuauuucauuaagugagagugauuccugccuuugaaugagaguucgagguggggagcuuggauguacaagugggacaguauguaggagcauggccuccuagauguauuacuuuugguaaacauuguaucacuugugccuggguauuagcauccauaaauggaguaacaacgguagcucccuccacccccaccccuucacucugaguugaguuucgaagaauucagagguaguaagugcaaaguugucagcacagugccugacaccuaauaauaugucaccuugaacauggcuuaauguugcucuucugauucuuccguagcucuuuauugacgugauauaaaaugucccggaaucugacucuucagccuucuugggucacuaauaauucuaugaccuugaggacuacacuuagcugcacaugaccuuguucccuuaacuaugaaauuaagaacauucaucuaagucagggaguguuaaaucuguucugagaaauguugcuuccaaguaaguaggccaagcugacagagcccugcaaacuugucuguguucaucccacuggcuucgaucugauucucagaucugagcuuugauacaagauuaugcucacacuaaggcuuuucacacacacacacacacacacacacacacacagaaagaaagagaaagagagaaaagagaaaaagagaaagcaagagagacagauguauauagagagacagacagacagacagaguucauaggugaguuacuagaguaguagguaucaucuacucucucaacccaaauaggggcuaauuagggucaggaagcuaaguagccauuuaucaccaacucacuucaaguuugucuuauuuuugaaaccuguacugaaaccugcugcaacacagcacaaacaaacgauagccccagcucauguuugcacaguucagccuuuuacaaugggagaaggaugguggaaauguuucaggcugcacugucccaugggagaucuuaaaaucagauaggcugggcuggaagcauuagcucugucaguucuguggucauaacuuugauaaagcauaucacuuuucagagucaacugucuccaucuaugggguagaaaagauuaugaacacucacaaauuuguaucgaagagucauguuauuagcuuuuuaacuugcuuaguaaauauuuauggagaaccaaauacguuguuucaaaauauaccagugaucaaauggaccaugaugaaaacaauaaaaaaaugcgucauuauugucauuaucaaguaucaguguccauaagaugacuauauauauauaaaacugcaauuacaaauaugcccuaauauuaugauuucuuaauaaaagcucauaucuuucuugcuuggcuuucuucauaguaugcuuuaauguagguggacuaauagcuaaacuucauugccuguaaaucucccugcuuucucacaaacaucucuuaccaaucauuuuauccuaggucugguuccuggcucuugugcgcucaaaaucuguucaacugguucaguacacuuccgaacucagaacuggguuggcugagucuaugucacaaagauuugggauuaagggagauaaggcugagggagagauucugggucagauaagaccuaaaggaauaggugggagaggggugaucuggaaggugguggaacaacucuagcaugcuuucauguuggcauggacaauggaaauaugcuuucauguuggagaagaaauaaggccuaggggagugaacuggcuauugccauuuugauagauacuagggcaauuggauuuccuuuuaguugauucugaggagcucugaaugcaacuguggguggaaggcaucuggaagcaaaaucuguauuaggaacuccaauauuaagacaugguugucugaaaagcuccaaaugaaaguuuacaaaagugagaaaccacuguuguuagauuuguauucaaacuguagcucugaaguguuuucuaaauagcuaaagcacugaugcauucaaaauuuagucuuaaaccagaaguaucaacacagaaaagcuuuuuacacaccauuguuaaagccaaaccuucagcccuuaccuuuuaaccugggucugauccucagacccaaaagaaaacaugagacccaccuuacucaagagcucggccuacauaggggccuccaauuggugcucagggguuacugguaccuugaaaaggagcucugagaagagaagcagcucaagaagcaugcugcuucuuccuuugucuccuuuucagccaaagguuucucucugcuacagcguauuuugggaaaacaccagagcccaguaaaccaagcacuagacaacacagccagcucugcagacucaagcgcuucucagcagaguguccaguuaauuaaccacagaccuauuuacacuuaggccaaggaaagaggcaaagaacacuggcucagaacucccucagagagcaggucugccagucauagaaacuucauuccuaucagcucccaaagaucagagcaaagagaagugacaucaaccaaacugucacaggcagaagguaccaaauaaaaaauacuuagaaaacacagaaggaccucaaguugacuucuuucuguccauuucccccauuuaguucaugguuuuagcaauuaguauuaaaaauggucccuuuaacgcugcccuaauauacucacuugaggacaaauuucaccagaaaagguuggaguguuaugcaauuaaaaaaaaauucuauucaaaaucauuuuucucuagaaaaagucucauuuuuuacucuucugagucccuauuucuauuucagaacaguacuaugugcaucuuuggugauggagcacauuuuaaagaugcugacaacaauacuacaagcaucuuuccacagauccucugaggaaacuuacuuuuaccauauauaugaacauuaccaacuguaacuaacauggucugaugucucucucaggccucuuggaacucuuuuggauucauuauauuuagggaaaagguaccauaacuauaucagacgcuacuccuuuggaggagaggugaguccccaaaaauuccauuacaaauaaacuuacauugacuaagcaaauaauuccaucaacuggugaccaagcauucaaaucuaugaguuuauggaggcuauucucauucaaacaacaaaaccuaaccugugccagguucuaugcuagacacacuugaccaaaagagagggaaaucagagauucucugcucucuaacaugccuugucuucacaccagcugucaugucuuagggaauguggacugauuagagaaccaauauuccaaacaugaaccaccucagcaccgguucuguucuccuuugcucugacacuuggauguuuacagagcagagcugcagaaaggacaacuuaaugaugcucaggggagggcugugggcaagucaccugccuguuuagaacaauggguucaguguugaguuagcaaagauauggccagucuacccacuuuuuaugacaccacacccacaacaauuuuuuaacacaauuuuguguuauuaaaugaugaugaacguuuuuguuguucgugaguuacucuuuccaacaccccuguuuuggcauugcaguggcuauguagauauaaaucagcuacacuuugaguuccauuuuacagaugagagaacaguggguagggaagaccaucuaccuugcuaaaguaaucagcuccugugcacugaagguuaaggcugagccaggcuauggagaaaacaaaucccuaauuuuggagucucuuugacccucagaauuucuggcaacugccuguuguguguaugaguauauauagggagacacacauguacacauacacaugcaaacaugcauacaucauacacgaaugcacauacauacacacauauacacacaugugcauacauacaugcacauauacaaacacauauacacacauguucauguacacuuauauacacacuugugguauauccaugaaaucuuuauuuuuaugcuaaaauauaugacuaauauuagucccuucacaauaaacuaggcacuaauuaaaagcuuguggcuuuuguucuuuucuaauaucaugugauguaaugacagcaagauucauauuugugguguugaggaaccaugguguggaagagacaaggcauaaaccuauuuaauuagucagaugauuuuagagcuucaaaauaauaaaauagaauaauccagaugacaggcaacauagcaugugauauuuaacauccacucaaccucaaacugugaagcagagacacauauccaaaauccaaugcuuucaauuuuucucuuuuaacuguuauaagucaaaaaccagucauauugauuuuucucuuugauuucugcuaaaauguucauuccugaacauauuacaggugcugcuuuauagcacagaggaaacuuauagccaaguaaaacccuaaaaauuaagaaaauauggguuugccagauaauaagaaaagcucugacagagcuuuaauuauagcaggacaagucuguguugacagaugaguugucuucaugaauuagacgucaagguuucagucuuugauuaacuuuuacccagucguagcaaagagaguuuuaggacagugucuuuaaaccuugaagugaaacagaauguucagaaagccugcagaagccccugaaacugcauuaauccauuguggcucugaggaccagggaugaagcuccucuacgguccugcauucacgugcagcccucuuacacuucacuguagccaucucucccugccaaugucucaguaagagcuggugauggagggagaggggcaggagcaaggccaaaacaacaucuggugagguccacaagagcuuaucuaucugauagaaaggcgaagcuuuuagcagaaaggauuuacuggauuaugcuuacgacuaaauuacuggugcaaauaagacccaaauugacaccauacaucuagugugaauaccacuagcuuucuuauugguuucucaguuauuuacauguauguguauccugucugucacuugaguucacgugcauguggaggcaauauaggcagugugaggcacuuggagaugguaauagcagggaaucacaugaagccccuuggacauuacuaguuccagggcagcuaguccugggcuaucacacaguuuucccacuuaaaagacacuguucaugaauucaagaagagugugguaguugauaucacuuugacuuaaaggcuuaucugcaugcuuuagccauuuaaauuagccuuggcaaaaaucagaagugaggagagaugaacugagagaaagagacagaaacagugggaaaggaaagcaaagaaggaaaggaaaaaaggaaagugacauaaacgaguuccuaagcuuuaauuuuacaagaugacaacauucuggauaaauguugcacagcaaggugaaugaauucaaaacuauccaagagcacacaguaaaaaagguagggggcaaacuguauuuuaaguauuaguuauuuaauuuaagggguucauaguccugccacauacuccaggcuggucuggacuucucuguccucuguucagcccugagauacugagaucacagauguguauucacacauuuguugacacuauaagaaaaagaaaaaaagaagaagagaaaaauacuucuucucuuaaucucuguccucucaccucaucccaggauacgugcuucuaguaugugggaugguagacugaaccagagaccuggcagaagaucgaacuucaaaacaaaacaacaagaaaaacaaccaucaucaagaaaaaccaccagcaucaaagaccaaaacugaauguggggauaagagguaauaggauuuagaugacuuacaaaaucucagaaaaucuaagauggagaacuggacagaaacacuuugagaggcucagcacauagaaaggaacaugauauauauauuuuauuuuuuccuagaaagugagguuaagauggacuucuugcauauuuuacuaucaacccuaaagggguaggcccaaauaaacccuuuuaauauuucuuuaucauuaacgauaagcugguauuucuauauguauauacaaauuuacauuauauuucugcacagaacuucaaauaugagugaucugggcaucagauuccuauguaaauuaagaacagaauugaacacagugggaccagaugaugaagcugcuucucagguaccuccuuugcuaguuucuauuuccuuuguuaacucuguagacauucuucauggaccaccaugaucauccuacagaacuuaaugcugaaaucugucaaaugcaagguacucaaggaacagguggguuuccaacaggaugccagucaguucaguuaugccagcuguaucuacacacucaucuaugucaacgagccuguccucagaguuuacaagcugggaucaaaggggccucuggaagcugauggcuaaggugcacacagcaccugucugaaguauauaugacuaucucuggguaaucucaucacuuugcacauucacagacacuaggacuuguucacagauuuaagggaagaaauaaaaaaagacacguagaccuggucucugcuacaucaggacgcaugaagagaaacgcucuucuccagggagacaggaguggagaggaggggacaaagaaagagaagaaaucauuuaagaaagguaaugauguucauaagaaaucaguuuuauccacaguugggguauggagccacacacucaucucuaaaguuuuaacccagaauugcuucuaucuaaaggaaauauggagccaaaguguggaguagagacagaagggaaggguuauccagagacugcuccaccuggggauucaucccauaugcagacaccaaacccagacacuauugcagaugccaaaaagugcuugcugauaggagugugacagaaccugucuccugagaggcucugccagagccugaaaaauacagauguggaugcucacagacaaccauugcacugagcacagggaagucaacggaggaguuagagaaaagacugaagcagcugaagcgauuugcaaacacauaggaagaacaacaauaucaaccaaccagaccuaccaagagcuccuagggacuaaaccaccaaccaaaaaguauauagugcaacccaugacuccagcugcauauguagcagaggauggccuuaucuggcaucaauaguagaggaggccuuugguccugugguggcuugaugccccaguauaggggaaugccaggguagugagguaggaguggauagguggguggguggagggagcacccucauagaagcaggggaaggggggaugggauaggggguuuguggaggggaaaccaggaaaggggauaacauuugaaauguaaauaaauaaauuauuuaauuaaaaaauaguaaaaaaaaaagucagaaauaguaauuaagucauaggauugguaggaguuuuucauguuuuuaagucagccacuuccuuaaaaaguagauaagaacauccuacacuuucuggcagugucuguggagggccuuucuaugucugguguuggugacuaguucuguaacuucucaccugacagaauaaacagcugcuucaggcccaaccaucccucucccaugucacaagguuauacaaguccaaggaacuaagcauacaaacagaaagauucucagcaugucugcuaagugcccacuuucaucuguggaaguagcuaacuuaaauacauucaggaauucacauucucccugauaauuugcuaacaaucucuugcauguuaaaauguagccacaucacaguaauauuccaccaaauacagccaauuagugcacagcaguacugucuucaagaggcuaauucuguucucaauuuaacaaagucuuucuacguugcuauaggguugcuuugugugaagcuggaguucagaccuagcacuagggaguuggggguuagggcuugcaauuguggucaguuucucagugcuucuugaugcccauuuauuuugucacuguuccauuacugugaaaggacaccaugaccaaggccacucuuauaaaagaaaacauuugacugggagcuuugauugagaguuucagaggcuuaguccauuaucauccugguugggagcauggcggaaggcaagggugauguuugagaaguggcugugagcuucauucugauccacaggcaggcagcagggacagaaagacuaguccugcucuguguauuugcaacuucaaagcccaucucuagaagcacacuuccuccaacaaauccacagcuccuaauccuucuaauccuuucaaacaguuauacucccuggugacuaaccauucaaauauugagcuuauggacucauuauuuaaacaaccauaaugguuuacugucccaagggcacuuugauauuacuaaugccuaaaagaaaacacaacuaagucaugguuaguauuagaacuccagcaaugaauuaaaagccaaacucuuaagacugagccacuaaauaaugggagaccauauaucauucucccaaaguaauuuccuugucuacaccauuagacuucucuaguuccaagcuguacugugucaccuaaaacaugauguaacacccuaacaaauggauaacuaacacauauggcccauucaguucuuuauucccauauccccgacuaauuuaguaaguagguauaguuagcauuuaccacuucacagacaaaaaaguaagacacacuaaaagaagcaguaaugagcaaacuggacuuaaggaugaucuuauuugauucuggaguucugacuuuauaaucuuuuucucuugccauugagaauuggaauuaagguguuuaaaaugcuaagaaaauacuuuaucacaaagcuacauucccaguacagacugaccugaaauugugauccuccuggcucaacucuuggaauggauaggauuguagacuuaugcuacuauacacaggucaguguuuggcucuuaaugugguagugccucucacuguaucugcuauauuuuuaaaaugaggccaauuagcucacuaaagaugccuuaauuagguauuauagacuggguuuaagaaaaaaagaaaacuugggguuaggaagcuggcuuaguugguagaguauuugcucuacauguaugaggacuugacuuugaacucccacuaaccauauaagaacauuaccaggcauaacaaugaaugccuguaaucuagucuuugggaagaagagacagaaagaucccggugaccugauagcuaaccaguuuaaaccaucaguaaguuuaggcucagugagaaaccauauuuuaaaaauaaaucaacucugaccuccacaugcacacaugaauaugaaaauacacacagauacauauagauacacauauacauacacuaacacacagaaacacacauauagacaaaugcucuaauguacacacagacucauacacauaaagauauacauacagauauacacuaacauagacacacauauaguaacacacucuuacauacacuaacacauauaaacacaaaugcacagacacacacagacagacacuaagacagacauacacaccuauacacacacacacaggagguuaaucaguuuccuauuccuggggaggaugaaugaacaggaucugcagguagccuucccugugaaccuuguggugucugugggaaccuuggucccaccugugagcuuaccauucagaugggaaagacacccauccuaaaguucucuuuaauuuacucuucaaaaaacuuaugucugauauacucccauucugaggaacuaucgaguuuaaaauagaucaaauuacaaagugaaauggaaggaaucacaaacucaugaagccauaacuacagggccauguauggauccuuccuuauucaacaggcucuggacuugugaugcucagacacaggcagaaguucucugauaguuugacaaggauagucuugaugacuuuaacuguagcugcugacagccaacaggauuucaguuuuagaagaaacuucaaaacaaagcauuugaaaaucacaacacaaauauacaauaccucauugauauuccaguugugccauuguuugcagugggacuaaugcuacugauuuuuuauuucuccccaaacaucuaaaaacggggcucccugaggggucacuuaguacagaacuagugauacuauuuuuuauccuugcaucauuacacuuuuguaaucuauuacucaauguaugaguaguucuacauucugaucuuuugauauagucauugcuaccauauguagucauugaguacaaauagaauaauuaauuaucaauuuugaccuacuuuuaaauaauuuauauuaaaacuugaucuuuguauacaguaauuagacuaccuuuagguguuuauagacacauuuugauuguaagaaaaccagugagauucauuaggacccaugcaucugcuuuuguagguaucuauuuuacaaaacuuucauauagaucagcuauuuccaauaaagaacuaucauccaaccagagacuguccucuaagagcauaugcacaccccauauggaaggugauacaaagaaagaacaacguaagagaugucagugagaauauuuauauugauaaugcacuggaauaaaguagaaggcaaauuaaacaaaacacacuauuaaugccuguaucuaucuagcucauuacuuuuguggaaagugaaccaggauuuuuuuuuucuagaauuacaauguaguuacugagagccuugaaccauggcuauauauguuuauauugggcaguacuagucuaggacuuaauacugagucuuaaaauucuucuccagaaagauaaagagaauuuuacuucuccauuaucuucuaauggagauauuuuguucugaauacuuuacuauaccaaacagcuugugaaaguccucuuuuacauauccuggauaaugucugcuaucugacuauuuugggucaaucugaucuauaaaguauuuauaauuuaaaugauucaugucuccgaaugcuaaugaagaagccuacaaucccagccuuccagauguugaggugagaggaauauaaguuccuguacuauucaaucagacuccgucuaaaaaauguuuuaaaaguuuacuuuuaucaacaauucauuuauaugauuugccuauuaaaaauggcauuugauauauuugaucccucugaccaaagaugaagcaucacacucaagaagaacauuugcuuacaaugauguaugcauaaauccaggggguuugaagacuuccaugcuaaacauauccauguuauucuuaagugucugguccauacaauccagacaaugaauuuuaaauuucucucaguuacucaaaauuuucacugcauuucuaguggcuuucuuugguuucuuuuucuggguuaucucauauccucaacuacuuuauccugucuuuaaggacacugaccuagauucagaaauaucuaaaauuuuucauaaaaccugacagcuaagacauccucaauaaauaaaccccuuagcuggugacauccuagaaauuugauucagcauaggugguggcuuauuugcccaaaggcuacucuaaagauauuucaguuaauucauguauucaaacaaagcacacugaacuugucuuuuauuugugguccuggccuagauuugagguaaccaacaggggaagacauaguucgagcccuugaggguuccuacuuagauagggaagacagaugacagacaauuucaauuuuaacacaugccaucaaugauccacugaagaaaggaacugugcaggaggaaaauaucuaacaggaccuuuuggcaugggaagaaagacaggugucuaggagagaauuguguaagggcugaguccuaagaggcagguaguguuaaauuaaauuaauuugacuagaagcuccuucuaaaacuugagcucauauguaauuucccauaacauguaaacaaacuaaaaaccuaauucaagagugcauuuuuuaguuauaggcaaucaauggaugcuaagggaggauaaaucaaguuucuccaggcaggaaccccaaucacagauuauccaauaccaacaagacagaccuaaccccaccugaaacacuaacuggacucuguagguguuacauauguauacauaaguaacaaugaaucuagauggggguugcuagaggaaugaggagcaguagaaguuauagguauaaaguauauuuauauaugaaauucucaaaaaucauuuuuaaagaccuguaaaauuuaucugagucagagccaauuacagaggucaaacuaaaggcaacaauaggcugcuaccugaccaaaccaugcaggauaagguaaaggccaacgcauggccccagagccauuuuugugcccuacauccaccuacugaccuuagaugccagugcccauguugaguagcagaguucucuguaccuuuucagacccuucccauggccuggcuugcaauuccucuuugcuaaaacuaacucaguaaaagcuagcccuuuguaguguuguaguuagcaauggaaaggaaaagugggguuccuggaaaccacucuaccaccaacgcugggaccuauagcucaucuucuccucccccaggaggagcauacucaaaaaagaaccuucugaucuuggagcaagcccccagaucacagcagccucugcuccaguuccccgcagucaccagugccucuuagucuacaacugacagauaaggcggcagcucaauuugacuuucagauauucgucuuucauuuuuuucuuuaugcuuccugcaauacauguuuguuaccuuucauucaaaaaugcguaggauacugggaugauggucuaauccaugaggugcuugcugcccaagaauaagaaccuauauuugaccuccaaaacccacauaaaaaaguccagugugcugggacaugcuuggaaucucaucacuacaggggucgggacaugaagaucacuuggccccaagucagugagagguagguggcaccugaggcacagcacccaagacuggcuucuguucuugacuugaauacacacauggaucugcagaaauauaugcaccugcauaucaugaacacucauacacauguguacacacacaucaugaacacucauccacaugugugcacacagaaaugcguguggcuacuauuaguucauauaugggaguauuuauguaugcauaaagugaaaucucugggauggaaaucaaaucaaaacagaagauuuaguuacauuucacacauauacaaaagccuagaguuauuuuauucauagauuuaauaauaacauuguuauuauaauaauaaaacauuggauuauauuaguauauuauauaauauaaauuguuauuauuauaauaauauuguauuaguuacuugucuauugcugugauaaagccucauaaccaaggcaacuuauggaagaaagagauuacagggcuugugauuccagaaggucagaguucaggguagcagagcagauagcaaguggcagguggcuggaguggcagcuggggcucacaucugaaaauacaaaugggaagcagagaggggucccuagaaagacacauggguuuugaaaucuccaaaccuucccuaaugacacgcuucccucaagaaagccaguccuccuaaucuuccccaaauagcuacccugcuugggcucaaauauucaaauaccgcagacuuauggagugacugcucauucagaccaccacacguguacaugcaacagaauucucugccguuauaucaggccagcauucaaaacacucuggauugggguucuucagauuagagauaucuaaucuguauuuccaacauaauggaaauuaucaaauaucuguucuuuaucauaaagggcaagcuaugcgccuucuguuuuuauuuguuaaaucugacaacucagggcacuuacaauuuaauauuauacugaaacaauaucauuuugugaucuggcuuuucgguuuccaauuuccccccauagccuucuaugaguauauaugcuaugcuccuuucuaccccagcaacuuggauguauguuuguguuugagacuuuuuuuucacuaggaauacggguagcaggguagugagauagcucagugguuaagaacacuggcugcucuuccagaggucaugaguucaauuccuagcaaccacgugguggcccacaaccaucuauagggguaucugacgcccucuucaggcagguggaugucuaugcagcagagcacucaaccaugaaauaguuaaaaauaaaaaaggaauauggguaucuucucuuuuuucuaggccauucucuugagggccuccacuaaaggaguuagacccuugcauguguucauccaugauuggguucucuccgguguugcuaaugcucauuucucuuaaaccuucucauuucucaacuugugagcugaauaggggaaagcaagcugucugcaagacauugcuauauguaagcauagucuggagacugggagacuggaaagauggucaagacccugccaacauuauggccuugggaaccaccucuaggagcacauagaaagugaaaguagugccugccauuugaugagucuucuuugaugauuucucuguuacauugccucuuugagucuuucuuaacuaaccuuauauauugucugcagauaugucuuaguuauugcuuuacucuugugaaaggcaccaugaccaaggcaagucuuauaaggucaauauuaaauaggggcuggcuuauagguucagaaguucaguccauuaucaucaaggugggggcaugguaguauccaggcaggcaugguacagaaggagcuaagaguucuaugucuucaccugagggcugguaggagaagacugacuuccaggcagcuaggaugaggguguuaaagccuacgcccacagugacacauuuccuccaacaaggccagacccccaauagugcaccucuuugggccaugcauacucaaaccaucauauucugcucccugagauuaaaggcauguacuaguuugccugggccuacccaagcuuuucauggcuacuaugcuucaaguuuuccaugucaagaucuaggucagaugccugugucuuucagccucaagaucuggaccacaggugcguccuccauuucuggauuguaguucauuccagauauagacaaguugacaaccaggaauagccaucacaucaguaaaaucuugaacuauucaacacagaaaaaauauuuucuuaaaaauauacacauucauaaauaugcaaagucuccagccuuauuauuuagcauaacucuccacaaccccacucuaauaggcacuucacacaugaaaucugaagcaauagccauuguauucuuccaagggauaacuagaggggaggaggcauggauaucagagaggagaacauguguaauuauuuuauucaauccuugagaaaaaauugagcuguuauggggaguggaaucagcuuaauuugauaacagcuuuacauaugaauuauuuagcuuuucuguucagaauguuuuuaaaauuuuggauuagauucaaauuuccuuucaguaccaaaugacauguuugcaaacaauuacuggaaagaaaaauuaauauacaaaagcagaagaaagacgaaaguuuagagagcauaaaauuauugaacauuaugaacuugaugaaggugaccuggcucugauguaccagccucuaccccuauucuagggaguggucccaugagaacauaaaacucuaugguucaucauagugaaaugagcaagucuauucaguacccugcaagcugucaauuacuuuccauaagaauaacacaaagaacacagagagucuguaugaauggcuuguuaauauccucgucaguguugacugaguucucagagugucaagggcaaggacaggaguuaauaggcacuguguguuguggcaauggcuacuguugacugaccuuuggcccuccuuauauaccagauccuuauauagaaaauuuaaaaauguuguccauagcguauaaaagaauaauguuauuucauuacauaucacuugugccaaaucugugguaaugcucugacugcuuauaguaagggagcaaggaaguaggaaugguugcauuugcugcacacuauaaacuaucacugguacugagguuguguguguguguguguguguguguguguguguguguguguacaugcacauguauacucacuagagcaggugggacaguuuuacaacauaagagaauggaaauguucugucacauggauuaccccauucugcaggggaaagucuuacauuuuucacaucucagauacuuuucucaugugccaagaaaaguaugcugcucugugccgcauuaaccacuuaacacuuaggugcucgugcacaccaucaggguucucaaaucagaucuuauugucagcucaacugucuaguagaaaagugacucuguaaguggguuucuccuugucacuuuccucauauguugguacaugcauagacacauguauacauacacacacacacacacacacacacacacacacacacaaucacacacacacaaacacacacacacaaacacacauauacacacauugccaucugaccaauagcagcugaaagaccuuuuccuucuaagucucagacauauuuuugaagauccuggucaauucuuugucauccugauggugcaauacagacauuaauugcugucauguuugcaccaagaaaaauuauacugaaaacugccaaaagaaagcagagauaaaagcagaauuuucccuguccugguuaucugaaaaaugccacacaaaacacucaggaaaagguuuagcaucaaguuugguaugaugagacaagauucucucuguagagaucaggcuggcaucaaaggaaugguauccuugccucucucugccuucuuaauacuaggguuuuagagaauuggccugaaaaaaauuaauucauacuugaaggccaaugugccaaagggauggauguuuuacguaacgcaggaacaaacuugagauccaacagguaaaugaacaccaaaagcaauaaaugcgguucuccggggagcucaguuugaaucaugcccacccugcaugugcugcaggcccuuuccaggcagcuccaugcauguaugugauuugugcuuccuuaggacucagucauuucacagagcuggcucugauggacagaguaagaaagaugaagauaaacagacaggaauacgugcuuaagacaugaaaggagcugcuuuaugcucaagcaacucucucugcuaucuccugagccccugccccucacccccucuuugucacugguggcauguguaaagagagugagagugagaugcauauucugaacacugaccacgaguuaugcuauauauaccuaugcauuauuuucuagaaaccagagaacaaaucuuuaagagggauuguuuuauccuugugauagcugaagagaaagcucaggaaauuaaauuagaauccaaguuccagcagugauaugaguugggaacaagaccaacaauguaaguccuguugaccugucaucuuauaaucauuggugccaacaaguagcugccacaguaucuugcccauuagagcccaguuuuaaaugcuagucucuguacacacaguauacaacauacacaaacauggaauauuauucagccuugaaaaugaaugaaaggcugacauauuacaacaugguuaaacuuuaaauauguuuacuaaaauaugacaaaccaucacuugggagauagagacaggaaaaccaggaggucaggguguccuuaacucuguggaaaguuugaggccagguugggauacacgaggauuugacucaaucaucuuacuucccuaagauuuaaaaaaaaaaaagauuuuuacgauuaagaagauuuuaaagaaaacacuuugugauguagcucuauaaugaucagacucauggaaacuggagaguacaauuuagguaaggagugcagggaaacaugaaaaagggaguguagaugggaaugcauaucugugugugugugugugugugugugugugugugugugugugugugcaugcacgcacaugugcacacucuuggaauguuagaguccuagaaccaaaauuguuauauaacacugaaaauacucaaugucaaugaaugauuuucagaaaauuguuaagauggcaaauuuucugugaaguauauuuuacaaucuuaaugaaauauuuccugcucuuuugcuuauuuaggagcuauguauucccauauuauaaggcucuucauugaaauccugcucugauuaccuauaaaugacaacaaggauugucuaagcuagaaauaucaaccccaguccaacauuagaaaccacaaagaugguugguugcuugaagaaaccccuacaaaugugcccaaguccagcaggaaggaagaacaugacagauuuguagaauugacucacaacaugacauaaaauauuccauaaaauacaacaaaauaugcucuauuguccuugaaaguguuaacuggaaauacaucaaguggcaagaggucagguuggaaggucuagguuauagacuggaauggccaagugcaagcccacguucccaacguauagaaaugaaguaagcaauagaguccaaccacuguaggggaaauagcagagaugccccgcauccaugaggcucagggcaccugcacacagacuguuuucagcuuaagguugcacugcauuuuccauaaaagcuuugaugcagcuauauaauaacuuuuguuuccuuucacagaaguuuacugucugcuuguucaguacaaaccaguguaacuucaacaugauccugugaggaacuccuaugguguauuuuccauggagaucauuuuuuaaauuguauuauaauauuauagcuauuugaugcauauacagggaugugagaaugaguccauagguauuauuauaagcugguacaacuguucuagaaaucagccuggugguuccucagaaaauuggaacauaguauuaccugaggacuaagcuaugucacuccuggguauauacccaaaagaugcuucaacauauaauaaggacacauucucuacuauguucauagcagccuuauuuauaauagucagaugcuggaaagaacucagauguccuucaacagaggaauggauacagaaaaugugauacauuuacacaauggaguacuuacuacucagcuauuaaaaacaaugacuucauaaaauucuuaggcaaguggauggaacuagaaaauaucauccugagugagguaauucaaccacaaaagaacacacaugguaugcacucacugguaaguggguauuagccccaaagccugggauacccaagauacaauucacagaccacaugaaguucaagaagaaggaagaccaaaguguaggugcuucugcccuucuuggauggggguauaaaauacucaugggaggaaauauggagacaaagugcagagcagagacugaagaaaaggcuauccagagacugccccaccuggggaucuaucccauauacagucaccaaaugcagacacuauuguggaugccaagaagugcaugcugauaggagcuuguuauagcuaucuccugagagacucugguagagcuugauauauacacaggcagaugcucacauccagccauuguacuauuguacugagcacaggguccccaauggaggaguuagagaaaggacugaaggagcuaaagaggaagaaaaauaauaucagccacccagaucccccagagcucucagggacuaaacuaccaaccaaagaguacacauggagggaccaauggcuccagccaaauauuuagcagaggauggccuugucaggcaggcaucaggggcagaagaggcccuugguccugugaaggcaugaugccccaguguaggggaaugugaggguggagaggugggaguaagugggagggugagugaacacccucauaggagcagagggagggaacaugggagaggggguuuccaaagaaaaaccgggaaaguggauaauauuugaaauguaaauaaagaaaauaucaaauaaaaaaauuguacaccacacacuuuuucucuccaguuugauacauagcacaucaacauuuuuggggagaaauugauauuuacccaauucuuugugauugacaggacuauguuaacagacaagugauaaaacuagccccggggaaacaagaaaccaccaugaaccauaaacaaaaaccagggacauacugaaaagcauaauucauauuuuaaaaugaaauguuuacuaaaauccacauucaaguuauaugaaaaaaguuuucugaaaaacaaaauuccuucaggacagaaucaacuuccuagcuaugaaaaauccaauuaaaaugaauuuauaucauaaaaucaauacucagggacuaauuacguauuacuaaauucaguguuauugauuauuuagagaaaacuauguuuuuauauguacugucuaauacuguucucuauuccugagaacuugcccuagauccuaauagcacacaguuuauccagugacuaaucucaugcauuaacuacuuuacaugccagaaauauuagaauacugccaacuguucaagauuauuuucaauuauuucccaaaguuucucccaaaagcauaccaccuucuucaauaacuuagauaaaucucaaugcacaugugggggaacuguagacuuuucagagaaaaaugagauuuugcacugcaaggaucuaguacauagcugucagccauuuuucaaaaugugaaaauggaguauaacuuuuugccccuggugugaaacuaaaugaauguuuuccuuuguuuugauuggaaaguacuuguuuaaauuuaaucauaaaaagacucuuguuucaauuuccucuauuaauuacuuccuaagguaacccuauucugaaucccgggcgcacaggggcuguucauuuuucaaaguggaaacaagggugagguagacagggaaaggagccacuaggcggauaugagagcuuccaucucugaaugcaagaagggcuuucuuccuggcagaggaaaucaagagggcuucugguugacacaugaugucaacgcauuagcugccauguucuacuuagacccacaaucacacugaauccugugucuuucaagaugacaaauaacgagaggaggaaagggcagcaguccugggcaucgugucacaagagucccguggaaugacaccuuucauaaaagcagcaucaauggucugagagcagacacacaggcgccacacggaggaaggacucaugaaaagucagagggagacuuuccagagagagacagaaggccauaucucugcccuacacuccaaccucaaguucacaucacacagccucugacaguguucuuuggcagcccacggcuuccuuugguuugaauccuacugugucccuguugucugaugaaggucgcuuuccuauuuuauguucagucccccaagaauggguuucccccuacauucugaaauaagaugcaaacagaaagcauuuuguaguuuugcauuucaauuuucuguuuugucagagaguaauuauagcaaauaaaauauuacagcugaguguaaauuguuaggcaacgagaucacaccaggagauuuuucuuccacaaguuuuucaucauagcaucuuaaauauuaaaauauugcaaggcaaguaaacagagaagcuucuuugcucgaagcauuaauuuuaaaugaaauuuucacuguuauucugaucagaugcuacgaaacacaugauguuuucuuucaaaugaauggauaugucaucugggagaaaagcagacagaaaaucauacacacauaggcaugaaccacacuggagacaaguuucaaccugaacaggcagcaggucugguguaggagagugagaaaaagaaagacucaaaggggaacucagaaaaaggaaaacaaacaagagagacuuuuuuucuaaacaacaauagcaaaacaacaauaauaacaaaacaacaauaauaauuuuuaauaaagauaucuuucagauugcaacaucaugcuauguaguugaugcuugucuuuccaauguuuaaaaaaucccacuaagaugcaccacuccuccacuaaaucacugaaagagaagaaaaaucaaaagaugaguuucuuaccuuacaccaggagggauaaaacuuauuuuuaauaaaagauaauauucuuucuuuuauaagagcaauggauuuaccuuaagaagacauuccacauuccucuacuguauagcucaaaaccaaacagcagccaauuaaaacugaaaagaacucugggacauggccuucacaagggaaaugcucaggcugugaguuaaagaaugauagcacauuuaaagagggauaaugaaacaggagcuuaauugcuguuuuguuuuuuaaagauucuuuuggaggagaagugaaauuuguuugaaaaacuugccuuuugaaguacaccagaguuaaauauuggaagcaaagacaccaguggucauaaaagcaguagagaaaaaguuaagacauuuucaaggugggaagaagggaaaagaugaaggacgaagaggaaaaacaucauauaacaugggugcaaaauggucuaauagcaaaaaucuuuucucuugucacaaagcucuacaaaaaaaaaaagaugugaaaagaagaugcaagagaaguaauagaaguaaagaagaggaaauagacaacaaaaaugcccagcagggcagguuauugggaaaaaaugaagagaaacugcaaauccuacugaauggaggcaaauauauuuuaacauacaugaauaggaaaaaguggaaaaaguggaaaaagauaaaguacacccucacaaaucugcaaugaguguggaaaacucuuuacaucccaugagcugugggaaaugauggcucaagacaacugcaguuugguuucuauagacugagggugucacuaugggauagucugcgucaguuugacaauuacuagacaagaucaaacacaggaaaaccaguuaagaaaacugauauacuccagcuccaucacucucccauaugagauuuuauaaaucagguacaaagggaauccaaauucuuuuggguaaggcaaacauuaacuuaacccaugcucucuuaaugacaccugauuauuuuuauucagacccacaaagggcagcaacucaguuucaccucacagacaugguauucaaaugguugauagauccacugagaggacaugaagugaaacuagggaaaagagaagaagaaggaagcuuuuauucccugguugucaggaaggaaacuuuuguauguuggacacccgccaaucuagucucaguacaggaaauuuaaaaacuccuuaacccuuuaagaauuacaaaauuaugcucaaauauauaaggugucaucuacagaccccuauauaucuguaguucuacauauauauagcucauuagacaugaaaccuuagcuuugaaacccaucacuaacaaaacaauaaaauauacagggagguccauauaucagcaauuagguuaaacauggauuuguuuucccaauacaaagcuauguguagagccaagaggcaggucaagccugugcuucaagacauagcaugaaucaaucucagaaaggucugaagaauguacacaaggcuguggcaauaaggaaaacuggaaaggaucagugugcaaguugacaagauucaucaguccuuucgagaaaaguuaaaagaaaauuuacuauuuagaagacaagagcauaguaggucauaaggcagagaguaauuggaaggaaauucucuucucauccuuucuuucugguuauuauaugcacauauuauuugacuaagauaaauaagacauauacaugaaacaugaaaauacagucauuaucuaaaagugcuaaaaccaugauauuuagaaguauaacuuugacauuuggauuaacauuguuaucuugaaguucauugcccugagcuguagauucuagcuuuggcagcaaugaaggaaaauaguacaucagguguggcccagcucuccuacuacaucuccaccuuaaaccagaagacauaauuucuuuucuuacuacucacaguagcuccugaguuuugacauaagucgaaacaacuauuacaucaugaacauuccugucuuaauuucuuuucuaguuguugggauaaauuucucugacaaaagcaacuuaaggagaaagggucugucuuacacuuuaagauauagauaacauggcugggaguugaugggagcugugacaggggaaggcuuggagcaucugugcccaucacaucuauaaucaggaagcagagacggaugacuucaugaugcccugcagcccucuuuguccguauacacaguucagaucucaucaaaaacaguaccacuccaaguggguaguucuuccacccugauuuacuuaaucaagauacucccccacaggcaugcucagaggccuacaaccagauagcauuagauucugucaggcugacaaugcauacuaacaaccacaugcuugagaugauggagggaaaggcuaacaggaagcugccaugugagaugugcaucaagagugcauucuccagcugugcuagcugcagagucgcaaccccucaaagaaaacaugagaucaagcaaaucauacucccgaccauccccacccacaaccccaagaugaagaaauuaacauggacaagugcugcacccuucauaucugccaauaauccuacuucaaucuguccuuauuauuccuuuaaccauuuguacaaagagcuaucaauuauuucaaguauugacuguguuggacacaucacaaguauuauguaauuuucuuuuugucaagaaagccaucccauaugaagaaagugacccuugaagauguaacacuuaacacaccccacaugacacuuuuguaagugcuggagaugggguucaagcaaaaccauagcaagauucuaguacagcacaccacacugacucuugauaagaguucugcauuguugucugagauauaucaaaaaagaacaaccagccuaauggaggaguuucuaagccugaaucugaagcuaaaauguggcccaugagagcaugcgggauacaccuguucucauuuucgaaacuauuauuaauuucuaucauuauuaauuugcugccaugcauaguaugcauuuuauugcuccaaguccacuccuaccuuuuguuauuuuaucuagaauuagaauaaauuuccuaaugauauucaagaucaugccauuuucucguuaccucaauuauggguuguuuguuuguuuguuuguuugggugggagguuguuguuuuuaaaggaauuuugggauuuaccauugaguuuuauuuucacuuccuuacuuaauaauguuguacuaacuagggcucuucauuguuaucuccauacaugcaucauacuuuuuaguauacguguuuagagucuauauuuaacacguguaaauagcugauggucagguaaaccacauacucucaccuaacuggagaauauaaacagcaugcuacuuuaucugauuuccuccucaccugaggcagugugaugaacuuguaagucacaucugucaugggaacucucaugugugaugggaccuaucacagcuuaucaauugcugcuauuguuugguggguaucaaucugagaaggccuuguauucugcuaaagucacuugugcagcagcuccucucuuuccuuugagugaaagugaaagcuccaauguugcaggcuuugggaauuucuacccugcagcuccacuccaucauuaaagacccagugaaagcuuguuauccagauagaugccccaauuaagcagugcaucccugcucauugcccaccguggcagcaggcucacagcgagacuuggaagggcagugacugauacaggaaauggucuaaagagcuacaaauuuacuuuuauuuguuuuacuuucaccucuucauuuguucauucgacaaaacacuuaucgacagcuuuaauggugacuuccaagcuuaaaaacguuacuuguuuuucugaagggggagaaaaugguuccuaauuuucucaguagcauaguauaacugauccugacauggcacucaaguauccagaguuacaugggaagcacugaacaggaaaggauaaaaauauuaauagagaauuccaggcagcaugguugcccacuguugguugugugcauuacuguaugaguccagagucuucuaugacuaaaguuaugacauaaauggugaaggaagcagaaggaaccacacacacauguuaauuagcaggguacacuuuccucagggcauucucuaaccuaagaaguacaaaccacucagucaguacuguaauuauuauuauuauuaauuuacuguaaaaaguacugaaccauggucucaugcaugcuaggcaaacacuaauccuagucucauaucuuauuuagaaucugauauauaugugugugucucucuauauauauaaagaaagagauagaucgauaugguuauagguauagguauaaauauagauauguagauaaauagcuauagauagagauguguauauauauuaauucuuagagaauugcauacaacagucuuugaccauaaucuccccccaaguccucccagaucaccuccaccuugugucuuuuuagaagacagugccucacagcaucuguucuaguccccuggcucuuauacuuuuccuaauugcauuuguuaauuuaccuucauggugcugggguucacaacuagagcuuuguauucccuagauaggcauuuuaucagugaguucuagccccagcucagaaaccgugagaaugagugucucuguauguguaugaaauauuaaaccugaucauauaauacauuuauauuucacaauuaaguugucaaauaugaagcuucuaaggaggaaugcuuaaugaaaaacaauuuucuauaccugacuuuuaauuaagagucaacaaaagcccaaaagaaauggcugauuaacaaaaugguuauucuuugcacaaaacagaaugcccuuagaaucucugcuagaugagaaaauuaauauucauaaaauauauauguaaggauguuuguugcuaugcugcuucuaaguuaguaauauuuacaaguaguuaaguaacuuucgguucuuucauuuaugaacuucuacauaguuacugagaagaguggaugauucaguaggacaaaaugucaaagcauacccguaaggcaaaguaggaaacacagcccagugucaacaguaugauccuguuuaugaucaaacacugggggcacuguauacacagggugcugguaaggaacuaggcauaaagaauggccugacauugucugacaggacaacuucuguaggcuggaaagcaauaguauguuuuauaugguagaauuugaguuacuuuuuuuuuuuuaguaacaagaaauguuuguguauuagucauguuguaaaacuuauccaaucagcaaaaugauaccgcauaacuucagaaguagguuauauauacuuuaguucccaacuuguuaugauuuaugaaacauugcuuaaaauaaaauuccuaauauaaucuaccuaauucuauuauauacuguaaguaacauacauccaccaagcacacacacuacauuaaacauaaaacauuauucaagaacauggauccagcauagagacaggaaacuuccaugcccacacaggaaaccaguccaagauagcacacaaagcauauauuuagagagacuuucagguauaaacauuauuuuuauauuaaauaauucagucaacucuaacacgcuggauucuguggcucagggagagguuugcugcuauucugguaaaggcccuucucagggagacgucaguucuguagcucacauucucugccuaucaaauauucaucccaugcacccaucauucagguuagguucccucaaacagaauccauaaaauaauuaugauuuacauucauagagggguuuccaccuuccagagcucuuccaaauacacagugucccaagagaugggugauuaugcagggacagaagauaaaacuuuaacacagaagagcgcucuaucuagcauacuuucuuucuggcuugccacuuguucagcuuguccuuacaccuuaauggaugguuuagaugucacaucgcucaaguaacauuccaagcuuaucuaggggucaccccugcauaccucagcuguuuucuaguugucacugguaguaagaugcuuuccauauuguucuguaauaacugcacccagaaugcuagggguaaaaccucuacagugcccuagauuacccaagagaaaaauacaggagucccuguauagguaugaauugauauaggcaucaguuauaauggaugucugugauaugucucuccucauuauugcagcugucccaacaguuuuguaagaguuccaagaauacuucccuuuucccucugccuccagagguugccauaucagaauaugguauaucuucuuacauggccagguccauaccuacaccauacugcuaauauaaaacuauaauucuuaaucuuacuauggguaagccaaaggauaucuugucucuuuuguacacucacucuuucuacagauaguaacuuggcaccuuuacaugucagacugucauugagugacaaagcagagcauguuuuagcaguagauuucauuacuaagcuauuuugaggucauuugauaccugaaacauauagagaaaaucaacuaauagaucccaagggacucuugaagguaaaucagagaaaaaacaaugaauauuugaggauccuguuagcauccuuggaugcuuccaggaugcccacaaugggcucuaacacucaacuccguuuauaagucccacccaugccuaguaagccuaggaaagaaagaaaggcagggcccuucuuuauaacacuaguggaaagguauuucccugacucuacaggaguuuuauucuccaguuguucuccuugagcuauuuggauauauuccuuaaaaggcuuaguugucacugcuguuguuaaaaaugguugacuuuuuuccuacaucaaaauaaaagguuaaaaaagaaccauguguugauggggcaaaagaagaagggagaguaugccuggagcccacuaaugggaaagcaggaagccaagacagaguucacaaccgauguuuugcuuucuuuuaguaaccucccaucugcucuaacaugguaagcaacgccauuucucaucugcuugucuguggaauuccucacucacucugccauucucuuccuugcuuaccauucaguuuuccucugaguagcuaucacccacaacugcuucugcaugugucucucagcugggacuaucccagagugaagcaaugcagaaguauaaaauacaaacccgaauucagagauaauaccagaauacacacguaaaaguguuacuuugcugcauuuuuaauuacucauauuaccuguuuuuuuuuuuaauauagugcuuuaaagguauaacacuaaaaucugucucaucugucuuucauuuuuuaugcggaacacuaaaaacauuacauuggcauguucaguugacacagugugaucacugggcagccaagaugucguggugguggcuuuuuucuuccuucuugaugagaugacuucuauacugcugaggucugucuuuguuccuccuucaccuuuaugacucuuauuccacacccuacauucuugacuguuguuccccuuccaagugcaguuuaagcagccucccuaggguaagaccuggacaaauguaugucuguguacuaguggcagcaaaguaggcauaagugauuaaaagggggacagcuauggcugccaagucuugagcccuuggcuuugggaacugacuuuccaaagauaggauaacaaaaauggcaacgaugaguggaagauggaaacagacauacagauacguaaacacacacagacacacauaugcaugcauggaugcacacucucucucaugcauacauacacaugcacacacacaagcacauucacacacaugcacauacauccacacacauguacaccaggaaggaaggauacgagucuggaaggggaggcaaaaugaaaacacagaagccaggaaugccaucaagccugagucuacccauagcaaagaguuauuccaaggacagcaccauugcuguaaggggaacaaaucuaaguguauucuagaauguucccugcaauaugccauaugcaaaaccaguuaaccucauuuagaacugggaagacaccuccuggaugacuaguuauuaaugcuacaucauacaaaggaucugguuagagggcugccaucgccuuuacuacccaaagacguacaacucuguaaacaagaaaacccaagagucuauaaguacuugcuuauauaccaagcacugguucacaacuuuuauauaugaacuuguuuaaggaaagucacuaaggucucuguuuauagauggauaagcugcaggcagguaugauguccuaaagucagugaggauucaaacacaggcaaccuggaccuccagcuacuguuccucagcuuucuaccuucuccaguguccuacaucuucugcucucuccuacugugagcaccaguauuccacaccuuauuaguacucauuauucagcuacaucuguucccagcuggagugucuggugcuugaguggagagaucuaacuaucuuguucuuugaaucccacaugaguucugcuauucuaaguucaugaucaauacaugcucaguggaugacuacauuauagcacugacccuggggauuaaagaggaucacaauuacuuaaaaauucuugaauaaaaaucccaaugccuauuugccuggaguugaaauuauuagguguucuuuuuuuuauugggaaaaugucuccagguguaagugauuaaaaauuaaacaucaauuaacaauucaagugacugucuguguuaauaaguugcuuauuaacugcacagguaaauauuguaccccaccuaauauuugaaaagaugguccuuuuagcauauuaaguagauaagaauggucuuuucaagauucaacaguuuuaugagcacuucagugugucacauuuaagucuguagaugacaaagcuauuggagaggguacugguugacucaaaacgcugcuuuguuaucuuauaaaguacacagaaugacaaagaugggaaauauuccaccaucuaugacucaguaacugaagugucaagacgcuuccagaucucccuuugcugaccacagcacauauguggauugauuucucucacuuuuccucucuuucagaucggaagccccagcucccuucuaccguggaugggggauuuucucuguugcacucugcagugucuucuucagcccuugacuagcugucugcugccuuuauucuucaucuacaccugguguuucaaaagauacucaaaucauccugcucaaaguuuugggcaggaacuuucacuggcuccuauuuccagggaaaauucauuccuuuauuugcagauguaauugaagccugucucgugugacugaagguucuuuaaggaucuaaauccugcuauuugucaacaugcuccuuggauagacaggcuggcauuuuccaugaaaauguauuuguucagguucuuucuucugcuaguccccuagagggauacguuuauuuauguuucugaccauuuucuugacuuggacaauacuguauuaagagauaugauguacuagaagcuuaauauuugauucauacaauaagcugacaucaaagcuccugcagguuuauuuuuuauuuuauuuuuauuuuuuagaaugaaagccauaaacccaacccacauccggagauaagccaaccugagcuaucucacagacuaauaaucagaauaaaugauuugauuuuuauuuuuuucuaaauuuccaguguuacacuuccuaugccuauauuuagucuucuuaacgauguaauaauauccuauaauccuuugauagaaacuguggcuccuuaccuuuggggauauauaucaucagaucuuaccccuggaugggaccaaauuaagauuuagucauuaacaauugguucaaaaaugaugggacuuuggaaauuaaccuucaacucuaagggguugcauaucacaccuggcccacuucaagguuagauuuuggacaaugucacugcuuaugauuguccuggaauuauguagcagggguggggaguggggauggaauguccuauaagaacuugcuaugacuuguuggcaaacccacugacguuuuuucucugguacuuauugcccugauauuuuccccuuccaguauguaaauauuauccucuauuuauguugaauuccacauucacaaacgaucaucucaaggaaacuauggacauuaucauuagguuuucuuuggaugagaugauuuauuuucuaaggccacuggacuuagcuucucagaguacuugacacccuuccacaaacagcacugaauauaagacaggaaggaacaaaaauaguggaugaccauuccuggaaacuucagugaccaaaauucauugugguuacauuuauggauuaagauuaggccaacaugauugccagucugaguauuucugggcaucauuuugaaugucaccuauggaagaacaaacccuuacuacgauugagaaguaaagcagcuuugaccagaaauagguaaaaguuuaguuuuuggaucuaggacacaaagcauucuuaaucuggucuaagaggacuuguguaaagcagaaacacacuugcuaggaaagucaagagauaaaaaacuuacucggugcaaagugaggggaauaucgucaaaguccaugugacauucuuuacaguaaaaacaagugacuaaugcucugcccaugauccacggguacaaagcccaggagaaaucacagggaaaacaagacucaccaacuuacuuugcaaguauuaguuauuccaccugucuaagcuaagguuuuauugcugugaagagauaugaccacaguaccucuuauaaaggaaaauacuuaauuagggcugccuuacaguuucagggguuuauuccauuaucaucauuguaguaaauauaguggcaugcaggagacuuggugcuggagaugaagcuaagaguucuacaucuugaucugcaggcaguagaaagagacuguuuuccacacuggacagaacaagugcauacgaaacuucaaagaccacuacuacacugaacacuuccucuaacaagaccacagcuacuccaagaagaccacaacuccuaauaaugccacuaccuauaggucaagcauucaaacacacaagucuauggggaucauuucuauucaaaccacuacauacaccaccuaaaaaaauaauauaauugaauuuuaugaaaccauuuacauuuaacucuuaguuguucaagugguuuguuuagaaugguauuucuaaaagcagugguugaaugaguuugugaaucucuuguguugucagauuucugcaccaaggggugaaacuaacagcugguagaucuggauguagucuuuuccaguuuauccagaaaaaaaaaaauauauauauauauauguauauauauauauuaccauggaacauccauuggaauugguauucuauauauauauuggaauuggugucacuuguuaugcaagacauaaagaugcuaaaagaaggacugagucuugaaguguagcauucccaugagucaaagauaaugagacaaaaguucucccugauuguacuaaaacucuuaaugucuacaauucuguccugucuauuaucaagauaguuuaaacugaugguccucgguucuauacaaaguaucuucacuaagaaaagcaagcauuaaaaggugcugagagaaugcaugugaucuacuuaaucacuaccugcaauggucacauggcuuaaaggaaagccccagacaagugugacugucaacugucacagaaauuucucaguccuggcacugggauauuuucuaugucauagcacaaucaccucacacaaggaaaaccauuaggaaauacaauuacugcaggaagagaagaccuuuugcaggagaauagauaaagcagcuuucauuaagaggucuuccuuuuucauguucaccuucuucuacuugaagaugaaagugacuucauuuucaagugaccuuuuaaaaaguccaaacaucaaacaccauaaauauucaaaauauucauaaugaaguccaguauuguuaugcuccauaagaugugccaaaaacccagaaaagccuauuuuucuuucuuuaaggauucaccuuugaaaaugauucauauuuucuucauagguucucauuuuauguuccuuuugguagaagguuagaguucccuaccccaaaucaugccaugagguaaugaugcugaacugaaagccuucuggagaauuuguuccuggcuccacuauaauaaccauuuuauuaucuagcuguuuuuugauaauaucauauuguaaaucuuaaauguacacaauacaauuuaaguuauuaacauaaagaggauggcuggcucucccucauuguauaauaucuaguaacaaauaagcaaugauuaaauagaaaaguacucuuuggcaauauuaauaguagucauuguuucagguaagaugcaucagcaaagguuuuuuuuuuaagauuuauuuauuuauuauauguaaguacacuguagcugucuucugacaccccagaagagugcaucaaaucucauuacggauggugugagccacugugugguugcugggauuugaacucaggaccuuuggaagagcagucugugcucuuaacugcugagccaucucuccagcccccagcaaaggguuuuuuuuuuaaaaggggcuaaaaugauaaacaaauaagauaucuauuuuuuucuaaaaguauuuuacuucauuuaaaaauuaaaauaauugugagcucaccucaaugaaugaauaacaucucccaccaaugaagaaacaugauauacauauuaacuaauuaauuaauguuaagcauuaggcaaguagaucuugggcaucaaggaggauaugaugcccuuucugcaguauuccugcuagaaaugaaugaagaacaugauuagaaucaggaauaaacaucucaucaaacacccaguuaaaaaacauuauugaaaucuaggaccccaugcuucuccaaauuguccaagucaugccagaaaaauucugaagaaugauuugagagugaacaagaugaagacaggacagauucaugcaguguaaugagugugaccucugugacccaugugaucaugaucuagaugacaaucaauggaacaagaagucacguccucguaagguuugaggaugacaaauagcuugaaucagcgugacuuuacuggguugauaguugugcuguugauaguguaagacuauuguuuauuuuuagguauuauuauuauuauuauguauuauuucagguaagaugcaucagcaaaggguuuuuuuuuaaugauuuauuuauuauauguaaguacacuguagcuguuuucagacaccguagaagagggcaucaaaucucauuacggauggugugguugcugggauuugaacucagggccuuuggaagaguagucaguguuuuuaauugcugagccaucucuccagaccccaauuauaugauuucagacacuagacauuauagcaaaggcagcacugggucugaggcuuggcuuucaaaacuuucaagagaaagguauccauuuguaauggauauauaaacauagaaaaagaauacagugaaauaaaccauuaauuccuggaaaaucugucagggcauaagcauaaggagauucuuuauagcacguuuacaauuuuuaagguuuuuuuuuaaauuuaauguuauuucaggaugaaaaguuaagacaggaaggagagaaggagagaggcagaaaagagagagcaagagagaggaggggaauugagagagucuccgcuucuucugaaagugcagagaggcaagcuucaccaggauacaagagcaguaagauccugcagugaagcccacuucccaggaucuggcucccaagcuccuauuaaggguagcuacauuccuucucagugaaucuuaacuagaucaacucaccuagagggcacuacagccagaagacaaguggagagccaacaagaucaccugaaccagcagagccagggcucaaugauguaccugcucuuagaugggucuauuguucucauuauuuuaauaauaagagagugucuacacaacuguagcccacacugauuuuuccagagugguggcauacaagcaacaauggaugaagaugguugagaaaagaaauugagguuucaauuuuaaagcaguguaaagauaguuaaaaauagucuuuccucuugaggagccucccuaggccccugcucucucagcuauuccuucuuuaggcucuucucucccuuguccuuugcugcucccugucaccuuuucuuacuucaugcccucucugucucuucugucucugucucucucugugccucucugucucugucucugucugucugucugucugucugucucugucucucucucugucucucugucucugucucugucucugucucugucucucucucucucucucucucucucucucucucucucucucuguuuuaaaaacuauucaucccaaaugaacaaaaugcugcgugggaaggaaaugaguagugagauguaguuacuucuuccacugccaaguucucaguucuuccuccaacucacacuaacccccugggcaaccagaaauggcacucuuucccagagcccgacaucucuaacugaaagggagacaaugaauaagggcagaaggaugaguccuuacugugcauuagcucuaaaaauaugcucaagugucaaacaguguuacauuauuuaaaagucaucaucaugaugaaaauguccuaauuacagcccuuuuccauuucaaaggguuuuaaacauuguaagcuaucauuuacuuucauuuaagaauagaauauugauaacuaaaacuagcuuaauucucaagcguaauuuucaaagagagaaacugucuuuuaucauuucaauacucuuuaucaucauuggacaauuccaacugugggugcuuaagauuaacucagacccccaggggucaaaaguuuccuaauaggucacuuauaucuuaaaacacuuucuuuagauauuuucucugauuuuugaaaauugaaaacagaaaaucucauucccuauuugacaacauucaugcauuuuguguuuuaggauuguguuuggggauggagggacacuuuccagaagggagaaaggcugcaagauauaaguuaaaacuugaacgaaacuauuuucauaaggcauagacuuaauucagguaaggacaauuugcaucugauagcgcugucuuucaagucaccuuaguuacuaguaaaguuucccacaccucucugcucuacaccguccuccuaaucucucuuucauucacuaaauaucuacuaagcaccuauuuauuugucagcugcaguguuaacuacagacacugaagaagaagcaacuguuugaagcugcauggaaccaccaggcagccugagaucacaugcagaauauucgugaugaaggcaaaaugcaugaggaauggaaaccugccagaggacuuaaaaggagcuaagagaggcagaagcaacacauccagaaagaccaucauacugcuuaccagggcuguggcuuacaaccuacuauaagcugucaugguuaccauaaccaaguccagugguuuucauauaugcaaacaucuauguacaugagaguacagagaauagcagacuuggagccaugccaggaaagaggaguaauugguaagaaggaaaauggagacaagagcucucaucugcuuccugacuauacaauuauucuugucccucuguucauaaccuuguagggacagaagaaugcacaugugucugucaagguccaugccauguaagauauaaaaggugaaaaguagaagacacacaaagugaguuaaguguuuguccagguuuggccugagauguuuccaccagcaucauuugagagguuuuuauagaauaccauauuccugggccaugagccagguuuaaagaaaaugggugucaggccugagaccuggaugugcauuuuaaacaaauuugaagagucgucuuccacauuaaaacucaagcugcaaucuacuuacuaaauugaagaucuuuauuuugacugaccuggcaaaaauucccuagcacauaguugucaauaaggccuugucaccaccaacaaggggcggaaucuucuccaucugccacucaaucucacucucccucucacugcaccaaggaacccagauugaugaagucaagucuggaucaauccuaugcauugcuggucauugguaauaaugucgaacugguuaaucauuucuauuacauagaggcuaaguaaguacuaagucaauauucacugugaauaaauuuuacccaggaaacccaaggcauauacuuuacauacugugcaacuuacugaugcugaaaagugugggcuaugauuuaauuaugcugugguuuacuaacugugcagugauauaccaggaacacuccauuuaaacaaacagauguggaggguauguugauacaugcguguauuuuucugagaaauguaaauaagauccuaauuaaagaaaucacacugauaacaacaauacaugccaagcaucuucccugucuccuuuccaggcaccagaaucaccugucaaaaacuuuccaagagaaaaaggcaacuacaacaucaauaaaagcuaccuggguugaguguaugcacaaacugccugagcccaccaaaucaucuuuaauauuauguggcuuuuggccuacaaagcagagauggaccagguccucauaguccaggcauaagaucauaaaaauauaaugacuuggaacauaaauuuuacauuuugcagggcauaugguuuguauaucaacaauuuauuucugcuccuaaaccacuaaaauucucagagacaacuaaugaacaaauaaguauggcuauguuucaguaaaacuuuauuuacaaaaacagguagagggccagauuuggacuauaccaauuccaaaccauccuuuaaaaauaucugaauaguuuuuaacauugauggugccagccuuugcuguaagaagaguaaauuacuaucucuuggcuuuaaauaccacacuuuuauaccaucaucuguuauaucuggcacacuaaccuacugacaaggagggugucaccauucccuacaauaaaaaauaucaugcuuuauagcauaugaccacuuuuuuuacaaacaaaauuguagacucccuagaguguguauguauguguauauguauauguacacacuagauaaguauggaacauucccaaugugaaaauaugaaacuugagcugucccagcauaugaaucuuggugcuauaauauaucacucaaaauguuuaggauuugagguuauuuugcauauuagauuucuggauucagaauguauaaccaauaaauauauguaaauuuucuaaaaauuagacaguuaaaucugaaauaaucuggccacagacauuuuggauaaaagauagucuaccuauaucuaaaacacccugguucuaaccucuggaagugggauccugaguaggaggagaauauaacaaugguuugccauucauuuguagucuuaaauuucauuacuaagaggcaauaauaccauuguuaacuuaaaauaguaaagaaaaacauaaguagucuuuugaauacuggaagaccuguuacuacccuuccucuggcucucaucuaaaacuucagagguuccuuccaucacuaaccacgcauuuuucauucuaaacauacagauaguacucauuaggcagcaaacacuagacugaggguaaggaguucuuggaguugaccuucuguugggaaaccagaugccaaucaacugcauguacaaguacagcuaaaauggaaaaggaaacaaauacauuagaaggccuggcaucaauuguucuuuuagaaaaacagucacuuaguggucaguccauuauugcuggaguuuaaaagcugaggcagugagcagagccauacaacacagaagaugaucaugaaaagcagaguagaccauacucaaguguaucagagcuuguaugucauccacauacaauuucuucuuuuuuuaaaguaaaacacaaaauauuuuauuauaacagaaauuucuuuuuuuuaaauuagguauucucuucauuuacauuuccagugcuaucccaaaagucccccauucgcuuccccacccacucccacuucuuggcccuagcguuccccuauacugaggcgaauugaagacccagaaauacaauuucuuugaaaucacagagaaagugcuaugacaacaacugucuuaaaaagacugaaauguaaacucaaugacacaaggcacgcugaaguuuuucccagcaagcuuucugauuugguccauuguuuucguauuuccagaacagaggaagggcuauaugcuguggcuuuccauuccugcagaucuaucuuguuaguguugacccuaaugagaagugaagggcaggggccaugucuuaauuuugcugugucaguagcaccuucuguccaucaauuuacuuggaauuagcuugccacuuccaagggaaugacgaguuguggcugaguuuguguacuaagacaucaagcuuggcuacccgauccccacaaggccacagucauuuccuuggauaauuagaauauggaaaaagaaagcagucugggauuuaagcuaauucaauagucauaaacuuccauuaacuuguuauaugacccaaccugaggcagacaaggcccccacagcaagaauacugguacagacucacaaagaagcagagacagccaaggguauauuauucaguccaguuuucgggagucuugagguuucaauuuucugaaagucccuucuacacccacugugugagaaucagaagaugucauccuauaauguuaugggauaaauauuucucuucuagacagccuucugagacagaaauccagauaucaaaaucaaguucucaacagucaaauuaguaucauuacauuccacaacaguuaaguguugacuaaaucccauggcuccugugucaagugacagcaaaauacucaagaguauuuacaagauucacaaaagacagaauguuguuccuugcagaucuagaggcuagaacagccaaaaucaacacucagugugggaagagaauugucuucuguucccauguggcugugucuuucuaaagcugugguucucaaccuuuuuaaugcuuugacuguuuaauagucucuugugcuguggugacccucaaccauuacauuauuuuugcuguuaucuuaaacuguaauuuugcuacuguaaugaauuguaaugcaaauaucugauaaucagggcuaugacucacagguugaaaaguacuguguuauggggagagaugcugugcuuucacauggcaaaaaccagaaaaauaaagaacaaacauguuacccccaugcucauuuuauuacacaaacacacauacacacauacacacacacacacacacacacacacacacacacacacuagcccacuuaugaggguaaacccauuaugauuuaaucacuccucaaaauggguuguauuuuuacugggaauuaaggugcaauaugaauuucugggagaaguaacagaaagauuugagcuauaauaucugcuacaggugauaagggaagaccaggaagaugugagcuaugaugaagugaauacuaacaagaacgaugcaaaaccagccaacaugaacacaagucuuacuguguccccgguaucauuccaaggaucuugauacauauuuuguuuguuuguuuguuuuuguuuuucgagacaggguuucucuguauagcccuggcuguccugaaacucacuuuguagaccaggcuggccucaaacucagaaaucugccugccucugccuccuaagugcugggauuaaagacgugugccaccaccaccuggcucacuuauaaacucuuaccaauguagguauguauuuauuuguaugccugugcuacauguacaugugguuguauguaugggugugccugaggucacaucaggaugucaacacuguuuguugagacagagucuaucauuggcuuguggaucacuaauuaggauaggcuggcuaucuagcgaggucuaaggaucuacccagcuucaguuauccagaguggggaguacaagugugccacuaaauuuguuuuuguuuuuuuggguuguuuuguuuuguuuuguuuuguuuuguuuuguuuuuuugcuuuugcuuuuguugguuuguuuuguuuuguuuuguuuuguuuuguuuuguuuuguuuuguuuuguuuuguuuuaugugaauucuggagauugaauuuagguccuaauucuugcucuguaaagguuuuaaugaguuaucaacuucucuaacuuuaauuccuaguuuuaaaaaaaucuucuuaaucuagagcuaagauucuguuuucaaaaagaggaucugaucauucuccuuuuguauguaagcacacauauauacaugcacauauaugaacaugcauguauauacacauacucauaccacacauacaaauuuaauucauaucaugcacacucauaucauagacauuuauucacuuuacacaugcauucucacaccucacacacauaaagaugcacucacacccauacauaccacauacacauaccacacaugcucauaucagacacauauacuaucauauaaccaugcaugcaaaacacacacacacacacacacacacacacacacacacacacacacacacacuacacuuggccuugugugaucaauauuuugaaauauuguuacccuuccacugaugacccaaacagaacacucauggcuucuuagccuagagaucagaaguaccugcaacuuguuuucuacaaacuuguuauuuccuuuucauaacucuccccggagaaauuacuuuuaagacucuccagcagcuugggaauacuaacuaagcccuaaugaguuuagaaaucaguaaugauagugcuaguucaguggcccauuugguagauagaccguuacuuuccuucaaggaaaaacaggauuaucaaguaagcuagaagaauuuucuuuacaugaugggaaggaauaguaaccaccuuugaaguagcacaagauaguucaccucuccaggguucucuuucuucuucugacacucauggguaauugaaaggccagaagcuucgcagaaugaccaaugaagcaagauggcaagucuuucuuuacuaucuacccacagaaugccaugcuggggacuuggauaguugagggcugagacacuguaaaacuugucuuugauaggcugcuccaaugccuggcucagggcagaccugcuaccaaucaagcaacaaugauuuuggguuuuacagaccagagcagaaagcauuggugcuuuucagaagccaguggccuagagaccugugguaagaucaucuaucagaccuuugagggacaaagagacaugcacaagguagaacacacugaauacaauuucaaaauacugucuccuuauccauagugacuaauuagcagggaaucucggcugacagucugggaagcauuagcauuggccuuucagcuaaagcucacugaugcagagguaaacagcucuucucuuggagaagcacuacucuauagcaauaaacuucggaaagguaucuuaguaaacaauuacaccaaaauacacugcugcuuauagaauguaagaaucagaaauggucaggugggugagaauuuugacauguacaugcucauuuuucuaagauucauaaauuugucuuuauccaauuucugcuauuaaaauagaauguuaaguugcuuaaauagggcauacaguccaagauuuguauugcuaggugauuucucuguuugaggagcaucauaaaacauacuuagaaaaucuaagauggcuacagcaugacuagaaagucuacuuucauaggagcacugcugaaugcguagccauagaaagcaugggccaucacacucccaugacucaccugcagaauggguaguuauggugaacugaaacuuaguaucugaucauucuucaggcaagauccaggaccuucuuuugccuuccaaucagucauagacaucacuuagagggacugaauacaugcuuauaaugaggcuacucuccagagaugagccuuaaucuauuaauaaaggccuaaaagauguaaucacucucuaaucaucccaguuuucaacacuguuaaauagccaacacaugaacuucaugaggccuauuuaaaauauuggguucaucuaggcaaggagagguccccucuuaacucuagguagaaagauacauugaggauagguuuccaggaguuagacacugucuuagucucucucucucucuguguuucugucucugucucucugucucugucucugucucugucucucugucucugucucugucucucucucucucugugugugugugugugugugugugugugugugugugugugugugcaugccuguauacaauaauggaugucaagacuagacuagugcuauguacaugcuaguugacucagguacccaucugaguaucacugccagcucagaaagaacuuucauuuagugaaaaguaauaguuuuugccuggugauguggaucagagugcagugguuguuaguuuguuugaggucagagguuuaaugccagauuauuggagggaagagaaagggagaaaacgaaauagucaggcagaauagcaggaaaauuagcagggagguccuuuucugggacaccucaaugucacuuaaguacuccugaaugauucuagaguuagagaguuauugaaugguacucauaccaugagugaaugagugucacuuguugguccuggguuaucagugguggagaaaggauggagucagggguacugcaggggaugugaaaugacacacuauucuuuugggcuucccuguguggaagaagggcugguguaccuagucaccauccauaugaugguggcacaucauaaccuugacacaucaccuccuggcugccaagcaacugaguuauuuucccuuugguaccuaauacaacaaaucacuggugacauacaagagaauggaaaagguauuuuaaguaacaguauaaccacaaucuccaggacaacaccaucucccaagaacuaccaaccuuucucagaagcuauaccugcaaagaaauagagggacucaagagacaccuaccuguuaaaugaaugaauacaaaugcaagauacaagugugcacagcauuguugauucauuaaaugcaaccaguuuacccuguuacaguucuaccugcuuggugacacuugaauuugauugcagaguguccauugucuuauauggcauagccaaaagaaaaaaaaauacaguuuuuuuaaauacagguuucuacuuaucuguugaaauuuucauuuuuaugcauaguauuuugaugcacuguguauuauccaccauuacuuucuucuaguugcuucuauugcuccccccaucaugucucccucccaacuucuugucuuccccuuugcuuuucauaauacuaacaaccucuucaguacaaugaaggcguggcuuuacauacaaauaggcauggagguggggccauguacuaggaaguuguugaugagauucuuaaucaaauacaauggcauguuccaaaauaggcugcccauauagaacaggcuuguauaauaccuuauggauguaaaagugagauuaaagccacugaguucaucauacauaguuucuacaugaagauuuggcuguaagaacaguauaaaacaacaaagcacuucuagaaugauuuaaucuaggggugcucuucuuuaugucuaauauauuguuagauaaaggauaauuuuaauaaaaacaggaucaacaugaagcuuucaggacggaucacuaagcaaaggaaacagaagugaaagaaaccccuauccauguacaguugcucuaacaagauggggagggaagugucagcuggcugguguaguaaaauaauaugaaugcuauugacauucacuaugaauaaaagaacccuacaagcucccccaaaacuucagucuggaagguauucauagcugauuauagucaguuuccucauguaauccccaugaacaagaaggagaaaauagauuguguaucaguucuaagugaacaugccugaugcaagaacuaguccaaugccaaagauaucucaauuacagagagaagaguuacaggcagaggggaaacuucuuuuccuacaaacacccugagccugccugagaaaacaggaagcccaguugaucaugaagguaucccauaagguucuuagggcugcuauuaccuugcugcucugggauuagaaaucucacuggaguuccccaaggcagaaguuaagcugugggacagcuaaaaucuuuucuucaggcuccuuucccagcuccuagaagcuucuggcaacauucaccuccauuccuccaucuucagaaacagugguggccccuaucugagucuccucaagauuacuugggacucuaguagaguugaugguuaugugucuauuugaaguuguguucucucaacucugucuccaauuugaacucuucauuuuauaugugcagcacuuaaggauuagggcauagugauccagguaggcagcuaguguucuauacagccuauugaaaauauuaaugugucauguucaguggagaaaaaguguaucuggcuuaaacuaauguaaaaaaugagcuauuuccauuuauaaagaguguacacauauguaagaguggacuuuuguuuguuuuuccaacuaagcuagcauguggguucucagccaccaccuaaacaaugacacccuaaugaaaauaacccugaaaguuagggguaaacagcaaaaucuacaaaguccacaaacaacuuauccagcaugcaauucaaaaggaaucuaucaucuccuagagcaguguaacuaucucacauucucaagcacucauucugauacaucuuguguauuuggacacugaucucuaaggaguuucaucucuaucaguagucuggacauuuuugauaaauuaaaacuccaucaaaugugaagguaucaaaacaauagaagacuuaccuuccacugaauauaauuuuagaugauggcugggcuucaccuauaagaacugcucaccacacucacaguucuaaauagccuaagcauuaccuauuuuuguagcaccuggcgggggugaggguaccuauacaggcuauacaucuagaaaauaaauaaaauuacaucuccaaguauccagccuucaaacagucauaucagccucacuguuuccuauccagagacauccuaauggaugguggcgugccaagguucaauucugguucugacaguaucucaugucagacaccugucaaggcgaaaugagacacuuaggaaaggagaguggauggccaagccauauccaauuuccuuacaauuccauucccaacuugaaggcuuauauauccuacugaauggugugguggcucagugccaccuagcaugcaccaccacuuguagguaagggggaagagaggacagcagcucaaaagcgccagaaagcaucaaaguggcauuaguuuagcagaugagucugagcucaaaagggaggcucgaaaagagcuuaaaugucaggauuuggcccuagcaccuugaucccaacuagcgacauggaauuauuuuuuaauaucuguuuuccauaauuaaggggcagagguuuucaugcagaugagccauuugaaugcacacaacaccaaaagggcuucauuagcuuagcugggaauuauaaagaaggaaggggaggggggagauaaagccuuaucgccaagagucugaggcgggaugugcugauagcggacuggccggaugauguaucuuguaaguuuauuagcuuagaggcaaaagcucuacagauccugaaggauuugaaauagugccaugcauuccauaugacagaaacagguggcaccccugggacagucuugaaguauuucucauaccuuuuuaguuuuccccaagccauuauuuguucugaauaucuuuccuauuguuuuccauugcuuccuacauuuuccuuccuugugaauuugaaaggaaaguaggaaacuaaaauuguggcucucucuaucacuguaugacgcaagcaguaaaucagaacuucagaaauuauuuuggguguauacucuuucuucauguucugauuaaggaauuguaaaucacaaaugagccuuugcggggggggggguguugcaauuugcuuacaaggaggcccaguguauaguaggaaagccuaagauggagacuagaccauuuccagcuauuaccagacagauuuuuuuuucuagauuauuagacuucagugcacaaugaagcaucaaggagaagccaguuccucaguauguugagaauccuggcuaaucugguauaaucaccuuaucugaacaucaaagaucaauuucagcacaaauuccuugaguuuuucucuagcaucaaucauccauaucaauauucacucccgaccucuguuguuucucagcccagaucuuuacucuucugauucaccacaucugaacguugccucuacuucaggaggaaagggucaaagggccacccauccuauacacacaaaagcaccuccauauuuaauuuauuucuauacauuuuauucuuuugggacaucccaguguugagcuuccuuuuuuguagaugucccucuauuuaaccaucucaaaaugaaaagagccaaaguacugggugaaugcagaacacaaacaugccaaagcuugggucuuuguuugcuuguuugcuuguuugcuuguuucuguuuuuauuuuguugauguuuugcuauuguuguuuuuaagguuccagaaaccaugggaagcucagaaaaggcaaagaacaaaagggcauauguggauaugacuuuagggcagagaagaaaugcaaaauuagugcuuaauauugacuaagccagugucgcuaaaucuucgucuagacaccauucccagcaaagacugcuuuauucucuagagauaacuauggucugagaaguacacuaaucuuccagacagaggauagaaagcauagauguaccaguguaaaagggaaauguccuuaaacauggugacucugaaaaaaaaaaucagucuggaacuccuugggagcccagaguaacaguaagacaaaucauccaacaguguuuaucuggcuccuuugucacuccauucuccaggccagcuucuucccuguggacuuuccuagucuuguaccuguugcaaugaacauggauaguccugggcugcaguggagugaugacacccuucucuugacccggucaccccgacuuucuccacugcugcugcuccuucaccucucacuugcuacuucagaaaaauggaaaccaugugcuauugcuuaaagauauuacaugucugccucauaauccuuggucacagaugucuuccuacuuagaauuuucuuccuacuuuacuuuuugauaacuuuucugugaacuggccaugacuuuuuaacaucucauaugauucaccaauaaaaugggaugcccuaaaagaacaauagucccaacacacauugcuccaggacaaggguaagcccacaugagguugugauuccaucagaucaagaugggguacaacaauuaaaaacggcuaauuuugcaucaugaaaagugcuauguacacacccuacaccauucucauacucacccaaugcacacacaacaauccucauuuauaaaugggauaaauccuguaucaccaggaaguugauacaacacaagguccuagaaccaggauucugaacaacagaauaugagagcuaaccauuaagcaagcuuaaauuucucuagggaucuucuuagcacugggaaccuggcacuuacauaagaccaguguuccuccuaggauccauuucugauuacagcagcagaugcaaauccuccuucgagcucucucauuugcuucaucugacaaaguuguacacauguuccccaauugucucagagucucauauacacacauaaugugcuuugaugaaauccauccucucaauccucuucaagcaucuguaccaauuuucucucccaccuucauuucaugugcuuuuucugucugucugucugucugucugucugucugucugucucucucucucucucucugucucucucucucugucucucucucucugugugugugugugugugugugugucugugugugugugugucuuaauucacugcauccaaucaguggugccuguaugcagauugcauggguauagauacagcuaauacccacacccauguuacucauggaaaaugaguaccccuucaggggccaaaugccagaagaaaauguacuccucucccagcagccaucaccuucucagacaauggugggacuucaugaguccccccucuuuccaagcuaggacuuuuuuucugguuugaucuuguacagguauuaugcauuuaguaacaguugcuaugaacucaugugugcaguagcccuaucaugcauagcaaauaauguuucacugaggaugucuacuacuucugaaucuuacaaucuuucuaggcuccuuucuucagugaucccugagucuuugugagaagcagguguaaaauaaaugucccauuuagauaugaucacuuauuuucugcacacugacaguuuuggaucucugcuaauuaccaucgacugcaaaacuaaaauaaacuucucuagugagacuugagagauguaagauaaagauaggaacaugcaggccacuuuaauacuaugucaauuuagcagaauaauagcaguagguucucuauuaauaccuaugacauggugagucaaagggcucugcccaauugacaguaccaggcacaaguuuuaucccauggagcagaacuuaaccgcacuaucacugaugccagguggugguggcacagaacuuuaaucccagcauggggauuuaaucugggagacagaggcagguggauuucugugagguugaggccagcgugaucuacagaguaaguuucaggacagcuggagcuacacagagaaaucuugucucucaaaacaaaaaguaaggaaagaccauccagagacugccccaccuggggguccaucccauauacaaccaccaaacccagacacuauugcauaugccagcaagauuuugcugacaggacccugacauagcucucucuugugaguccaugccaaugucucacagucuucuauuggguggaacacagggccccuaaugaaggagcuagagaaaauacccaaggagcuaaaggggucugcaacucuaaagguggaacaacaauaugaacuaaucaguaccccccacagagcugugucucuaguugcauauguagcagaggauggccuaguuggccaucaaugagaggagagacccuugguauugcaaagaucauaugcuccaguacaggggaaugccggggucaggaagugggaguggguggauuggggagcagggcagggugagggaauaggggacuuucaggauagcauuugaaauguaaaugacgaaaauaucuaauaaaaaagaacaaaaaguaaauaaauuaauuaaauaaaaaaucuacuaucacugcauguuuuuucucauaugcggauguuaaguuucaauguuuagauuucuguauugaaauuggagcucacauagcugccaggagacuaguaaggacaaaauggggauuuucacggaagcacaaggaacagaagcuguauaccugucuccucucaacaacuacaguaugccuauuguauaccugucuccucucaacaacuacaauauaccuacuguauaccugucuccucuaaacaacuacaauauaccuacuguauaccuggcuccucucaacaacuacuaaaaugcucccagaaagcagugacccugcccaaucuaaccaaagaguaaccaaacugccugagacacagcaguuaaaaacuuuucuuccaaaugaacauuuuccaggugcuucacaaagcagugguuauguuuauaaaagacuucugcuuaaaugagucacaugaguaacagccaagcuuccacaaucacaaacaagaaucccuuuucuuugucugguccuaaccuugacucacagaucagcuagacagcuuguucugccaggcuccaagagaacugcacaagaaagccuuugucuucagccgaauagugcaguuacaaaauucuuuguaguuguuucgaaccaugaaaaucuucacugugggcauaugcagacaaacuuacuugcuuugagauugggacaaguguagaauugaguuauucaugaaacaguuuuuuaacuguguauguguguguauguacauauguaugcguguguagcuguguguguacacucauauauggaugagugugcaugaauguguguagagcacagaauaaacccuuagcuaucauuacuuagaugccaccucccuuuauuuuugagacaggcucucucagcaagaccugagaguugccauuuugcuaguccucuggccagugaccccaggcauuuccuucuaucuaugucuccaacacuggaauuacaagcacguagcaccuagcacuauacccugauugcuaucucccaguucaaaaaacaaaaaguauuuaaaaaauauuaaaaaaaaaaaaaagauccugaguuguuucugcuuccaggcucuuaaguaggagucuuacugcauagccggcuggccauugguaguuuauuguuacagcuuuggauuucauucucugguuugcauccaaaaauaucaucaaaucccugagauuacaguaugauaguuagagcaaaaggggcugggaagacaacaguuuacuugauuguuauucacgauucuugugugugugugugugugugugugugugugugcuguacacauguacaaaugcaagugugccugccugcauauguucacuggaguuaagauaacaaaaagaugugucugucucuauuguucugcaauguacucuccugagacagagucuaucuuugaaccugaagcuccuuccuucaucgaaucuggcugacuguggacuucucagaauucaucugcugccccauaacacuagaauuacaggcacacgaggcuaugccugguuuucccauguauuccugggauuuagacuuaggucuuuauauguccacaaagcaaauacuuugucaauacacccaucuuccuagaucugccauuucuuuuucugaucacuaaaauaagucuugguuguaaaguagcgacuaaguaguguguguguguguguguguguguguguguguguauucauuugcccuuuagacaacuaagauagcuuauagacagccacuuaaagguaaggccccauucuauagaacggaacauaugauaaaucaaauuucuagugguuauacuuugaaaacagggucugcuauuuuaauccuuuggcacggucacucuuaccuggaagugaacucuuaccuggaagugaggucuucuaagugagccuuuagucuccuuccucccccuucauccucuccucacacucaccagagggcucuuauacagugcaaugcagcucauuccuacucuuugcuauaaugccuuuugguugcacugagaauagaucuguccguuaucuggccugcaaagcccugcaugauggacuacggcaccucucuauaucuagcuugagccacagccuaagcuuucuaccuacucucacaucuacuuccuuugaucuagagcuaucugcucucaguucucuaaguuuagugggugucaccaucccaacccucugugguuaucacuuuuauaauuucaugugcuccccuuaacucuccugcuaaauucuaucacacaccauuuuuguccuuccugacgcuuaaaacacaacccauaauaaugcccuaacaguguuucauuuuauuuucauuuuuucaaccaauagucaguauuuuuuaggguaaagaaacagucuugauagucacuguagccucuauuugaucaaaacacaacacauagagucauucagugccugugaaacaaauaaauacaugccaaaccccaucccauugcaaagccagccauuaccuuggcucccuaaacuccuuccaaccucagcaacaugugcucucccaugugcaccaacuacacacagcacacagaguuuccugccaguuauauuauguauaacuucuaguaccugaaaguuuaugccagcugcaaccucuuacuaggacagcuuucaaccucacugcaguuaaauagaacuuggcucaagccccagauuagguuuuacuuugugugguaguuugagaaugugcccgccuauacuuuuauguucgauugcuuguucucugauuaguggaaauguuacaaaaggauuaggauguguggcuuugucagaggaauugugucucuuggaaugugucuugaaauuucaaaaguccauagcaagcauaaucucuaucucugucucugccucugucugucugucugucugucucuacuugcugccugcugucugcacauggagaugucaaucucucaacuauaccuguccccaacacugugccugucuccuuuuugacaugaagguccuagacucauucucuaaaacuguaagccagccccaauuaaaugcuuucuuuuauaugaacgcccuugguuauggugucucuucacagcaauaguauaguaacuaagacacuuuuuucggaugucaaagauauaugagacagaaaauaagcagagccuuaaucuguuaaaauaugugcccuuuuacugugugagucccagaaaugguugagcaagaacuaaagcauagguuuauugucagcagcacaaugccugauacaugguagguuaccaacauuagccaaacaacuuagaucaagccaaacagcauguaucuagcacccacugcauucccuagucacuuaguuuaguggaagaugaugcuaagggccucucagaagacagcagcaaagauuauuuagauaaccacaucacaggcaaagcagagccuguaauacacgaguacaaaugguuaugagggguuuuaaagaaacauaggugucaagugagucagggaagagaggggaaugcagcacaaugaacgagccaguccagagauacuaauccaauucuuauugagguucuuagggagccucagcaauauacagccgugaugugaaucucccuagaaagacacaaggcaugaaucuucagagccaacguucuugacauguucauuaaguuauuuuguaaaauuaauguuaaaugaauaagaacuuaaaaaaaaacccaccuuuaccuguuccuguaauaaaacaucucucaauagaaaagguuacccauguuaguauuccuccucuuuagaacucuaacuuuuccauucuuagauucacaaagacccugucacuaacagacggcaucacagcaucugugaugggagaaugagauagagagaacaugugggaugauuaaaaacaggaagggaggagagggagaguagcacacuuaccgguuaaaaaacaccaacccugccuacuuccgauaaaaaggacaaguacagcugaggacacauuuacccacucaugccuggccugcauguaagaagauccccugcccauggagaaauuugcaaaagucaauuucuccucauguuuuucuuucugggaggauggaccaauuaauauuauccuuuugugccauaggaagucaugauuuauguguucccauuuuuccuucuuaagaaaagcuaauguacccugacuucucuuugaacugcugucccucucuuuuugcugggaaauucuggccucccagauuuuccagaaugugaaguugguagacauauuuuccuuacaccaauaacuaaauaaagcccacuccaagauuacacuuaccuuagacauaaaguuacaauuaguuuucuuaacaucuggauguaucugguuccccucucucauauaccuuggagagagaggggggaggcacacuucugucagauauguucucacaucacugcuucaaagucaaguuccaugcucucuaaaugaugccauggcuuuguuggaagaaagagguaaaugcuuuucaaacacuaccgcaggucaaaaucagccaugagaucuagagaaaggcaaguccuacaaggcagcaccaacaugacuucucauucauucguaccagggaauggccacauacaggaagaaagucuccuuucugccaagcagucaccagucaacaguacuugaucacuugaguacuugguaagccucauguuagacauuuaugcugugcucaauaagcagggcccauguccuuuguagcaauuaucuuugaaacuauuugaaccauucaaaacaagcaugacaaguuuauauggaaagagcaaaagggcaaauugaguauacaauaugaaagugccacagagagcgugacuuaaacgccaccuuuaguguuuauuuaaagcagggccuaggcaugaaacauaggcuagacuugauggugacauccuuuauguguaagaugcucaugugcuagcagauaguaaugaucaacugcagagagucagagagagaggaggaggagggagggagagaagagagacaggugcugagcaaacuuuaucuuugagaacucaaauuacuucaccgugaaucuaaaagaacauucauuacaucauuacgagggcugacaaauuacuaaaacaagacagaacaaaccagucagcaugaagagaaggugacagcagaaagagaacccaagcaaggacuuuuccagaccucacuucaugccagagaaaacuuacauuuacuuaaacccauaaugaaacagaacaagcaaauucucccuccaagcugagccauuggcaugcuugagguuccauuaaacuuaguugccaguuaaacuuaguugccagccacgccaauguuccuuugagagagagagagagacagagagagagagagagagagagagagagcacaauauuucaaauguccccagugcuagucaacuaacugcagggucaaaugggccuucugaguauucucucuuggagaccuuacugucucuauacauuuuaaaauaaaauacaacucuaaugauaaaagagcucaauuaggccuaauuugugcuucagcaucuggcuggguggaugcucucugcacuucacacuugugcagcaaaguaucacacuucuuaauuaagauuaccagcucugcuuccuaugaggcuguagggugaaaagaaacaaaggagcuucauugaaucagacagaguacagaccagccaaguucuaggcuauuacugaaaccgagagcagcagacagccccaccuuaaacuuccucccauguguggaugggagaguggagugaugcucucauguguguucauggguguguggugguucauggcacuccaugugcaaagagaggccauugggcaccauuguguccuccaccccccuccuccuguaucucugagacaaugccuccuuuuggaaccaaaccuugccauuuuggcuaggcuggccggcccugagcuucugggucccccccuggaguuuauuuaaauuaacauuauaguauuguuuuuaauuucaugcucauaacuuuagauugagacuuuugugucuccucugcuuuguaagacuuuacuuggggaccucagccagcuuauaugcuuuuuuugagcugaaauagugagacacugaagaaugugagaugcaauguccuacuuuacuacccagccggccuuguguauagaagcaguucuucuucaccaagggcugucugccuucuccucugccagggguaguuaagguuagcaagacagaaauaggaagugaaggagcuucuacacccacauuuccaguccccagacuuaggagaccuuaaaugcagguguucaugguugaaagcccaucucaaagucuuuggcuuuuacucuaaaagcuuuugaaauuauauuucaagaauaaaaggaaagggcacugugaaauugguaauagaggauacaguuuucagagaaauuuacaucaaaagaaacucaaucucaguuguccagugaaaacugcuguguugcuuagaagacuaauccagcaucucuaggugcagggggugggugccuaaggaacaagugccccaucguucacaugcaggggugugccacaaagaugcaagugauagcaagggaaguguggcuauuugggcaucagagagccuuaaagggcaaauucauccacagccacgcacacacuuugauuuuguggcuaaauuaaaccaaaauauauuauaauuugacauuguuacaaaaugugaaacuuccucauaaaaauuccuauuguguaaaguagcaaaaugacuuucuauuguaggacauccuauuguacauacauaacugagaaaaauuagugauaauuugcauuggcuuuacgauaguugaauagacccuuuuaaaaccuaucuuuacauaugccuggaaaucugggcaauauuuuccuaggaagagacuuauuuauauuaaacagauuuuaacauuuaaaagaucagauauaucauuuaauacaaaagauguguguauguguaugcauguacaauaguguaugugugugugagugcaugugugugugugugugucugugcauguguguaaaugaugcuucaaccuguuugcauauccacaauuuauacagagacaaaucuucacagccaacucucuuguuacagauagcuugucucacagauaaaagaugcagaucaauagucagacucuuaucaaaagaaccuaucaauagaaaaauaaguagacugcauacgagcugauaguuuuucaauauaaccuuucauaaguaccagaaagcauaguguuagcaauuucagcuugcuuuguugaguccagagcugugugacuagacauccauuucaaugguuuaauuuuaaagacacagugcauacagcuuggaggacugccuuaaaggacaguggaguagacaaacccugugguguuuuugucuccaagguucuaagccaugcauaguggcauguccuuguaaucacaaauaaagauaggagaauuaguaauucuaggucacaaagugaaaccaugccuuaaaacaaaacaaaaugucuucaaguauuugucuccauauauacccuagccuaauuaccuugacagacuggucaguuuaaucuuacuggagcagugguucucaacuucccuaaugcugugacccuuucauauuuuccccauauugugauggcccccaaccauaaaaugauuucauuguuacuucauaccuauaauuuugcuguuguuauguauugcaaugugaagaucuuuguuuucugauggucgaaggugaucccugugaaaggucauuugaucccccucaagaggucaggacuuacagguugagaaauaguaaacuagagcuucaugcaucuugaggcuugcccauaggcgucagaucacugauauucgcuaggagccaaagcaccaggucucuuauagggccuuucccauaacaaaaccuuucccucugguggagaugcugagaccugacugagcaaacagcugaugaucuauauuuucagcagccacuaucugagggcuuaguuagaaggaagcaguuacuauggauucuauagcagcaccaaaagaaaagagaacaugggauucagggagcucaaaaguuaauuccgggggggggggggggggaagccaaaagauaaguaaugaaaauuucucccaggucacuggcugguugguguuucugugcauuguuuuauguucugccuauccagugcagaagcuucuguuguauuuugcugggaauuccuauuguuugguuucauggcuggacaggaagccccuagauccuccuguuagcugcaaucuucagucuguggugcgggucacaagggcucucauggaaggaguuacagagacaaaguuuggagcugagaugaaaggauggaccauguagagacugccauauccagggauccaccccauaaucagcauccaaacgcugacaccauuggauacacuagcaagauuuuauugaaaggacccagauguagcugucucuugugagacuaugcuggggccuagcaaacacagaaguggaugcucacagucagcuaauggauggaucauagggcucccaauggaggagcuagagaaaguagccaaggagcuaaagggaucugcaacccuauagguggaacaacauuaugaacuaaccaguaccccggagcucuugacucuagcugcauauauaucaaaagauggccuagucggccaucacuggaaagagaggcccauuggacuugcaaacuuuauaugccccaguacaggggaacaccagggccaaaaagggggagugggugggcaggggaguggggguggguggauaugggggacuuuugguauagcauuggaaauguaaaugagcuaaauaccuaauaaaaaauggaaaaaaaaaagggcucucuauaugaaugacuucccacuucuugggucucucaccugccaugucuacuucugcuuucacauugggcuggcuuuguuuguccucaugucaauuguggaaccuuugauuucuguuuauuaccuaguaguucucuuuuucucucgugaucaccagaguuaguggucauguuguuccuugaaagcuuacuuuccagcuacaaggaaaaugggagaagagagaaagggcaaaaugguaaccugguugugcucacucagccaaagcaacuuucccuccaguuuacaauuuaaaugggaaggauuuuccaaguucagcguaagggaccgggaagaaauauuagcucaucaguuaacugcauuagcaagaggaauuugacaucaugauuugcauuugcauuaugccugcuaucucauauguauuagcaguauuaaccuucaaaaacaugauuccgaaaguaaaguauuaacccaauuugacucuauaagugaguucaaaaaauaaaacaaacaagacaaacaaucaaaaaaauaacccaccuccugcuuauucuuaaagagggaauaaauagagauaauuggagggguagaaaauaaaagggagaauuaaaaaugcuacuccaaaggcuucauaucccagcaggccuagcaaaacacaagugagaaagcaccugaacacaugcucagagauuugcaguaaaagugguuaaugguuuucuuaaaugcugcagaaaguggcuucucugucccuaaguguccugcgcuacugaggcuuagugugaaggaaaggugaaaauggaauucaagggcccuagacaccuccuucucagccucaccugcugcugcuucucugcauaaaucugaccuugugugggugaagagcuacuucaugaaccacacagcccccucccaccccucccugccuucagguuugcugaagacccacaguaauugucagaaguagucagaggauauacuuccuguaguuuccuucaauuuuucugaaauaagguauuaauucuccaaauuuauauuuucagguaauugccuuugauagcugagucuagaaaaaaauuuaccaaaaauguuaaaacagcuuuauagacuuuuaugauaucuauugaaugagucauauaauucagaccaccaaugguccaauauccuggcuguugaaaauuugguagcccugugugucaugagaauuguguugggggagggguacauauuugcagauuuguuguagauguauacauucaggcaugcuuauguguaauagcugguuaaucuaggcuauauaccuugaauuuagagacagauugucucacugcccuacagggauaugccagucucugucucuuuagcacuaggauuauaaacauguaguacaaugccuggguuuugggggacuaaguuugggcucaugcuugugugucaaggucuauacuaagagagaaaauacuaaguuuucaguaucggcugccuaguuuauacuuguuuuaucagaaagaaggagaugucaaaacaaugauugcaagaagcagggaauuuucaguaaggaaugauuuuaguuacaagaaaaagaaaaucccaaaugcaauuagcuggaccaguaagagaaaugaccauucuauguaaugacauaaguagcauaauacacucacucuucaagugugggguuagugccucauacaguacaaauacaguaaccaggacacacacuagagauuuaaagcagggggcugcauuuaauauagagggguucauguuuuagaaauuacugacaagaauaaguaaacaggcuuccagcaagcuuccugggacaacuuccagauccaccgauuccuaaccacuaggaagucagaaggagcuauuguuuccaucuucuggccauuaaaagaaaucaggaaccucuacaagugucucucuccccacagugaacuaaaaucacuaguuuggaguucaggaagcaaguuugacuugaauaagugcaagagcugccaccacucacuacaacacacuucagcuggccuuuacaauucaagaaacuggaguauagacaccugaagaucuuuguggaggcaaccuucccacacccuuguugccaaaagagcagagagagguguggaagguguuuccaucccccuuuaccuuuuaaacaucacauggucacaucuaauugaagaaacugcuucuauccucuguccuggcuuaaaagagaaucugagaaagacugcuuuuguuuucccaacaaguuugacuugaauaagggcagaauagcaauuguaggaauccaucagaaguauacaaaaauaacaggcucuuggggagaguccugacacaagaacaugaaaagagccagcagcaaucaaggccaugagagccuuggauacaguuagacagcagggaaaaaagaaaagucuccccuaauuuugcucuugagagccuucuuuuuacuuuauugggccaauagaagccauuugugaaccugugaucccaaaccagugauggcaaauauaugggcugauuguuuagaugaaacaccaguagaaaaaucaaacagagaggccccuauagggcuucugcucacuaauuauucagaaauaaguuagcugaucaaagaggccuguacugaugauccuuuugcccuagcacagcuuugucucaugcccaauugcuauguuuucaugguaguuacacucugaagugaucugguuuugcuuauuauuauuucuauucucuaucaggaucccaaugaggcaagaagucuugccugucuuuuucaugucuauauccaacauacaucacuacccuggauucuauagaccacugaaggaagaagugagugggugguaggcuguauuuuauacuaucuccauguuacagcuacaaaccuuauguucuuccauuagguuuaauagcucaacuaaaacaggauggaaagcaagagcugcuaaauauuugugcauggcacucagcuaauuagcucacgcagucuuugcaauacaagguuuugugauacuacacauuagccacuguguuccagcaacuaugcacacaucagagcccuuuguccuguagaaacucaaugacacaagauuaagaauggguuacaugaaccaccacaaaaaugcauaaguuaauuucuauaccauguuuacaacaucagucaucagacaaaaaggcuagagcaaucaagugaccauccauggauaaaugauaagaguaugaacauaagaugaagagucagucagcuugaagaggcauagucaucuuuacacgugcuaaacacaaaccuugaggacauuaugauaaguaaucuacaaaaagaaaucccauacacucucccuuauauguaggguaggaguggcuuuauacacagagagaccaguggggcaggaguugccugaggcagagggagucagaugguggguagcuguuacucagugguacagauuuucaguuuugugagauaaaaggggcacagaaguguaaagcucauuagcacuguaaaucuacaaaaaauggcuguuaaccgauaguaacauuuugcauuuugacauuuaaagauagccaccccccaaaguugaaaauguauauucugaacugaaaccagcauuucauguaaguuacuuguuauauuuuauaaucaagcaaauuuaaacauuauauuuuuaaaauauaauauuuuuaacugauaaguuuauuuauguacacaauguauuuugaucacaauuacccccacuucugccucuaacucuucccaaacuuacccccagcucucuauuccaugucaauuuccugccauuagaaaugccuagcaauggggaaauggaaccugaagggaccaucuccaguagagagacagggcucccaguggagggauggggaauaccagcucaucuucaaaacuuuuaacccagaauuguuccugucugaaagaaaugcagguaugaaaauggaggaaagacugaaugaauggcugaccaguggccagcccaacuugggauccaucucaugagcaggcaccaaacacugaagcuauuacugaugcuguguugugcuugcagacaggagacuagcauggcuguccucugagagucucuaccaacagcugacugagacagauguagaaacuaaacagcaaaccauuggacuaagguucugaacccccuugggagagauaggggauagcaacuccauaggaagaccaacagcaucaacuaaccuggaccccugggaguucccagggacuaagccaccaaagaacauacacaggguggucccagcucccccaacccccugcccuggcccacacauauguaucagaggacugccuugucuggccucagugagagaggguaaaccuaauucuguagagaagggagauaugggguaggaggagagggagcacccucucagaggcaaaggggaagaggaauggggugaagaacucuuggaggggggcaauaguugggauguaaauaaguuauuaauuuuuaaaaagaaguuacaguaaaaaaaaaaaccagaguccaauucacucuguccauagacuucuguguauaggucuauccacuggacagagugugucccaucuaacuggagcauacccuuaaagaagaacgacucucaaaucucuguuuuucaaguccuggcccagagggcuggguugcagcucauugguauaguacucaucugauacauacaggauguauggauuccauccagcacugugaagaaaagaaggaacaaagaaagaaaaaggaggggaaauuuguaguauaagagaccguuauucugaugaagacauuauguuuggaggcaaggcuagacuagaacuugaaucucaaucuagaaagacaauggagugaaguagcaggcugggauguaccuuagcagugugcuguuuuccuagucugugaaagacuccaggcgcugaccccuggcaugacaguccaucacaagccugaacuagagucuaacauacaucauuugacuuucacgaucucauggggaagcaauaggaauuuuccuguucugaaaacacugaccaagggccagguguagcucaguggcaagaauacuuaccuagcaggcauggggcccugauucgagcuccagaaacucaagggaaaaaggacucaauccaguuuuaggaauaaacagacauaagucagcuacaacaucaugucugaaaaugcucucuucucuuccaccaaucugcuuaauugauaaagcuuccacugcuuuuuauaauggcaauugaauaaacauaauuauauaugcauauauuguucuuuaauuagacuaggugagaacucucuugaacuaaauuuucuuaaaaagagaaaagacuggaauagcuggaugagaguucauuccaggacacucaagcagauggguggaagagaacacacagaaaaagaucagaaucucugaaugguccccaaauuacaaugcuuugacuugauaguuuucaacuuuacaacaaauagcaaacagauaggcauucggcagagucuagauuuuacauuguaaaauauuucacaccccuauguagugcaaucuucucuguugcugugauuggcagaaacagagagcugcugcuuccagugagccagucaccauggaaacaagcaacauuggacagagcacucacugcuaggcacugaacuuggggaguauucaaauauccucauguuuaaagggguuuuaucagggccuaauaccauauuaagucaagagcuuuucuuuacaaaagacaccauucccgcaaagacugacaggccagauccucgagaaggaaaaacauuaaaaaaaaaaaaaaaaaguaguaaaaacauuggcuaauuuuaauggaaaauaugguauauucuuuucuuauaauaauuauuaaaaugagaagaaaauuagucacaucauaauuaaaaggaaauuugaauuaacuuggcaaggacauaguuuaaaguuaaagccacuaaaacauuaaagaaagaaggauagauagauagauagauagauagauauuucucuugauaauaaaaaccugaaacauaaaucauauaaauaaaaccugaaaaauugagaacauuuguuugaaaaauaugaagaauagcuucuugggaagcuaaggcaggaagacuggaguucuaaggcuagcauguguaagcucagggccacugggccauuuagaaagaacuauuaucaaaauaaaauauaaaggacagacagucuauuucaguagcacuuccauuguauccauaagucccagggcuaucaaaaagaauaauaaguuacauugcaggauacaaaugaaugucuugaagaacuauaaaguauuagaaaaauguaauucuucaucagaaaacuaggauaacaucaugaauagaucauaaaaagagaaauauaaacaacugaaauaucaacagcacuaaacuucacuauauucaauucacuauaauuuaugacaaugaaaugauauuuuuauuagaaaagcugucaauuguuuuucaguaaaagccaacagaggcuauaagauagagacauacauacacaccucccucuagggauaaaugugaaugcauaucaaaacacugauucauagaugucuaaguauuuaugucaauguaauuaucagagacuaaaagaaggacuguguauaauaacaaaaguauuaaaaauuagaacaaauucuuauacacccagacuuagaucugaaaaaaauuaugagaugggguuuccaguaguuaauagugugaaaaaucaaaguagaccuaaauguaaucaaaguggaagacaaaacaugcaaauauauguaagaguuuuaugaccacacaaaacagucccauauuugcacucagagaaaaaucccagaaggcauugucaggaaauagauccauaugucaccaccuggcauaacuaaaaaauacaauuuauggauuuuugcuucuuuuuuugggugguggggcaauguuuucaaauaauuuuaauuaguugauaaguuauauuuucagccuuauacugcaagcacuuagucuauaucagacuggcuauauucacaccuguuuaguuuacuauuguaaggaacuaauagaaagacaaaacaguugucagcaaagucaaacuccugauauuagagacugguuuggaaaaggaaggcuacuuguuagugcaauguaaggaaaguagaaagaaaaacaaaaugucaugaguguugucuggugauuccagcagccaagacggcuucuaggguuggagacaaagccucaucuaauggacugagggcgagaaucuccacagaagcauugcagccccugaucucacagccucaggcuccagccaauguuguaaagcccauauccaauucuuuguaacuccuauuucucuaccgauuauguggcugccuuccuccucgaucugcuggcaauaccaauuacagaggcaaucacuauguagaagccaucaugaacaacucuggagacgaguccucacauuaauuauaacaucuugcauauuaaagcccaauauuagcuguuguuaguaucuacaguuauaucugaguuauccuauacucuaaggaggaaacaguguacccagucauagaggauuuuucaaguaucaggcaagaagauguagcagguuggcugagcagguagggcagagcaaugaaaauuccaccaggaggcaaaggcuauuucucuguuaauccaaaaaucuuucuuaauagcucauccucacaugcuauugacauacugaaguuuaaaaaggaaggaaauucaauuagucguaacuuuauaguuauuuaguacuaacaauauguccuguagguagccaaaaaaguuaaggaaagcauuauaaaauauugcccaaauacacuauggguuaaacaagaaacaagaucugaaugugggaaauaaccugugcuaaucaugucuucuagggagauccacagucucccaauccugaaaugagaaagucagcaaaaagaugaacugaaucccagauguuaauugcacaggcuuacuggauuagaacuagagauaauuaauugcuaaauuuuaauaugcacagggcuaaggggacuagaaaauuuccaguaguguguuugaggucuagaaggaaaugauuacuucuucacuggacugagcgcccuaggggccaacgacagcugcaaugucugugucugggagacacagggugauaaagcaagacaaaaacuguagugagagagaguggaagcuucccuuggcuuuucucauuuggaauuuagaaugcaauuguguguggaaaugaauguuuugaaggccuuuucugugguggugguguugauuuuuccacuucagugauuagcauuccaauccaguaaagucaacauuaaaucuagccagacccaaaguccauuacugcuuaucugaaagaagaagaagaaaaaaagacacuguuuaucacugagauaauugcaauuuuuaugagcuuaaagauucaggagaauacugugguuaauuggggaaacugaguuauggccaagcgguuccuauaccuucccccccccaaaaaaaaaaaaaaaaaaaaaaaaaauacugcucaaagggcaagaaagaucaccaagugcacagcuaucaccaaaaccuuuuacaguuuucauggggcuguguggagccagacaauaggcagugcccauccaugcuacagaauuguccccugagcagccuguuaaaaguaugggcuucuggacuccauucuggaaaugcugacagcucaggcaagagacugacacaaggaugcucuucuuggcuccucagcacaccugagcaucgcagggaugaaagagguuugagaacuacuuuuuguauuuuaaacuucuaacuuuuacaauggaaauauaaauacuauuuugguagucuuuucuacugaaagaggguguauaguaagggguaaaugacauagacaagacauuauaaugacaaaugcuuccugaaguguuucagugagccugagauuaucuuugaugucacuauaagugaagaaaacauguccaugaucacacaguaaauuaaugagcaagagcgugaaaguuuaacucuaauauuagaaagaauauacuuugguuguguaauaaauuagagugcaggucacuacaauauguuaccuuuaaaauacccauguuuacauuauucuuuaacaaacaauggagagauauagcuugugauuuauguauaguagaucccuuuuggcuagaggaauacauuccagcaccuuacaguggaguauauauuuuucuauaauauauaccugaauuuuauuugaaaacagagagaaugaaaaauuaagagcuaauuauaaaaugacauaaaguauuuaaaacuuuuaaacucuucauuucuacaacuuuccaugccaucuuuucacucuacagucaauacuaggcuauuugacuauaaaaguuagaaccaugguuaaggcacccaauggguguauauuuuuaauguaguggaauuucaucuuuaaaaugagaagauaauagugugguuauagccaacaguaugaugcauucaaggagauauggagcuugugcauaugugcaugugugugugucgugugugugcuucaguuucuguaauuagauuuucuguuacuuagcaucaucucuguagggcacaagguugauaucucagaugagagauggagaucccuaugggcaagaagcguagagaaaggugcaggauggacaaugaccuugccccaucagcaucuaaccacacacugaagacuagcucuuccauuucuucaguauacaaggcucuccuuccugguuccacagcuucaacuuucccugucugcaggacaaacaaaaucugcaaggaugccacaucuaucugcauuaaauacuuauucaauucugucacuucuccaacaccucugcugacugucaagugauuuccaaagugagucuagcacacccaaguggcaugcaggauccuauaaaaucacugccgacccauuucugaggcucguagccauuuuggcacucuaggauauuggaagcugccaagguuuauuucauaagucacauacuucaucaaaauacauuucuccuacuccaacauguccauagccagggcauagccagcaugagacaccucacauuuucaucuggugugugucugucuauacaaugcaacacugagcuacaugaugacacaaaugaguuccugcucaugucagugccccuacucccuaagcucagcaugcuauuuguacauaguaggcuuucaggaacccucaaaaauucuucacaaagcuucaacugaggucuuuaccaguuaaagauauaagagaugacuuaauggacuuaaaauucuuucccucauggaggauagcugcauauuuuuauccaucauauguggcauaauuuuaguugauauuaugcugauaguguaaaacuuuucuacuccaucguggccaaccccauggaagcaauuaccuguuugaguaagcauaugacaguuuuaaggacaggauuauaaaauuuuacuauaggguugagaauguaaaccuaauucugucaagugagaaacacucuaaauagcauuuuuaauggaaguaauggaauagcuuacuuuuggaguauuuaauaccaucuucaauauuaaaccaagcuuuacuaacuacucaauuucacaacagacauccauuccuucuccuauaggauuagaaaagaagcaccaggaaccaucagucucuuauaggucucagucuguuaguccaugcaugcauuauauuucagccaggucaucuuugcuuuucauuuacacagcagcgagcaagcuuuacacucuauugauuucacgguguuuccuaaauuuucccuuuagguuuacauugauuaaugaauuucagaagucuuccuuaccaaauccuaggagaccauuuaaauuguuucauucucugccugaccuccuaaagcuuccaaaaauaauuauagaauuauaaacuuguuauauagauucauuucaaaauuaucauugaucacaucuucacugcacuaaaaaauaagggagggaugcaaaaaacuagacccagauuuaaaagcauaucucaugaugaugguagagaacaucaagaaggacuuuaauaacucacuuaaagaaauacaggagaacacugcuaaacagguagaagaccuuaaagaggaagcacaaaaaucacuuaaaguauugcaagaaaacaugaccaaacaggugauggaauugaauaaaaucauccaagaccuaaaaagggaaguagacacaauaaagaaaacccaaagugagacaacgcuagagauagaaacccuaggaaagaaaucuggaaccauagaugcaagcaucagcaacagaauacaagagauggaagagagaaucucaggugcagaagauuccauagagaacaucgguacaacaaucaaagaaaauacaaaaugcaaaaagauccuaacucaaaacauccaggaaauccaggacacaaugagaagaccaaaccuacagauaauaggaguagauaggaaugaagauuuucaacuuaaaaggccagcaaauaucuucaacaaaauuauagaagaaaacuucccaaaccuaaagaaagugaugcccaugaacauacaagaagccuacagaacuccaaauagacuggaccagaaaagaaauuccucccgacacauaauaaucagaacaacaaaugcacuaaauaaagauagaauauuaaaagcaguaagggaaaaaaaaaaaggucaaguaacauuuaaaggcaggccuaucagaauuacaccagacuuuucaccagagacuaugaaagccagaagaaccuggacagauguuagacagacacuaagagaacacaaaugccagcccaggcuacuauacccagcgaaacucuaaauuaccauagauggagaaaccgauguuuuccacgacaaaaccaaauucacacauuaucuuuccaugaauccagcccuucaacagauaauaacagaaaaaaccaauacaaggacggaaaaagggccuagaaaaagcaagaaaguaaucacucaacaaaccaaagaguagacagccacaaaaacauauugucaacucuaaaaacaaaaauaauaggaagaaacaauuacuuuuccuuaauaucucuuaauaucaauggacucaauuccccaauaaaaagacauagacuaacagacuggcuacacaaacaggacccaaaauucugcugcuuacaggaaacccgucucagggaaaaagacagacacuaccuaagagugaaaggcuagaaaacaauuuuucaagcaaauggucugaagaaacaagcuggaguagccauucuaauaucaaauaaaaucgacuuccaacccaaaguuaucaaaaaagacaaggagggacacuucauacucaucaaagguaaaauccuccaagaggaacuuugaauucugaauaucuaugcuccaaaugcaagggcagccacauucauuaaagaaacuuuaguaaaguucaaagcacauauugcaccucacacaauaauaguaggagacugcaacacaccacuuucaucaauggacagauuguggaaacagaaacuaaacaaggacacagugaaacuaacagaagagaugaaacaaauggacuuaacagauaucuacagaacauuuuauccuaaaacaaaaggauauaccuucuucucagcagcccaugguaccuucuccaaaauugaccauauaaauggucacaaaacaggccucaacagauacaaaaguauugaaaucgucccaugcuuccuaucagauuaccauggacuaaagcugaucuucaauaacaacauaaauaauggaaagccaacauucacguggaaacugaacaacacucuucucauugauacuuggucaaggaaggaauaaagaaagagauuaaagacuuuuuagaguuuaaugaaaaugaagcgacaacauacccaaacuuaugggacacaaugaaagcauuucuaagagggaaacucguagcucugagugccuccaaaaagaaacuagagagaguacacacaagcagcuugacaacacaccuaaaagcucuagaacaaaaggaagcaaauucacccaagaggaguagacggcaggaaauaaucaaacucaggggcaaaaucaaccaaguggaaacaagaagaacuauucaaagaaucaaccaaacgaggagcugguucuuugagaaaaucaacaagauagauaaacccuuagcuagacucacuagagggcacagggacagcauccuaauuaacaaaaucagaaaugaaaagggagacauaacaacaaacccugaagaaauccaaaacaccaucagauccuucuacaaaaggcuauacucaacaaaacuggaaaaccuggacaaaauggacgaauuucuggacagauacuagguaccaaaguuaaagcaugaucaaguuaacgaucuaaacagucccauauccccuaaagaaauagaagcagucauuaauggucucccaaccaaaaaaagcccaggaccagauggguuuagugcagaguucuaucagaccuucaaagaagaucuaauuccaguucugcacaaacuauuucacaaaauagaaguagaagauacucuucccaacucauuuuaugaagccacaauuacucugauaucuaaaccacagaaagauccaacaaagauagagaacuuaaaaaaaaaaaaagggagguaugguuuuaauuccuccugugaaucacuacccuuccaauccagcuuacaaaaacaaaacaaaauaaaaaauauauuaaaaaagccuuuuauucuaaauuacuaguaguaacaaugucauauaauaguccuaacauaugaauuacauauuauuuuaaaauaaauccaauaacauguaacaauauacucaucaaaauuauuaaagaaagacucgcagauugaaucauugaaauuagcacaauacuacuuuaagaauuuucaagcauuuugaaaauugcacugcacaguguucuccuacugagccccaagugacauggggaagacaacagcaucauugagaacguaauccaccagccuguaucaccuuucuccucccaggggauugauaguguaaauacaagaguucauuucauggcugcauuguacuucauccaagaacauauuauucuuguucucacucuuuagcuaagucacaaugcugugucucagacccagcucugcaacuaugaggcaaacucagugacuuaguuacaccaucuaacuugugggucauagcccgugcccacaucagguucuaaaugccagccucagaaagccaauccaaagagcagaaagagcagagagcagaaaagggagaugauucaauauuauucauauugcaaacaggaaaaaagagaucaagggaaccucacauccaucuuuugagccuaaaguagaauuaaaguuuaaacagaagaccaaggauaugcuuguguaagcacucuuggucacagaggggaccugcccaacacugacccaucagugcccagguuucagucuuacguugugagauaacaaguugauaaaaugguguggagucucuuuguggaacacaagacaccauucuugcugguacauuuuucuucccccagcaugagauuccuggggaaauccucuuucuuuuguggggugcagggggcauugcuucaauagucaagggguggucauugcagcuguugcuauuauuguaauauaaacagcuucacauguucccuuaacaaggaaucucguuuauaguuguuucauuugacacauauuaucugaggcaaagcuguaacuaugagacaguaggaacaacuuguucucaguccuugccuccccggaauaucugaguuccuggcauuagccugggagucaagagggaagaguaagaauaauuuuuuccaggaauacagcaacacaaggcagaucuaaaaggaaaccuuaggugaaagcuuaccuaaggauuagguaaaggcucacccaguaggagucuguuuagauuuaaaaaccucgggagcaucuuaugggaaauggauuccaugccugggaacauucaguccagcacagagaagaaggaaagcagaacaucagcaaaggagagaggacaugggaggucagagaugcugcagaagccacgcguacaagucauuggcguagacauagaggagagaggacacgggagaugcugcugcagaagccaggcguagaagucauugguguagaaaugguauaggaaaagaccacaguaaagucuugaaaacuuggcaacuucuuaucauuuacaccagcagaaaacacuuagggcagaagaauaaauguuaguuaaacuuaaaggauuaaauuacaaauuuacucaagugauuuaaacuuuuacuacauaaguagcaauuuuaaguuauaagggaucugaaauguuucuagaguuuuaaaaucgaccauuuuacucuaguuuuaaaaagaauaggaagaaaaagaaggggaaaaagauuuuuacuggcagucuuggagugcauagcaaauccuaugacuuacaaugggcuguuguaauugcacaguuucauuaaaauaauuuuacugaucacuucccaguauucuguuaauuaucauuucagaauaagaaaaacucuuacuuuuaaagcuuauagaaaagugggcuuaagcaagcauggaaagggaagccagcaagagaaaaauauaaaaggagccuauuaauauuagcaguuacaguuggguacuuguucauuuaauaaaucuuuggcaauauuagcaagauugaugagaagaguacaaaugagaagaacaugagauaagugaucauuuguuaucauuacugagauauaaagcaugauccaguguuucauaauggauguuaaauuugauuuaacauauggucggcucauuugcugaaaacuacccuuaaagacacaaacccguucuaaagucagaaccauucucuuaauaacccuuuggaauuauccaugucuaagagacugaauaaaguuugucaacacaagcuugaggaaaggauguggaaaggcucuucuuuaaauagaugugccacugguuccaguuccuuaagugcagcauagaaaacacugugcccuaguauaaaagaauuaagaaugaauguaguaacaucaguacagauauucuuuaacacaggguuuucagccaucaguagggaaacugucauggcuguaacagcuccaccugagaaaucuuccucuuuaucaucacagaagagugucagugcccucuugaauuuaguggauuaaguagauuaagagcuauuaaaaugguucggaauugcugcauuucaguagugaacuuggggaccaagagacagugaaacacacuuguuacaugcaucuacuccuagcagucacucaauuuuauuugagcucucaguuuuaucaagaaaaauacauuaagauuaagaauugaugaacacucuacccaauagagucaccagaugagucugugaaugagcugucauuugcugucccaugaaggcugauuucuugagcuccuugcuaucugcucugaaaucagggucauuagcaauaugccuauuuuucaaaauaaaaucaggauugucuucauuuguucauaccuuuaggccuccucauuuaugagcuucuauggucaugcuuggucuacauuuauguggaauagggacugcuaagguaacuguuaucuaccucuuuaaaaauuaucagaaaauaaagagugugguuuaccgugcuauguuguugauaugcaucccuguggcucaaaaugucaucuaauccuaugcagcuaccagcagcauaaaacguucuuucaucaaacaagcuuuauuuguccauucucaggcuugacuguuuagugaauguuacuuuuauaugauauugauugauaacaccagugucuauauuuauuaucacccugacucucuagacuucaauucauuuguaaaaugaagagugugagcauccauacauugguagaugcagaguucacugucaggcuggcuaugcaccuggcucuuauuuuacuccagguaacaucagaaauuaaguuuaugaagguacuuacauuuugauauuuuacugaauuuuuauguaauucuugagauucauuggaaguacagcauuguagcaauuuacacaaccacuagccaaaagaaaaccaagacuacuaaaucgacucaacagcccaccaagggauacaagcccuuccuccaagaaacuuuucugaaaaagcuaccaagccaagaaagagaggaggaucccauagcccggacccugcagguuccucuucacaaucugaagagaucauuuaaaacagcacgugcaagccacuuuaaagacagaggcauggagaccccggggaggaccaagauucuggccacguuaugacgccaucauuucuaaagcuuagcaaagagaaccacuaagaaaacaauaucuccaaauugcuagauuuaauccaacuuccaauuacuuaugacauuaaauuagaacauacuuauuaugagccuaguauucauaaagcacucugauggucucuggcuccuucacaugcaucuuuccccuuuuugcucuccucucuacagggacuucuugaugagggucuuucccuucuagcuucacaugcaaguugacuagcgaaggaucuaaugggugauacuccuggagaacccugggacuuaguaguccuacaggguuaaauaaggcauaacucuucaaugagcaugcauggaaaagggcaagcuaccccuucaggauuuauaaguagccaugauauauaucucagaggacagagaucucaacccacgcaauguuuuaaaaacagacaccccaacucugacugggcugacaggcacgcagcugcuccaacuuuauuaauuaguacccagacccucugagaauugauuucuccuuugaucccagccugcacauuucugucucugauaucuaaacagcaaaucauguuaucuuauaauuaagugauaaucuucaugacagaaaagaugacaggacuauaaauggcuccugcaagugaugaaaauaacuucuucccucuuccuacccugcucugaaacuuccuccaacuucauaaaucuacuagucuuuuuuuuuuuaaauaaacucuuggugacauaagccuuauucugauucaacaagaucauauacccacuaauauacucuccagaaacuauaugcauaugauuuucagguuuaaauaggagcaucuugugauugguguuagaaaggucuucaaaugcugcuaaaccuuugacuugaauuuccagauuguucaauucagucuaagaguucaaaauaacuuaagagucauuauugaaacaaaacauaguauuuaauguaaaacaugaauauauagcuagccaaagagauagaucaaagaguagggaaccuuacugugcaagcaugauaaagaaccuucguuugaaucccuaguaccuacauaaaaggugucuaugccuuuaacccauguugagauaaggagaagacaguuagauccuagaagacccaguggcagccacccuagccaagacagugacauacaguuuugugagaggcccugccucaaaggaauauacuggagagcuauauaagacauuugccaccauccucuggccucuccauugguggauauagguacacauaccagcaugcucacaugcacagaguguacacauacucgacuccuacccagccuucccuuaagauaauaaauagauauuagaagguaaggcuuacuucaauaaguaaagacgauagucauuuagugaucaauauggacuagauauuagaacagguguucaagauaguauagccaacaggacagaauuuuacuuuuaaaugaaacaggaacagguuuuaggguggucaaaaaggaauaggaguuacuuuguaguuaacugguugcuagaguaauucucaaaugacaagugggaaaggugccaugaccaggacugaagauggaguacacacaguucauuguguguacacuccauaaacacuacacaaaagaauggguacguacaucaaagccaucauucugccuggaccgugaguucuguuggagcaagcuccauggccaucccaccucugugccuucuaagcucuugacaguuccuugugcacuguagacauggcauuguccuggacagacacucggguggacacuucucuaaauauaguucuaugucauuuuggacccuuccuugaucugaaacauucccuugcuaguuacuucauccuuucuuucacaguccuucauucucaaaauauggcuuugcuucugaauaaacugccucuguuagggcuuccuuugaauaaauucaacaauuguauuccucuagaauuuauauuaauaaccuuuagguccuauacaucuccaaggcauuuugaaaccaaguugaagauguuuucagacuguauaaugcuguucuuaaaaaccagacucucagguucucaagaacccugaauguguguguguguguguguguguguguguacguauaccuugcuaaucucuggugaccuuuuuuuuuucagcuccaacuucucaguuuuauuuuacuaucaaauugaaaacaaagaaacacaagagccucuuggguuagaaaccagcucagucuuagguucuuagggacucacaauuuguucugucauuugcagaauguauugcacuuuaauucuuacaugauucaucuuccuaaugauacuucguuuucaauccagagauguaccuuuuuccacuauccacuauccacaauucccauguuuacuuuuuaaaacuuuuagccucaaguaguucuguauuuuccuuugggcuucucugugucacuccaaauugcuuccucuaacauaaagauucucaugcuguaaauuugguccuuggagugacuauacugagaggugguggcacauuacagaaguggggcuugagcauagagaagcuugcccagaagagcaggauccucaugucuagauuaacauuuuguuuguuuguuuguuuguuuucaagaguuuggcucaguucccaugagaguggucguaugguaguaauaaccuaggucucccccaucucacaggaucaauuauggugagaaaauccucacauaucugucuuccccugaucauuuccuuccagaugucaugcccccccaacacacacacacacacacacacacacacacauacacaagcagcacauaagcagacacccuauaauuuccugaaauucuagacugccucauguaucuuguuauagcaacagaaaauacuaagucacauuguucaaaaauaauucccucucuccaaaucacuugaaagggaacuguuaagaucuagcauguuugcuuaaaaugcagcuauacuaccuagguuuccaaaguucuuauauauacaaaauauacucauauuuacagaacuauaaucuuacauuuguaugacaaaaucauuacauugacauguuaucaacuuguuaagagaauugucacgcucugugucuuuuauagaagaaggcucauucccaguggacacagugaugauuaugucauuuuguggggugugugugugugugugugugugugugugugugugugugugugcucuuucuucuuucaguaucuuauaaaccauaaaaagguagggaggaugcugguccuuccccaaggcccauuuguugcaccuaauuccaagccuagcucaaacuauauggucaguaaucaaacauggagugaaaagaaaaccaaauccacaacaucacagcauuuuuauuuuauggggugugaguguauaaaaauuuggauaaacaugacuuugaguccuugacacagcaauagaauggagacuagaaauagucuuucagcauauuggguauaucauccuuauuuggaagguacuuucaagguugaauguauguccauuagcuaaugaaugggugagaauguucaguauaacuaacaaggacuaaugaauuagugaaacuuuucaugagguuguugguugaucaacaagcucuagguauccccuccuuugcuucuauuuccuagcuuauuuccacacugauuuuuaugcaucuguauucaaaagcucagguaaaugaagugaaacucuggagaaugaucaacacuaauagaguagacugaaaauuuuuagacugaaauuccuacugcuuaaagucaccaucaaacaaauuuuauuacauuugagcaauauuuaaaagaacaccacacauuaaucugcuccugaguuagauugcuggagauaaaugagauucugaaagaguaacugagggaauuaauauguaaccaucuacccagaacagauuuuuuaaaaagaaaauugauuuuguaucuagagaaauauaaaagacauauucaugcuaugaaaccaggauguaaaguggauggacaguggaguuguauggcaacuuaauggucuuuacuaucuggucuuugucaucauugugguucuuaaaacaccuagaguuucaaccacuuaaggaugaagacaugagcacugguacugacuguauaggacacacaaaucccagguacucucagauccaauaugcuuagccuaagagauccaauaugcuuagccuacacagugagugacucaggccuuccucaggcccuaugagaguaccaccuuccauauuggacagagauggggcagggggaggggguugaagacagaaaucaaaggagccucacuacuuucugaugacacauauuuguucucuggugcccugcccugcccugcccugcccugcccugcccugcccugcccugcccugcccugcccugcccugcccagcccugcccugccuagcccugccugacacagcccagcucagcucugcuuugcaccacuacaccacacccagacccacccugcccugcccugcucucccugcucugccaccuuucccuuggagaggaaauauugcacccuaagcaaugcaguacgaagcccacuaaacuccugcuacaccccuucaugggcucuucuuguccagauggauaaaguagaaaaucagagaagaggcagagguagggagaggagaggugaguggaggggagggaaaagaaggacaggggaggggagagaugaaaggacaggagaaugaaugaccaggagguuguucugcaucuuaagguucuugccuacuucuaaccacugucauuaguaaauagagcaaaucugugucaucagaaguagugagguuccuuugauuucugucuucaaccccuccccugccccaucucuguccaauauggaaagugguacucucuaagggcccgagucacugacuguguagcaugggucacaaaaaaaguagggcacacacugggcaauucuaacuucuaacuucccaucucucaccuucaucguagcuacccuguucuuuuuuuuuuuuuuaaucuuaaaaaaggcagcauuuuaaaugaccuaaaucuaaaaguagguuacuucccacuuauaacuauuucaacagcaucuauaaaaccccuacaguuuccauuuucaugauuuuuuucaccccucccucaacaaauagaaaaucccauaacuugguugccauuuggccuuguaucacacuccaaaccagcuggaaacccagguccucauuauggcagauaauucuugcaucaacuauuuguucuaggcugauuuuaccaccacugugaugcagcaggucuucccuuguuuugccugaaaaauugguuuaagugugaucugucuggaacagaugcuacucaaaacaugcacggaagcacaccucagugaggaauccagcugcauuucuggagaaaccguguuuaaacauaaguuaauguuuaauggauauagaccaaaacagaaauaagacaaaauaccaaugaaaaagccauauuuccauaguaaaugcucaaguauauuugucacacuucacaguuugaauacggucucuuagguacaaagucacucagaacagguggucaaccaacaucuuacucuacacucaagagauuuguccccauuguuccacgugauaacucuaaaugcaguuauucuuagaucacauuauaauuuagccaaugaaacauuuaaugaguagaaauucaguuucuaggcauggggcccacacacacuacuauaguauuucauaaguuuguacuuagauagcucacagagagcacaaauauacacugcaauggcuguguucauauauaauauacucauagauaugauauuaagcuugaccucauauauacaccuugcaagggucucuuuuauaacacuagguuuugucucuauuuuuccugauugucucauagauguacaaauacauucucucucucucucucucucucucucucucucucucucucucucucucucacacacacacacacacacacacacacacacacgguaccaucuaccaccauuuauuucaagaccuuaaaugugaggugugugugugcauaagugugcauguauaccuugaauuuuacaguuguauugcugugaccuuuguacuauaucauuucaccugcagcuuagaguuuguuucucuauaaucuccgaaguacaaagaaggcauucaguuaauaugaaaugauaaagguggacggggcuuaagggaugagauggagugaaaaaagaaaugaaggaagaggaaagaagaaaaggaaacagagaagccaggagauggcaaaguagagaaaacagaaaagaaaagcuacuuagggaaaaacauacaacccaagaauggcggaggacucugcaacaaguaaaaugguaagucaggaaugccaucacuagguaaaaagcuaaggauggaaaauaguagaaaaugagacaaauguaaaauacuuucaaaagaagugagccgauuccaaaccagagaucuucaaagggagccuuuucuuuacuuguaucagauuuaaaaaaaaaaaaaaaaaaaucagcaccuagggcuuagcagguaaaggguaaguaacauucucaaaaggccuccagggaccaggcaaagaagagaaacagaaucacagggcacaagacggccaaguaucaagcagaggcuaaauuuaaaaaggaaaaaucuggguagagcaaacuguucagcugagaaacugcucugcccucagaaccuggaaucagaaagauacuuuccuucaaauauuagguuuucuuccucuuuuuucuuuaaucaugcuucuuugcuugaauagaugcaaccuuuagucuuucagccuuccuuccucaucaaugccuuucaacuuugguggaaagaagagauuugacacaaugaaacccaauuuugauugcuuuguccugagaaagaaaacagcaacaccuggccuguacugguuggaacucuucacauaccaaggauuacauuccccuauauuuaacacaugaccuuaaauauuguacuacugggauuggcaccauggagcugugagcagccuaugcugcaccgugaugacuucauugccucuugguugcaugagaaaaugcauagggacuuaugaaggccacuacuuuuuacaaggccauggacuuuaugggaaaacauaguggcuacagaagcaaugcccuuugcuaauuugcaugaaguugcucugugucuucuagcacucuuuauacugacaacuagugugaaauucaauaggauguggcagauaaaaccgagggaguugcuuagaaaagaacauuaaccaggcaaguguuauagggaaugucccuuugucacuaucaagaauaucucuaagggacuguaucauuaaagaaguaucuauuucaaaauauauacauaaugacaagggacaaauuaugacacuuccacuaaaugcacaggacucacaguuaguuacugaugagaacacugaagaagcuuucuccaaugguuucucaccucccuagggcaagaugguuuccugugauaagaacuuuccuuguugcccagcaauucuggacaguuaauaaauaacauuggaaaaacaaauuuccuucucaugucaccucacaaugcaaagugaaggugaugaguggcaggcgaccucuuggaugacaaaaugguuuuuacgaaaguugcuaaaaugucaucuuaguaagaacauaugucugaggcucaagagacggcuuggugguuaagagcacuuggguuuuagaacucuuacgguagcugugaccaaccaguaacuacacaugcaggugaucugacauucucuuuuggcuucugcagucugcuauaugcauauggugcccaggaacucauucacacucacagauagauuaaauacacaaagcccuuuagaaagagaaagaagcguaccugucuauucaaccaaagcauuggaaaauagcgaugaguaaagucugaugaacugagaugcacaacugucacuccacaaagacuaugacuggguagcuagaugucagucauccacacacuggcaucaugagccuagggcucauagagcugguuucauaucuuaaaugggacucaggcaagaucuugauacuaauggaguggagcuugagggagauuggaguagaggcucauagaaugacuuucccugggggaaauaugggucuuacuuuggauagcauuauucucuuaguaggaaaccauaucgaagacucauuuaggaaauguaaacucuuuggaugugcccauaaagggagagcugaaggcaagagucaccaggucaccaucccuucugacaaguggacugcaccguaucauuagcaaagaaaacaaaaauggggggaggggugucuaccauuaacuguguccugaagcaaaagugagagugcacauaaaaaacguaagcugucucugcacauaagggacucucagcuggguguggcagcucccaucuguaauucuaauacuaaauguuaggaagggagauuauauauuuuaauuuggcuaagauuccacaguuaguuuaauaccagucaacuugagcuaaacacuaagacuguccuuaauuuaaagaaaaaaaaauccugaauaaauauccauggaauaagaacaauggucuggaagucugaagguucucuaaccuggucaagucauucccagaucaccuauaccuuugaaucaucaauuacaugaauagaaguauccccaauuuccuaguuagaugcagcaacagaaauuauuacaucuguuuuaaagaugaggugaccaaagcuguauccauauucucaguggcuuaaaucaaagugaguuccaggacagccagagcuauacagagaaacccagucucaaaaacaaaaacaaaacaaaacaaaaaaccuaaaaaaaaaacaaaaaacaaaacaaagcaaacaaaacaaaacagaacaaaauccuauaguaaaacuggguccucgcuucauguuuucauaugggcuuuuggcuguaggagaauucuaacuuuaaaugcauucaaaacaaguguaaaaucacaagauguagugucacugagaaaagcagacaacaagcacuuuuaccuaacaugugaaccacgugaaucacugagcaucuacccugaguaccaaaggaauaugaagcuaccuggagguagcuaugaauacuauagaaagcucagcagcaauuuuaaaaaacagacauucuuuucuuucucugagaaaaagcauaagagauagggauuuucacuaaaaugauguuucagauagacaaauguuuaauuguauuggcaaugcuggcaaauuucacacuagauaguagcaaccauuuugcuaacucccucaugcuacacuagccuaagaucccuguaggaucuccuucgccucauccucaggacaacugcaagaauuaucaacuauacucuccaaguuucucaggacugaagcccugaagggaugccuauguguacaagucugaggcucacuacagaguggagagaaaacugagagaagagauacaguaaagucaccaggaacuuugcgcucauuaguccuaggaaggacccugaagagcucaucagaaacuguugccacuucugucauuaucaagaagguagagagucaggaugcccaugacaaagacauggauaauggaaaugguuugauggaugucugcacagaaggcaguggcugucacugauacaaccuuuaguggcauagaaaagccacacuaguaaguaaaucaguaaccuugaaguuauuaacuagaugauuacauaguacuuuucacaguaaaacuuaaucuucucaaauguucccggggugcucccaaccuuuuaacuuugcaacauggcacugucaucuacaaaccuaccuaucccaaggacacauguaggccaaggccucaaguuggauauguauauauauuuuaaacaauaggaacugcauaaauauagaaagaccaccuugcuucaauucuuacuucugaaacacaugaacuuaacuagcacaaaaggaauccuauuucaaguucaggcuaugaggggguauagggaauguaguauuuguuuuucuugccuuucauuauaagaagacucaagaaaagcucugaaggccacugugccccagucacuguaacuuggcagcaugugcaccaucccaacagggacuccuaaguaaacgaagagccaugaguaaggcaaguacagauguauggauaaauguauggguaaauguaugugggccauaauaggaagugacuaauaagaaaacugaaauaagauuaguacaacuagaguaacaacacauccaggguuaaggcagggauguggcugaagaggcacagagagcuggauggugcuacgucugcgaggucagcucagaagcagugucugccagaugucccucuugagccucuaaggagacuucagcucuucguuuguccacccauacuuugccuguucugcugcuacccuggacagggagggagaaagcaaggaggagauacacaguuucacauuuucacccaaaggucuggcauauaacaaauacucauuaaguaucuaucuauauauggcauugccucuuaaaugaggcauuuuguagacuaauccacaauugauuauuuacauucaaaaggaaaaugcucuugucuaccugaggcaucuuucauuauaaauauugcuuuacuacagauuacaggcagcuaauauaauuaaaaauaauuuuuguauguuuguauacagugcuacaaaacuguugcuuuuaaaugggcauucacuuuccuacucugaaaauaguaccccaguuuuccaguagggaucacuuguccuccuucagauagaggcguacaucgggcuuuaccucagccuugagguccaaguuggacauaacuguguccuggcuggaucaaugagagcugucuuugggauucugcuaugagcuaauauagaaaacuugcucucuuucuaaugagauacuguuucugguaucaagaugaucagguauuaacauauucaagggccacaaaacagaagaguucuaugaaguaagagagaagccaacagaagagaucuaugacaagccaacauguucacaugccugccugcuugccugugaaccugcauuauuuauuuguuuguuuguuuguuuauuauuuacuuauaucaagguuucugucuuuuguuauuaaaaagaauucauuuuuuccccuuuaacacacaaacauugaagauuucaaugacugaaagcagaagaaaagaguuuggaguuggggcaucauuguccacaaguuaacaugaagacauucucagaggugacacugggaagacagauagccauuacauugccucuugccccuucuuagaauuggaaacaaucacccauggaaggaguuacugaggcaaaguuuggagcugagacaaaaggauggaccaucuagagacugccauauccagggauccaucccauaauuagccuccaaacgaugacaccauugcauacacuagcaagcguuuguugcaaggaccgugauauagcugucucuugugagacuaggccagggccuagcaaacacagaaguggaugcucacagucaacuauuggauggaucacagggcccccaauggaggagcuagagaaaguaucaaaggagcuaaagagaucugcaacccuguaggugcaacaacauuaugaacuaaccaguaccccggagcucuugacucuagcugcauauguaucagaagauggccuagucggccaucacuggaaagagaggcccauuggacaggcaaacuuuauaugccccaguacaggggaacgccagggccaaaaaaugggaauggguggguaagggagugggggagggggacuuuugggauagcauuggaaauguaauugaggaaaauacguaauaaaaaaaaaaaaaacacaacuaaaagaaaacccaacaaggccuucuccuauacacauucacauauaauugauuaauggaaaauaggaagaugaucauuaccaagacugcuucagaguucuucaggguuaugggaauuacaaaugauuugaaagaaaaugauuauuuugaauuuuccccaauguagcuguacaauaauuaaugauauugagacagcaugauacucauuaaaaaaaucauugaagacuuuccaaauaauugagccaaaugagaugcugcaagaucaaaaccaggaagcaaagcaacagagcaaaaacagccccgcaaccagaagaggaagucaaucauccccagacggccuugguucgccauucagacucauaggagaugcuuaaaaggcugucgguguggcaguuucuaagugaugcaucacugaauucauucacagagaauacuucuucaugccaagagccaacguuuccagaaacauacccuaaagagucaacuguuaaaucaauaaaaugaauguuuugagcagguguguguuauucugcugauuucuccauauuuuccaguuuaauuucuccauuuaccaccaagcuucugcagaaaacauaaaauguaccuggaaguauuaugcuccucauaaauacgaggacaguugugcuaaacauuucugcacugcuaacagugauucauaaaucagauucauuugaccuggauucuuaacguuuucuacucaauccuagccauuggaaugccaaaugucacacagcuuagacaguauuuuuaagcccuuagcagaugacuauuuaauuagaaauauuuauaagagauacaggcaaaaauaaaacagacaaaauaaaagauaagcaagugauaaaaguugacuccaggccucaggagaggagaaaagaaauaccacccauuucauuuuauccuuuauuuuagugcaucgguugcagggaagauagcuuaguggcuaagaaugugauauucaaagccagacuuuacagcucagaccauagcucugguauauuuaucagcugcaagaccugagcaagcuguaucaacuguauuggcuucuguaaggauaacauaauaugagcacauacauccgaagauuguuugggaaacugaauugacuauuacuucaaagccauucugcuugcaucccaagacaagaaggaauggucaauaaaugcuaguuauugcaaugcuguuuguaucuuacuuauaaguaagggaucuaacagugauagugguuugucacucaaauuacuauuauauuucuucuuucuuauacuagaaaugauuugaaagauuuaaaaaaaaacccacaaaggagaaaauaacacaauuuuaauaaaauugguuaaaugaacaauuaaauaaaggauauagauaaagaaaaggcuaagaauaagaaaaugccaagaauucuaaggcuauggcugcugucauaggauaauggugugcguuagacuuucaggcaucccagcucacaaaagaaaacuggauuugcagcagcuuuuagugccgaugggaagcacucaauuauuuugcuggagauagagcacaaagcacuaaggagaauacauguaccacauaauuaguuagcacagaagacaguauuuuugccuccauugucuucccugcuuuggauccacaccugugugccauucuaggaacucagugacaaaguagauaccagaaugcuuuacuuucaacuuggcuaugagaccuuccauaggcguguggguggaagugaugacguguccuacuucugcuuuaucuaaaaagguaucaaaugugucuucuggccuuguugcaccucuagcauggccaggacaauagaagucaauggaauagguagucugcuugccaauagaaggaagauggaaagcaaagcagagucagacacugcagcacugugcaaaaccccaaaugauucacucaccaaaacaaaaucaacacugcaugaccuugggcuuaagcuucagaauuuggggaugcuuugacaugaaguaagaaagcaugacucaaaccaucaaauaauguuaacuccuugcuuaaugaugcuaauaagcaaagucugaggcucaauaguaaauaauuuaaaaaauaagaaauaauaauaauagcaacaauaacaauaguacugguuauaugucuuagucacuauguauaacaguagguauggauaauuuccuuuaauuuauugaaccuuuaguguaguucaaaagauauacuuauuuugauuuucuucccuaacccacuuugccuuuggcugcuauaggucuauaauucugaaucuuggagagguaggagaugugcuugugguaaaauaauaauaauaaaaugaaauaacaguaaaacaaaacaaaacaaaacaaaaaaugcucccuuaaacaaaggugcaaaaugaaauagagaaaggcucacuaaauuacuauaagcuuuagagaagucuugaauacuuuuuaauuauucuaaguuuuaauucuuaaauaacugaaauggucuuggaaaauaguguggcaaagagcaaggccuguguaaauaaauggaaggguacagaugcacucagauacauccaaccugcuuucgagagaaaauaugaauucuggugauauuaucuuuggguuuauucagaagucuuuuacuaaaucccuuagcauugcccuuuaacuaacucugacccaucggaaauccugaucauaugcuccuauugucagaugagcaaccuacagugcauuuucccuuugaauucuguuccacugaaaacaauacacagccuuuguagucaccggaaauuuuccugugugugcacacaaguggcucuucaaauaauuucucuucacuucuguuucucuugauuuugguaccucaaacaaaugacagucuccauaucuacauuuauaguauguaaauuaugcagaaguuucaucaugagcuuucaaauuugucuaaugauuuuucaugaaggcauguggggcacaugauaauagccagcaacaaagcaugaggaauuaaauccaagcccauagcacucaggcuauaagcaucuccaauaucuuuggucuacaauuuaguucagacuugaacacauuauaaagauuugagacuucuccauauucaugcaguuuuagaaagauggcuuucugauccagaauauucaaaauuugccagcaaaugauguggucuucgaguucacaagacaaauaauaaaaaggcgauccuacuccauaugccauacuggugcaucugacuguuaaagacgaaggaaugucucaaucuggaugacuguguuuugaaaauaaaaucacuucuguaaccaucuucaaacgccauguuacuugauuuccccccaaagagugugaaccuuagaugggagccaaaggcugccaagccauucccacugcuccuuuguuucucuuuugaaggcaccaggugcuauuggugaaugaccucucaucaucagcuacgaaaauguuacaggaauuucagauccucgguuaaauauuuuuaauauucaguaaguacccgacagcuuaguauucaaagcuuucauuaauucccucauuauuuccuugcguaugacacuaacgaaaguguuuucucguaacaugagcauaaacaguaagaaaccgggcuggugaaacggcucagcggguaagggcacugacugcucuuccgaagguccugaguucaaaucccagcaaccacaugguggcucuuaacuacccauaaugagauccgaugcccucuucuggugugucugaagucagcuacaguguacuuauguauaauaaauaaaucuuuaaaaaaaauaacaguaagaaaccauguauccaaaccggaguuccuacagcugcauaugauugcaaacuaacucaaaguaacaagcaaaaugauaaaaggggagggugcuaagcuguagacuagggcauccauuguucagcuuauugaccugaaugaugccacuuucacugugaaugguauaggcaucggugucugguaaauauuuaauauaacucccuuaaaaacagaagucacaaacuguccuagccuaugguuaauuuaaaacuacuaacauggugauguugacuaguacccagaaucaugaaaccauaacaauaggcuaugguggcguaguacaagccaguuccagcauuacuacauccacguagucaaccaaaugagaccauaaauuuacuucuucccucucuucacucaucugcauuccauuagauuuguuucucaggaagguuuauucugcauaguacugaauuucauugcagggucugugccagaagagcucuauauacauugacuuugaaugugcccucucaacagccaauagugcagcagaggaagggaauauucugagcgcccacgagggguuaagcaggcuucagcaaacccucggggcauguggaugaaggugaacuuaucugaacugggggaaauucuagucuccuaaggagggaaaaaaauuguagguaaauaucauuaacuccagcuuucaauuaagucuaauuaaacaugcaccugaaguuuacuuuuucagaguguauuauacaauuaagacuuccuaguguguguccacaugcaguaaaaauuugggccaaagauauaagauccaugaaaaugaaauguauuuggaugacaaauaggcugcuacaauauagagaagccgucuucaguccuggcuaaauacaaauagugaagcuaaauaauugcugcauaaauuuauuaauagaacugcuaaugucguacaucucacaucuacauuuugacacacaaucuuuuauuuuucuguuaccgaggaagaaaaaugaaggagcggaacuguuaaugcugcuugcaacuaaauuggauuuuccaccagaggaagcugugcagcagaagcuauuuggaaaaagcaaaacagugcucacaaaagaguauuaaugaguccaaccaggggaaagccuccugcaagacaaacaaagcauuucaaagccacucucaggacagcaagccugcuggaugcuuugaauucccuguuguuguuguuguuguuguuuuuguuuguuuguuguuguuuuuguuuguuuguuguuguuuuuguuuuguuuagguuuguuuuguuuugguuuugguuuuguuuuuuuugcagaaauaaucuuaccugugaacugaacauaagaccuaguagagauuuagaauaagaacacuucaacugugggucuuucugauuuaagaaaagagaccccagucaguggcuuuggguuuagaaggaaaccuauguauccugccaucaaacugagacacagcgggaacaagauguaagcuccauaggaccugugccuccaucugucuccaacacagcuggcaucacaauacacaggugaaagucugcccagcagaacacaaagaaaaugcaagccugcucuggcuuuacccuggguggaccguucccagccugauggcagacuuuuaaaaaucuuauuuguuuagcuauucaggagaaggaaauaacauugaaauagagggaaaaaaaacuuaauuauaucuuccuuaagaaaaggaaccccuuucacacuuuuuucuuucccacccagugaagccagcugcaaaacuacggcugcugaagagugcugcagggagaguggagcaguuggugaauggcaucaguuaaacaaauccaggaccauuugugcaugguuuuaggccuauugccaugguauuugagagccuagccgggccacaauuaggacagcagaaaauugcagccaggggcucugacugacucaguugucacuaagcaucuucagugguaaaguggccucuguauagggaguuaauauggaaacuuucccuuucaugcccuacaccagauuacuggcaggaaaugaagccgucaaauauugucuguugugcccaauggaaaugucugaaaugguaucauuugaugaucauguucgcaaggaauacgguauuaucuacaauugccguagcuagggagaaacaaugcaaacuuccagcccuuucaguggagcagugucauacagcauuccuacugacaaggccuggaguugcauaucacauggcuugccauaugugaacacauuaacauauuugaaauaggaucaguugacuaugaacaggucaaagaugaggcaaguguuugaagauggggggacccuaaaccuucuauugcauuacauagugaaaaauaauuguaggcacaugggauaacaggugugugucugaauauuaaaagacgucuauguagcuauuccauuaauauaugcagcaccucuggccuaaacucauuaaauuacuuggaaaaaugucuacugugugguauaguuuguacccauguguguguaagcacauaugugugaaggaugugcauagauccuaaaucauucuccaguuuauuuuuugagauaggguuucuucccuaaccguuagcucaaugacuuggcuagacuggcugaugagaauaccccggaggaauccuaaaaccucugccuccucagugaugggacaacagguauuuucucuguacccuggccuuuuuacaugaguaacucggguauuuacaauuguaauggcaaacucuuuaaugacugagcccucuccacagucuggaagaugcugccagaggacaggaagcccugagucuacagaagagcaaacauuugugacccucauaguaccuuuccugcuuuucaggaauaaauuuaacaucaugcauggacccaaucauccauacucuugcucuguaagcuuuaaguagagccccaccccuacugaggaaaacucaugcccuguggaaucaacagaagcaccauacuucuauggccacaggauggagacaugacaugcacuguccuaaccacaggaugucacagagacauagcaaaauaagccuguguuuuucuucugauggagccacauugucaacaccugucaggacauauuugcaauucuuuugauaugagaaauuggggaccacaguaugguaauuucucacuaugguuuaaauguguuuaaauauaucaagggcucuagucucuuaggcugucuuagaagucucucccauggaauuuuuuugguuuugcucauuaacuuguaacaauucaaucauuuuauuuuacauuuuauuuacaaaaggaaauaagcaagaaauacaauuuccuuauguaacauaccuaaaagcuuucaauaacucaucauaagguugaagugggagcauaaagugucuaaaagauccuacaugaagaagacuggacaugggacuguuguaauucugcauuuaugccucagccaauguauuuacucagauuuaagagcaguaagucucuacaugguccauccuuucaucuuagcucccaauggaggagcuagagaaaguacccaaggagcuaaagggaucugcaacccuauagguggaucaacauuaugaacuaaccaguaccccggagcucuugacucuagcugcauauguaucaaaagauggccuagucggccaucacuggaaagagaggcccauuggacacacaaacuuuauaugccccagaacaggggaacgccagggccaaaaagggggagugggcggguaggggaguggggguggguggguauggggcacuuuugguauagcauuggaaauguaaaugagcuaaauaccuaauaaaaaauggaaagaaaaaaaaaaagaaaaaaaaaagaaagccacaugaaaaaaaaaaaaaaaaaaaaaaaaaaaaaaaagagcaguaagucacgccuuaacuaaaaguugaauucucuaaucaucaugugaugggaauucuagcaaauuagcucauaugccugaauauaauauagaucaggauauucaaaggauguaaaauucugaucauuucucacaaaucccaacaucagcaacaaaucuaagccaacgacuccuucucugagucacucucgaagccucuaaacucaccuuucccugacuuuccucccaaauagucuauuuacccaacaaccaggaaauccuuaaagagagaucaaauggcagugcacugcagcagucuccccggucuccccuuacaaacuccuggccacgcucugaagggcuuuuccacuugagacucaugucuauuuaugcaacccagauuccuggaauacacucacaaggcugaagcccucgugguuuaagaagacucuuaaaauaucaaaaguacagaagagaagccagcaggccucaggcucugcaaaaguguuagaacucugcuucacucuaguucauacugaagcaucauuucuucaacaagucuuuuccauaccucauuuaaguuauuaucuuugggcagggacaaugacucaggggaugagaguguauauugcucuuacauggggccuguguucaguucccagcaacucaguaggguggcucacaaccauuuguaacuccagcauuagggaauaugacacucucuucuaagcuauagacaccucccucaauguaaauaaaccuacacacacacacacacacauucaugcauauguguguucccacaaaugagauaaaaacacauacaugcacacauaccacaaacaccacacauacaauccuauacacugacauacaaacacaaauccccacacaagcacacaccacauacacucgaugcaaauacauaucgcacauacacacaccuuauagaaacauacacaacccacauacacaugaaucacacaucccaacacaaauauauaucacaugcauacacacacacacacacacacacacacaaaucuaaaaauuaguaucucuuuccaaaaauucacuguucuuguccccuuucuuuugguacccucuacuauccacugaaacguagucuucuuggacaugaagauuugucuauguuuuauuuguugcaguagcaccagaaaagaugcuggcuacacaaguugaucgauaacauguuggugaaucaguaaaggagaaauugaaucuuguauaaaaugauccauuuuaaauaaauggucagaccuuucaaguguaagacugggagucugauucacugaaaugagcaagauuuaggguucaauccucagcacaaugauugcaaauaucguguguauuuaaaaguuuuucuaucagggaauuugauuuaaaaaugcuaugaguaaguaucucuuuguaggaaucaauacucaugugugcacagagaugcacagcaugcaauuaaacaaaucauuacauuuuuaucuaaaaucacaaauuagaauaauaauaguauauuguccuaaacacauagaaaaaaauuaauugaucccuuucuuaaacuauaaacccacagagaagguaaaauacaggguauaugcacaggguaaggaaacucaagaacaacgaagaccaaauuguggacacuuugccccuucuuagaauugggaacaaaacacccauggaaggaguuacagagacacaguuuggagcugagacgaaaggauggaccaucuagagacugccauaucuggggauccaucccauaaucagcuuccaaacgcugacaccauugcauacacuagcaagauuuugcugaaaggacccagauauagcugucucuugugaggcuaugccagggccuagcaaacacagaacuggaugcucacagucagcuauuggauggaucacaggauccccaauggaagagcuagagaaaguaaccaaggagcuaaaggggucugcaacccuauagauuugucccaccaguaucccccggagcucgugucucuagcugcauauguaucagaagauggccuagucggccaucaguggaaaaagaggcccauugguugugcaaacuuuauaugccucagucaguacaggggaacgccagggccaauaagugggagugggugggugggggagugggugggggaggguaugggggacuuuugggauagcauuggaaauguaaaugaaauaaauaccuaauuuaaaaaaaagaagacaaaaaaaaacaguuuuccagccacaggcaguuuuacaugauacaaaaauggagacuuaauaacuuguauucaacuacaggaagaaucaagacauuuuaagaaaaugauguaaacuaccauaugacaaaggaaaaggagccaggcacagcccacaaagggugucagcacuuuucucuuaggaagcacuauacaauggcaucuuaggaauuccuucucaauccucuacaaucuguccuuccuguauuuuacauggcauguuuucugggaguaaggaugccaguaguaucauccuugagcacaggagauauuauaccuuuaaaaaacagaauuuuuauaacuuuccuaugacaaaacacuuuauguuacugcucugauuuggcggucucuauauuauaauguuauaacaccacaaucgcagguaacacuuauauuaacuuuuuggauucaacaacaauuuuaaaaguaucaaaugaacacuuagaauuguuuauuuuucuuuauguauaaaagugucuuaccugacuguauauaugcaaaccaaguggaugccuggugccugccaaggucagaagaggguguuggaucuccuggaccugaaauuuggauuguugucagucaccuuguaggugcuaagaacugaacccagguccuauaccagagcagcaaauaauauaaugcuugcgcuaaaucucuagcaucccaaagcauaguuuuuaaugcaccaaaagaaggcugagcgaaucuggggcacuugguauaauaaaugaugcauugcucaugguuaaacuaacagcugacuugugucuccugcaucugaugcauuacuuccacaggcaacaagugagaaucagaacagcuuaccauugccuuacgauuuaggacuugauagcuuuacuuuuauuuuuggcuacauuuauuuguuuguuuguuuguuuguuuauuuuuguguuuuugagacaggguuucucuguguagcccuggcuguccugggacucauucuguagaccaggcuggccuggaacucagaaauccacuugccucugccucucaagugcuggaauuaaaagugugcgucaccacugccaggcuuggcuauauuuauaaaaguucuuuaaugcagaccaaaagaagucucaaucuuccagaugaaauuuaggaaaaaaagaaaaaaaaaaaaagauuuugccuuggucucccagcuauguuguucuagagcucaggucagaacccauguuugcuaguggccugugcacaugucuuucuaucaaccacagucucugaaggcaccaagugaaaugaucuuaucuuucuuacacaauucaccagaaaaucaaaauuuaaaagaagaagguugaggacugaggcaguuaaaagaggaagggauggggagacacgacagaggaagaagacaucccccccaaaacccugugaucacccccccauccucauaaaugagugauaaauuucacuuaaaauugccuuuguuuagucucagugcuaugcccaacuguaccuaaacccuuuuuguguuuuaauuucaauaaaagcacuaauuacuaugaagaaauuuuauuuugagguuuaucauaaauauugguuaucacaaaauucuuaauuaagaaacguuagaaagcccaggucuuucucaauugccggggguucagacuauacaggaacaccuucuugucuuucuucuucuagaauaagaaacacucgugucuagauuaagucaacaguagcccagacucauugccauagugggagcauaucuuccccaagccucagucauccauuuacuguguccugugugucugaguugugcagcgugcugggcauacaauggagagcacuggcagaaugguucugauccuuuagagaggagguccuugugaggaagacacgagcagauagcaaauaaacugggacacugaugaugcauaaugaagauaauucuuauacuggauucuuugucuguugcucugauaaaauauccuaagaaaugcaauauaaaggggaaaggguuuauuuuggcucccagcuccaagguaggauccaucauguuagagaagucaaggcagaccaugaugcagcugguaacaucgaauucacaaucaugaaacagagcaaugaaugucaguucucaguuuaccuugcacuuuauauagucugagaucucagucuagggaaugugccacucagaauggacagaccuucccacuuuaauuacccuaaccagauauuugauaccugccuagagucuagucuccugggugauuccuggucuuacaauuuugguaaauuagguuaaccaucccaacucccuggagaggugagucaacgaguugcuguuaaugagaauugcuucccaaaccacaccugcuuuaguccauaauauuucucuuacgagguggcuaacgaauuggucagaaacucaguaggcuauaguagagcuguuaucaagaauauaagacaguuuacuauaagaaaagucaugaaaaguuaguuauucaaaaauaaaauuaacauaguagagcugaaaucuugccaguacaaaaauggccucuuuguaacucaucaagguauagugacucaauuugacaagaaguguauugccaauaaaucuacaagucuguuuccaauuaauacaaacuuacaauauuccaagcuguuauuagauuccaauuaauaacuugugaugcuucauuaaugcaaauaugcuuucaguggugcuaaaccuucauuagugaaauggguccuauggcaugacuauuucauaugauaaugggacaaugauuaaaaggcacaauuaaucauuuucuucuacuaaauaaucucuaugacaauuuacuuaugccuguaugaaacauuuguuucauguaaaaugccaauuuauauuuugaauuauucaaugcauaggaaagcagaguuaccacacuaauaucuauuccuugcaaagaaucaaaugagcaaguaaggugcuaaaaaacaaggaaggcuauagaguuuguggguuuguguagccuaugugacacacugcaaaagcaguagaugccaguuguacaguugauauuaauuccccacuccuguaucuccuguagguugaagccaaucacagacacugagcuaaacacagaaaaugcaacagaacucacucccacccaaaaugaucugugugacuuuagacagcuuuuguaacuuagccaugacugguuuguagccuagccuggccuuaaacucacagcagacuuccuuugccagacccccaagagcugguauugcaacucaacucuaucacauuuggcuaaagcaucuuuuugauucuguuuaguuuguugcuuguaauaagaucucccuguacaucaacuuauacuccaaccaccauccaugaaaagccuaucccucuuaaugacauuuuuaaaguuccuaauguuacucauuggcacaagacagaguuuccaaaaaacacauaauccucccauuuauguaaacaguaguuuuaaaaacucuauugaaauuucaucuuaauuguugcguaguaaccaccaaaugaugucaacuguguucuaguuuaaaaaagagaacuguaaaaaauauugaucuaucauuuuggugucuaaaauuaagaaacugucuuaaagcuaguuaaagacucagcaauuauaguagccuuauauuauaaaugcacccuaaaaauauaaaacacaauuuuuagaaauucuauuuuaauaguucaaauacuauccucuacucucuuccuaauguucauaacuguuuccuuggaaacagaaauaauacugagucuugguuaacauguguuaauaugcucacacaacuguauuuucuucaauacugacagucccuacuuagacuguauggcuugauaauuuaguagaaaucauacucugagcuggauauuuugaucuuuucuuggacugguaauaugugguccaacaauccuucccaaugcauggauacagcauugagccagagcugucaacagucacacaauuguuaaaggaagcaguggaucuucuagaggguucuguacuuccuaagcucucauauccaguaaugcagcaagaguuaucucaauuucaacuuaccaauuagcuuuuauucugaccuugugagggauuuauugggcuauugcuccauaguaacugauggagcauuuguauacgauauuaaagacauaagacacauuauauaugacacaugauugaaaugauaucuguauuuaaacagcuguccuuuaaucaggaauaaacauugauuaugauauguguucuaugcaguaaugguuucaguguguaugugccauauguguauauaugccagaccugggagucuaauagaaguuaggaaacaggcccaacagcaaggaaucagggcucagaaguagccauauagccauaaggaaagacagccaucuacuguugcauggaaaguccaguugcucuguaagaaggugcuugaccuuuauaaagcucugauacccuggcccuuugagggcuuugaaugaauauucucuaauauuccuucauguuuaaacacaauauaauauucuuaagaaagaauaauaauagcucuuaggaucagcagccagaguuucuguguggggcagacagacgcaggcagcaaaggcucagauggaaaagcuuggaacaacagugagaggggagagagcagaaaauguagaugucgaugauuucugaaaaguauguaguuugcauucuagauaaccuuuaagccauguuugcacuucacggcuggaaacgugcuugaguugcagccagccuguucucggcuauagaaaccagaaggucacaauuucauaaugcagcaaggucagggaggcauagugacucgaggcaucauggguggccccagagcuuuugagcucuuugcuccauagucaaaaugaaacucugccuuuaggcuauuugcccaaauggugauuauguggguucuaguagcuauugcuaagcucugcucaauuucugaaaaagacugguuuuucuuuuacagaaguacaggcacgccuccuuuuaccucuauggggccaaauugguuuagaugaccucaucucugaaucaauaccuggcaaagggggugaaauugcucugacugggaagaaagaaggcaagaagggagaaaagagaaaaagaagacggggaaauuaggaaagagggagagaaggaggaaaaggaggggaggggagaggggagagaaucaggacaagcuaagcuuucaagcuucugaaagcuagcaugacauucauuaggcuuagacuuggaugccacuccccucccagugcacaguguucucuugaugcauauaaacaaucucccuaaacaccaacaacucaguagaggucauuugagacacuauaaaugaagauaagcaagagguuucauagcucugucuaaacauagauaaaaaggccauugcucaacucuuaagaugccaaccaucucuguccuuugaguaaugacaguaacugcuccuucaagacuagcaaugguuuaagccuaacucuaggcuguacucccuagagagauuuauugagacaucaagucauagauaucuuguucacgacuguuuccacagacacucuauacugugagaacagaaugaaucuagcuuucucuggacaccccuucccacaaccuaaccaaugucuagauugucuuaaacacccucucucuaagauauucuaucauucuucauggugcuggcuuucugauggaauaaauaauaagucuguguagucaaguguauguugauaguuuccagcuggggacacugugcucauuuuagaggaauguucuugagacucuugucaucauuaaucuccuaaagggccuucuguugaaaccaucccuuauuuuugaaacauuguuguuuuaguggcauuuaaauucuggguauugcucugagguagagggucauuauauugaccacgauggucucaaacuugugaucuuccugcauuggccuccugaugcauuaaaugaaugcaucacccuagcugaagucuaccuuugaaacuuugcauccauaucugcugaugugcugcagaucuacuguguuuuaugcauaaaaaugugguuuuccuaauuuaccuacaguaauagauuaacugccacagacuguagauuggaauaacuccagucuggcuucaaaucguuucuugacaggucuuuugugguggcaaaaagaaaaguacguaauauaugucucacaucacagacugacccacagagcggacacuguguggcuccaacucugacugcagagaagacauccuuacaagaauaugugcugccugaguugaguuucccuuggugcaugcuaagugcacaaacaaaugucucaaaagcaaaaguccuuaaaguaaaaaaagaaaaugucgauggcaggggaugagugggaagagaauauguagccuaugauggaaagagacuugcaaggacacuaaagaaaagagacucacaaacauauuggauuacaauuacuaacuguccccagcuaaagaguagccgaaagacauuaucuuagaguuugucacucauucccacaagagggaugaaugagcgggauuaucaugcuauuccuuuugaccauuagaaauuaggcagggaacauuaugagcccaggaaaaagaucuaaauguaagaugcugaugacacagaaaaucauccuggggaaacgguucuagaauuuauguccuguaacuguuucggagcacaaagccuguucucuguguaaguaaaaccggcuugcuuagcaaauggggggauuuccuuccucaaaacuagaaauuaaaaagcagugacgaaugacuucauuuaucugccagaggcaugggaauucuauuuagcuaauagacagcacuggucguuugagcucaguuugcugcugguggucacaggcugagacagacucucuuccccaagagcugcauuugccacauuuucugagcacucuucucacaguuugcauuguuugucuuuacaucugucuuuuugucccgacugccagauaauucaggauccacaaagaaacguguuuucuaaggucaagugauccacucagucagauuuugcucaagccagagccaggagcugauuuuacacaaucgcuggaagaagauggcuuuugugaugagcaucugcuguuuuguuaaaaaugugguuaaagacauuaacagaagugacauuaccagcuguuguaaugucaggcaguuuagcuaaacuguuuuguaucaaacaacaacacaugauacucaaaucaauucucaaccaauaauguaacgcuacuuauaaaacagagcugagugcaacugagaaugagcaaccaugagucuguacaacuaaaaaugagguugagguggggggagguguggaagagagagagagagagggagagagagagagagaggugcuaauuaugauuucuucuagucagacaguagaugauacaauacugauaauuuucuucuuuuuuaauuagauauuuucuuuauuuacauuucaaauguuauccccuuuccuaguuuccccucagaaaauccacuauccccucccccuucccccugcucacuaucuugccuacuccagcuuccuggcccuggaaugggccauagaaccuucacaagacgaagagccucuccucccauugaugaccaaucaggccauccuuugcuacauaugcaacuagagccaugagucccaccauguguuuucuuugguuggugguuuagucccagggagcucugggguacagguuaguucauauuauuguucauccuauggggcugcaaaccccuucagcuccuuggguccuuucuccagcuccuucauuagggacccugugcucagcucaauagauggcuaugagcauucacuucuguuuuugucugacacaggcagacccugucagcagacagcuauaucaggcuccuguuagcaagcucuuguuggcguccacaauagugucugguuuuggugguuguuuaugggauggauccccaggugaggcagucucuggauggucauuccuucugucucugcacugaacuuugucucuguaacuccuuccauggguauuuuguuucccccuucuaauaaggaacaaaguaucuauacuuuggucuuccuucuucuugaguuuuauguguuuuacaaauuguaucuuggguauucugagcuucugagcuaauauccacuuaucagugagugcauaacauguguguucauuugugauuggauuaccucacucaggaugauauccuccagauccaucauuuugccuaagaauuucauaaauucauuguuuuuaauagcugaguaguacuccauuguguaaauguaccacauuuucuuuauccauuccucuguugagggacaucuggguucuuuccagcuucugucuauuauagauaaggcugcuaugaacauaauggaguauguguccuuauuagauguuggagcaucuucugaguauaugcucaggagugguauugcuggaucuuccgguaguacuauguccaauuuucugaggaacugccagacugguuaccagagauguuguaccagcuugcaaucccaccagcaauggaagaguguuccuuuuucccuacauccucaccagcaucugcucucaccuggguuuuuugaucuuagccauucugacuggugugagguggaaucucaggguuguuuugauuuguauuucccugaugacuaaggauguugaguauuuuuuaggugcuucucagccauucaguguuccucaguugagaauucuuuguucccuaaaauuuuaauaggguuauuugguuuucuggagucuaacuucuugaauucuuuauauauauuagauauuugcccuccaucauauuuaggauugguaaagaucuuuucccaauuuuuugguugcuuuuucgucuuauugacaacuuccuuugcuuuacagaaacauugcaguuuuaugagguccuauuuguuaauucucgaucuuucagaacaagccauugguguucuacuugggaauuuuuccccuguguccauauguucaaggcuauuacccacuuucuccucuauaaauuucagugucucugguuuuauguggaguuccucaauccacuuagacuugagcuuuguacaaggagauuuauccuaaaacaaaaggauauaccuuguccucagcaucucaugauaccuucuccaaaauugaccacauaauugaucacaaaacaguccuaaacagauaauuuucacacacacacacacacacacaugcagacacagacauauauacacacacacagacacacaaccuaugcuucaaacacaaagcaaauauaauuauucacucaguacucugauagugugagggggaaacaacaaauuaauuauguaauaugcuuacagucacaaaaaaaaaaagaaaaaaaagaaaaagaaaaagaaugauuggguuccuggccaguuaaagucuggcuucuguccuugaguguucauacccccugccugaggagagugacugucaggagagaggaccugccuuguggagcuguguucaucugcucuauuuuuaucugcccaucauuuuuaauuaucaggucauuaaaagguggcagaucaguagcauagccaacuguguugcccuucuggcugagaagucugcagcaguugaugaaauggacccccaccacauguuuaucauagagccuguaaaagcaaaaugguaccaaaucagcgagguauacagccaugaucaaucugggacacaugcucaguuuucauaacugugaugagaagagggucugauucauaaccacugccuagggaucugcaagucuuuuaauaaugaaaguuacaaaugcuuaguucauagggccugggcuaaguucugcuuccagacauaguacuaccggaggauccagcaauaccucuccugggcauauauccagaagaugccccaacagguaagaaggacacaugcuccacuauguucauagcagccuuauuuauaauagccagaagcuggaaagaaccuagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaagaaacucacacaauauguauucacugauaaguggauauuagccccaaaccuaggauacccaagauauaagauauaauuugcuaaacacaugaaacucaaggagaaugaagacugaaguguggacacuaugccccuccuuagauuugggaacaaaacacccauggaaggaguuacagagauggaguuuggagcugagaugaaaggauggaccauguagagacugccauagccagggauccaccccauaaucagcauccaaacgcugacaccauugcauacacuagcaagauuuuauugaaaggacgcagauguagcugucucuugugagacuaugccggggcccagcaaacacagaaguggaugcucacagucagcuaauggauggaucauagggcucccaauggaggagcuagagaaaguagccaaggagcuaaagggaucugcaacccuauagguggaacaacauuaugagcuaaccaguaccccggagcucuugacuuuagcugcauauauaucaaaagauggccuagucggccaucacuggaaagagaggcccauuggacuugcaaacuuuauaugccccaguacaggggaauaccagggccaaaaagggggagugggugggcaggggaguggggguggguggauaugggggacuuuugguauagcauuggaaauguaaaugaguuaaauaccuaauaaaaaauggaaaaaaaaaauaaaaaaauaaaaacucaaaaaaaaaaaaaaaaaauucugcuuccaguaaaguugaugugacugaguccucaggaaaacaguacaugcaaggguaucuuccucguggcuggaaaacaaaggcacaugcugugcagaaggauguuggccagggacagaagggauacugcacauggagaauagugcacaguaagugucaagagggacacguacuuggauaagcgugucagaaccgauggacagaauaagcagacauaagcaagcagcugugggucucauuucuacaaacugaaaagaagauagggcccaaagucacagucagcauauggagacauaccaagugaaugcaccugggaaaacucagagcaccgcgggcuugaugaugccuggguacccugagggccucacugcagaacggcauguggaugaacuuaucucuuaaacuggcagagacagauggagauccuacacugagaaauacagucaaggaggcaccgauaacagaaagcaauauauaagccugauauugugagaccaggaaugggacagaucaccaaaggaugauuuagagcaaagugagggaaggaugaaaaagcccuauuggaugcugacaguccacaccaugaauaaagggaacugaguggccaaaugacaauauuggccacuggagauguagcaguguuggaaacaaaugccucccugaggaccuucaacucuaaguuuccaccagagagacuuccuuuuaguauaucuuuccucuagucucccacagcacaccuauuuacuuuugaaaguaaucugcacauuuuucauagucacaucucagcucauguuaauguuacuguccacauuuacaguggauaaaauaacccaauuaucaacccaacuuagaaagucccucguauacauguauggagguugguuuccugggugauacagacccucucaaguugauaauauuaacgaucaaacaauacaugcuucagugucauacaaaagcagguagauauggccuuuaccacaccugagauaauaaacucaccuuaaaucucgccuaacaugaggaucuuuuaugacccuguagaucccacaaagcaccaggucaucuauaggcucucccuuccccuacaucaucaucauugccguuggaucucuucugauuaacccacacaggaagcucuucaguucuuucccacccgugcaccuucaauggcaugucuguuguccaucuagaagcuuccuccauccucuucucuaaugaauucucccuucuacugauucuugggaacuucuuccuggaugucucccccuggugguccuagaagucuagcuucccacaccacauaauacaaguuuucaacuuuuguacucagucuuggauuuggguccuuucugugaggucuauaccauauuuuacaugcagcuuaguggcauucacuaggggucaguacagcucuuaucuguuuuggacaaucuaagauguuuugagacauugccaaaaauccauagaagucagaguaacuacuuauugaaaaauacugaucuaaaaccuuaaaacgagucaaccaugucacugugacaguguacacauguuucugugaugacuuaacugucuauugauagaacugggcuuggaucccugccuuauuccuuaugaccgaagugcauuuggcuacaucaugugaccuguccaguacuuugcuaugaugcagguacaguaacacuuaacccugugggaguaaugccuucagaaagugcaaugugcccuggaccuucaguccagucaugauaaauguagcggauccugaaccaagagaacauccugcuuguuguuugaauguuuuuaacuuuggcuugcugucauaaaaggguucuucuauccugagaaggcuuugaacaacuuugacauggccagcuuuccuuaugggaaugguucaucagagauagaauacacuaagacagacaucauguuaugaagagucucuaaggggcaggggcacuugugaauucugcuugucuuuaaaugaccaguguugagguuagaaucuuacucaaagcagaauuacaaggaugacaucuguaauaaucucuuccuccaaaccauugcagacaauaauaucauaaacacaaggcuguaggcuaaagggagauugcugaagcuuuuuccaauaauaauaagcuuuuaaaaauaauaaucccagaauuauauuugagcaaagugaaucaucugacgagauggacaauauacacaaaagcaccaguuaugaucaaggaaugaaauaugagcuuaucaacaaguuuccucacagcacacaagguaacaucccaucaaagugucagugaggcccucauuuaaaaaaagucuguucucugacacguacugcuacacagccauggcagugaugggacauggcacaucccgccaaucugaaaucauacaccaugaccuggaaucucugcccagcuguaccacuccauguuucccugauggaaauuagaaaauaauguaaccucagcugacagguuuauuaagacacacaagacauuacaaaggcccuuuugacauuauaaucucuaacacagucagagguagaagccaguuugccaucauuauugaaaguaauuggucaaaaaaaagauauaagggcggggggagcaacccuacaaagcugucaaauuaauuauuuggcuacagguguauucaucauucacugccugucuuagagcuugcuguggcuuuguucuguccucccaacuaagcuauccccauaccaucccugccuugcacacugugauaucaauaaaacagugcuuaaaguagaaugcuaucauagccccacuuucuccuugucuaguaauauucacauacugacuaucaauugccuacuugugcucucuucuguuggcauaccaaaccucuggauuuuucuagagaagguaauucagacagaaaauuccuuaguuugaggauauuuaaagggucacacccaugugcaagugauauuuagauuauaucgagguccuuaggaacuuaagaucuuaggaucagagauccaaagcccagcuaucuucccaugccagguggcuagcauauaugaaucaagucagccagauggcaacauaaagggagugcgaaggaugaugaaagcaggggcaucuagcuguguucacugucaccagagaaacucuuaacaugccaggggagcaggggaugcuuuguaacggagccaagucccacccccccagaguaagggcucaguguuggcugaauaacugaauuccuaacaaguauucacccuggcuuaagcucaugguccuaggauguguuuuugagcuuaagccucuagagcaucugaccagcugccauuugaaagggaacaaaugaaaagaaaggcuugguaaggacaugugggaaacaccagcaaugccagcugcaggcugaggacccuacuuccaaaaaaggccacaaagggaaggcagguaauccuacaggaggacaccagggcauggaaugguugaaaaugcucuguuauuuguaaaugaaccaugcauuguuuauaaacuuucucauagugcauauccugaaaugaaaaaugaagaguuaaucacugcuaaagaacuggaaaucugcccuccacuuuuccugaguggaucccauuaguguacugaaaaggaauuuauuuuacauuuugaugaaaaaaaaaaagguucuacagauuagaaggaauucuauguuacugcucugguggggaccaaacacuugaaaggaccccuggcuugaagaauaaaggagacugacaaggcuuccuuccuccagagaggcaucuuccguggcccucuguggcuguuaagcugaugccauuaaucuaacacaugcagcagauauuauccuucauuuucaaguacacuggcuauuaccaguugccaccagcauacugauuauacaaaauucuuguuaauggaucccugccaauccaaccauaggacuaaugauuugugcuugccagauccaagguaaaggaucccucuugggcccaucucucuaggacucagaauuccuaaaaaugaccauucacuuccugccagggucuaguccagcucagaaugaggcacagagguguagagacacaaagggcacuaauccauaucgguugugauuacugacuugacucucaaaggaagauuaaauaaaaagaaagagccaagcucucucaaggcaagauccacccuguuagaccacaguccaucaaugucagcauuugaguguugcuugacaguguacagccugugaugugccacugguaccacacagagaggcuaaagguuggaggcuacuccuguaaugacuggcacucuuuucaccaugguaaccagcaucugcagauccuuccuuuuuucccccucugcuuuuaugaauccugcugaaggcuuuuuaggugaaaaccucagcagacaucagaccucaaacaugaacuugacauauggggcggugugauguuacugucugcccugcuucaagcuccaucaggcacaucuagaauacuguugauggcagcuguuugaacauuggggugaaaguguguggaagacccacauugucaauaccaucuuaucagccuuauaaaaagacacgucagggaagcacauguuuucagcugauggaaaggcuugucaaaauccuguccauccaccucgacuuccuagcccacacuugcuacauugcaaaccuaaacagaaacaagaagaaauuccaugaaaacaauaagugaauaugugaagaaucucaauaguuuuaggaauacuaggugcucuuggaaaucaugugaucauucaaggcuaaauaagguagaaauagcugugccguauucuagagaggagaaguagcaaacauguuacugacuuauaaacuucacauaugggguucuuuauuucauuaggugagaagccagcaugaaauaauuauuacuuuuaaaaaacuauauuuuugauaaaugcuauuuuaaugcgacuguaagucgaagugaagcaaucccugcagcuccagagaaaauccaaaauuaaauauuaaguucuuucaaaacuacccuucuuacccauuuucucccaagggaauuuuggaaaaguaaucucuguguauuucagaaaaguaacauuuuggaucacuaaaaacucagugucagugggauucuuagagcacuaagaaagguucccggggaacagaaagcaggagcccugcacgcaugaagaucugaguucacaucuccagcauggcuacccgugucuaaaaccccuucacugagcagcugagacaagugaauuacaagugguugcugaauaguuaguuagucuagccaaaaaaugaaaugaacuccugaauuagugacccuguuuuuaggcaauaaaauagggaguggucaaagaagacauccaauauucugcuauggacucuuggauucuguaugcauacauacgugcacaguugacauaaauuugcauaaaacauacacacacacacacacacacacacacacacacacacacacacacuuaacaaaggcagacaacaaugccuaaugcccaugaguaagagaaugaaauuaaacaugggaaggagaauaaacuguagcuuaaauuaguagauuugcuucaaguggcaaauauaaagaugaaguccuacccuuccuagaacaugaacaacaguuguuuagaaguccagcauucacuccccaaccugacucuccucugggagauuucuuucucaucuacucacaguucuuuccugggaaaguugcucuaagaacuucuguugaaacaguccaaaaaugaguacuguuuauaacaguggaucaggaagaugggaggagguagacuggaaguuggcuuaagcaaguggacucauguccaucccuguugucaucuagaagaccuuuccagagacuaaagaaauuaccuuaaaaacaaaagaaagauaaugggcagagauuucuaacaacaugagucuuuaaggcuacguuuaugugaaguuaggaguucucacuauuugagcccaaagcuucggugauaacugaaacuaccuuagugagcacuuuuguuacuuggaagacaauccauccacauggccauuuuaaacacagucucuaaccaaacagauccugucuuccucacagucauauauacccuucacuuagcacaggaugaugggaauagacuaaguaacuguuucaugcauaaauuguugaagaucauaugccccaguacaggggaauggcaggcccaggaagcgggaguggguggguuggggagcagggcgggaggggggcgguauagaggacuuucaggauagcauuuuaaauguaaaugaagaaaauaucuaauaaaaaugaaaaaaauuguugaaaauauguuuucucuugacucaauaauuauguuucaaauucauaacuuuuaaaaugaaggcuaaucaaaacagaauuguccuuuccaaaacaguugcugcaagaucaaacaauggauaaaguuaguauccuuccauuuaccugacucacaucauuucuucacauaggacuuucauuuggcagaugcuaaugcauuguuaaucauccauuugucuuccccuaacaagaauacuuagagccaacauaaguaagcaagucuccuaaggccucagcuauuucaaaucccugggguccagaggagguuaauuaggcagcaaaaaggggcaaguucucagaaagcagugagaucuacuuacaaagaaaacccacaacucuccagccacaggggacauggggagcacuucucaggcacuguucauuucccacuauaacaagaacauuaaaacaucuguauaguuuaauuuaauguuacuauuguggcuuccucccuaauuugaaauacaaaucacuguuucugaaggauauauuuucaccacaagcucaguguuguuuccuagguuacaaaugacucugaccaucgguagaaacagagcaaaguguuucuguccauggaacccuuugggcaauaaugugagcauaugacaugaaggguggucaugacaauuggacaguugaaugguuucuauugaaauaaauauaaauucugcucaggguacacagugggaaagggcuugcugcacaagcaugaggaccuguguucaaauucugggaauccacauaaaagcuagacaaguagccucuuaucuguaaugcuagcguaaauacagagagaugagguguggagaccacagaaacacagaaccuuguggacugauuuugggacagcuaggcugccacaugcaguauaaaaacaauaaagaaauucuauaauaaagguacaaucagaauacccuuuuaacuucugguaugcauuguuuaugccacacccauaugcauauacaauuaaauuauacaauuaaaaauuaaaauauaaaauucuauagggaaauuacuacuuuaaacuccuguugagacauggauucuaauugauuuuaaacuucaucaucucauucuuagaauccuauuuuuauuguauauuuuaguuaacauacaaauaaugguuuaauugugauauuuuuauauaaauaucaucugacuuuguucucauucaugccaguaauauauucacugcuucuucucccagcccuuguuggacucuucuguccagcauaauccaugcuucuguuuucauaugauacuccauuaaauuaucuucuuccucccaugcuuuauaucucugcuucucucauaguuaccuuucauguacacaaguacauacucacacacacacacacacacacacacacacauacacacacacacacacacacacauauacacaggcaugcacacacacaugcauagaagcuuuaguuuagauuucucauauaaaaaaaaaggugauauuggcacaucuguguacuugcuuugcuuaauauaaugaucuuccgacccauccauuuuuauggcugaauaacguucaguugcauauauauuccuuuucuuuacaauuucaucuguugaugggcuucuacacuggcucuagacugugacuugugugaauauuuaccaauagcaugaaugaacaagaguuuauuacaaauaacucaggucuauucccaacaguuguagaguuggaucacacuguagcuguaauuuugguuuuugaagaauguccacacugauuuccagcauggcuguaccaccauuaacugucagcacucauugccaugucagcuaccaugacuacccuguguaguuuugaucugcauuucccugccaagcaucuuauagucugcuaacuagcaucuuuauucacuaggugauucagcuuuaggguugauguuuuuaguucuuuaaagauccaauacauuauuccucuguaggauaugcaacacagacauuuuucucacauucuauagcuucauucugcuauuuccuuuucuaagcagaaguauuuuaauuuuauacggucccauaguuaauccucgaguuuaucuccugaauuauggguccuuaaaaguacugcuuaaaaggaaguccauaccaauaauaguaucuugaaguauuuuuuucuauuuuuuugcuauguaguccagcuuucauauuuuauauuaaagccuuugguccauuuugaguucauuugucuguaggaagagguauguggauccaauuucacuacugauagguuuaugucuaguuuuccaagcacugcuuguugaaaaggcuggcuucucucuaaaauacauguugauagacagcucuguaaaagauuaacugccauagcuguaaggauuuucuucuggaugcugcauuucuaaugguugcugugucugcuuuugugccaauagaacacuguucaugucacuauggcucugcagucuaguuugagaccacauauuguugucacuucucuagcauuacguuuuccucuuucuccuaaagaucccaugacuacucaggguaauuugugcauccacagagauuuaggacuauugauuucuagguauugauaaauagcauuguaauuuugagggcaauuauaaagauuuugcagacaaguuuugauaauaagcuauuuuucacaauaucaauucuacaaguccaugggcccaucuuaauuucuuuuuuucauuccuuuaaaagccugugauguaccagcaagugauccauugccagaauacaaccaugacugauaucucccauugucccagcuuuaaaugagauccuaggcuaaugaaauagaaaaaaagauacuucaacugagaaaucuccuuuauuaaugcaacaaaaugucugagaguuguaggucaucacaaaaaaggaaugaaaaugaauaucagacuucauaaaaaguugguuaaaggaugauguuuguggaucagguaucagaaaaguacauuuuguagggcuaugaaaaaguaggaagugggugggaguagaaaagguccucaaaacaaagagagugccuuucauggaaaacagccuagaguggaaagaaacaaacaaggccaucagagcuggacccagauacaaggauagaaagaagaucuaagaccaaggguagcuaccuugguaggaacauucuacacugguauagaauagagcugagauuuuacucacaauaaaaacauucaauuuuauuuuucaaaauguuccauucaauauauuuuuguaucugggauggagggacugagagagggagagagggagggagagagagagagcgagcgagagagagagagaagcgagagagcaagcaagcacauagcuuacuugcaucaccuagccaauaaagcauauuucuuuuaccuccauuuuucauggaugugguauuauuucuuuagcucaucuugugaucaugacauuuguaaauuaaaacagcaauuauaauaauuuaugacaacagcaucuaguauuuuuuaagacuuaauauaagcaagacgcugaaccaacuaauugcuauguauuccugcacuaaaagaagcuacaaccuuuugaaguucagguuauuuuaucuuccuuaaacaaaacugaggcuaccagaagugguuguaagaccaggcugaggaacagugacaccuuagucccacuacaaggcuacagcuucaaaguguaugacuuguuuucauuaggcuacaacugacauaauuaagcacauaaacaauucaaaaacaucuacaaauucauaauaugauacuaauccuaucuauuuaagugcaaagcccuuucuucaccuccaaguaaauaaagcaaguacaaaaugauuaaaugcuaaaugauuguuaaaaauaaaaucaguauuuccuuuucuauucugccacacucuauauacuagaauuuguuugguauccaucaauagauauuuauauaguuugacuuacagugcuaguauaagguauguguguguguguguguguguguguguguguguguguaugcaugcucccacgcacgcacaugaucuuggauauaaaccaaggaaauacgguuuaacuuuuugaggagauagcaaacuguuucuccaguggccaucccauacauuccaccaacauuacaagaagguuucaaauuuucccacucuucccuagcauaaguuacugucuguuccuugauuuugaacauccuaguggguaugagguugugucuuuuagauuugauuuggauuuaugauguuguacauauguuuacugucaaauuaaguuuucucugaauaaaggucuacccaaguccauugccauuuguaccuguuuauuguugggcuguacauauguggucacggaaccguauagauaggugauuuucagaugcuuucccuccuccuacagcauguuuucuuagucucuugauguuauugcccuugagaucaaaaguucuuaguuucagucaauucugaucuauuauuaauuugacuucuguguguuuguuugucuuuccuccuccaaguacaaacuaauagagauguacuccaaugauucucugaaguaugcuauggcuuuagaacucauauuuugguuuguuguauaggaugugggauauuaaaaugucuaaggaggugcuaucaaagugaaaguaacagcuaaaugacagguguaguuccuggaaaagaccuguuggcacaaaacucugaaggacauucuagggucuuccaaaaauuaggaggaggggaagaugcauaugcuaacagauagcaccauguuugucuaguagcaugaacaaaguuuuauaaauauguuuaauauaugauauuaaauaucauauaucacaugguauuagauuacuuaugaacaaaaaugaagauuuuuguaaaauaucuagacuuacugauccaucuguaaguauaggaagcuauagccaccugacuagaccuuaaagaaaacaaguuuucucugaguucccaaaggaaacccaucucuuggguuacagaccucagcagguucagugaguucacucugaauccacuaaggcuuugugcacacuugcguuguaaccuuugccacagaaagaauuaagaugcuauuggcugccaugguaaacacugauacaaacagaaaucaaagaugaauggcugguggcuucuaccaguuagucauggugauccacaggcuuagugaggauuaugaguuggaggcuaccaugaugguaucuaugaaacagguaccaccuuuagaaggugagaaugucaagguuugggguacucacuauuaaugcaauugcucugcccugcccacugagaauuuucagaaauuuguaugcaauucuguccugaaugguccauuucacaucuugauuuagauauugguuccuucaggauaucuuuugagauaguccacauuaaaauuaaguaauccuuugauauaccuuuuaagcucucuuaaaacauugacuacacaaucuguaauaccauccuacaauaugaaugcaaauaucacuguucaaaaaucauuaagagucucuagauugugagagcagaacucuaagccacguggaagaucacucuaaguuaggacccugggcauguucacaggugacaagucuucagaucagucaaauacuuuucuccucugccacagagucuggcauccuuuauugccaucucuucuugucuuugaaucagccagcaguuaauacagugcacaguguaguaaaugucaagaaauauggucugacugucugaaugaaaggauggggguggauaaugauuaagcucccauaaaauccugagcuauuguucuaacaucuauugcucacugcuccgcaaaugauuaucaaauucaaauuuuaucuucuguaacaaugauacuaugucaaccuaaccacggaacccaacaguguuaaugcugccugcuaauaaaaccaucuuuccccuacagagcuggcuauuuauuaagauggagcuuuacaauguagaaagucagggucuaacauacuggauauuuauuccuaaaucugaacaaaucaaagguauguguguuacuacaggcauauuaaaucuaaagcuuauguuacaugagugcuuaaagaaagggaagguggggcucugaggaaggagaacgucuguugcuagucugaaaacuaacaauagguucucaaccugugcuacaggacagcucuuaguaaaaaugguuuagaagaaggaagauuugagguacauuuuaaaaagugaaaugguuaaaaugacugauuuuuguuaaguacacugacuuuuuguuagguccaaacaguaacgucaguaagaauagaaaacauaccuuagaaaggagagagcagauucucaggaaagguacugagcucacucuuaaaauacauuuuacaaaaugcaacaaagacaaggagcauacacuauaccuauagacuuuccaacauguaaaccauggaguguacacuauaccuauauacuuuccaacauguaaagcauggaguguauacuauaccuauauacuuuccaacauguaaaccauagagugcauacuauaccuauauacuuuccaacauguaaaucauggaguauacacuacaccuauagacauuccaacauguaaaccauggaguguacacuauaccuauagacauuccaacauguaaaccauuguaguuucuauuccugguugucaacuugacuauauuuggaaugaacuacaauccagaauuggaaggcucaccgucccuuaucuggaagcuuggagauagaaguuucugaucuggaucuugguauggagauauugagccauaguggcuauggauuccagaagauuaacucucugaguucaaggucauccgggauuaaaggugugguggaacacaccuuuaaucugggcuacaccuucugcuggagacaauauaaggacauuagaagaagggagucuugcucuugcuccuucgccugcuugcuuugugagacugaguaauuucuagauccuuggacuuccauucacagcuacuacagaaccauuguugggaauugggcugcagacuguaagucaucaauaaauuccuuuacuauauagagacuauccauaacuucugugacucuagagaacccugacuaauacaaccauggaguguacacuauaccuauacauguuccaacauggagaacauuaccaguacauccucuuccaccaacuuaccagucagacuaugauaggacucacaccauuaucuacaaaauccuuacaaagccaacuccagcacauuuuaugaaagcuggcuauuuaauucaacccagagaaaccacugccaaucuuauugccuacucuaaaagaacuuuauggccaagcagaaauaucucacaugcuccuuuccaaaugucacacagaccaauugaacauuuaaaaugggguuaacauuauugacaaaaacaauguacuugaaauuuauuuuauugaaaugaaucuacacuuaaauagccacaggugacaguaacacuguguguuagguagcaccaaucuaaagagacaaugauucagacagagcccaagagaaaggagucaaauuauguacuuuucguggaagcaaacaacacagccuuaaacaagggugguugaguuauaguacccuaagcuagaugccagcuggcaccagucuugguauaaacagacauaccccuaggucuuccugcaagaagagggcacaugcugauaagugucuggaagcugggaguaucaguuuucccaguaagucuccacuguauaaagauguguguuggcagagaaugauggacagaaagagcugcggggcuaguccugagucagcaaguccugcucugggcuucucaugccucucuacuggaaauggaaucccucuaccaggagaaagaagucaugggggaaaaauagaaacuggggagagaaaaguaaggagaaagaaaggcugggcagucagauaaaacaccaaacuaaguaccauaucuugaauuuugaaaauuuccauuuucaaaauugaacugggaaaagggaaauacaauauacaacaugugggaggaaaugcaauguguggugcucugaggggaaggaugaaaagucagauggaggaugaacaugucccaaagcaggguacgaugaacacauggcaaagcagggcacgaggagcuugagaaaccaggauaggaugucacaaaucacaccaagugucccuagggaguauaaaugcauaaaaaagaaccuguguaaauaagaaagagggggaaggagagagaggggucugacagugauucaauaauccaaguccuaccuagagaaagcaagggaggaaggaaccuauuuuaggauuggaagacaccacuaguuaauugagaaaaacaaaaaauuauuaggucugugugcuaaccuaaugagaaaccuaaagcauuaacaggaguauccauagcucagagcaaugccaugugauugaguucucuuuaaccucauaguuucaaacacacaaaaacaacucaguaacaacugcgcuuucacauacuuccaugagcaguagauaaaccuggagcgaucuuuugcagggcugagaaacaggcauauuccguccuguaauagccaagggacacauuuaucagaagcacuggcuuccacagccuaccucaccaaggcaaaacgaguacuuucagaaacacuuucccaagaagaacuaucauugaguuuucagucuaugugcgauaaagccaaaccauucagcacucaucucucuggagauggagguucuagaaacuucucauucuacugauacuguguuuucuuccuuuuucaaaaagguugccacccagguaggucauucccauuacuuucucacagaaacacuuugcauaaguuauucagggcaagagcugugaaucagagagggcauaagaaacccagaugauuuuaguugcuggagcacaaaugcaggggcagucauacaaaaggcaaguuguuguaggcaaagaaguuguugguacuuggcucauuuguuugcuuuguuuugagacaaggccucuucuugaugcgugauuuaggcuugcucagaacucuugacuuggccuuuucaguccccccugugcagggauuacagaggagcacaucaccaccaaagagaguccagaguacugggcacagcugagauccuagcaauggaaguaaagaauucacaccaacucccagugugacauuuaauaugaauuguuccaaaaagcuauagcauaauaugcuaaaagaagaaaugucuacuauggaaguacaggauuugugagagcucagggaggacuccugacuaauuggugccaacuccacaacuaagcucccugaucacaaucuucauugggguuuaacaccuguaacugagucacugguuuuuacugaagaacuauaaccggcccaaaugguuaaucaagggcaggggacagcuaagaacuacuagcaaaauggagucagauuuauuucauaaacccaaguucaaauagcacucuauucaucauacaaacuauauguuuaaccucagauuucucuauuccgggacaucauauccuuagaagauaccacuugaagaaaagcuuucagagacugauuuaaacaaucagguucuguccaaacauggaggaagaggcagauagaucuuuguaaguuugaagccagccuaguguacauagacacagguaggccagucagggauacauuacaagcaagucuuggcaaugaaauuccuugccuacaaguguggcacacugcaaacacuacacucccugaggaguuccccaucagcaaaagcucacuuugucucccaguguggaggggcuuaggaucauuuucuuucuuuguucucacuauagaacgccuacauucaucuuguuucuagaguccccgggaacuacacacuuccagaaaggcauccuacagcuaauugcacucccagacagcacugagguagauuuucaaaaaaauaguucucagaauuaccuuuccauaggccuaaaauaaagcaagagaagcagcagccuucacugccacaggcucuugggaacuguuccgucucagccaauccucacaccacuuuucugguaggggucauuauucuuuuucacacagugggaagcaaagcucagcuuuuucacacaauccacggagggucaugaggucaagaggggacagggcaggaacuuugaaaggucuaugcucuuugcccugggccacacagcaagauuaauucgcuaugcagaaugcaaaucugagucauuuugaaauauuuuuccuuaaugcugcccccugucuccaauugucugcugaauguaauuagauuacacuauuaaaagagucagcuugugcugugacccaucauuugggagacaauggcagagcaaaucaucucugugaggaauagaucaggacaagaccuguggagacaagugccuguggagacaaacugauguaugggaaggaaucuugacagcuauaaaaccucaggcacugagugacaauacaggugugcauaggugacauaccacagaaaacaggucucuaaaaguggcaaauauccaagauguuuauggaucaugaacauggugggaaacaugacccuuuuacuuauacugcugacaucuucucuuccuccauugcuuacuuuuuucauguugcaagacaggaacuagaagccaguaacuuuccagcuucucucucucucugugugugugucucucuaccugucucucucucugugugucucucucucucuguuugucucucucuuucucuaacacacaagcacacacacaaacaacaugaagcuaagucaaguccucuuugacuuugagacacaauucuaacuucuuugggcaucuccuucacaaggaugauguuacguaaguguggucaguggaaacucacacaaucuuuaugauauagacuggagaaaacagccuuucagaagaggaaaugagugaggauuaaacagcugauagaagugacagacaacuuugacaaaaaaaucaggcucucccacagaagaugugcaaggucacacugaagugauuuuauaacuaagaaaaccaagagugguggugguggugagucauuuaaaugaaaaggagaaaucauaccaugcucuugcaaccaaaauaacccaacuagugcauaugcugaaguuauaaaaagaggagggaaaaacucuucacaccugcaagagaaucauuaaaacauggcaggauggcuggggacugucacaguuaugggccaccugccgcuuugcuuuucacccucacccuaaucugaggucuggaaagcaagcugaaggauuucuuccugagacagugaagcugagccugagcuggccucagccuguuuuucuagcuuacaagcaagaaucugcagagcugccucucaacagcuccacgucuugugguuuucacaccauuuuuugucuuaagacauucaggaugauauguauuuuauuuuuuaauuuuauauuagaaaaagcagaauguauguuguaaaaaauguagagaagccuucauuucugauuugaugcuaauguuuugaaaaaaguaacacauuuauuucuuuuagaacuucaguaaaauaccauaucucaaauuuuagccaaaucugcacuucaaagaaccagaugggaaggucacauucucucugaaucaauauacuggaaauuagacagagagaaucaagcugauaauauuuaauauacacaucauucacaaaauuuaaaggacucaacauauuuuaaaguaucuauuuuuauuagauaaugugaaauuuuaguuccuacuuuaaaauggaguuuagagagaaaaauuacacuuccuuucaacuacaguggguaaaaguaccaccuggaugcuauuuacgaagcagcuaaaaaaugagaacuaaaauccucugugaacaucaugaaagucuccaguuucccuacagugauagaguaugauccucaucagaagauguggccaccuugguagggacauuucccacgaacacacagcuaauaggcuaggagucuuaacacuaugugaugucagagguuuuguugguaaauuugcuuacuucguaugcucacuacccuggguugaauucaccacaucauaugaaacagggcaaggugacauaguccuguauucccagcauuuaggagguggaaacaagagaauuaguuggucaaagucauccuucauuacguaauagaaaauucaaugccagucuaaaccauaccugaucuaguauacagaaggaagggaggaagggaagaagggagggagggacgggaaggggagaggaggggaggagaggggaggacaggaggggaagggugcagggcaguaggcaccgggggaauauagggaagugggagaaaauccaagucccaccagaguuccaguguucuggccaaguggacauggaagacugccgcaugcuuuccacacagugccggguggguggcugguugugugaagccauggaccccagcucagcgggugguggacaaggggcaguccuaggcaccggguucccagcuccaggcaucccauacacugauggacacuguggaagagcugagaauugaaugagggccccaggggccagggccaaagggaggagagggcagggggagagggcguuuguuaguucccaagugggugggagaccuugguccaguccauggcuugagcauaggaaggccuuccagcuggagguuagacacagcuuauuagggccuaucccaucauucaagcacagagggccuugaugaacagagacagucuauaguuuuagagcuuuauuguagaaaggcagggagaaagagagaagauagaaagaaggagagaagucagccauggccagguggaaagaggaggaaagagauagagggaaggagggcuagagaguaaaaaaggugagggcuuaaagagagugaggaggggccaagcagccccucuuagagugggcugggcuaucuugcuguaauuagguaacuguggggaggagcauaccuggcuauagucagguaacuguggggguggagucuagccagaaugccagaagcuugggacauugucugcaugacugauagucacagaauuauggaauugagggcucuguggugucaggcaccugagucugggaacuuggcuuacuuuuccaucccuuguagaguucucuacuggguugccagagcaagcccuauucaaccaaaauaggcugccuaucacagucccacagaagggaaggggaaagaaggagagggaaggggacggugagggggggggagggaagggaaggggaaggaaaggaaggggaggaaggggaaggaagggaaaggaaagggaguggaugggaagagagggagaagagaagagaagagaagagaagagaagagaagagaagagaagagaagagggaggaugggaaaaaaacuaagagaagaagaaaaggaaaggugugaagcuuuuggggaaauuaaaacacaaagucccugcauaucacccugauuuggccuccugcaaauaagggaaaauauucccaauucauuucucuagaugcuaauggugcuaaguuucacccacccaguucuucagcacuacaaaaucauaucccaugacuucacccugagacucuuacaucucuuauauuguaacuccugguuauuaauuuagccuauacuccacuccaaaggaaugcaacauaacuuuuacauaacuucuauuguccccuugguguaagcauggccucuuacauggcugauacaagccauaauccuuaacccacauggagcauugucuuauagaugcuccgugagaaguggaaucugaauucugggacuauacaguacacagacagaugaacacucagaaugcccagggaaagacagauaccauggagcuagguuuaucugggcuaagcagcaagaacuguuuccacuauaggucugaagcugucuauucuaccagccacaagcucugccaaaaccaggcccauuaacaccuuuaaauagugcaagacaugucagcagauuucucucuuccuauuuagcuguaucuaguugcuaggcaaaauccuggugggcuucuuaugaaaaguuugcucaagugagaaacucaguuuuuccuuuauucuuugugcaugcgggugggggcggagaagcagaauauuucagugaggaaaaucaagcagaguugcucuccuuugaaggugaucuuagcagugguggugccucuccccaccuacagaaaacaaaaaggcggcucccuuagccucacagcucccccaugaagaaguaugaucaucaacacgucuagguagaaaggaaacaucuguuuccuaauaguuugucuaucugcaauucuccuucacccaccuccuuuuuauuaauuuacucaaauaauuguucauuuccauauggaagcaaaggucuuuggcuuguaauccaaaacuacuugugacucuaaguaaaccaucuauacuuaguacaugaauuagcaaacauggcccuaucauauacuuuuaucauuuuggauuuugcauauguucuugcuuaacaccauaaaaccuugaggcucuguuguaauuuuaaaauccaugcuaccuccuuuuccaggcagcagcccacacuccaaccucucccgauuuagcucugagaucagcugcugggggaccuuacucccaauuugcccauuccucuugucuagcuuugccaagcagccagcuaucacccagcugcucugccucuccccaccuuagcucuguggaagaaaaacacaucagaaggcuuuauuauuuuaaaacuuuccagauaacacaauugcuggguaaagaaucuccugucuuaaccuuauuagcuagccuauaucagccaucugccggugguggaggcugcaggaucuggcagccccaagacguuuuuuauagcccuggcuguccuggaacucacuuuguagaccaggcuggccucaaacucagaaauccaccuuccccugccucccgagugcugggauuaaaggcaugcaccaccacuccuggcuugccccaagaucuuuuauggauauaaucccacucauuccaaagccuggcccaaagagcucccuccucuuucccugcaucuacucuuccuccuccugcgacucagaagucccaccguuuuccuuuuacccaucaacuggcuucugacuucuuuauugacacaaucaaaaaccagcuagggaaucaucaccucccuguacaaggcagaacuuuuagguuuucuacccagaguccuagaaugaaguauaucuacaaagagcuuucuuuacauuagugguaaaacggcauuggaaacuaagaucuggguauuagugguuguucccaagugacuugacuaauaagauaagaaaaugcaggggugcaucuauagauauuucuaagucagucauuauuucuaugcaugagugugucuauagauaccucuaaaucagucaguagugucucuauuaggcugaacagaguuagaaagcgucagucuaauuuaucacugcaagguuagccaaguguguuuucugcuugucuguaacauccuacuuaucccaacaauacuuucagggcuggcuuucaggaaucauaugcaaccuauuuaaucacccaagucuagacagauaaacaaacauggggggacacacacuccccuaaauguuucaaaauuuuaaucuauaccacuaaggaaaacgauuucaccuacaagguuauaacaugauccaaguuugucuuguguuuaaccuuacaaaacacauuuaauucuaguggcaugucaacauauucucucucacuccuuuuaguuaggaauuuuauacacuaaaacuacaauggauucccacgacagugguuucguuuugugggguaugauuuaaauuaucucuauggugcacugagaacuuaacauauuuuaggaaaggaccagacugaaauuacuuuuauuguaagguauugcuuauaaauauucuaaucugccauuaauuauuagcguuaaccucuuacaugcugaauuuagcaauuaacauuuauaggcaguuaugaggaaaagcugugugucuagagcaugguaccuccaugguuucuggccuggaaaucuuagaacaaauacgucagagaucuggagauacacuguccugugacacacccguccagcacauaccuauugaacuccugcaugauuucuaguuuccauccuuuaugaugcacacucugaguuguacacucucaaggucuucaacaaagcagagugucccauguccaccugacaguaugacagaacaguuugacccugcccugcaucuguuuggccuuagccuaaagcucugagaaccacuguccuguuuguuuuguuuguuuguuuguuugguuuuuguuuuuuguuuuuuaccuacaacgcuuucguuaaaucagcaauucauauaauugcugucauauaauauaaugcuuuuccaggcuggcuauagcuguauaacuccuguguuaucuuugguguaguaagagcucaucuuuguuauuguuuauuaaugcccugccauguaacugaaaggaaauaaaacuugagacaugugauucauguaauuuaugucaaauagcccaaagaguuguuugugagguuugaaaccuggggcugagaacauagcagaacaggccaggacaugcccgggcaggcccgucguuacauguccugacuggccuagugccucccuaucucccgcccuucugacagucuguugauguuuaaauggaccaaucaugugaaaccgcaccaauuccucccccagccccaccccuuuucuauaaaaaccccuagcuuccaagcguaggggucgaaaccacugucuccuaugugagauacguuucaaaccggagcuccgccauuauggcuccaccauguggucaacaccucugucuccugugggagauaugugucggcccggagcuccgucauuaaacuaccucaugcuuuuacaucaagauggucgucuguucgugauuccugggugcgcgccgaauggaaauugaguggggguuuccccacuagguucuuucauaacugcaucacaauuuucuuaggaccccucugccuuuggcauucuuguguaaguuuugguaagagcauaugcuuucaugccaguuagauaggaacaugaugacaguuugugacaaaacuuaacuuuguaagaaauagaaaaacuguuuuauaaagggaccacagaauuugacauucucuaaaacaaccugagaauucccaaucuaguaacuuccuagugauggcuuaauccauuuuuuuaaggcucugucuauucuagaaagugucuuguggaaccugcucuucucuuuggaguaugcucuugcacaucucuucaucuaccuucugucccugaaucuuucauaaugagauauuugcagcauuugcuugucuuuaaaugaacuuguuuucuugucauuauaaaaucuguuaugaaggaucccaguccuuuaccuuuucucugagguuagucucuccauuucucuuccccuacucuggguuagcauucucuucuguucuguagagucuucuauagagccuauaguauugucuuaguaaagcucuauguagugguuuuucccaugggucccauuuuugcuguuauauauagaaacuuacuaccaagcacaugacuguaugaauuuuuccuuccauauuuuucuucuaaauuuuacauuuuagucuauuguucauuuuaauaaauuacaaggcuaugucuagguuuauauuuuuuacacuguauauucaauuguucuacuacauuuguagaaaaaaauaaaaccuuugucauuuucuauuuuguugucuuuggaaccuugacaaagagugacugucugaauuugcauuaaaaauuuacuauaugaaaauaaauaaauuuuuaaaauaaaauuuuaaaauguucugcaguauugaaaggcaagaagaaagguaggcucaacuguaaucccaaaggagcaugguaguaacagguugcucuguggacauuguguaugcaggucagauguagaguuggaggaugacgaaacuuaacagggcuauuuccaucacaucuauguccuaaguguuuccuaagcaaugauuauaccucuucuggcagaguugagucucauacucuguuaacaaaaagaaaggcaugcaauaccaaggccagagaugauaccuuagaguagaagaccuacaaagaaagugaaaggucucugccugucaacuuuauagguagguuuuaggauuuaaaaaaaccaauaugacuaccuggucauuuccucacaaacauuucacacucccugaaauaaagagaagcagaauuuuuucuuagccaccaguaauguggguuucucacgaaaggcaugucaucauuacacuucauaaugacuuuuucucugcagcaucaaguaauaucucauaaaagcugaaaaagaucuugcuuugagcagagccccacugagacuguauaaacuaagacaagggcaaagcaaaccuucuuauccagaagggacuaugggggaucaaauggaacugacuguuuuucccuuuguaauuauucauccuauauguuuaccaaggauggccuggaaacacaaaacaaaagccucucccuggagucauccugaauaaugugaaacccucuugugucaauuagagucaacacaucauaagccugucuuaaauuggcuuuacgaaaucagagaagaaaguagaugaaaucaccacaaauaauauaaaacugaaguggaagaagaaauucaagagaaaagcuggccuuagaggggaccaaaguguguaaguauuuuuaaaaaaugaggcaugaaggcagacuauuacccugcuggcagcaucggaagaacucauggguuuuccauggaacagugcaguauaaaauagugaaugccaugcaugggaccucaucaggcuggcaaucagucuucagucuagauagugugugaucacuuacuaaauggcauuccgcugcauugccagcccugccuauuacacccacucugcucaugcacggagucagaacgaccaaaacccuagcagcaaauaaauuucaauaaacagauuuauuguucuauuucaauacaaaucacagucuauuaagaauaaugcacucuggccuggguucugacaggcagaaauauacugauuuaagaagaaaauugggcuccuaauuuaauucauucauuugcaucuuuccucuaagugugaaauaacacaggcauacccaucauagcugguaaucauuuuucugcucgugguucaagucaugcuucugaaaauuacagcuccuccuacuaaagaaagugcauauauguuaucauuguaggaugaauacuuaucaaaugaaacuauggaaagaaagguugcucaaaguagaaugauuuaauauagcuuaagaaaaaugcgaaauugauaccucugcauuaugugaaguuuuguaaaauccaaauacauuuucuuucuugacaugacauggucuauuuacacuuauugucaaaaguguuugcuaauuucagcccaauauugcccauugaauguuagacuauaauuggcuuuggugaccuaagaggaauuugcaauuucuuuguauaccaugaauacauuaaagagggauacaauucaggucucuuauauggauacaccauuuugggggagagaauaaacacauuacuuuguauauucaugcuuaugacacauacuauaaaauuugcauacauaauucaaauucacuuucugcuauacaaugucuaauuugaauucaauggauucaaggccggaugacuuuggaguaaagaacacaucauggaccagaauuauuuuggguuaguuuuagucccuuugaaagcuacucauugcccacuaucaugucugaucaugucugaccuaacaaccuaucaaaaccucuaagaugaauucuuaggaaaacauugacuuccacccucccaaacuuagaaauuucaucagauaacaaccacaccucuguaacagaauuagcauugcuuugcucuaaccuacauacuaugguccccaaugauucaauuauuaaauuccuugaguuacgacuuucuuugcuuuguuuuacguaugugaguacacuguugaugucuucagacacaccagaagagggcaucggaucccauuauagaugguugugagccaucuaucugugguugcuaggaauugagcucaggaccucuggaagagcagucagugcucuuaaucccugagccaucucugcagcccuuuuucuuugcuuuguaacaaccacaaucucaucuaacuacuucugugguggaggaugcuuuccagaguggcagaaaucucagguccuggcugcucggaagucaagaguaaacucucucauucacuuugaggugaaacauguauacagccacaggguuucaaucuuaaauaggaauguaaaugucucugacaaagaaauaauaauaaaccauuuuuucuccuuaaaaguaaagaauuucauaaccagaauuuccaggcuucaguauguuuuuuagcugcagggcacuccaguagaguuaaaaauaaauuacacuucuauucuucucagagaaggacauuaaugugagcacuacagcauggugcauuuugguuaaaaucagaaacaaucuguggccaggugacuuaacuugauucccuuacagaacacuggcgcuucucucuccgcacagcuucugaaagccagccugccacagccccugccuaccaaauugcacgggaauuacucucaauuacaggcuucugucuguuaaacagugagagcuggcgaucacuucugaccuuucuccucuugacaagccaaagaaaugaaaggaaauaaaaccuggcagcuguucaauuuagaggcuggaugcagggggaaagaaaaaaagagaaaagaaaccccauauugccuaccuguaucuuaagguaugugggagauuguuauaucauccuauuuucuaaacucucuuucaggggauaaauugcacauaacaauguaaucuuugcuaaaaguuacuuguuugauguuuuaauuugaguaugauuuacugaaaucuuccuacaaucagucacguagacuugugguuucauauuucaaggcaauuuugcugaaugcugaacuucuaaaccccugccugccuuccuuacuuguaaguagguuauaaagaacuacagagaaaugacccaggaccaccuccacauuccauaguuuacugagagacaaaggcuuaggaaggcaagccuggacacuccacuuacuuaucccguuacuauuauugaauagauuugaaaugaaauuggguuuaauugaaugugaauguuuuaaauaugacacgaauaguuucacagcucucuugacauuuacccacaauuuuccauuucaaaagaauaacuacuuugcuaaggauuaaaauaguuguuuggaugaaaguuaaaagcaaagacauucuguacucugggaaaguguuugucaaaaccucaagaauccauccagaacauggucaucaaaacugccaguuagagguugaugccaugagcacugacagacugcauaccaagcucccaaagagagaggaccagaaucugucucacccaacauaggccaaucaggccccuacuugccuuggaaacacauuccuucuaagucagcaacucuggcauguuggaaaaacuauucugggaagaacuaaugauucuaaaacauacuguagaguccagacaguuaaaacucccucauccuaacagaccugaaaacagcauguggaaaugccgauucugauugacugaugacaucauaggacaaaaauaaugucccauauuuucuuccugaucugcuauuucuguugccuucaagaguugacgcugcuuuuucugaguugggugagauaguuagcugagaagugacucacugaaauagcuaauggcuaaagaguaggaugucaccagaaagaaaauauuaaaaggaacaugggggagaaaugacacucuuuugggccaagaacgaccucaccaggaucuacuuugcuuccaggaaguggguccucauaagacuuuaugguaccucuuuccagcugacuccuuuccugcgauggaucagucaagaagacacuuaauugugugagcuacagagcuuugguacuagcacaaaccagcaaaggagcaaugaggcagacacugaagguaucacuauaucuaaguugucuaaagagccagcuuuauuuaaaauucccaaaaagcgagauuccgaaauuuaaaaguccuaaggguccuuaucccuaacaagcagcaguuguuuggccugguauuuugggagggacagguaggugagaagucucuuacuaggaacuucucaugcugaagagggaggucagaaauucaauaugagaauaaauacaguaugcauacaaggggcaaucuguauggcucuaaucuaaaauacauuauaaaguauagagauagaaacaucauuauacuuauacaugauuccaaaagcaauaaacacauagaaaaugaauauuuaauaaaaauaagauuuucauguuagccuuucuaaguucagcaggucacuguaauuucaaauccauccuggaccaaauaauguccuuuagccuuagauagagcaugaaacucugacuuaacuuuuucucccacuuaacaggaauaagauacucagcugucuaauuuaacuuucaauauugaagacaacagaacaaauauuccucaccccuaugucauaacuauuuuauauaagacuucaaauauuuuuaaaaguuuaaaacauuucauuugaaauagugaaacaaauuguaaugcuaaugcauuuuaaaacaugcuaaaaaaaaaaaaaacuagauguuggacugugaaaggcagucuguauucugguugaguaaggcuuacuccagagaccccauagaaaauucuacaagguacagaauccugagcuacgcucccagacacuagacucuugacaccauaagccuucaacucccuaauccuguggccaucagucauguaggguaacuccccagguuccuaguauucuggcuggacuccacccccacgguugccuggcuacagccagguauacuccaccccacaguuaccugugaauagucagguaggcuuggccuacuauaaaaggggcuacuugccccccccccucucucaagcucuugccucucuuacccucuugcucuuccucuugcccugccucucuccucauuuccuucuccccuuucuccacguggccauggcuagccucugcuucucuauuccucucucucucucucucucucucucucucucucucucucucucucucucucucccucccucucccucccucucucucucucucucucucucucucucucucucucucucccucucccucucccucucccucucccucucccucucccucucccucucucucucucucucucucucucucucucucucucucucuccaauaaauaccuuaaagccauggacugccuccuuucaucuagacuugccaugcuggaacaauggaauaugccuuucccuaaagagccacaucuaaccucccaccaggcggccuuccaguuucuccacccccuagacaggaccaaggacucucaccaggguggggaccacccaugccuuccccaccccuuuuucccuucagccugggccuacuaccgcuggggaggggggacuaggcgcccauccauucucagcucuuccgcaguaucaagugauguccugugaugcccaagagcuagaaccuguugucccuggccuccgugaagcccaggcauccuagacugcucccucccuaaccccccuccgcccugcugacuggggucccauggcuuccuacagccagacaccaacucagcagugugggggcgcacacaguccaaccuccacaucugcccugagcucuggcgggaugcaggucaucuccccaacccccuuuauuuccccauguccugcacugagcacgaauacaauccaauuaugugaaaacccacacguuuauuauaggcuaaaguaaguaaauacaagauaacauuaaaugagaaaacuaaagcacagaaaauaaaccuacaaauucagcuaaaaucccuaaaacaagaaaacacaugccacaucccuggguagagacaggggagcauagugacaggugcuggucauguggacaugcaaauauaucucccaaugucccaaauagguaucagguauguucuaucccauaauuucuccuguccuuucuggcuggguacuacagaauuugaaaugagccauguccucuacagaaaauucaaggauggaacaaacugaguggagcucagugcagaaugaaggggggcggggcggcauugucugcauuccuugcuaggauaggaaagagcugggacagccacucuauacaaagggaagcauaacgagauaacagagaaaagagaaagcuuguccccaagcaguguagagaaagcuaccuauacuucagauggaaauucagaucuggauuccagcucccaugauucuuuccuuuaauuaccauucuucaacccuaaugguauaugaacaacuuugguaaguucaagggagguaccagaguggcugguaggaguauggaggcauugcccuucccuacaugggcauugaguugccacuaggauucccacaauuuuucuaaaccauuuucuauauauuucacuccuuugagaacaggaaagcugucuuuaaggacaggggaaaauacuugaaagcagacagguaacuaaaaaagguuguaaagaaaaggaacacagcgcauuccucugcaaaacccuuucagucaagcacaauuccacacaucuuucuauagcaucuggcagaagcaaccccaaagugaccucagguccuguugggaggcccugggaaacagagucuagcuugagaacaacuguguuuaauguuggcaccuagacaugauuuucauucuugcuacucaaaguauacuacccagacacagcagaauaguuauaugggagcagggcagaaaugaccagaucaucagagcuugacuccaaacuggaagacuagaacacauaguuuuauaagcaccauggauaagaaaaucagaaauaauuuucuucuugacuaucuaggcuuuaccacuuucugucuggcauuuggggacagaaucuuguuauguaucccaaacugaucuugaauucaagauccuccugccucugugucucuagcacuaguauuauaagccuggaccacaugcuuccaaaauauugaccagccuggccaauaguuugauaauaucgauaauuuauguuucuagcccuucugauuuuucaucuuuccuccaaauuccugccucuucaaauguagaauauucuuuuuuuucuggguuuucuuuuuuuguuuugguuuuguuuuguuuugguuuuugguuuuucgagacaggguuucucuguguagcccuggcuguccuggaacucacuuuguauaccaggcuggccucgaacucagaaaucuuccugccucugccucccgagugcugggauuaaaggcguccgccaccaugcccagcuaaauguagaauauucuugaggcuucuagauuuaacuuuucucccuacaaugccaucagcaacagcagauaucaaauaaauggcuggcuuugauugauuuagagaauaucucuguuucgagggcucuaagcccaugcagaacaugcaaauaaaccagaauuccaaguucuauuaccccaggggggcacugacugggguuacauuuuucacaucauuguccuacaagcuaauugccuacucacauacucaggaccucuacaucaccccauguucuucaaggucuagcuuugggcgccauuuucccaaauagcccaaaaucaccuaugagaggagaaugaugaggagugugaaugguauauuuguguguggucuugacguucucuaacaacagucaauacgaagcuuuuuggaaguaauuacauuuugugugaacuccguaauuuuaaacaauacaaguugccacugaaguguuuguucauuacugguguugccauucaaagaugacuuccucugugauuuuuaaaccauccauuccaaaugacacugaaugacauuuuccuugaaaggcagaauugugaauuccacauacguuuggugggaggauaaaauuuuucucagucuuuaaauuuacaaccaugaguaguugaacaaccaaaauauacaaaaaaggaaaaaacaaaacaaaacacugaugauguguuaaauccuuuaaaggaaauacaauaaccuugucuauaccuauauauauaguagugagaagaggaaagucaguaaccaccugagaaaacaccaaacauagcccuggcagagcccaaugcuauauagcauaacuguucaaaauagccuagacccaauguccuugcaaagaaugccccagacauauagcauuuugaauagaggaaggacagagucuccauauuauuuuuuucuaaaugaaaaugaaauuaaaauacaaacauuaucaaguugguuaaagagcuuccaaauaucaauccaagauagguuucagagaauuuuagaaaauauacagccuucaagcacaugagcagagacaaggcaggaaaaaggagucaugcucaacccuacacuaggcuugaucuucacaaaccaccacauagaacacauacaauguaggacacaaucuuuuagauaaucacucacaaagucagauacuuagggugacugaccacagcaugucuaugagaauguaagaugcuggcccuguaacagucaugggaaugcagacucucauagaccugauugcuguccuguacacuaccuguagucuccauacgggguuggcaaaacaauacugugcauaacccagaggggagagcccucagccaagugguucagggaaaaaugcacuuaguuuuugugucagagaacauguguuuucuaauagcuggaaguggucgcuuuugaaucaccuggucauucaggcugcauauauauaguaacuugguaaagcaaucauuuaccacagaucuagugauucaaaauaacaaaacuuuaucuuguaguuuuaaaggauagaagucccaaguucucacugcacuaaacucaacaugagagacaguaguagagcuggaguccucagagcuacuagagacauuccauuuacuugcuuuaucuagcuucugaagguugcccacacucuuuggccccuugcucuaucacaaaaccaguaaggcaugcuuagccuucuuacuucacucggcucucugccaucauccaagucuuccuagauucucuugccucucucuuccguuugcuaaaauauuuaugaccugccugagcaaucuaaggcaaacucccaaucccaagaucauaacuuaguuauaccacaaaaauuuccuuuugccuggcuaggaggcauucacagaucuagauguucaguuuuguguuucuggguaagagcagcauuauuucugccaccuucaucuacuagagcuaacacugcaugauuaaaucauaaaaaaaauauauguguguaugaaaauggugacuauauagugacuauacaguuauguauguauauauacacauauguguauauauauauauuuauguguguguguauuguguuauguaucuacaauguaguacacagauacuauauauaguaauuaugcuauuuuaagaauuaauaacaaggaauauuaucuuaauaucauuaccuuaaguuuauuauauagguacucauggacaggacaaacauacacacacacacacacacacacacacacacacacacacagacaauuuguagcuaaguauauccauccauguagaguuacaacaauuugaauaccauccaucaugccuaucacuaccucccucaaauaaaaagucaaggauugugauauauggucauauuacauuuuacaaaccaauacauaacuagcaugcccacaucacaaauauauaaaugucccaguguagaaugccugugaccaacacagaagccacaaaccacacagacugugucaauaccuacaauauggauaguacacauuggaacauaacuugaguacaaaauauacauaggauuucgaggucuauuacaaaaaugaauauaagagaucuaauuuaauaagauguauguugacuacaggcauacugaugcuaguaaaguuauguaucuuggguuauguaaaauuaaaagaaaauaaucugcuuaauuuucuauucuucaguaugacagcuuuguauuuucuguucuacuacauagcacugacuacacagccaaaguaacauuuaaagauaguugacuuaaaauaaaacauggugacuuuaucauaaauaugccauaaauuucuugacaucugaaagcaaauaacugugcuaauaguaugagauaguaucucuggagaaugggauccgguguuuugguuuuaauauuuuucagagacuaccuuuauucuucugcaauucuaccaauaucaagaaaagccacaugguaaaaauucauuuugcugacuauaaacuuuaagauucucuauauuuuucucuuuguagccuucaguucauguugaugaaaccagcacaaagguacccucucccacccacaaccaaccacucuucaacuucuaaaccuuuccuuucaguggucccuugaaaccaacuuaagaacucaggaacuacauacacuucaaaggccacauuguugggggaagcuucugacuauaggcccuggcaguccccaccgaggagcugaagugcauuauuauaaaguucugugcacacuuucugaugauggauaaaacaaauggauauggcccacaggcacagcaggaaucaaaaauacauuagcuccuugcaacuucugaucugggacugaggaguguuugaaugggcuucuccccaccccuuucaaauaauguuuagaugagacaggaacgcaacccacagcacaguucugaggcucucugggcccaagucaguacuuggagaagaaucaaacacaucguaccuaagguacggcacuacguuucauccacaaauuaucauaugcccagucacaaaugguuauuguaaaaucuuuauuaaccuaagugcauauaaaaauugugaauuccuaauacaaagcaguauuugacuuuuaaauuucauuuucaucuuggcccguucacuuggaaugugauuacagaguaaauuaaaaaguaaucacaugugaauuacauuuccucaugaauguaaugacuucaggaggcugauuaauguuaagcagcgccuguccuacagucuguauaccuucccaggugagagauacaagauagcuggcgugaguugauuuaauuuucuuucacugguauuccagaaagacuugucugaacacauaaugggcucugcauguucacuaggacagagaugucuuuccuacuguuuguccaaguccuguucacaaaacacuagauuggaagaaaagcccaggaaaagcaaucuaccucuggggcuguuuuccaaagagccaagucucaauuucucaguuuugguauuuauggcaaauucuuccuaugagaggauuaauugaagaggaaugcugagaaaugcaucugagcaaaugggaagguggcaaguuuucucagaagaaaugaaagcauauuaauaauuuauaguaacauugcuacuauacaaacaaacaaaauuuaaacaauaaauuuuaaaccaggaaaacuaaaaucaugaaauuguuccccucguggaugggaggaaguacaggagcucaauguaucuccuccuuuuuaguauauuuagggaaagauucucuuuucuaaaagauuuaucagagaaauucuguuauuccugguacagagauauccuggcauaccauuauaccuguuuaaaacagguauaaaugugguaaacuugagagaaugucagagaaagacugaaagcuaacacgccuaagagugucuuccuuacugugacuuccuauuccauugggugggaaaaugggccaggccugaaggcugaaaagaacacuuagggcauaauguaugccagugucauucaaguaugaaaaaggaaaacuacucgugaugguuugacaccaccuaucuguaauaauuuauuuuuucaaauuugugagacaaauaagucauauuccucuacccaagggauagaaccagacuuuaguagaccauuuccauggagcucaagggucacugaaucauuuuguggccauuuauuuauggauuuucaagaacugcaauguuccaaugucaccuguucucagcuaguaggaagcaauagaggaaucggcaagcuaaccaucccuguccagagaaugacauaggaaaggcacagaaugauaucucuggcucugucucugucucucugucucucugccucucugucucugucucugucucucucucugagagauaaccauccuuggcaauucccuuuaauuucuuguuucuuucuguuucuacuguguuuuagcuuaagcugagaacuuguggaacauuccugguuaauucuaauggugguuggaaaguuaucacagaagaauaaugaaagggcucugggagauuucuguuuagaaugcccagacaccugcucugggcagagagcagaaacaauaacucuuguauguggagcugcagauagcagacauaacuacagacaugaaagugcccacuggacucuaguuguauugcauagcuuaggagcaggguaucacucuuacauggcauuccauuuuauucuauccucucuucuuccuuucuggcuugguggcuuccuugcuaccaugguuuguaguacuuagaaaaacaagaugaagacuggacguaauuuggguuaucauagaauaauuaaccaaagaaugcaaguggucuuuuauaacacagacgaagaaggaaucaggacagugggauggcguagaaaguagugucuuugccugaaggaaaaaaaaaaaaaaaaaaaccucgugaagaccaugaaggccuagaauauggagucuuccugauguguuaauggggaguuuucuuuauaaccagaccaggcuaauugauuccuuucuauugcacacuacugacuuaaaaugaagaaugaaaucuagcuacuucccaauguuagagcugaugugugauagcugccuuaugagagacauauauucuacaaauccaggucaaccauguuuaacuggagcuauguuuagccucacuaugcuuuggaaccuaccacuggaauacgguaugcacugucaaaacucuauucccagaaugcaguguuuuaaacauaaugggaccaugacaguagcucaccuugguaaacuaugagauuuuuuuucuuuaaacaaagaucuuaccucuacuuguaucugugguuagaauguuaaagagagcaguaaacaccaguauaucucuucaguaauaggaacguuuugcuaacuuuuaagaaaagauggucucuggacauuuaauuggguucuaaaaugugaccagagacaagaauagaauguccuacuuuaauuuugcauugcuccuaauggcaucugcuuaaaaauggccagguuuuggaauacacugccacuuaaaaugcuaaggcuacuaacuuccuuuuaguuucuuagauaccuuuccuugcuccauuccuugagcuaacaucuguccaucuaccccuuccuuuguggcuucuucccucccucccucucucucugcaauguauacauccaaguaacuguacauucauuuucaggcauugagaacauacaaauagcauaaagagacuaguuccuguccccaguggagauuaauaauuucccccuguaaagaucaugguaccugacuggaaucacaaugaauucauaggacuuaucguccuuaaagagauucaaccccuauguacuggucuucacuguugauuccagcacaaacuuauuuugccuuugguuuggucauuuauucagucagcauuaucugucaugcccugcuuucuucauugcucaguuuauuggccauuuguuugccuacugcaucuuaaacaccacuccgauagcuccauaguauaugucaagaauuacucgaaauucuguauuccacuuugugacuuuauaguucugggugacaucaucaacuuuaauaauaugugaaagaaccaaaagacagaugcugcuucagguagcuaaccaguaaggaagugucauuucacagccuaccccgaaucccuuucuucuccucagauuaacuaucuggaagaaauauaaaaauauaaucuguauaucauuuuaaaagcaacauucuccuuucacagcgaugcugaauaucaccacugaaaugagaaugugcugcuuugguuacuuaugcguaugcuugaaauuucccaccuuaagauugguucugaagggacagugaucaggaucaguggacucagcacagaggaugcucucuuaggcauccacugcagcucucaacagaaacccaagccaggcccaacucagcucaguuuccuuuguagccuugaggaggaaugaaugcucuagaaaaauucucuaaauuuugacaaguuggccuaccaugaggacuugagccuuuaaaacucuccuguaagccaauaaaagcaaaagaucugaagagaugguucagccauuaaggacauugaauguucuucuagaggccccagguacaaaucccucgugagacuuagaaccaaucauaaccccaagccuaggguaucuaguaccuucuucuggucucugcaauuauuaccauacacacauugguauacagauauauaagcaguuaaaauaucuauaaccauuaaaaauaaaauaaauaaauaaauaaggaaagaaaaagaaaagaaagagaaaaaggaaggaaggaaggaaggaaggaaggaaggaaagaaagggagggagggagggagggagggagggagggagggagggaggaaggaaggugggggugguuggaaagauggcucagcaguuaagaacauuggcugcuuggcuuucuagagguucugaauucaguucccagcaaccauaugauggcucacaacuaucuauaaugggauaugaucuuuuaauguccagauauaccaguacucauauauauauauauauaugaguauauauauauuuguauauauauauauauauauauauacaaauaaaccuuuaggggcuaggcauggugucucaugucuuuaauccuagcacuugaaaggcaaaggcagggggauacccaugaauuuaaggcuagucucauacaaauagugaguucuaagacagccagagagaccuugccucaagaucaaaacaaaaaaaauguuuuuucuauacacuauaguuggucauauuuuacccuccuccaauuccuccuagauccuccguaccuucccauccaaccaucuucagguuccuucucccacccuuuucuaccucuaccaaauuauuuuuuuaaaaaucaaaacaaacaaacaaaacaaugaaauaagcaauugagaaaaaauccaccaaaaauaaaacacaauaccaaaaauaaaacaagcauacaagaaacaaagaggcuauuugugcugaccuacuccugggcauggggaaagauaccagcaacacuccauuguagaaaacugauuuucucuuucccuguauguauugauuacaaguggcuuuuugguugggggugggacaucgcaucuaguuuuccugugugcucagaccacaucuggcuugaagcugagcaggucuugugugugcugauggagucucugugaguuccucugaacauuaguacuguuguaccuggaugauguucuuucuggagucacucaccagcucuaucccuuacaaucuuucugcuuccuguucuucaucgauccccaauccaggagauuugaugaagaccaaccacuuagggcugaguguuccaguccaaagucucucacucucucccuauuuuuuuuaaaaagaaaaaaaaauggaaguauggucuuccagaugcacacuugucccagccuguaaccacaugguucagagaagcuggugagcuauuucucauaaauuauagcuaugguugcaugauuguggauuuguaauugauuauggaaaugcugugauaaaacuacaguccaaguaacccagcaaguaucucuguaguuagggaaacaaaccuucacacacacauccauuauguauauuuuauuguaaaaugagagaagaugaauucuuaaaauugcagcuuaaaguugaacaaauuggauugucaucagaaggccaaaagucuccaauucuauggaacuaaauuaauaaauuauguuuaaaauauaaauuauuuguuuuaaaaauaagacaaauaaaauacuaaauuauauuaaaauauacaaauuauauaacaacaaauuaauaaauuaaauucuauguaauuaaaggagacauuuguggcaagcuuagccugccuacaaaucuucugggauacauaucaacccaaggccuauuuguaggucccccacacaccuguaaauuugcucacagaaugacauucacaacaucaucccaugcuguggauuucugauaaccuguuugucuauuuucacuuaugaauguggaauuuuaauuuuagagauagaagaacugguaacuuuuuucuaacuugaguuuugaaaauaagccaaaaccuacacauguaauccuuuuaaacuagcacagucugaguaaacacuguaaagucucuuuacugauuuugauauguacuacuauuauuauaugaugcaagacccuaacauuagaaggccauguguaauguaugucaugucccuguguuuggcuuuuguugcuguuguuguuugcucaguuguuguuuuuguuucacuauucuuugacuuaagaauggugucaagaaaugaaaauuuaaaaagagucagggaaaucauaaccuaaaaaaugagauacaaaauacaacuggaaaaguccagccucuuuauaguaagagagaccucaucuccaucaauaucuuucauucaaaaaauauuugcuaugauaauaaaauuaauaacuuuuggcaaggacauggaagucacccauaaugacuccuaggagacaaggguuacauccuucaaaaacauuuaaaaggaccugagguggcuuuguuaccccacaaucauaucaacauuuaguauuuuaaucauugaaagauuuccugucaacuagcaguccuguugcgaguaacuuuaaaagugugcuuguacuucuauaugcuuauuccuggguauuuaugcacgugacacccaccuaccugcucagccucugucuuuaugugcaaaaagauguacaaggaauauauaaacauacauguagauuagaauuuccuaggcaaguuggucucaacauuucauuugcaaaauagcagggcaugguggcacacaccuuuaaucacagcacuuaggaagcagaggcauguggaucucuauggguuugaggccagccuggucuauaugcugaguuccaagacagugaggguuagagaggaauccuggacaaaacauaaaaaaaaaaaauaaaauaaaaggucaugaaaaaguuaacgugcauaaaguaucaaacaauaguguaaacgcuaaauaccaacacuagagaaagaaaugcauaaaaagaugaagaggcauguuaaaaauaaauuuaaaaaguuaaagagcaccaaggaauuaaaagacuauccaacuuagcagaagggaaccaaaccaagaguugguccuuagagcuccaggucuaaaaaaauuggaaauaucuacuuuugguaggcaguagagaaauggguacuguuauguguggcaaauuaaaaugugaauucuuaaagcuuuugggaaauacccuagaaauaugaauuaagauaaaauaguacauuuucucaaauuuaggacuccaaugccuaaaauuuucucauauuaaaauuauauaaacuuuuugauagugguaaaacacaauacaugcauagaaaugaaauaacuacaacuggagaauauuguacauuuauuuuaagucauucaaaauaaugaguuacacuauggccuugaaggcguuuccacaaagaauuguggaaaaaggagagaauaaauaagauucaguuuuuauaaaacagugacuaaaauguucccaaaggucuauaugugaaaauacauuguauaucuaugugugugagcauauuaacaacauguuaacaacauauuaacaacauauuaacaacauguuaacaugcugaagucuacugaagcuucuugccaggugaagacuuccacuguuuccaaaucugacacacuggaguagaucaguaguuuacuuccagccagaugugaccagccagaagaacgaccugccuaaaguuaaauguuggaguacagggggugaaccuuucaaaagccgauugcuaucagaggaggaaagcugagcaaauauggaacacagagcuagauuuugucguucaaagggugauuggaaaaagauaacaccaaaugaaaucaaaaaaaaagggcccaaaauugugaaaggugcacauuuaaauguauggaaauguacauaacuauccagacuuuaugaucuaaugcauagauugcaaugaaaauuugguuuuacaacuuacuauauuggagcugagaugauauuucaguggguaaacagugugucaugccaguaugagggccugagccugaaucccuagaaccuuuauaaagccugacuguaguaggcuauagcugugaccuuugcuucaaaggcaagguggcuggcacacacaggacuccagauccucagcagcaagucugauguacacaaugguggacagcaaagagauccuuccucaagcaagaugggagaugagaaaugacaccuccccuuguacugggagccccacaugccugucacacuauauacuauagcacacaugugucuauacuuaggcacacaaacacauaacauaugcauaccgaucauuaauguauaucaucaauacaugcaaaaugauuuuuaaaacuuuauauauuaaaaaugacucuuaaaaaugauccuccaugaaucuggcccaugguuuccucuuuuuaaaagcuggaggacauagcaucuccccuccucucucauaaggucuagcacucaugaaaaaaagacaauaauccaacagguccuacaaagccuuuuugcauaagcuaaagaacugcagaacuuuuccagaugccagagaauucaaccucucuaaguggcugcugugcaaagggagcuaaaaguugacugucccaguaggccaugauuuauuacccaaagccuaauguuucuucuuuuguuuuuaacauguuagcaaagcacauagagcuauaaggauuaagccuaacccauuauagcuaugcucucuaagauguaaaaggcacagggcugcacuaaaaugaacuuauccaucauguggugcccgggcgaguguaugauuagcauaaguaccuaaagaaugcagagcaggugggcagcuccaugaguccauccagaugaauguaaaugcuagccaauggccuaaguacacagcuaagguuucaauaggaugcuuuauuguguacaugugggugugcauggauauguguauaugugcuugcaugccuguaaguacaugcuuuuugcacuuguguguaaaacaauagaaaagaggauucucuuuuagaauuagcacagauuacacuuucacuaauuuaguuugcagccaacauuccccauauauauaguuuaaguuacaacucuuauucuacuugaauuucauauauauuuacuuuaaaaauaguucuucaguaauauacacaucguucuuauuaguuauaacaaaugacuauccacaugggucaagauacccucucacacaaauacccagccacaccccucauugcacacaucacaccccacacauaauuauuggccugagugugcugaauuugggcucugaagagguggaaacuacuuuuaaaaucuuagagcccauggagaaaguccaaauucacuuccucaucuaucaaagcacugucucaaauguuauauaaauaagaaaauguuccuauauacuaagaaauuuccagaaaaaaauguauaagaucaauauagcaauauaucacuuaccaguaaaaacccaagggaucaaugaucuucaaacugggucuuuaugauauaacauuucagggcaucagugagagcagaaaaacuuggguagaaauacaaaguguggccacacuagaugcugucuggaagggugagauggggugggggcauauuaaaacagaggcuggauuauucccccugacaaauuaaaauucuaugugcaauuuagaaugucaugucuuacuaguauauccuucaugagucaggcagggaaugacaggaguggguaaaaaugaaccacgugaggaaagcgcaggcaccuagugaacgccggcuggguaaccacacagguugacugagaacucuuuagcaggagauuuuauuagacacuuuacccuugccacagcaucagcgcuuccuauaguccugggauucacuuaccucugucacuuuaaauguguuuacacuuaauauguguaugagaagugcugacaaagccaagcauggugugucauacugaugcuguguuaaaaguaggaaaugcagagugccaaagaaaaacuauaaccuuaggaaacaucuuaaucacauuuuuccuggagaagcuuauuaagagauaccauguguucaaaaccuaacaauuuuucaucuuuugccgugucagagaugaguaaaguauacucugaaauugcuucccccagaccauaaaccuaauuucagaauuacguacugagaagaacaagcuggcuuaugccuguaguccccagccuugggagaaggagguugaagaagaaggaggaggaggagggggagggagaagagaaggaggcuagaggaagaaaccuagccugaauggcacaguggguuucagaacagccugggcuaaaguaacagaccuuguuuccagaaccaagcaucuacuauaacagccacaaaggcuccaucucuagaugaagaagcaauuaauggcugcugucucucugucucuauauaucuuuuucucucucagucucucucucucccuuuuucccucucucuucccuccaccccucgucccucuauguguauguguuuaaaacaacuuuuaaaagaagugaauaauuugagaugaagaaggacccuugggaaaaaagaagagcugaaaaugauaugauaguguacucauaugugaaauucuuuaaaauugaauaauugaaauguaaagaagaaauuacauauuauagugcauaucuauccaacuauucuagaauggcugugaaguugaaaauccuaaguauuuguauuagaaggaauugagacagaggccacaaggcuacuuucaaaccuuguuuagcuccuucuauuagucaugagaaaagaaugugcucuuucuucucuauacaauauguacaguuuuccaucaccauuaaggaagaggucucuuuccaaaacauugacuaauauuuuuuuaaaaaguucuguaucuuaauauauagcucaauguuuguagacuaugaaaguauauuucuaagaauauaaaagaauauaaucaguauggaaggcaauggacugcugugugggcaaaaguuuuauauaugauuuuuccagcugaauaauauuaaagaaucauuuaccucuaaguuuuuaugacaggcuuuaaaacagacauaucauucauuauauucaauaaauauaaagagaacauucacaguauuucaggcacaaaaauagguggcacuggggugacauagaguacacuaauuauaucuuuaagaaaauguacagccuacugcuuccaucucccaugucauagggagaagaaauguuuaacgauuguauugacauucucagaauaaagguacucugaauaaaauauuuaaaauuccaaaugagacuucaaaauucacaccaaaauauuuacucaaauuauucagcccuugugaacuuagugcuuugaauauuuuaggauacuauuucaguuacuuucaauaaaaagaagaagaaaaauuaaugcauuuuauuuuguuuauguaaaacaacauauauaguaccauccugcuuauuucucuuucacaaaaauccauacacccuuucucuggguaggggauggacugauggcuagaagcauaagaaucuaugagaacuccaggacuuugagaagcuuauuguccagaaaggaaggugaauaaauuguccugucuuaguuacaguuuccauugcuuugaaaagacacgaugacuguaguggcugguuuugugugucaauuugacacaaguuacagugaucaaagaaaggagccuccuuugagaaaaugccucugugagauccaacuguaacacauuuucucaauuagugaucaagguggaagggcccauugugaguggugccaucccugggcugauaguuuuggggucuauaaaaaaucaagcugagcaagccagggaaagcaagccaguaagcagcauuccuccaugacuucuguaucuacuccugccuccaauuuucuacucucugugaguuccuguccugacuccauuuggugaugaacagcaauguggaagugugagcugaauaaacccuuuccuccccaggcucuuuggucaugauauuuaguucaggaauagagacucugacuaagacaaugaccaaggcaaccauaaaggacauuuaguugaggcuggcuuucauguucagagguugaguucauuaucaucaggccaggaaguauggcuguguggaggcaaacauggugcuugaggaacuaagaguucuauaucuugauccaaagguuacggggaagacuggcucuucugcaggacacuugcaggagguuucauccacacuggauguagcuucaaaacccauuccacagcgaugcacuuuuucuaaguccacaucuacuccaacaaggcuacuccuccuaauagugccauuucccaugagccaaaggcauucaaacuaccacaucuccauuaaaauguucauuuuaaccucucccucucugugugauucuuauaaaccucuccacauuuuuccucauuaauuccaagccacccaccugccccacagccaagacuacacuaaaccauuaaggaaaacuauuccauuucugggcauacauuugaguagaauggguggcccaauuuuagccaauaaagaaaaugagagaaagcuguaaaacaaauccucugaggaagugucuuuacucuuuaaaaacaggaaauaaacugaacggacacaugucaguacacaaugugagaaggaugauacuuucaagucaaggguggaaggagaugcaguuucaauaaucauuguucagguaaaugaagaguugcuauauugagaaagaugaaauuagguccauuccuaagacuuuaaaacaggaaaauuuacagguaaaucaaauacucacauguaguuacagauacaaaguauauguauacacaaacacacacauacacacaaugcaggagaggagcagggauguaucuaaucccuaugauuucauugaauuucuggcugaagaaaauauuacauaugcaaacuuccucuaaggacugaagagacugcuguugcccucaccagcccucacacucuuccuacucacacaucuucaggugcuagcuccuugcagucacugagaagucacacauucuccucaaauguguucuuugcuucuaucuuucacucuccagcugggguuuuagauucucauauugucuuugcuuuaaaaccaguuucaaugcagaccugaccggacucauacccuugucuuuauuagugauccaacauaaggauaugcagcagagaaaccauacuguaacuacugccaagaaugagaaaggcaacugcagauaaauaacauuacccaugcaguuuguagacauuauuuuagauccagaagaaagauugcaggauggaggcucaaaacauguggcuugauacaauauuaaguuccauucuaggaaaugcaaagaacauuuuaaacuaagaacaucucauuaucauaauggcagacagugagaaaguaccccaaugaaaccaaccaaauauguuuuauagaauaaaagacaaaucuagagaauuuugaaagaagggauaaguucauguggaguguaauguauuugauuuggaaaaacaccuaugaccuguaaaaauguagaaaagaaaaugguacuugaauggucauaggagagaugucagguucaaaugaaagcaaugagaauauguguaagacuuacagaaaaauagaauaugacaacaaccugggcgcaauuuccugggagaucaggagaucacaguucucuggagacucuugggggcacagccauuuucuguuaugaucccuagagcccuucagccucauguccuguggauauauauuuaauagccugugauguuucuaaccuacgugaaagcaaagcaagaaaggagcuccauaggcuagcuuuguguacuuccuuaguuucuuguguugacuauucaacuacuugguugccuaugaaagugcaaacuaaaggagccucaaagaaaagaauauuuacuggcuuauaugacuacuaauuccauagacagcauggcaggcaacccuuuuggaagacauauaucuaccugccaagcucuuucucuccuauuucccucucauuccauaaucgaguuaugucuaucucauuaucuuuggccuugggucccaaauucauucuuccaugaagcucucaaaugccacauccacauuuuuauuuauaaucucucccauuucaguauacaagagcucauggaaguauuuuuacugacucaacauaggaaaugguucugcucuuuaggauaaucauucaauaaaucaaauguucaagucaacuuaacuacccucaaugcaaacagguuaggccuaucucagcuacauucccuaaagaauaaauaaauuuccauuauaugcuaaugacugauacauuucaacauccuuccaaugagauuauuaacccuccaaggucaaaaccauugaaaauauuuuugguuuucucuauacuuuuaccauuaaacuuccuaaauacacaugucaugauuaaacagauaagagccgauauuuuauuauacacaucaucaaggaauuauucuaacugauugcaaacacaucccuucucgauuccauuagcugauuaugauuaccaaaccaguaggggaaacgugcucugagcaacaugagcacagagagacaagggcaugucaacuuggaaauaccuucaguagaaagcuugucucuuuuucuuuccuuguuuaaguuauaaacugaaggcauuugaguuacagugaaagaaguuaacuaaugagagaagauggaguuggcagucaaaagauuuuaucauccagguuugugaauauaugaguuaauacaaucccuggacuagaguucaggaggugaucaugggagacaacuaagaacagaaaauucuaggucuucccccuugcucccaaguuucugguugcauccucucuuucuuauuuaggaauuuagcaucaccuggugcuacacuacuuuaauccuagcauucgggagauagaggcaguuggguuucugaguuugagaccagcuuggucuugagugcgaguuccaggacagacagaaacccugucccaaaaacaaauaaauaaguaauacauaaauaaauaguaaagaaaaacaaaaacaaaaacaaaaccaaggaauugcacauuaguauuucaaaaggaaauuauauuaucaaagaauacacaacauguaucaguguacacaccuucuuuuauagaagggugcuguaauuccugaaagggaacuccguccggaacagagaaccauccaaaucugaauacggugcuccacuuaccucacugcauucucugucuuaaugugacuauucaaagaaaguauuagcuaagagauuagugcuauagcuuaauucuuaaagugaauacauacauguaaauuguguuuaagaucaauacagaauucuggagagucuugagcucugaauaauucuaaaaucaccagcuacaucaaauggagacaaaagacaagucuaugucuguauaugcugagcuaccaguaaaccugcugguaagugcuugcaggagguuagucaacauaauagcuaaaauugugguucacaguguauggcucagaaauaaacaauauacaaagccuauccuucauagcuauuuugaauuuuauauauaaugcauguacaaugucugauuuggucauauauaauuuccaagaaccuuuccuuaugguuuuuuaaaauauuguuucauaggucagcauaaacuggucaagaacuuccuauacaacacaccugacucugaauuuucagucaucuuuaagagaucauugaaagccuuuacaaugauaaaagauaauucuuagacuaagaauacauuuauuuucuaaugguaaaugacauuuuccaagaccuaauuccuugaugugguaaauaaacacacagugaaaauauauggccuaucauuaaaaugaacacauaguguacacagcacaaacuguaaaucaagaugacaauaaaaauguuacuucuuagguggcccugguaacacagucuuacaacucuggcacuugguaggcugcuuaggagccaaggaaaaagguggcuuguuaagacagccuggaucuacauagaaagaucugucuuuaaaacaagcaaagaaacaacaaacacucugcuuuccaaaugucaguugagaaccaugaccaaaaacaaugagugcuggcagcuucccaugaggccaaaugcuaugcuggguuuauaagauauuucaaaaucaggggacaauuuaugcaauaaugugaacaacuagucuacccaaaguagugugcaaucuguucagauagaaccuucuaggaggcuacacagaguucuaagggucaaauauuuuucuguucuguuugggauuuuugacaguuuggcaaauucuugggucauuugguaaaagagaaccuuaacugagaaaaugucuucuaucaaacugaccuguaggggugucugagacacucuacugauuaaugacuaauguagaauaucucaaccuacugugggcagugcuacacaggaguaggugguccuuggaugaauaagaaaguagguugagcaaaccaccagggccaagcuaguauuuuuuccauaguccuugcuucagcuccuaccucccgguuccugccuugagcuucuguccugauuuccaccuaugauagaaugugacuugagaaugcaacucuuucucacuaaguuacuuuucaccaugguguuuuaucacaacaguagaaagagcuuccuucuauugaagaugagucaagcuauuccucugaugaguucaugcuaaaauaccauuucaauaaaaugauaaagccccaaggacacuuuucccuuuuuauaccucuaaauaucauuuuaauagugacagcuuuuuuucuagcugggaguagauaguguucuacauguaguacaggcauagguaaaguugcuuauaaaacuacccacuucauugacugucuaucaaauucuggguuaaaacacacugacugaucaggcuauauauaccuucuauuaguccuauagauugcacuuuaacaagacugaauggauaguuuauuccagacaaaagcuggauucuauaacacacaguauuucuuaaugucaagccaucaccuaaccacaagcaaaauugauuuuuccagacauguuccaaugucuguucacccuuuccugcuaccaacugucaucuuacuccccugauaaaacucuugacauguuuugcaguacucucuacuccuucuccauuccaaacagcugucauccuuuccuggcagaaacucccggacaucuggaaacucaggacagcuacuguugugaugggcagauuccucuguuauccaguacccagcucucagaauuuaaaaggaauaaaagaggaaggauuguaauaguuucaccugcuaaccaaguacucuuucaaguaaugucugcuucaaagcaugcgaacuccuaauaauugcauuuaaaaacacaauuaguuccuggcuaccugcaagaugaugcuggacaugaaaaagcugugauucuauagaauacaugauggcaugcuuccagaauuucuaccaggauaggaaaugauaaagggggaggaguguaauacgaguguaaaguccaagaccuuagcuucaacagaauuuuugccccaugaucuacuuugaugcuuuguuuacuagaugaaggacaaaagccaugugggaaaaaugaagaugggugagcugaagaaaacucaguggaggcuucccuggagcuccuggcucauagccugucaaucaccaagcuccaugcuguacugaucccuaaguguguaucaucucuuccauauccuccuacaauaaacauuuaaaaauguuuuuguaucuauccuucauacccucucaaccuguuuuucuacagagaauuguauuuucucagguguuuaaaagggaccaugcccuuuuauguccccuuccccccacuacacacuaaaauucaacaggugggggcuaggaagaaagcucuguaggugcuguacaaacaagaggaucugaguagcuacucauauuacccaagugguaggggggacgcugagcaugaaccgguaugccugcaaccccagcacuaugggaguuggaaacaggagcaugacaggcacuugcuggccaaccagauuagcuagcugcaagaucagugaggaaccuuagagaaguagagacaaauacaucaaaauaccuaaugcccucccucaagcauguauaagucuacacacucacaaacacagguauguacacacacacaaaugcauguccacaugcauguuucaaaguuuugggugagcauauacuggauccuggaucucuagccucaagggucugccuccccuuaauauauuuaacauauuucuagucauccuggguuuuccuucuacuauuuaaaugcuaccaacaacucccacuauacuacuaccaccacacucucguuuuguacuaugcucuuagucugccucugccugcucauggcugcgaucuugauuuaguaugugucacuuccucagggaauuacuccucaaucaaauagaauauguugggugucccucugcaucucuccugagaucuugccauuuuucuuuguggcagauuuuacaacugcauuuaauuaacauacuaaguuagacauuaaaccuuuuuuugaaacuguauaucaaugccacuggccauuuuucucaaauuuuuugaaaauauagguuccuuuuacuuaaaaguaucuuauuaaaguaaaaugagcuugcugcuauuuuagaugaauuuacaauuucaaauucuccuagauuuaauuucuaguauggcaaauaccaccagauuuaaugauauaagcaaucucauucuuuuuauuuucaguaaaggauuguaaaaacagaaaauguuaugcacucauacaccagaaauugcacugugcccuuggaagacuacgauacugcagugaacuuuaagccuuuuagaaacacacauuuacaauuuaacuuaaauacacuuuauauacugcuaagcaaauuacaagaucaguuaggucaggagcaguguaguaauuauacagagaucauaaagaaaugcaaguucccaugacaaacauaguucacaucuuuaaagggauaguuuucuccuuugaaagcauuugagcaagugacaucuguaacgacaagcacacacagccucaaauauuaaaagcaaagaugcuuggaaauccuaauuaaagcaaacuucuugcuauuaggcccaaguccuuaccaaaaaauuaauggguaauuucauaaugauaagauaggucauguuuguguguuccuacuauaaauauuaccucaacacaauuauaguguuuuaggagcuuugcuuuuuuuuuuuuuuuuuuuuuuuuuuuuuuuuuuuuuuuuuugagacaggguuucucuguguagcccuggcuguccuggaacucacucuguagaacaggcuggccuugaacucagaaauccaccugacucugccucccaagugcugggauuaaaggcuugagcuuuucaucuuuuacauuccacuuccuuaacaacacaauguguuaaauucagaccauauuuuaaccaaugaaacaauucccuuacuuacuaugagcucuucuauauauaacuuuuuguagaucugaccacagaguaagagguagaaaguaggauuugaacccaaagucugagcuauuaauucuacacuguucaugacacauaaguauaacuuugauauuccacuucuaaacaaagacuguaaugacuuuauggguguuuuacauucuuccaauauuccuuguuacagcuucuucaaagacaaaggaucacaaaccagaaggcucuuguuuuaacuauauuuuuaccaaggcugacucaauucuuaauauguuuacaugaucuaguauccuucuuuccaguuuguuguucuuuccuuuacaaucauuaucuaauuuucuccaggaaucuguuuuucugucuaccuucccauuuuuuagguguuaauuuucucacaaguuuuucuggcaggucuugggguaaugguuaguuuuaauuguuaacuuucuacuaucagggauucaccuaggaggaaaguuucauugagggauaaagaaucuaaauugguuuggucugugggcauguguguaggagauugucucaguuaaaguaauuauugguaugugaagaccccagcccaccaugggcaucacucccugaguagggaauccugaguccuggguugaauaaauauagagagaggucugaaugccaguaggcaugcaugaauuuauuauuucugugcuucugacuaucaaugugaauagaucuuucauguuccuaacaugacuuuuauaaccugggauguaagcuaaacaauucuuuucucugauaaguugcuuuugcaaagguauuucuaucauaguaacaggagacaaauugguaccuuaaguuuguaagucuuccuggugcuucaguagcuuucagucucaaacaguaauguugcuagacuaccagcugugggaaagcuaacucaggaaaagcuuugccucuguuacagcccuccacauaguucauccuuuuugccuaacauauauuguaauauaaccaggguuuggagucucuauaaaccgaaagaaaauccuauccaaggucaauauauuuaaaaaacaaaagauggacagaguucuuuagaccuuccauccuuccuaagucaaauaugaacuuuuuauuaaguaaggacccuggaacuauuucuuaauguacauaauuaauacuuaggggcucuaagaucaugugguaugauguuauauuuuauauguaauauuagugcaacauaauauaaauggucccuucacacccaucacuagucugaggcaaacaaaacaauuguuuccccucagagcuuuguucccaucaucuuuuggcuaccuuccaaaauccagugaaccugccacuuucaaaggcuuucucuuagaugccuuuucaugaccuuguaucuaaccauguaguuauaucuuugcauguauauuccuacagacauagaggagcugucagcucaggucauaccacagcuguguuuguuucaccuaaacauuaauaacucaguugacuugcaauuccuugcaugaauuucccauccuuucuuugcucaauacucagaguuauagaaaacccuuuucagugguuaacagcuuccaaccccuugucuauggaagcuuaugucaguaagaaagugguaaggaaagauuacaaucaggacauugaugaauauggauuccacggcuaaacuuuuaucaacaggugacuauauuaaauauaauauuaugauacauguauaugaguggcaaaguagaggucuuugauuccauacaauuuuaaaacauuacuuaaaauucauaguagggacauuuaauauaaaaaucaaauuguuaaaacugguuauaaacacuugagccaaaccaucuuuuccacuucugagcuccauacauuuccaaagccugcuagucucuccuacagggucagguucaccacuuucaaauuagugaggggugcccaaguaaugcgauuaaguuuuuaaaaaaucacuuaaguauacacacacacacacacacacauucuaagacaaauucauaauuagauuuuauggcaugaaaggacauuuuaaaaaauaguaauggcauuuccuucuacccuuacaaagaauuuauguaggcaauucuguaugcuguuauggcuaacugcauggacaguguaggaccuccucaaauucagggaucauugccugaaaaaccuccuguauuccagggcagaucauagacugaggaagcacacaugauacauuuggaauccacuuuucccucauuguaguauuggaaaugaagagccaaaguagaugccauuuccauguggcuagaucuaugcuuuucuggaucuaaaauaaaauccaacuccucaauacuacuggaucaauuuguauguaugguuggguagggguggguuaauguauauucgcagcaacuguccugauggcugccaccugcuagucaaagaguauuauuagaaagaugaacuaacaaaacaacccugggcuauuacagcaccacaaugccucaaauaauuacccaguuuccuuagaauuuguaauguacccugccuguauugauaauaaugucacucuguuuucaguugaagugguaucuuuaaauguauuucacccuaguuuuguuuuuaauugacaaauacuauagauauuuauggauaaaaauacugauuguauugacuggauaaauguauaugaugaaaugaggacccuuccuauuucuauuuuauuauggauuuguuaucuucuuaguguaaaaacuuucaaaauccuuacuucuugcuguuugugaaauuuucaacagacuauuuuuaggcacagucacccagcugugcaauggagcaaagagcaauguucucuccaacgguagcuuugucccugaugacccacugaguucucuuccuacugccccuuaaguucuauggucucugguuaccacuauauuauucuuugugucuaugagauuaaugauuuuaaauauaacagcaaugagaucauuucauauuucucuguuugcuucuggcuaauuucauacaauauccucuaugugcagcuauauugccacaaauaacauuuuuuauggaugaagugucuuccuuuauauauauacugcacucucauguucacucucauguucaugaucuguucacuaccauaugaugaauauuauucacgugcauguguguguguacauguauuauacucuuuuuauucaucuauucacugacacaauaaagagagaaucuacaguguaaugaacaugcuuguaaacugugccucuggcaaggcgcuaacauacagaauauauaaggaaaucaacuuaagagaaucacaaaaaaaaaaaagagaaagaaauagaaagaaaaacuuaaugcaccaaccaauuaacagcugaauaaagaucucaauagacuauucccagaauaaaccuaaaucuauaaucaacaggugcauaaaaaaugggaauggguggguagggaaguggggggaggauaugggggacuuuugggauagcauucuaaauguaauugaggaaaauacgaaauaauaaaaaauauuaaaaaaauagauuuagaucaaucaaaaaaaauguugaacauucccuauaaccugagaaaccuuaaccaagacugcaggagcuaaaauccaacuagaauggcuaggauagaaauuugaaaaugaugagugguaguuuggaugagggcgacacauauuuuugaaaaggaaaggcaggguucugauuuacuguugguggaaaugaaaauuagcacagccauuauuaaaaaaaugugcauuuucuucugaaaauuaaaaauacuacuaccauguaaucccacaacccuacuacucaguauaugaagaugucuagagggaacuuagaagaguuaucagcacuacaaugcugcacuacugcuaauagccaaggucuggaacuaauugucaaaugagcccagagacauccuccagguggcuuugcuucucaucaguacacucaguucacuuucuaaccuacagaugguuguagacaaguaaaagaacaaugaagaagagagcagcuugguguggcagaacugugcuguggaagaccucuauggcaagggaacucuaguagccucugccuggacccuccauuauccaugcuccacacagaagccaaagauaucuaggaaacuaguagaucacaucaugccaccauucaguuuacaauacuucaacagcuguggcuggcaucagaaugcaaugcagacuucuggugucagcccacaucacuccuuuauuacacauaggaugaauuucaucuacagcaucaucuacaugauuguuguuaagugcucagaaaauauuuuccuggcaggacaguaaaaugaaccugcuaguuggacaguuccaucaggaaugcaagugaacucaaucugcaaacauguuccagaaaauacugaguccugguccuuauaacuaaggugaaacaaacgcuccucuuuccucuuccacagauuccggaagcuucuaucacccugguacaguuuguaccaugucugugccugguauguaccaauuuuugucuacaaaacacauauacacauuuacauagauuuuucuauaggaaaucaucucuuccaguacuugggcaaacagugaguuaaaagaaaagagccacacugucugucucagggguagaggcuuccuggccaggaugcuacugcaaggaaccgcugggacaaaggaugcucaugaagcacuugcuacccagaguucccaugcugaguacaugacugauucuccagaaggagguuauagcuuguauuagcucucuuucucugggagaggggagcagguacacaaauuucacacuauuuguucaaggucagaggcuguggaaggcaguaguggcauccaaauccaaaucugccugacaguucauuccacucuauuaaacuuugcucauacaguuuucuuugcaaagcaugaucaaccugugcuuuguuucauaucaaccaccuuccuccuccgagcugcuaacgcaggggcuuuuauuuaguuauuuuauuuacuaaugugaaagcugucaacacagaugacuucccuaccagcuuccuaagcaacaagcuuuggggggaggggggugugcaaaaagcaagccaagcuuuccuuuuuauuauucagugauuuauauguugcuaaucucaucacugucuuucagacuaccagacuuuuauuuucauaauuacaggcugccauggcuuucucccaaagccccugccaaugcucuaccaagguacagugacuagcugcuuucuuaucuccacuaguuagucucggagaaaagcaggagacuuugaguugcaaaacacaggcuagucccugagagugucacucucucuaggcacccuuuugcaagagguuccuguauuccagagcuuccaaaaagcuggccccaaagagcauauucuucucauaaacacgaaucuaaacuugagcuaaguaccuaugcugauguucucuucuuucuugaugccuguguggcaaauuugaaugaucuaagauuugucaucuuuaaaugacuuguacaaucucgaucuuaaaaaaugaaccacuccauuuuuaaaguuaauaagcaacaaacuucuguuucuuuccuaucgggucucaugcuaagauuauuuuaaaauaaggauuauuuuuugcuacuacaauaauuaucuuucuggaaaaaaggucucaccuuuaagucauggcugaccuagaacuugcuguauaggccaggcuggccuugaacucacagagauccaucugccuccucauugcugggccuaaagaaauguauucucauaccaggcacaagaaguauauuucuuaagaacaacaaucaaacaaaacauacagcaacaaaaccacaacuaaauaaaagaugaugaggguaggcagaugucccagucaguaaugugacuguugugcaagcaugaagagcugaauuugaccuuuauaaugcauagaaaaaccaccuagcaaugacaccagcaugugcuuauaagaccaaugcuagggaaguagacucauauggucccccaauguuugcuggcuaugcaagcuagucaaacauguaagccuagguagcagcaagaaaaaacaugcuucaaaaaccaagaaggcaucuccugagaccacacacacacacaaccacacacacacccacccacccacccacacacacacacacacacacacacacacacauacuccagacaaacacaugaaaaggagcaaagagaccuucuuguggaguagugcugauuuuaagccuccucacuugacagaaguagaaacuaagguuaacaguauccacuugagaagggaauccaugauucuugauuccagagcaucuguuaggaggguccacagcacaaagucucucagcuggaacagucacagcuggacucuuaagagaaauuaaugcaaaugacagguguuugagagauuucucugugauagaaaaguagaggauaauuaagaacaguugagaacuugggagagugggugucucuccucaaguucuaacaucuguuccugcaggucuuugcuucuucuccaaggaucuucugggguguccccuucagggcauuucuuuuuccuuuaguguuuaguuugaagaaagccaguaaggaccugguuuacuagugcugccaggacauaauagucauucuuucaucucucucucucucucucucucucucucucucucucucucucucucccucucucucucucgugugugugugugugugugugugugugugugugugugugugugugcgcgugcgugcauggcugugcaggagcagauuuacauaaguguucagugucauccucagaaacauggcucaucucucuuuggccuggagcucaccaguuagccuagacuaucuaggggcaagguucaagaauccccccaucuccccaguguggaucaugcucaacauguucacauggagucuaaggaucaaauucauggccucuagcuucucaagcaagcaucugacuaagugugcuaucuucacagccuaguuucaguucuaaguuucuacuauaggcagaacaucauauggccucccugacccuugccccacucucaccgcagaugguaagguugugcuuucucuucuuuguaucuguuuuuagacaucucaguuuuuacagaacgacaaggccaaugguugcaaauauccuuuaguuaaagaagacaaaccuucucaguaugagauuuccuuuaacauuuuauucauaacuacguccagggcugauauccuguaaugaaggcacauuauacaccacaaggcacauuauacagcaugcagugaucauccaugcaaggccugaguauugauucacucucuuauucuauuauggucuggaaagauauuuuauccaaugacacauuaacuucauauugaaaccucaaauuucucuuucuauccaucuuaguuuauauuuuuaugcaaacauguaacaaggcuuuaauucuacaaaggaagaaagauggaaagagacaacagagauguggugagcuguucaagaagugggccagaugcuguugggaagaaggaaggaaggaaauccugaagaggacuaaaagccaagguggccuggucugcaaauauuggcagguuaaagcgguaaacguagguguagauguuuuccuaauuggaacaugauugugucaauaaagaugguggaagacaaucucugggagaagggaaaaaggugggauuucggggucucaggaggaaaaugagaggaugcugagaggagggguggguguggaggggauaaagcagcagacacguuggucucagggcaccuauaauggagacccaggaggaugggccaggauuagucuuugcccagccauugagauaucuggcuaguuuuaaaguaucaaggcugucuuauguuuccauccucaguguuaaaguggaguggaagaaaaagaacacagccagggcagaauucgaugggcuuuggaaugggaggauugggcaaaggacggagcuccagggaauagguaaccaggugugguaaccagguggagcgcuuucuggcaggagagcaaucucagggcuguggcuugguaaagcccgcggggaugaagaaauaacaagguggagugcuggcuggcaggagagcauggucuggggcaaaggagcagagugguguuuuuaaaguuagaugcaaagguaagaauggacaaggaccuccuagacagaggggaaggaaacacaacauacaagaaaguaucuaugugcauacauuaagguuguaugcugcccguagcugaaaaaaaaauccugaaggagaugagcaggcucaacagucugggcugacuucccaagauguacuguaaauucugugguaaguguuaaaagacacguauaccauacuuguucucuucaacacagccaccugagaaacauaaaaucagacaccacagaaccagacacagcagcccauaucucugauuccagccuugaagaagcagaaacagguggaucucugugaguugaaggccagccuagccugcauaucaauuuccaugccuaccaggaauaaaugaugagaccuuacuucaaaacaaacagaaaaaacaccacaaagcaguaaaaaaaaaaaaaaaaaaaaaguugagacuauaauuagcaguaauaguaagucagaaaaaugaccugaggguaauuuauuuaggcuuuaugacaggauaagaauccuguucuccuuuuacacauauccaucagcagaagaggauaaagccuuggcuugaaauugaucucaauaacaagaaaagucauuuccauguuucucuggaucccccuugcuguagagaugcuaacgcuggccuagguuuguaagacauaauguugaaucacacugagagguuauucagcaggaaggugguggcagacaacuccauagaagaagagauugagaugcucacacauguggccaguggggagaagccacacgugaugugccacagaugugacuacuggucaguuugaaauuauuaucugaaucuuaauaacauauauuaacucucaacucuggucagagcuaaaauguuagaagaaaggaugggggugaccauagaugauacucguggggaaaaaggaggggggacgcaugaccaauuauuaaccuucuccacugauguguuaaaaagaaagaaggcaggugaggaaagggacugauuguggggacuggggagcaugagaaaaaggaaugcaugaaaaacaauaagcauaauaaagcaaguguguuuucaaugcaaguuccugcagaggccauggcagcccacuuccuacacaaugcuacuccucccuuuaaaugugagcaucuucccucuccuccagcaagaauaucuaccuaucuaacauaguaauugaaucaaauuuaauuuaaagaaaaucaaaaguccuuccaaugcauugacauaagaaagcacuuuaucucaguauucucacaguuagagugaugagagaauguccaagugcucagagguacauaguaaaugagaauccuccccaacccaaugaagaaauauagccaagaucagcuucccuuuugaccuaagccacauguaacauuauauauauuaggaagauggguuugggcaaugagcugugaccacuggugauucagaggaauccccaaacacacgccacuacucuuacagaacuuccuuggcuugagaaaaugacauuuacucaaacucuuaauaaaauaagccuccuuggcugguucagauauuauuggauuuuuuuuuggcauauauuucagaacaguaauaccuugacucugccuaugagugaggugaguccccacaggaccacccuuccaccccuggaaauauauuuauuacccaacacaggaaaaaugagagagcuuaauucuggucuguuauguuugcaugauuugcauuuccuuuggaauaugagugccuccuuggacaugugcucagagagcacuuccccauuccacaccuuugugcacaguuuucaguuugauuuugaagguuuuuagaacuaugaaaucuaugcagggacuuuuccuugcuugccucccugcucucuuccuccacucccugcuucucauuauuccccuuuguucaaauagacaauuuuacuuuuacuuucaugcuauaugcacacacaugauuuuaaaugagcagacaguucucaaaagauaaaauaaaaaggccuaauaaacauaugagaagaauuuuaacaucacuuauuauugccagcuaauaaauuuuauuucuugccuaauuuucuucacaauguucaugaaacuugaaaucacuuuauaucuucaacauguauuuguuaaaaauaagucacuugcaguaaccuauacagaauacagacauggucugacauaaugagacuuaguauccaaaguaucacauacuuccugugcauggaauaaaagugacauuccaauuauaauacaguaacuuaauuucuuauuagcccugaugauuaaggccucaugaauagcauauuaucaucagacaauauauugugucuuagaacuuuaaauuauucuuccaugcacacacccacaguaguaaugaguaguaaauacuuugaacuucuuuugaauucaauauauacuacauaauaaauucucacacauauuaacacagcuaaugaguaccuaauagcuucuucuuuugacccauccacaauuuauccuuauccacaacacauacauauguagucauucuucugaugcuaaauaugucagauuauugauucaugcagaaagaauacaacuguuuaugaugcuacauuucuggcaagagauuuuacugcauauucuguugcuaagccucagacuuuaaaauucauaucuaagacucuuagcugcuguaaaccagccuggcauaauaagugaguuuugauuuccuuuccaauauuccuggcugcagcaagaauugauuucucagacucuucccauugaccuaugaggcugugaagaagagauagcucuucuuaaucucaaagauccaggcaaaacuuacaguaccuggcuuuuguauagaugucaccuucagagccagcuucauugucccuuucuggagaaacacaaauguuuagugacgggaccuugacugacagcuuuuaacauucuguaagauucuggguuacuaaugauggcauggugucauucauuggaggccaccugcauccaagugucacaguuuuaucugaauauccauaccuuucugaauauuagcauaugcccuuuauuggaauacuuauugccccaaagcaccaagagcgguagugagcaagauguacaauuuugauuuuaaccagacaagcaauggaacagcaguucagacaagauuaaacccacacaaacuacacuuaaggagagucacuuuucuaacuaguaucucuuaagaaagcaagacuaucaacagaagacacauuacuguaaaucuguccauaugccuaaaacuagguuagccuaaucauuuacugagcuucacaugucuuaacccaucuuuuuuucaucaaacaacuaaaacuuagcaguacuaagcccauagaugacugccagaaaacaucucuuuaucuuaaacauuguugcuccuccaaggaucugagacacugaagaaaagacugaauaaagguacacauguaauauccacauuaauuccacacaacuagucugacacuauaccaucaaaggauuauauguggucaugcuggacuaguuugcuacuacuuucauaaaggaagcccagcaaacacgaguugggggcaaucacucuuacuuugacuaagcaauauauguaguauauuacccaaccagcuugauuccaacuggcaggcauaacaaaugaaaagagaaaagaaaacccagagagccuguaggauuugaauugaaagcaaauaaacaaaaucaaauuccuaagucucucaguuaauugcauacuaacaguuuugcuagugugaacuucuuuguaugagaaacauguaacauaagacaccuguacauucucauuagaucccuggguccacuuucauucucaaaacacagaccucucucuacugcagaccgguaacucuuucaccucacacuuaaacacuuguucuguacuggaagguuuuguuuuguuuucaaaacccagauuguacauaaaucuuguuagcagggguucccugagaacuaacucuuuaugaagucuaucgcauccuuccaaaugauuuaaccuuagugugcucaugcuuuuaaaacaugaguuauagcaccauccggaccagaggacagguguccgccuggcuugggaggcggccucagccucagcagcagcggucgccaucuugguuccgggacucagcagaacuuaggaaauuagucugaacagguuagagggugcgccagagaaccggacagcuucugggacgggcagaagcacagagccgcugaggcagcagccugggcgggccgcagacaaccggccaccauccggaccagaggacagguguccgccuggcuugggaggcggccucagccucagcagcagcggucgccaucuggguuccgggacuccgcgggaccuaggaaauuagucugaacagguuagagggugcgccagagaaccggacagcuucugggacgggcggaagcacagagccgcugaggcagcacccuuggcgggccgcagacagccggccaccguccggaccagaggacagguguccgccuggcuggggagacggccucagacucaggagcagcggucaccaucuugguuccaggacucccuggaacuuaggauuuuagucugcacaggcgagagucugcaccacagaagcugacagcuucugggaacugccaaagcaacacagcuucugagagaggcccuguuuugggccuucuucuucgaccaggaggagguccaaaaacaagauaucugcgcaccuucccuguaagagagcuugccagcagagagugcucugagcacugaaacucagaggagagaaucugucucccaggucugcugagagacgguaacagaaucaccagaagaacaaucucuaaacagagucaacuauaacuacuaacuccagagauuaccagauggcgaaagguaaacguaggaauccuacuaacaggaaccaagaccacucaccaucaucagaacccagcacucccacuucgcccaguccagggcaccccaacacacccgaaaaccuagaccuagauuuaaaagcauaucucaugaugaugguagaggacaucaagaaggacuuuaauaaaucacuuaaagaaauacaggagaacacugcuaaagaguuacaaguccuuaaagaaaaacaggaaaacacaaucaaacagguagaaguccuuacagaaaaagaggaaaaaacauacaaacaggugauggaaaugaacaaaaccauacuagaccuaaaaagggaaguagaaacaauaaagaaaacucaaagugaggcaacacuggagauagaaacccuaggaaagaaaucuggaaccauagauuugagcaucagcaacagaauacaagagauggaagagagaaucucaggugcagaagauuccauagagaacaucggcacaacaaucaaagaaaauggaaaaugcaaaaagauccuaacucaaaauauccaggaaauccaggacacaaugagaagaccaaaccuacggauaauaggaguggaugagaaugaagauuuucaacucaaaggaccagcaaacaucuucaacaaaauuauugaagaaaacuucccaaauauaaagaaagagauaccuaugaacauacaagaagccuacagaacuccaaauaaacuggaccagaaaagaaauuccucccgacacauaauaaucagaacaucaaaugcacuaaauaaagauagaauacuaaaagcgguaagggaaaaaggucaaguaacauacaaaggcaagccuaucagaauuacaccagauuuuucaccagagacuaugaaagccagaagagccuggacagauguuauacagacacuaagagaacacaaauuccagcccaggcuacuauacccagccaaacucucaauuaccauagauggagaaaccaaaguauuccacgacaaaaccaaauucucacauuaucucuccacgaauccagcccuucaaagguuaauaacagaaaaaaaccaauacaagaacgggaacaaugcccuagaaaaaacaagaagguaaucccucaacaaaccuaaaagaagacagccacaagaacagaaugccaacuuuaacaacaaaaauaacaggaagcaacaauuacuuuuccuuaauaucucuuaacaucaauggucucaacuccccaauaaaaagacauagacuaacaaacuggcuacacaaacaaaacccaacauuuugcuguuuacaggagacacaucucagagaaaaagauagacacuaccucagaauaaaaggcuggaaaacaauuuuccaagcaaaugguaugaagaaacaagcuggaguagccauccuaauaucugauaagauugacuuccaacccaaagucaucaaaaaagacaaggaggggcacuuuguucucaucaaagguaaaauccuccaagaggaacucucaauucugaauaucuaugcgccaaauacaagggcagccacauucauuaaagaaacuuuaguaaagcucaaagcacacauugcaccucacacaauaauagugggagacuucaacacaccacuuucaccaauggacagaucauggaaacagaaacuaaucagggacacacugaaacuaacagaagugaugaaacaaauggaucugacagauaucuacagaacauuuuauccuaaaacaaaaggauauaccuucuucucagcaccucaugguaccuucuccaaaauugaccacauaauaggucacaaaacaggccucaacagauucaaaaauauugaaauugucccauguauccuaucagaucaccaugcacuaaggcugaucuucaauaacaaaaaaaauaacagaaagccaacacucacguggaaacugaacaacacucuucucaaugauaccuuggucaaggaaggaauaaagaaagaaauuaaagacuuuuuagaguuuaaugaaaaugaagccacaacguacccaaaccuuugggacacaaugaaagcauuucuaagagggaaacucauagcucugagugccuccaugaagaaacgggagagagcacauacuagcagcuugacaacacaucuaaaagcucuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuagagggcacagagacaaaauccuaauuaacaaaaucagaacugaaaagggagacauaacaacagauccugaagaaauccaaaacaccaucagauccuucuacaaaaggcuauacucaacaaaacuggaaaacguggacgaaauggacaaauuucuggacagauaccagguaccaaaguugaaucaggaucaaguugaccuucuaaacagucccauauccccuaaagaaauagaagcaguuauaaauagucucccagccaaaaaaagcccaggaccagacggguuuagugcagaguucuaucagaccuucaaagaagaucuaauuccaguucugcacaaacuuuuucacaagauagaaguagaaaguacucuacccaacucauuuuaugaagccacuauuacucugauaccuaaaccacagaaagauccaacaaagauagagaacuucagaccaauuucucuuaugaauaucgaugcaaaaauccucaauaaaauucucgcuaaccgaauccaagaacacauuaaagcaaucauccauccugaccaaguagguuuuauuccaggaaugcagggaugguuuaauauacgaaaauccaucaauguaauccacuauauaaacaaacucaaagacaaaaaccacaugaucaucucguuggaugcagaaaaagcauuugacaagauccaacacccauucaugauaaaaguucuggaaagaucaggaauucaaggcccauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaauauuagccagagcaauucgacaacaaaaggagaucaaggggauacaaauuggaaaggaggaagucaaaauaucacuuuuugcagaugauaugauaguauauauaagugacccuaaaaauuccaccagagaacuccuaaaccugauaaacagcuucggugaaguagcuggauauaaaauuaacucaaacaagucaauggccuuucucuacacaaagaauaaacaggcugagaaagaaauuagggaaacaacacccuucucaauagucacaaauaauauaaaauaucucggcgugacucuaacuaaggaagugaaagaucuguaugauaaaaacuucaagucucugaagaaauuaauuaaagaagaucucagaagauggaaagaucucccaugcucauggauuggcaggaucaacauuguaaaaauggcuaucuugccaaaagcaaucuacagauucaaugcaauccccaucaaaauuccaacuaaauucuucaacgaauuagaaggagcaauuugcaaauucaucuggaauaacaaaaaaccuaggauagcaaaaacucuucucaaggauaaaagaaccucugguggaaccaccaugccugaccuaaagcuuuacuacagagcaauugugguaaaaacugcaugguacugguauagagacagacaaguagaccaauggaauagaauugaagacccagaaaugaacccacacaccuauggucacuugaucuucgacaagggagcuaaaaccauccaguggaagaaagacagcauuuucaacaaauggugcuggcacaacuggcuguuaucauguagaagaaugcgaaucgauccauacuuaucuccuuguacuaaggucaaaucuaaauggaucaaagaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacaccgucaauaagacaaagagaacaccaacagauugggaaaggaucuuuaccuauccuaaaucagauaggggacuaauauccaacauauauaaagaacucaagaagguggacuucagaaaaucaaacaaccccauuaaaaaauggggcucagaacugaacaaagaauucucaccugaggaauaccgaauggcagagaagcaccugaaaaaauguucaacauccuuaaucaucagagaaaugcaaaucaaaacaacccugagauuccaccucacaccagucagaauggcuaagaucaaaaauucaggugacagcagaugcuggcgaggauguggagaaagaggaacacuccuccauuguuggugggauugcaggcuuguacaaccacucuggaaauccgucuggcgguuccucagaaaauuggacauaguacuaccggaggauccagcauaaccucuccugggcauauauccagaagaugccccaacugguaagaaggacacaugcuccacuauguucauagcagccuuauuuauaauagccagaagcuggaaagaacccagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagcccaaaaccuaggauacccaagauauaagauacaauuuccuaaacacaugaaacucaagaaaaaugaagacugaaguguggacacuaugcccuuccuuagaagugggaacaaaacacccuuggaaggaguuacagagacaaaguuuggagcugagaugaaaggauggaccauguagagacugccuuauccagguauccagggauccaccccaucaucagcauccaaacgcugacaccauugcauacacuagcaagauuuuauugaaaggacccagauguagcugucucuugugagacuaugccggggccuagcaaacacagaaguggaugcccacagucagcuaauggauggauuacagggcucccaauggaggagcuagagaaaguacccaaggagcuaaagggaucugcaacccuauagguggaucaacauuaugaacuaaccaguaccccggagcucuugacucuagcugcauauguaucaaaagauggccuagucggccaucauuggaaagagaggcccauuggacacacaaacuuuauaugccccagaacaggggaacggcagggccaaaaagggggagugggcgguuaggggaguggggguggguggguaugggggacuuuugguauagcauuggaaauguuaaugagcuaaauaccuaaaaaaaaaaaaaaaacaugaguuauaauucauuuucuacauuuuucacaccuacuauguuuccaacaugaaauguccuccacagacucacuugugaacaccucacuuucagcugguggugcuguuuggagaggcuauggggccucuagaaaguaaagcuuugcuggaagaagacuaucacugaaggcaugucuggaauuuuuauagcugucuggaacacuuguucauucucugguuucuaucccugccaucauaacuuccugccugcugcaaugucuccccugcaacauaggcuauaucuuuuccugaacugcuaagccaaaugagccccuucuccuuuaaguugcuuuugacaaaggucuuuuaacauagcaaauauggcaucaaugugagggcaggccuuugguccugugaagguuugaugccccaauguagaagaaugcuagggcagugaggcggaagugaguaggugauugggggagcauccucauagaaucaaagcacugggugggggugggguagcauagggucuuugcagaggggaaaccaggaaaggggauaacauuugaaauguaaauaaauaauuuuguuuuuaaaaagggaggaggagaaagaaaaguagcuaagacaucuaccauaugagaagccggauggcaaagaagagauguucuguagcagugcuccgagggcuacauggggccaacaccaaguggcuccucagaaaacaccuaucagaaguaacgaagagaagaagaaaugcaugaagcagauuaguguucuagucuacuaccaacucccacaaguaucuuuccauucuguaucuaauagaguuuauguucugccuacuccaucucaagcacuguucaauuuccaaguuaauaacagugaaaggcuguugaaguacccuggcacaaugcauuuucauuaaauaauuuacuacuguggcuuauauaagcaguaguucauauuuaugcgcuuuuaauugccaaaugcuuuccuucaugaauggagauguuugcguguguuuuacuuccuucuuuauugguuuaguuauaaagucauaugugaaauaguucucagcgggccaaguccaagccaaacagaagccuuucagcaucuccccuaaugcacuccaucugucaugaaauaaucuuuguaugcuguuucuuacauauuaaaacacauucaaucaaauacgucuacauacauguuuuguguugagugaggacuguauaccaaugcgaauuuguagauauuuauagauauaccucagagauguucucaggucagaaacagaccgcaugcuuccuaagaacuagcaugcucuacuuggauacuucagaguuuauuaaucaccccauguaaaaugaaauggauuagcccuaacuuuuuauuuugaaaaaaugaacuaaacaauaaaaaaaaaugagauuaguuugggagggacaaguagaagauuagacauuauacaucaguacguaugaacuucacugaaacccucagcgugcucugugaaaaggcauuucccuccagagcuagcaugaaaugucaguggcuaaaguccaacagaauugaugcaaacgagaugaggaugagaauuaugccccugaugucuuaacaaacuuuacuacgagauauuuuaaaugcucuauccuggcaaaaaaaggaaauaaacucauaauuuuacugaaagcuuaagaaagcuagccaagaacuaaaauccaaaaucugaacugaaaagagaaauacaaauuaucucucacacuauucaaauauuucugcuauuaacaaugccauguuuuagcaccaagaaaaauaaugaaaugaaaggaugcuuucucaaaugcagaacaccaugaacuaaaggguugagacacuuuauuguacagaugugaugcagaaccuagaacugucagcugccugaggauggugcuuucauguuauucuguauaauucugagaggagggauggucaagucauauuugaaagcccuuaauguggcaauacccuuucuuggcugacagauguuaaaguucaggaaaagcaaaaacaagaaaugagggggaaaagaagggagaugguggggagggggaagaaaaaccagauccauucucuuucauccaaccuguauucucucccuuauuauacuacaaagcaaaaauaaaaguacuggauaugaacaccagaaagauucuucauggcugagucuugacaaguucaauugcuuuaguaaugcagcugauuccugugacuuuucaauaaugguaaccccucaaagaaaauuaaaacuaucuccuaaaauauggucuaaagaguuccauagaaauugaagaaaacauuaggagcauugcugccauuuuucuaaguguguauaacacauggguuugguaggccuuuucacuucaagcaugguuauuugugaaaagaagcucacauucacuugagagauuuuuuuuuuuuuuuuggaaagccucuauucccagagucuuuguuacuuguuuuucucuucuauguauuuaaguuuuaaaauagagacauauuuaaaaaggggaaauacacauuuguuuauacuucaugaggucuuagauuuaaaggaacaacuaauacuucauugagaaaugaugguuuauuuuaaacaugacaaauuaagugcuuugagagucaccaggauuuccacuagagucuaaugagcacauguccccaaagugugagugcacauaaagauggaguacgucugauagaagauggucccagggguuuauucuuguacaauaagauaauguaagaagugggucccaauucccauucaaugacugaguguagacuaaaagcaauagagauaaggaaacacaaaacagacucugguagacuuugaucagugguucucaaccuuaaugcugugacgcuuuaacacacucgcguagucacccucaaucauuaauuacuuucauugcuacuucacaacuggaauuuuccuacuauuguaaaucauaacauauaaguuugggcuuuuuccaguggccuuuuuuuuuuaauuuaaaaguuuuuuauuggauauuuucuuuauuuacauuucaaauguuauccccuuugcugucccccaccccugaaauccccuauugcauccucucucccccuacuucuaugaggguguuccuucccccacccaccgacucccaccucacugcccuugauucaccuacacugaggcaucuaucaagccuucauaggaccaaggaccucucuucccauugauguaugacaaggcuguccucugcuacauauccuacugaagccauguguacuccuuuguugcuggcuuagucccugggaguucuggggggggggggggggagucugguagguugacauuguugguuuuccuaugguugcaaaccucuuaacuacuuaguccuuucucaaacuccucuacuggggacuccaugcucagucaaauguuggcugugaacaucuggcucuguaauuguaaggcuuuggcagggccucucaggaaacagucauaucgggcuccuuuuagcauguacuucuuggcauucacaauagugucuggguuuguuaacuuuauaugggaugaguccccaguugggacagucucuggguggccuuuccuucaggcucuccucaacauuuuaucucuacuuuugcuccuaacaguauuuuguucuucuaagaaggaccaaaguacccacacgcuggucuuuccucuuauugagcuucauauaaucugugaauuauaucccaguuauuuggagcuuuugggcuaauauccauuuaucagugaguucauaccauguguauucuuuugugauugaguuaccucacucaggaugauauuuucuaguucuauccauuugccuaagaauuucaugaaaucaucauuuuuaauagcagaauaguacuccauugcauaaauguaccauauuuucuguauccauuccuguugaaggacaucuggguuccagcuccuggcuauuauaaagaaggcugcuaugaacauaguggaucauguguccuuauuacauuuuggaacaucuucuggguauaugcccaggagugguauagcucagucuuuaaguaguacuauguccaauuuucugaggaaccgccaaacugauuuccagagugguugcaccagcuugcaaucccaccaucaauggaagaguguucaucuuccuccauauccuuaccagcugucaccugaguuuuugaucuuagccauucugacugguguguaguggaaucucaggguuguuuugaucuccauuucccugaugacuaaggaugcugaacauuucguuaggugcuucuuggcuauucaauaguccucaguugaaaauucuuuguuuagcucuggaccccauuuuuaauaggguuauuugguucucuagagucuaacuucuugaguucuuuguauauauuggauauuagcccucuguuggauguaggguugguaaagaucuuuuccuaaucuguugguugccuuuuuguccuauugacaguauuuuuuuuuuuuuuuuuuuuuuuuuugguuuuuugagacagaguuucucuguauagcacuguuuguccuggaacucacuuuguagaccaggcuggccucagaaauccaccugccucugccuccugagugcugggauuaaaggugugcaccacaccaugcccagcucuauugacaguauugacuuugccauacagaagcuuuacaauuauaugaagucucauuugucaguuauucaucuuacagcauaagcuauuggugcucugaucuagaauguuuuuuuccccugugaccaaguguccaaggccuuccccacuuucucuucuguaaguuucaguguaucugguuuuauguggagauccuugauccacuuagacuugagcuuugugcaaggagauaagaauggaucauuuuguauuuuucugaaugcuuacucccaguugagccaacacuauuuguuaaaaaugcugucuuuuuuuuccauuggaugguuuuagcucguuugucaaagaucaagugaccuuauguguguacguucauuucugggucuucaauucuauugcauugaucuuccugccugucuuuauaccaauaccaugcaguuuuuaucacuauuucucuguaguacagcuugaggucagggauggugauuuuccguacaauucuuuuauuguugagaauaauuuucacuaucuuugguuuauuguuauuccaacugaauuuguaaauugcucuuucuaacucugugaagaauugauuuggaauuuugauggggauugcauugaaucuguacauugcuuucagcaagauagccauuuuuacuauauuaauccugccaauccaugagcaugggagcucuuucaaucuucugagaucuucuaagauuucuuucuucagagacuugaaguucuuaucauacaguuauuucucuugcuugguuagagucacaccaagguauauaauaauauuugugacuauuuugaaggguguuguuucccuaauuucuuucucagccuguuuauccuuugaguagaggaaggcuacugauuuguuugagauaauuuuauauccaaccacuuugcugaaguuguuuaucaacuuuaggaguucucuuuuucauggucuuaggugggucugaggugacccuuuaaaagggucauucuaccugaaagaauuuaaaacccacagguugagaaccaccgacuuagaugaauggauuagaauucaucucaagaauugcaaucagaucuaugaaggagucgagucaaagugccuuccccacucucucuuacuguccucaugacugugccucacuuucuuuuaguuaaaacaggauaugaaacagaugagucacaaugucacauuaagaauuaaauaagacaucagaguaugcaaugaaaauggcauuauaauuacuagcucugauucacaaaguuagauuuuuuaggagaaauaauuuaucugcugcagcaggggaaaaauaugcauccaauaaacagaaggcguucuguuacuuucugaagcucuuaguaaaaaauaaaauuaaaaaacccagaaauuugauuggauggaaugaaaagaaauuaaauggcuuuuguuucaaauucauauuucugucccuuccuauuaagagccaguaaugcagcaauuaagcaacaguuugcaauuuaaaaugcauaaaguggcugauaacuggggccuuuaaaucccaucaucuaagcagaggaucagccucaaacauaugcuacucaggaugcagugcagauaaugaagacuucaauaucaggauuaugacccuuaauuucaaaaggaaugugcucuauugcauuugugaaagcaucgcaugcauaaugagagaaaacaugaggaaaacacaaacauagcacugcagggaggagcuccuugcucugguucuagugcaguucuauuucuauucagcucaaauaccauaggacaaaggaugauaaaagaagaaugcuugagagagaagccaauuuauaaaaaacuaagacagaaaaauagaacaugguguacucucuugugcucuaaacagcuggaaaauuauauuaaaaggcuaggcauguuuucacaguuuacuugaaagucuguuugugaccugugacccccgaggccauaggugcuuucaaagaaacaggcaaauaccaaauaacucauuucuucucaaggggacaaaugagugcuaguaauuaaaauauuccaggguuuggucauaaagaagaaauuaaaaaggcgacuucaauauggagauaccucuucacacauggacuuaagagaacuaggaagcauguauuccuuuauaccaccucauuacauagaguaagucuaaaccacugaagucaaggacgagccuggaauacuuccuggaacauuuccccuagagaaauggggaugggagaugggauuccuucauugaggaagcuuaaauguggauuugucuauagagagugcuuauuaaaagacuguccugagaucauuauucucucagacuauaacaccauuaaagcauucacacaauuuacaaaauuugcccaaaauuucaugguuugcuauuacucuuuaguuaagcuuccaaguaacuuuaauguuguccugaucaagaagaacuuaaaaagcagccaacuagggauaugggagaugacucaaccagaaauuaauaaguucaaauagcuaguguccauguuaaaaaaaaagaaaagaaaaagaaaaaagaaaaagcuggaaugacuuagaacaucauaaaccaggcaagguucugaauguauauaugucagaaauggcugugauuaugcuaagccaggcaugacugggaacauacacaagccaggcaugguuacaaaacuacauaagcgaggcaugcaugugaacaugcuuauaaccacaauguagugagaggcaaaacaggagagucggugggccagaaaagcgccagguucagcgugagaccauguaucaacugaauaaaaaugagagugagggagaagauacccaaggucuucuucuggccucugugcuugcaugcacacauaugagcacaccaaagcaugcacacgugcaugugcacacacacacacaaacacacacaaucgcuacauacacaagacacaucuuaaaaacaacuaaauaucacauuacaauuauuacuagguauguuuaguuaggaaaguagacagaaugcauucuuuauaaaaacaagguguuuaacaaugacaaaccuuuauuuauuagauucuuaaaaauggaaaaugaaauaauccuaugcacccagugaauauuauauugucauccacucaagaauucaacaaggggaccagguaagaaugccaucuuguauccugggucccccagagagcagucugcacaggagagcaugugggcuggagaagcaacauagcuucuuggacaggggucccuuugggucuucaucuucagccaggaggcagagcugaaacccagaccucuguucacuuuccccugacagaggagaguuggccuccagggauggcucugaccccaggaccaggugagaacaccauccuguauccugcaucccucagagaucagucugcacaggagagcacauaggcugcagaagcaacagagcuucuuggucagggucccuuuagggccuucaucuucacccaggaggcagagcugaguuccagaccucugugcaccuucccuguaagaggagagcuugccugcagagagugcucugaccacugagacucaggacagacuuggacucccaggagugcugacagaggcuaacagaaucacaggaggaacaagcuccagccaaagacagcuauaacaacuaacuucagagauuaccagauggugaaaagcaaacaaaagagucuuacuaaagaaaccaagaccauucagcaucaucagaacccagcacucccaccacagugaguccuacauaccccccaauacaccuaaaaagcaagauucagauuuaaaaucauaucucaugaugaugguagaggauuuuuuuuuuuuccauuuuuuauuagguauuuagcucauuuacauuuccaaugcuuuaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucaguaaaaucuugcuaguguaugcaauggugucagcauuuggaagcugauuaugggguggaucccuggauauggcagucucuacaugguccauccuuucaucucagcuccauacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaauauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucugguuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucucacuggugugagguggaaucucaggguuguuuugauuugcauuucccugaugauuaaggauguugaacauuuuuucaggugcuucucugccauuugguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacaguacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucuguuggaauuuuuagggucacuuauguauacuaucauaucaucugcaaaaagugauauauugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaaggauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccacguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuuuuucuugaaggcacucauagcuaugaguuucccucuuagaaaugcuuucauugugucccaaagguuuggguacauuguggcuucauugucauuaaacucuaaaaagucuuuaauuucuuucuuuauuccuuccuugaccaagguaucauugagaagaguguuguucaguuuccaugugaauguuggcuuucuguuauuuauuuuguuauugaagaucagccuuagugcauggugaucugauaggauacaugggacaauuucaauauuuuugaaucuguugaggccugauuugugaccuauuauguggucaauuuuggagaagguaccaugaggugcugagaagaagguauauccuuuuguuuuaggauaaaauguucuguagauaucugucagauccauuuguuucaucacuucuguuaguuucagugugucccuguuuaguuucuguuuccaugaucuguccauuggugaaagugguguguugaagucucccacuauuauugugugaggugcaaugugugcuuugagcuuuacuaaaguuucuuuagugaauguggcugcucuuguauuuggagcauagauauucagaauugagaguuccucuuggaggauuuuaccuuugaugagaaugaagugucccuccuugucuuuuuugaugacuuuggguuggaagucaaucuuaucagauauuaggauggcuacuccugcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggcgaguugagaccauugauguuaagagauauuaaggaaaaguaauuguugcuuccuguuauuuuuguuguuaaaguuggcauucuguucuuguggcugucuucuuuuagguuuguugagggauuaccuucuuguuuuuucuagggcauuguucccguucuuguauugguuuuuuucuguuauuaaccuuugaagggcuggauucguggagagauaacgcgugaauuugguuuugucguggaauacuuugguuucucccucuaugauaauugagaguuuggcuggguauaguagccugggcugcaguuuguguucucuuagugucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucauaugcaucucauucuuuagauuugggaaguuuucuucaauaauuuuguugaagauguuugcuggaccuuugaguugaaaaucuucauucucauccacuccuauuauccguacguuuggucuucuuauuguguccuggauuuccuggauauuuugaguuaggaucuuuuugcauuuuccauuuucuuugauuguugugccaauguucucuauggaaucuucugcaccugagauucucucuuccaucucuuguauucuguugcugaugcucaaaucuaugguuccagauuucuuuccuaggguuucuaucucuaguguugccucgcuuugaguuuucuuuauugugucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuucuuuaagugauuuauuaaaguccuucuugauguccucuaccaucaucaugagauaugcuuuuaaaucuaggucuagguucucagguguguugggguucccuggacugggcgaagugggugugcuggguucuggugauggugaguggucuugguuccuguuaguaagauuccuccguuuaccuuucgccaucugguaaucucuggaguuaguaguuauaguugacucuguuuagagauuguucuucuggugauucuguuaccgucuaucagcagaccugggagacagauucucuccucugaguuucagugcucagagcacucucugcuggcaagcucucuuacagggaaggugcgcagauaucuuguauuuggaccuccuccuggccgaagaagaaggcccaaaacaggaccuuucucagacacuguguugcuuuggcaguucccaggugguacagacucucaccuaagcagacuaaauuccuaaguuccuuggagucccgggaccaagauggcgaccgcugcugcuguggcuuaggccgccuccccagccgggcgggcaccuguccuccgguccggacgguggccugcuguccccggcccacaaagggugcugccucagcgccucugugccuccgccuguuccagaagcugucagguucucuggcgcacccucucaccuguucagaccaauuucccacguucggcgggucccggaccaagauggcgaccgcugcugcuguggcuuaggucgccuccccagcugggcgggcaccuguccuccgguccggaagguggcuggcuguccccggcccacacagggugcugccucagccccucugugcuucugccuguuccagaggcugucagguucucuggcgcacccucucaccuguucagacuaauuuccuaaguucggcgggucccggaccaagauggcgaccgcugcugcugugaugguagaggauuuuuaagaaggacauuaauaacucacagagaaauacaggaggacacaccuaaacauuagguaaaaggccugaaagaagaagcacaaaaaucucuuaaaaauuacaggaaaacacugcuaaacagguagaagcccuuaaagaagaaacacaaaaaucccuuaaagaauuacagaaaaacacaaccaaacaggugauggauuugaacaaaaccauccaagaucuaaaaauggaaguagaaacaauaaagaaaacccaaagggagacaacucuggagauagaaacucuaagaauaaaaucaggaaccauagauguaucaggaacagaauacaagagauggaagagagaaucucaggugcagaagauuccauagagaacaugggcacaacaaucaaagaaaaugcaaaaugcaaaaggcaaaaagauccuaacucaaaacauccaggaaauccaggacacaaugagaagaccaaaccuuaggauaauagguauagaugagaaugaagauuuucaaauuaaagggccaguaaauaccuucaacaaaauuauagaagaaaaauuuccuaaccuaaagaaagagaugcccaugaacauacaagaagccuacagaacuccaaauagaauggaccagaaaagaaauuccuccugacacauaauaaucagaaaaaaaugcacuaaauaaagauagaauauuaaaagcaguaaggaaaaaaggucaaguaacauauaaaggcagacauauuagaauuacaccagacuuuucaccagagacuaugaaagucagaagauccugaacagauguuauacagacccucagagaacacaaaugccagcccaggcuacuauacccagccaaacucucaauuaccauagauggagaaaccaaaauauuccaugagaaaaccaaauucacacaauauauuuccaugaauccagcccuugaaaggauaauaacgggaaaacaccaauacaaggauggaaacuucgcccuagaaaaagcaagaaaguaaucccucaacaaaccuaaaagaagacaguuggaagaacagaaucacaacucuaacaacaacaaaacaggaagcaacaauuucuuuucuuuaauaucucuuaauagcaauggauuccauuccccaauaaacagauauagacuaacagacuggcuacacaaacagaacccaacauuuuguugauuacaggaaaccuacaucagggaaaaagacagacacuaccuccgagugaaaggcuagaaaacaauuuuccaagaaaauggucucaaaaaacaagcuggaacagccauucuaauauugaauaaaauugacuuccaacccaaaguuaucaaaaaugacaagaaggggcacuucauacucaucaaaguuaaaaucuuccaagaugaacuuucaauucugaauaucuaugcuccaaaugcaagggcagccacauuuauuaaagaaacuauaguaaagcucaaagcacacauugcacaugacacaauaauagugggagacuucaacaucccacucccaucaauggacagauccuggaaacagaaacuaaacagagacucagugaaacuaacagaaguuaugaaacaaauggauuuaacagauaucgacagaacauuuuauccuaaaacaaaaggauauaccuuuuucucagcauuucauuguaccuucuccaaaauugaccauauaauuuuucacaagacaggucuuaacagauaaaaaaauauugaaauuauucaugcauccuaucagaucacaauggacuaaggcugaucuucaauaacaacauaaauaauagaaaucccacauucacguagaagcugaacaacacuacucaaugauaccuuagucaaggaagaaaugaagaaaggaauuaaagacuuuuuaguguuuaaugaaaaugaacccacaacauacccaaacuuacggggcauaaugaaaacaguccuaagaggaaaacucauagcucugagagccucccaaaaaaaaaaaaaaaaaaaaaaaaaaaaaaaagagagcauacacuagcagccugacaggauaccuaaaagcucuagaacaaaagggaccaaauucacccaagaggaguagacugcaggaaauaaucaaacucaaggcugaacucaaccaaguugaaacaaauauaacuauuaaaagaaucaacuaaaccaggagcuggucuuugaaaaaaaucaacaagauagauaaacccuuagccagaagaacuggagggcacaaggacaguauccuaauuaacaaagucagaaaugaaaaggaagacauaacaacagaaucugaggaaaugcaaaacauuaucagauccuauuacaaaaggcuauacuggaaagaaaacuggaaaaccugcaugaaauggacaaauuuagagacagauaccaggcaccaaaauuaaaucaggaucagauuaaugaucuaaacuguuccauaucccauaaagaaauagaagcagucauguauagccaaaaaaaagcccaggaccagauggguuuaguucagaguucuaucagaccuucaaagaagaccuaacuccaauucucugcaaacuauuccacaaaauagaaacagaagguacucuacccaauuaauucaaugaagccacaguuacucugauaacuaaaccacauaaagacccaacaaagaaagagaacuucagaccaauuucccuuaugaauaucgaugcaaaaauacucaauaaaauucucgcuaaccgaauccaagaacacaucaaaacaaucaucugucaugaucauguaggcuucauuccagggaugcagggaugguucaauauaugguaauccaucaauguaacccaguauauaaacaaacucaaagacaaaaaccacaugaccaucuaguuagauucugagaaagcauuugacaaagucuaacacccauucaugauaaaagucuuggaaagaucuggaauucaaagcccauaccuaaacauaauaaaagcaaucuacagcaaaccaguagccaacaucaaacuaaauggagagaugcuugaagcaaacccacuaaaaucagggacuagacaaggcugccuacuuucucccuaccuacucaauauaguacucgaaguccuacccagagcaauucgacaacaaagggagaucaaggggauacaaguuagaaaggaagaagucaaaauaucacuauuuucaggagauaugauaguauauauaaguggcccuaaaaauucuaccacagaacuccuaaaccugauaaauagcuucagugaaguagauggauauaaaauuaauucaaacaaaucaaaggccuuucucuacacaaaggauuaacaggcugacaaaggaauuauggaaacaacacccuucacaauauuaacaaauaauauaaaauaccuuggcgugucucuaacuaaggaggugaaauaucuguaugauaagaacuucaggugucugaagaaauaaacugaagaagaucucagaagauggaaagagcucccaugcuaauggauuggcaggauuaauauaguaaaauuggcuauaucgcugaaaguaaucuauagauucaaugcaaucaucaucuaaauuccaacugaauucuucaccuaguuauaaagggcaauuuccaaauucaucuggaauaacgaaaaaccuaggauagugaaaacucuucucaacaauaagagaaccucuggugggaucaccaucacugaccucaagcuguacuacagagcaauugugauaaaaacugcaugguacugguacagcgacagacagauagaucaauggaauagaauugaagacccagaaaugaacccauacaccuauggucacuugaucuuuuuaagggagcuaaaaccacccaguggggaaaaagacagcauuuucaacaaauggugcuggcacaacugguggucaucauguagaagaaugcaaauugauccauucuuaucuccuuguacaaagcucaaguccaaguggaucaaggaacuccacauaaaaccagagacacugaaacuuauagaggagaaaguagggaaaagccucgaagauaugggcacagggggaaaauuucuaaacaaaacagcaauggcuugugcuguaagauugagaaucgacaaaugggacgucauaaaauugcaaagcuucuguaaggcaaaagaaacugucaauaagacaagaaggccaccaacugauuaggaaaggaucuuuaccagcccuaaaugagauagcggacuaauauccuauagauacaaagaacucaagaagauggacuccagaaaaccaaauaacccuaugaaaaaaugguguacagagcuaaacaaugaauucucaacugagaaauaccgaauggcugagaagcaccugaaaaaauguucaacaucgggacccgccgaacuuaggaaauuagucugaacaggugagagggugcgccagagaaccugacagccucuggaacaggcggaagcacagaggcgcugaggcagcacccuuugugggccggggacagccagccaccguccggaccggagaacaggugcccgcccggcuggggaggcgaccuaagccacagcagcagcggucgccaucuuggucccgggacuccaaggaacuuaggaauuuagucugcuuaggugagagucuguaccaccugggaacugccaaagcaacacagugucugagaaagguccuguuuugggccuucuucuucggccaggaggagguccaaauacaagauaucugcgcaccuucccuguaagagagcuugccagcagagagugcucugagcacugaaacucagaggagagaaucugucucccaggucugcugauagacgguaacagaaucaccagaagaacaaucucuaaacagagucaacuauaacuacuaacuccagagauuaccagauggcgaaagguaaacggaggaaucuuacuaacaggaaccaagaccacucaccaucaccagaacccagcacacccacuucgcccaguccagggaaccccaacacaccugagaaccuagaccuagauuuaaaagcauaucucaugaugaugguagaggacaucaagaaggacuuuaauaaaucacuuaaagaaauacaggagaacacugcuaaagaguuacaaguccuuaaagaaaaacaggaaaacacaaucaaacagguagaaguccuuacagaaaaagaagaaaaaacauacaaacaggugauggaaaugaacaaaaccauacuagaccuaaaaagggaaguagacacaauaaagaaaacucaaagcgaggcaacacuagagauagaaacccuaggaaagaaaucuggaaccauagauuugagcaucagcaacagaauacaagagauggaagagagaaucucaggugcagaagauuccauagagaacaucggcacaacaaucaaagaaaauggaaaaugcaaaaauauccuaacucaaaauauccaggaaauccaggacacaauaagaagaccaaacguacggauaauaggaguggaugagaaugaagauuuucaacucaaagguccagcaaacaucuucaacaaaauuauugaagaaaacuucccaaaucuaaagaaugagaugcauaugaacauacaagaagccuacagaacuccaaauagacuggaccagaaaagaaauuccucccgacacauaauaaucagaacaucaaaugcacuaaauaaagauagaauacuaaaagcuguaagggaaaaaggucaaguaacauauaaaggcaagccuaucagaauuacaccagauuuuucaccagagacuaugaaagccagaagagccuggacagauguuauacagacacuaagagaacacaaacugcagcccaggcuacuauacccagccaaacucucaauuaucauagagggagaaaccaaaguauuccacgacaaaaccaaauucacgcauuaucucuccacgaauccagcccuucaaaggauaauaacagaaaaaaaccaauacaagaacgggaacaacgcccuagaaaaaacaagaagguaaucccucaacaaaccuaaaagaagacagccacaagaacagaaugccaccuuuaacaacuaaaauaacaggaagcaacaauuacuuuuccuuaauaucucuuaacaucaauggucucaacucgccaauaaaaagacauagacuaacaaacuggcuacacaaacaagacccaacauuuugcugcuuacaggaaacucaucucagagaaaaagauagacacuaccucagaaugaaaggcuggaaaacaauuuuccaagcaaaugguaugaagaaacaagcaggaguagccauccuaauaucugauaagauugacuuccaacccaaagucaucaaaaaagacaaggagggacacuucauucucaucaaagguaaaauccuccaagaggaacucucaauucugaauaucuaugcuccaaauacaagagcagccacauucacuaaagaaacuuuaguaaagcucaaagcacacauugcgccucacacaauaauagugggagacuucaacacaccacuuucaccaauggacagaucauggaaacagaaacuaaacagggacacacugaaacuaacagaagugaugaaacaaauggaucugacagauaucuacagaacauuuuacccuaaaacaaaaggauauaccuucuucucagcaccucaugguaccuucuccaaaauugaccacauaauaggucacaaaucaggccucaacagauucaaaaauauugaaauugucccauguauccuaucagaucaccaugcacuaaggcugaucuucaauaacaaaauaaauaacagaaagccaacauucacauggaaacugaacaacacucuucucaaugauaccuuggucaaggaaggaauaaagaaagaaauuaaagacuuuuuagaguuuaaugaaaaugaagccacaacguacccaaaccuuugggacacaaugaaagcauuucuaagagggaaacucauagcuaugagugccuucaagaaaaaacgggagagagcacauacuagcagcuugacaacacaucuaaaagcucuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaacguggacgaaauggacaaauuucuggacagauaccagguaccaaaguugaaucaggaucaaguugaccuucuaaacagucccauauccccuaaagaaauagaagcaguuauuaauagucucccagccaaaaaaagcccaggaccagacggguuuagugcagaguucuaucagaccuucaaagaagaucuaacuccaguucugcacaaacuuuuucacaagauagaaguagaagguauucuacccaacucauuuuaugaagccacuauuacucugauaccuaaaccacagaaagauccaacaaagauagagaacuucagaccaauuucucuuaugaacaucgaugcaaaaauucuuaauaaaauucucgcuaaccgaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguucuggaaagaucaggaauucaaggccaauaccuaaacaugauaaaagcaaucuacagcaaaccaguagccaacaucaaaguaaauggagagaagcuggaagcaaucccacuaaaaucagggacuagacaaggcugcccacugucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauuccaccagagaacuccuaaaccugauaaacagcuucggugaaguagcuggauauaaaauuaacucaaacaagucaauggccuuucucuacacaaagaauaaacaggcugagaaagaaauuagggaaacaacacccuucucaauagccacaaauaauauaaaauaucucggcgugacucuaacgaaggaagugaaagaucuguaugauaaaaacuucaagucccugaagaaagaaauuaaagaagaucucagaagauggaaagaucucccaugcucauggauuggcaggaccaacauuguaaaaauggcuaucuugccaaaagcaaucuacagauucaaugcaauccccauuaaaauuccaacucaauucuucaacgaauuagaaggagcaauuugcaaauucaucuggaauaacaaaaaaccgaggauagcaaaaacucuucucaaggauaaaagaaccucugguggaaucaccaugccugaccuaaagcuuuacuacagagcaauugugauaaaaacugcaugguacuggaauagagacagacaaguggaccaauggaauagaauugaagacccagaaaugaacccacacaccuauggucacuugaucuucgacaagggagccaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacacugucuauaagacaaaaagaccaccaacagacugggaaaggaucuuuaccuauccuaaaucagauaggggacuaauauccaacauauauaaagaacucaagaagguggaccucagaaaaucaaauaacccccuuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagugagaauggcuaagaucaaaaauucaggugacagcagaugcuggcgaggauguggagaaagaggaacacuccuccauuguuggugggauugcaggcuuguacaaccacucuggaaaucagucuggcgguuccucagaaaauuggacauaguacuaccggaggauccagcaauaccucuccugggcauauauccagaagaagccccaacugguaagaaggacacaugcuccacuauguucauagcagccuuauuuauaauagccagaaacuggaaagaacccagaugccccucaacagaggaauggauacagaaaaugugguacaucuacacaauggaguacuacucagcuauuaaaaagaaugaauuuaugaaauuccuagccaaauggauggaccuggagagcaucauccugagugagguaauacaaucacaaaggaacucacacaauauguacucacugauaaguggauacuagcccaaaaccuaggauacccacgauauaagauacaauuuccuaaacacaugaaacucaagaaaaaugaagacugaaguguggacacuaugccccuccuuagaagugggaacaaaacacccauggaaggaguuacagaaacaaaguuuggagcugagaugaaaggauggaccauguagagacugccauauccagggauccaccccauaaucagcauccaaacgcugacaccauugcauauacuagcaagauuuuaucgaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaauaccuaauaaaaaauggaaaaaaaaaauguucaacauccuuaauuaucagggaaaugcaaaucaaaacaacccugagauuccaccucacaccagucagaauggcuacguucaaaaauucaggugacaggagaugcuggugaggauguggagaaagaggaacacuccucuauugcuugugggauugcaaguugguacaaccacucuggaaaucaguuuggcgauuccucagaaaauuggacauaguacuacuggaagauccagcaauaccucuccugggcauauacccagaagauguuccaacuucuaauaagaaaauaugcuucacuauguuuauagcagccuuauuuauaauagccagaagcuggaaagaacccagauguuccucaacagaggaaugguuggccuagucagccaucaauaagaagagaggcccuuggucuugugaagaucauaugcccuaguacagaguaauggcauugccaggaagugggaguggguggguuggggagcagggugggggaagggcauaggggucuuuugggauagcauuugaaauguaaaugaagaaaauaucuaauaaaaaauacuagaguugaacaacaaaacauucaugaucucuauacucaugaaacucauauguccaucaggacaacagcaacaacaacaaaaagacaguaaguuuguuuugagaccaagaaucuagcaaugcuuuccaaucuugcuguaaacuuagaauguagcaaaagcuggccuuguaauuguuaaccuccugucccugucacccaaaaacugggaauagaaguguaggcuacuauaccacuucuaguuguuucaagaacagguaaguaaggacuguagaaacccauuuuccagggaguaaagguuacugcaguccuaugcaggaaauauaggauaagauuaaaagcaugacuuuaauaacuuuaaacucaguaaauggcucucuuggcuaaauucaaccaaguguucuaagcaacuauaccucuagaggacagagucaacaucucuuauguaauguauaauucaucacaaguccaaagacaagguauuaugccauguaggggcaugagugacuuugaggaguagugcccaccaccauaggcugugaacauggaaccuguguuagaaugcugaguggcaccuugcagugucuuagacuuucauucuaccaccuagcucuaugaucaauuaacugcuaauuucucuuaagccaggaaaggagauagagaaauaaugagguaccaagcauacaugcaaggcaagaugcacucucuacguaauguucuacaagaaucaguaggacuuguauaggaauaguuuacuuuagauuuccugacaauuaccaucagcuaaacucaguuaaaugguuugcacagcugagaaccucagccaggccuuucacuguucuccuuugccuccaccacuaagaacauuucauucaaaggcuugggguaaagauauuggucccugucaagcuaagauauugaagguggcuuuuugguuauaccaauuuacagacagugcagguguugugaugagccuuaaaauacaaucugacauauuuucagcugcucguuccaguguccaauacugcaauuauuauaugucauaucauauuugguaaaacaacaaugagaacugauugucaaccagacugauauauacacuuaugauaucucuguauaaagagaggcagacaggaguucuguuaaaacugggaaagaaacagaagaaacaguucaauaauaaagaaacaacaaacaggaacaaaaaggagaaagaaagguuauacaauugcuacuuucuaaaaauaguuucuagggaucuaucaucuuugugauaauucuauggaugaauuauucaucaaaacuuauuaaaacuaagaauuuaaguacuacuucugaauauaccuccgaauaauguaacaagauaaucacaagcccucacucaaauucaugcugauuaacaguaaauaguuuuggacugacugauuucugccuuugaauaacacugccuagacucuguugccaaaaaaugccacaaaauuguaguggggugaauuucagaagaaggccugaaugacagccuggauaugaaggaugcuccacagcgcucugaauuugcauagcagcauuugccacacaugauacaggaacuacaaacaccgucuuaaauagaacuuuuauuuaaaauguguguauuuuacauuuauuuuuuaaaagcuaaagaucuuauauuugaugagucugguuucuaauuuuagucauaauuauuuuuaaguaugcaaagauauuccugacaucucaaaagaacaaguuauuacugucugucgacucauuuuuaggagagcuauaucauaaaaaauguauaucuucauauaauuaaaaaaucuaaagcaaugugaauugaguaaaguaauauggacuauuaaauaauucagaauuguguuuagcaguagcagcuguuuaauuaaaagguaaaaaaaacuguaacuaauccacuuugggugacagaaauacagccuguauggauaguaagauuccccuugaauugaaacuauggaaugaauucaagaagucccggcuucaacuaauuaauacaguaaaaauaaucacaauaaaucaccacuuaaauauauuuuauguuguagagcauccaaaugcugcuuuaccucaaugucauccucauaguuagcaauuuuccauuucaaugccacaaaagcuucuuuaauguauauauuaguauccaccacccagcuuaaccugauagcccagaucuccccaggggcuuacaggugagaaaagcccuuaaaaacauuagauccuuucaaacuuaagaacuucagggucagcagucagguccuuguucauaauuacuguucaaccagaacaaguacaauggcaaugaacacaccaaguuaagcaaacuccucaacaauugucaguguaauuucaugaaaaaauuguuuucacgggguauuuuagugggagaaagggcuuuguuaaguggcagaagaaaguaaguggcagaagaaagaagguaaguuaauaucaaacacaauuuccccaaacugguauagacuacgugaucccagucaauucuguuagaauacuaccccaauaugugggugacaaugcaugugcaaagauguuuauugcagaaauguuuuaauaaaaggaaaacuuguauaaauaccaauaacaaaaucugaccaagaaaauuauggcacaauugcacaauaaacuaacuguauagguauuaauacuuacuuuaaaaugcuauacaguaaaaucaaaugacaaaaaagaaacuauacaauuaaagcaacauuaauuucucuuuuuacaaaguaacuuagaccuuaaaaagugacaugauuauuuucuaaacuuugccugugcugaaauacgugaaauuaacucaguuuguaacuuggucuaaucuggguguguuucacaaaaacacauuggcugcauuuguacucaggagaccgaagcuauaauaauguaaguaacaagcagaaaugggagaagcagagcaguaugaggcagagcaacaauucuuguuugggaucaucacacuguaaucugacaaccuaucuccuuggaaaauaucuaaauacuugucuuuaaugaauaaaauaaauuauuucaguauuuuuuuuucuacuuccacaaugggacagacaggaaaugagaguccucuuagagagaccaaagagagagugggaagagaguguugauaaccuaccuuauaaacgaguaacaaauacuucaaagggguuuuagcauucacauuguauguccuguggauuuuacuugcaaauuauagggucagcagagcagaaaaugagagucuuuaauuagccagagcagguggcuaagagccacaaggugaauauuagccacaucgcuguccagugccaaaacucauggauuugaccuacaucaugaauucuaagaaugagagcaacugucuccaaguagucguagcuugaguaaagcccauguccuguguacaguugacugaauuauguuuacugaugcuuaaugaguugguuuacucuucaguuugcguuaggauguacaaauuauucccaugcucuccauauuguacuacugucuaugcugucuugcuuugcucaaguauaaucuugacuuaccaauagcucuacuucccuuauuucugaagcaccaugaagcauuacaaauugagaauaacuuaauguacaacauccaaguacuucugugucaaagaaaagaguuuuagggcaauggaacucuuuuguguguuacuacaauacacaucauuccaaauuuagccaaaccaucacccaugcaggaucaagaaggaguugugauaccaacugugugcucugcgagguugugaugggucagcuuugguccauuaaugacaauuauugugacaaguggaggguugacauuaggaaaaaacugcauggacaaggcaggauauuucuuuaaaaacaaacaaaaaccaauuuuaaauugcauuucauuuugaugugaacccauacaauucucuaaagauaaggaucauuacaaacacucauagauauuaauguuuagaaguuuuuauauuauaaaaugguuuggcauauaaaauccagugguuuuguuauucaucuucuauuauagcaguaagcccggaguugcugcugaucaccuccacaugguuccagcucucaaauguguggcuaugccaaauuuggggacauggcucugcacugagucuuugaguagacucauguucauaugcuauugcucauaagaugcccagccucgugccucaguuuucucauuucucaguuuucuccuguguaacacaggagaaaugguaguuagccauucacugaaaauucccacuaagcacucaggugacagcaacuccuuuuguuauuauuacaacuuaacucaaagcaaagacccaggaauucuuuaucuuuugccaaauggcaugcaaugaguaaaagauaaaaaacuggaacuuugugaaugacgaugcuacauuuucaacucauuaacacuggaaacuuuuacuugucuaaagaauuacaacuguaucuagaaccauuauuguuuuucugcauaugaagccaccuaacuugaagaaggucucaaacauuuuaguuuggucccccaagaguucaaauucugaucccuggaucauucuucagagaagaauguuuuaaaaagcagauuugcagagugcaccaagucuacuuucagaaauaauauucuugaucuaauaugaaauaauaaauaauucagaaauuguaccuuauuggggaauugcaucuauaagauuaacuggggcucucuggaauaagaagcauuuaccuugcuagagcaaugcuacucugcauguaacccucuucccuuggagaagaugagacagcuugugggagaaauagaaugauucuuggcuguauucagaaagagaacaaaagcaggcaggcagguaaaggacacagcaccauggaaaugacauuuaauuucuuuugaguucuaacguauuguacauuucaaaaucuucauuugacgaaacucugaaaaaucugucgaguggguaugaaaaaugauauagccugacacuugggugcuaaaaaauguuacuaauuauuuaaucuaauuguuuugugugaaggcaaagcuaaugggaaaugucaucccuucauaugccagguuggugucagguucauauaccaugaguucuauaaaaucuaaaagugacaagaagacuacucgaacauuuaauuuuuccuucuggaaaucaggaaacaaacuccccuauagaaaauguccuuccuaugcaugaaaaaaaguguguguguguguguguguguguguguguguguguguguguguguaucuguguaugcacuccgggaagaguucagcaucugguagcucuucccucuagaacagugacucuuaaccuuccuaaugcugugacccuucaauauaauuuaauguuaugauggccuccaaacauauaauuauuucauugcuacuuuauaacuguaauuuugcuacuauuaugaauuguaguguaaauaucugauaugugggauaucugguauaugcaugauauuucgugauccaaaggaaucaggaccuacagggugagaacuauugauccacauuuuacuuuacuauuuuuuuuaaugcaagguaacccuuaucugaacugucugccauuaguuccuagaaauucucccucucuguuugguauuacagggguacuaaacgacuccuguuucauuuuguuuucaugggugcuggggauccaacucaagcccucaugcuugcacuuuacugacuugcauauauagcuagccccagaaaagaaaaccaaacugaaacuuuaaguguauuacauuucucaucuccaugacaaaauaacugagaagaacagccuaaacaaguguuuccuuugacucauaacuugaaaguaucauuccucauggcagagaagacacuggcaggagauggugagggauggugcuuccauauucaggaagcacccagaggugagcacugagcuuggauaccuuucucuucuggauugagcccaggaccugagcaugggauggaggcccugcauugaccauguuuuguacgucaacucagucuagaaacuugaucacagaccuggcuucagguguguuuucuaggugauucuagaucuugucaagcugacaaccaaugcuaucauauuaaggauagaauuuuauguaagcaugcuuugcguaaguaauuguugcuuuuguuuguugguuuguuugguugguugguuugguuucccacuuaguagcuuuucuacaaauaacuuuugucaaaauguuauuuuugacgguuuuccaggaggcugugcuacugcuaaacuuugcugacaaguggcucaugacuucggcagauggcuuacaugcuaagggcugaggccuccuuagaaaacaacuuucuucuccauucaccagcaaaugauaggacaaugcuccacuggucauaugaauaauauauaggaacuauacauauauuguauaugacagagaaacccacccaagaacauaacaaauaaaacuaauggaauauacauacauauguauacacacacacacacacacacacacacacacacacacacauauauauauauauauaucauguaucauauauauauauauauacacacacacacacauauauguauauauguguauauuccauuuauaugguguuaucaccuugacugggauuucuguuauaaaauucauaugaaaugcuuuuuuauauauucuacuauuaaucuauuuauaucaauugauaguaauuuauaucaauuacauucucacgguuaguuuucuuuacaaauccuaagaaaguagagggauuuuuuccccuuuucaacaagguguucaucuuuuauucugaaaacuucccauaugucucuaguuuccuaacaaaaagucaugaaaacaacuaacguauuggaaaggauucagcacauucuuuaugauuuucucuuuacuugucucuuggaaauagugacuuccucauauacucuggguuaagcugacuuucagcugggcuuuagggaucagccacaguuccagcccaggacaacuccacuggccauauugauugccucaggaauggucaugaaaccaauggagagccaaaggaaauucagaauuucuguucaccagcuauggaagacagaugcucuacuuauaaauaugaauggagaaaugaguaaggucuaaaccuagagugaucacauucaauccacaagaguuugcuggagagugaagauugggcacgauaugaaggaaagaaaagaaacagaaccacccaugcacacaccuaugcaugggguggggugggguacugaccuaccaggaaagagggcagagaaagaaagaaagagaaagacaggcagaggauaaaaagcaggggaaccaucuguaugcuacuccuagcugaaacucaaaugaugcugaaugcaacugaacaccauuuucugauccaagcuaagaaauuccauugucuaauauagccagaaugggccacuucuccauaguuuucuaggaggacuacucuaacauaucaacaggcaagauaaugauagcuggagcaaugccuaguggucucuauuuucccucccacccucccacuccaagagcauuguccuaucauuugcugaugaauggagaggaaagcugguuucuaaggaagccccagccaauagcaugugagccaucugcugaagucaugagccacuugucagcaaaguucagcagcagcacagccuccuggaaaacaguucucuucucaccaguggguauuuauauaauuagggucaauuacaauuuagaauuucuagggcauggggcuaaauuacagugacauuuaaaagcuuggcuaaauuuucccauuuaucuagaagauuucuagaguaacuauguuguaauuaaguaauuuucuucuuuccacuuuuaucacaauuuucuucuuuaggcuuggcaauuacccaccacuccaggacaccuucuuugagaugggggggcacugcuugcuggagcuucagauuagguuuugcagccugcugagcauugaauuuggauguggagagcaacuuucaaguuaaguugcuucaacacaauauuuucaaagcuucccaacccuccucaaacucagagccugguaaaaaaaaaaguauuaaguuuucugagggaguaauagaaaucuaaacagggcacacuaugauuguccuauguccuucacucuagugguagagauuuuaaucaguuuccaggaauuagagacuaaaacccuaucacuugcuugugcuuuuuuccuauguggcucauccacauagauuuugugaggccauaccuuuugggcuucauuuaauauagagaaaaaugccuucguuuuugguuaacuaaaccucaaguuaauuaagcuaaucuaauugcauucauuucuacuaacauggugccauccuauaagcaaagacaaaaagcaggucugugagcuccacaucaguauugccugauacauuccuguaagaagccagaccagaauucaacagucucauucaaugauuuggcuuacucugccagagucauaaccacaacuuaccuaucaaccaccaccaucaaugaaaacgugcucugugcaagcaaccauccacucaaaacauuguccacugccucuuccaucuaaaaaagucaagucuacauagaaagcucuaggccaggcauggguauacagugagaccauguuucaacaauauaaaauaguuuauuauaugauuagacaauuucagggugaaagaauauauccuuccaaccccaaagcuuacauuuuguguuguacuuuaacugaggaaauauaccaucgagguagcuaugcagguuuagagcuuagguaacucacaugucuccauuuuuuuuuccaguagaggcguuucuuuuuugagaaaacuucaguggucucaucucuguccagcuuugagguaacuaguuauccacgccaguagugacucgugugacaggccuagaaaccuggacgcaguccgagacaaaaaguucacaggaaacuuagucaccuggaaccauggcauccuguauaaugaaugcuccauuucuguccccacuuuagccagguauauagaucugugugcuuucuuucaauauuguuuuauuauaagugucucuaaggauugauuuugacauauagauaaguuagauuagccuccaccaguguuccaaaguccuaggcaguccuugagccaacccuaggcuuggaauucaguaagaauauuaccuauucaguaacauucagaauuacuucuaguauuguaagggagacagugaaagaaaucaggcauuacaguuuacuugaauagagcaaguaaucucagggcuagucuacauaguaaauacuuagaacaauagcugagucacucacaugcacaggaauuuacaauggccuaugaagaagguagguugugguuguaggaggaacugaauuauuauucaugaaaggguuaguagaauggaauaccccuggugcauguuuuucacuaggcccagaagaacaacauuaucagguauuuacuaagggaccccuggugguggguuuaacaauagacuaacuuugcaucagaccauucuccuggcuccuguguuuagcugaucuuagauagagcuguuccuaucucaguuguaaacacugccuggcucccccuagcuuuuuauguauacauuuucuuuguuuuguguaaagcugggcuugguggcacacaccuuuaaucccagcacuccugagguagaggcaggcagauuucugaggccagucuggucuacaaagugaguuccaggacagccagggcuauacagagaaacccugucuugggaaaaaaaaaaaaaaaaaaaaaaaaaaaaagaaccauuauggauguaccuugguggauguauuccccuaguuuucuuguuuuucuucuguauauuaagacuggggcucgcuuugagaaauuacauucagauaccacacucccuugugucugugucuguuugucacccuuuucucgacggcuccugcacaccuguaaugggacccugaguuugaaaggaaauuaaauaaaauaagagguuuaaacuaaaaaggccugggacugaaacugcaaagaaaacaagcccgggcacaccugagucugucuugaagcuaggucacccggucauaaagauaagggaaggaaugcaggaacugguucugauuaucuuggcugacucaaugaccaucuggcagcccggugccuccugcucaccucccuuucuauagagagcauagcuaaaagcuaaaacauuaaccagaugcauugucaacucagagaagccccuggcuuuagaauucuuauacacccuggccugcacguacuacucugcugacucauaaucauguugcugauguuugaaugggccaaucguguguaaccgcaccaauucuuccuagccccuaaacccuacccuauaaaaacccugaguuuuugagucucagggucgaauccacugucuccugugugauauacguuuugacccggagcucugccauuaaacuaccucguguuguuacaucaagguguugugcucuguucaugauucuugggugcacaccgaauugggaguuuaguggggggguuccccacuagguucuuucaaguucuccugaggaggggccgacugaggacaguccacagcacuuuugucguuucuucuauauggcacacacacuucuuugccuuccuguuucugccgacugaugucuggcuuggauucuaaagcccugcuaauucuuccucuaauaaguacguauugggcaaugcuauugcaacauacaaugacacagugacacuaaugaagccauuuugcuguggucacacauugauacagggcaggaacacccugaguugauuccagggcucccaacauuccuaccaagucugggaaauauucaaaaaguaaccaaauagaaucaaaagaacagaauuuuauucaaguauaauaaaugugccagguguuuauuuucaugggaucuaauucauucaucagcuaugugacaaaaauugaauaggagcauauuaauguguuccccuaaaauagucuuugaauaguucuaauggauaagaugcuguauaagacacuugguacaauauaauaaugagccaaaccauaggaaccuauuauuauacaaauauccaaaaugaugguaaugccuuaauguggggaauaaaagacagaaguuuucaagaagucuacuagcauuuacuucuacuuccuaaggagcccuacauagauuuacaaguucaucucuauaaagcuuuaaaguuucauuagagcagaaaugaaauaguuguggauaucuucauuccagaagccaggcugccccugagacaugguguuugugagucaaagacagacacuguggccucauggcauauccagucaugaccaugugacgacgagcagagaaaacaagaugcugcaauuucaauaaguacauuugcuuucaaauccagauuuucauuugaaagccauuaagaugcauauggccagaaaggcugauuaugauaaacacaaauugguuuguaaugaagucuuucaugggcauuguaacaucaagaaaaguuagagaggaagaugguacgggacucugaauaccuauuauaaacugaagaaaguauguagcugacacauuuuagccacuccuaaugguuaagagcugcuuugaacaaguguauggaauugucuucaaggagacagagauugcgacuuuucacagaguucugauugguugcaauaaucucuaaaacuaugacacuuaaguaugugauaguaauuacuucuagagaaucaaaauuagaaauggaauggggaaacguaaauaagaacagaauucagagacuucucucuguuucacaguugcugacuuugucauauggcucccuaauucugugaacucccaaaauaaagaaaaggcaggugacccagguaaacucucuaacauguggcauauaccuacaacuagugggaagucugaagcuuucuccgugaagauaaauacugugcaaaaagcacgcauagcacccaguaugcccuuucucaaagcagacagacagacagacagacagacagacagaaagacagauaggcaggcacgcgcacgcacacacacacacacacacacacacacacacacaauguuuuccuuuccuacaaccuucauagaauccaugacagucaccaaugcuaaaauacaucccaaucauauggauccacacacuguucaaaguucccuugggaugacucuggucuccaauacuucuuuauuuucuaauuuauuuauuuucuuaaaguuugagaucacaguaaguuauaagauggaacaggaaaagcaugcauaccuucaaccaguguugcacaauugcuacaucuauuuuuccugugcagcacaacacacauaccacaacucauaaauauacauacauacauacacacacacacacacacacacacacacacacacacacacguauacacacauacacuaacccacccaugcacaaaugcgcacaugugaguacacacauacacacacauacacacacacacauacacacaugccuguuaucauuaauuauuugccacccuugucuuggcaggaugucuaauccauuccagaaaagaggauuugagccccacacagugacaacucacaccugugagaagcauauucagagucuuaaaggaaaaaaauaaaauaaaauuuccauaaugcagagagcucauaaugcacuggauacuagaauauguaacuagaaaguagggaggcaaagauccucaagacuugauguuuuauguagcagacaaugaagaaauaaugcagauuuuaaguggccuucuaagcaaaaugauguccuucuaagcuaacauguuauauugauaacacacaggaacggggagggaaauguuuucaaaagaauacuuggccuaagucuaaaugccaggaguauuggguuagaaaaccaagcaaacaaacaaaccauugagagcagauuugugccauuguuguaacagaauaugacagaaugagucugaaaagccauucccagugauauguaauaugaacauacucaaaugguaucaauuucaauuaguuaggcuucaagaggagucaugugguauuuggacuccgacgugaaaucaauauuggccuuauggauacuucccauguaccacagcccuccauuccaaucuacuccucuccccucaagaaucaauacaaaaaccuucuaucugccagaaaacagaguaaucuuuaaguggaaauaggaaucuaaauuacaguuguaaaugucgaaagccuguauuguguggauuuugcugaugagauauuugaugugacuucuuguuauucuuagggcuguacucaugagcauauaacaagggugguuuaaaggccucagugccacaaauuagauuuuccuuaagaaauccuguccuugacaucuuuuuugauuaucuaagaagaaugaaacagauauuuucaguuaauuagugcuaaggcauguauuuugcauuagcuuuaaguuuaccaaaauggcuuuaaaaacuugaacagauggcagaauuauaauaacauuuucuugugauuuuuagguuaagaacaaaggguccugagauuucuucuccugucuaacuuuuccauaaugugaaugcauuuaaaagauaggaugcauuugguuuuaguucuugccaaaguguagacaacuccagcucaccuagaugaguauuaggagauguggggauacaugagaggguauuccaggacagaagcaucagagcacagagauaacuccaugauuagauaggcccuguggguuagaguggugcuuggcaggcagauggacacaggguguggcagggauuuuguguggguaaagugaacuucuacccaggauaccuggcauggcaagaagcucugauaggcagaaagagcagucacagacuagagguggagaacuuagccucucacuggcugcuuccaggcacucugugcagaauccagacagccagaacagccuaauuuucaaaguuaaucuccaauugaaauuuuguuugugaaaucauauuuaacaaaauauauggggagcuaggaacucaaccuguggucuguaggugaccauuacacacugguugacaaaugacaugggucuauacgagaugcucaccuuaaaggccuggcuuaucucagauacugucugugagauagguugacccuuggaauaaaaacacauuaccuuauuaacggaguuguccucuaacacauggccucgugacuucugacagaaagucugccuggaucugaagaaaugacccaccccugccaccugugugggacaaucuaacgcucugaguuucccaaugcaugucccuuucacagccuucuugacucagauuuuuccuaagagcucuccuaauugcccaucugaagccucagccaagucagccauuaauaagugaaucagcaaauucucagagcagguggggguuuguuuugguuugguuguuuuguuuuguuuuaaagcuuucuuuugcuuuaauuuugaggaagcaucagguaucuuguaccccgugguuuugauacuaucaacacgaagcucucugggugccuccggccacagcaaauguaccuuuucuuucucaaaccuuccucugaaggcccugcagccuuuuagaacucgaucauaaauucuguuuuuuuuaaguuacuuaacuuagggcauucugucuuaagacauccacacugaccaagaucauguaucaccuuguuuugcuccccugacacugaagagagagagguuuuauuguuaugcugcuuugguagaugagcacacuguggagaaaagcaacagucucguugacacaaaauagaaaggcccggggccggcaacuaugaagcauguuauuccugacccaguuccuuuuucaauuucuacuuccuccaaccgaucacuuuaaucauucugucugguugcaguaacugccuuggucagugcuaacauugcccuagccacaccccuuucgacauugccccacugacuggugaagcuaucaaugauucgcuaauuguucucuacuuuuacccuuccauucaagcauccaccuucuugagaauacacuaaaauauaacucuugucuagcugcgcgcgcgcacacacacacacacacacacacacacacacacacacaaagcauugucuuuaaggcacuuuguuauucuauaauuauagguaacugauaggcaugaggaaucuuaggcacacaaauuacuucuuguuacugugaagcuugguuagguuccucccauccagcuguagaaaagcugguuuacuuucacaugauuucaaaguaacuuuauuucuagccuauaaacaaguuuguaguuugaauuuucucagacuaguuauaaccucuaccaucuccuucagaauuaaacaauuuuaacaaagguuggcuuguacaucuccaugagucaugacuuuaccuacuacugaaaauuauuauuucacauguguaucuucuaauuagucuuuguucuaaagccucugauuguuauucgaauauucuagaaccuucacguagcauuucaaucuuaguuagaaccgacugcauccugucuuacccauccugagcuauaauucuccuaaucuagacaacagauuucaccuuccugauuucuuccuugaucauccuucuaccuaggauguggcuuuccucagaauguugaacaccaauaguugcugggaucuuuuuacucuguuuagagguuacaugcucaucuuuacaaaaaaagaccuggggacccuggauacuguuuuuacuuuuuagaaagucccacuguuaauuucuaaaaugaaaaucaauaaguaauugaaucugugauucaguaccuucugucacauuaguuuguuccauuaaaacaccuucuccgccuucugccugaugacagacaucaugcugcaucucagaaacauacaaaaccuguuaggaaaacaguagggcugcggagagagcucauuuugcaaaggucuugguuugcaagccugagacuugaguggacucuccaaagcccacaugaaacuaagcugggcaauuagcaaugugcuugaaccccacacuggagaggaagggacaggugaucccuacaaacugaugaccagguaucccaggauaacacccauguuucaggccagugauguuguuucaaacaaaagguagcuggcacccaaggaaugacccaaagguuguccuccauccuccacacacuugcacauauguguacuuaacugcaacugccccuuaccuccaagaagcaaacaaaaaggaccuuguuuaugacuuucuuaaauuaauuuagugucagacacaucucagaacacuggauguguagcucaguuuaaucuuuauaacauuacuaagaaaugcauaaaaacucuuuucuccuuucuagauugguaaacuaacugaguuuuagaguguuacucuaaaguacaaguacucaagugacaaucagcaccaagacugaaagagugcccccugcaggggcuauaugcuuuugacacuuguuuaggccaagcuggguucuuaccugauggucucacuugacaaccuccagugguucucccacacuggggugccaggccacucauuuguugggugacaaagauaaaaccaauuccuuccugaauccuuuguaguuuauauucuuaguuuacaaaaucccaaucuaaagcaaagcuaaauguagggccacuaggcuucccaccaaguccaagaaguuauacacccugcucuccagcuucuuccuuuaauuuuuauuuucaauugauguacaauaucuaaacaaguuuaugagauguaauguuaucauuaacuaauguauacagaugacaucaggcaauugcuacuucuauugaucaaaauaauaucauucucauguguuugcaaccuucaagcucuacugauccuauuacggggagaugcauaacuaaugguuguacauuacaguucacuacuguacuauaaacccucagaaacgcaucucuaauggaggugcucugccauccauuaacuauauuuuuucuauccuugccuccuucaccuucuguucuguucugaccuuauuuaaggaugugauugcucuuuaagcuuugaugcauuuuaaguucauaguucucaaacuucuccauggaaagaacauaggcaaagagaauuaacaucuauucugugaaggagaaagaaagcaauggagaaaggaagagggaagguggagugugacaagcuguaaauauccugaggccuuguguguuaucuuaaaaauaucucaggauuuuauguacacacaauauauuagcaugggccuuugugaaaaaucuacuauaaauauuauaacuaagugaacuuuugagaaaggugacuuaucuaacuugugguugggagagguugcuaugugacugugcacuauaauuucccagaacaauuugaaaucugaaugcagggguggcuaagaugucuccccuaguauuggcccugccccuugucugggccaagagcugaccucaaugacauggauacaggagagcuuucaagcugaccaacucagagaccaccaagguacagauccauggcuuugagcuggcccaacccaacaucuaccccaucuaugagcugcuggagcuugcaaaggugcuggcccagcagaaccaaagccaugggaucuccaggacucagggcaacagcaggaugcacaagcacauguaugaggauccaguacugauguaagaaaagccagagauaucagagaugagaaaugacucuuugaaaugaacauuugcaaguaaagauguuugggcaaaaggguaugugagacaucacaacugccagugccucuacaacuaaugacuacgugaccaagagguaggaaaaacagaggagcagagugcuucacucacagcagaacuggacauggaagcugggucgggugugagagaagaaggcugcaguugauaaagguugauaggacuuucucagggaaagguuuguauguuuuauguuaacuuuuucaucuuuuuacuuucuuuugaagggguaaggguagacuuggaaaugagaagguuuggggcacaugugaaauucucaaagagucaauaaaaauauguuaacaaaagaacuuuucccuauaucuuuccaugacaccaauauuccuuuugcaugccuaaaccuuuucacacugacccuuuucuuuaauauguucuauacugagugucuagccuacuacaaaggccgaauaaguccuucaucauuguucagugacauacagcauccugaaaagcgugccaugagugccccaugauuuauaugaugcuucucaagaccauacugugagaugcuaaaugccagcaguggugugggagaaacagcaaaacucuucuuaaccauaggcauccucgaggcuaaagucccuguaauaggaaacaggauaacaagagaaaagcagccacaauuuuacaugcauuuuaggaaguacaggcuccuuuauaaagaaauggaguguggacagaacagggaaaccuguacaugcuugaacauuuggcucagaagagaaagguaguguaauggagauagaguaugaccuaauguaccuggaaggaccuggggaaugugucuuuggacccugcccugaaguaccacgaugguaccucugaauaaagauccaaugcccuccuuuagguacagggugucugagucugaaaccucuuucuuuugcuacuuucuaaaacauuggagaauuguauuuuaggauuuuauguccugagcuauacaucauuggagaaaaaguugugaaagguguugguuuuuuuuuuuuuuuuuaaacuaucauuuaagagugaccauugaggucacagauguaggaacccagagggaauuacugccucagggaaaugaugcugaaaauggaggcacaggaaacaggaaagagugagaggagagagccuucccaucacccaucagacaguaaacucaauagcugcagguacuauuccaauuguuuguuaauacugccaggacauaggagaggggcugaaugcugcaguuauaacugguccuaaggaaagcuauagaaucuucauugaagcuuugaaauucaaacuaaaacaaaguuaaaaggauaaagcuucaugguagaagacugucuaggcaaggcuuuggaucuacuucagauuucccuggacacaagauagaguuuaaggaaugccuuaaaacaugcagaaaccagguaaguaacugacauuuauuacccacuaaauucuuauagcaacuucaggagcuaagggcuguuauuaugacauuacuguauaaagaggacagucuuggagaggucaaugaacuugcccagaaucucauuaaguaucuagguuuccuaacucaaaacaauaccaauuccaaggacgguaccaugagaaucucacaagcuagaauacuuggugugaacuggaaucuggacugagaaggaaaaaaaaauuaacaaagggucaaacuuccuaugucaagacugagcaaaccucaaggcaauagacagacucugaggagacucaaagcaaaaggcuugguccuugggacggacacacucaugcagacuaagcaucacugugcacaccugcaaucccagcauacagagguggaguggagaugaucgugaguguaggaccagucugucauacagcagaaccacaucuguaaaccaaggaguacauaggagaaagaaugaccucagccuacaaccacacucuagcauuccucagucaccacauguaaggaaagccaucuuccaaacauuuuuaaacaucugagaauacuccaauuuugauucugugugcaccugacuacugcaaauuacuuggagugugggggugguaauguucuuguauacaccuagcuaaagcgccucccaaaucuaagguacuuugaugguauggaggcugguucacacuuuagggugugccaguugaauaugaugacuacuagaaacuaguggagaacagagcgaggagauauuuuaaaauuucacuaacuggauuauugccacugcuggagacuuuucucucuuuauaaaacuaacaguguugucaggagaaacauguuaagaaacucaucauauuaacuauucgugagauuaaaaauuuuaacaaaugaaacugaaaagaagaugacacaauucuagacucaauguuuuuugccaacaaauacuuucaaaaucuuggugaauucuaacaguuaucuauucuaucagcuuucauaugugggggaaagaagaaaaagggaacaaaagacacaaauauaugucagauccugucaagucuaugacaccaggguaaaagcauacucauaaagggaaaugugaaccaagcacaagacaggccacagucaguuccugcuuaguaaacucuaguuccccaaauguggacauuuguaauaaaauauguguaagggauucuggguuuuguuucccauuuuucauuaaccauuuuauucauuuauauuucaaaugaugucccccuuacugguuacccccacacacaacccuuccaucucaucuguccucucccccugccuuuagaggauggccuuaucugacaucaauaagaggagaagcccuucaucuuguggagguuugaugccccagcauagggagcugcuagagcagugaggugggagugacugaguggguggaggagcacccucaggaacacccucauagggacucuguuuuuaaagagugaaauaagagcaacccucaaaauagugaagaaccacucacuucaagccaaagucuuucccauauaaagaugagcagcaugaaaaacuaaauguaagagaaauuuaauagguagguugacuuuauuaauauaccuucucaguaugugagguaauggugguguuugagacagggcaccccaaaauaaagaaucuugacauucgagcaacagcagaccugggaagcacccuggucuccagcuccccuccuagagagcacaccaugaaagaucucuuaaucuuccacugcagaaggucguaacuccuccagagaagccccacuuaacccgaguuggaggaaugcucuucugccuguggacacuguggcauggaagaacaugaccacccucugagcuaaccccaccccauuggcuggcauaugaucagacucuucuagcuacaauuuccguuucuccucaaccaugcacuucaucucacuuauuauacuacacagccuuuuauauuuucucaggccuuuauuucucacaccuccuauaucauauaaaauuuacauuaaaugcauugcuauucucucuuauuaaucugauucugguuaauagguguaagguauggguucauuuuauauuaaucacccuagauuccaaacauaucaaauaauaauuuuuaagguaaggaaacuacacccucacaaauauaaaguaucacaauuuaauuuuuuaaugaggaaaucagaaaggugguagucgggguuuaagagaauuccucuaagacuaaacaaauauucauugcauugaggaugccuggacccugcccucaauaaagagaguuaauauuucaaaacaacaaaaaucaagccugaagcccaaaggcaauucugccuaucucuucuccuauaccuuugaauucugcuacauugcugaaugaaaaaaaaaaaaaaaaacaauaacaaaaccaagccacccuucacuaagacuuagauaggacucucacucugucagaacacccauaucuguagauuacaccuuccucuucaccucaccaaggcuuagcagacacuaaggucccucaccuucuccuauacacagugauggaacacaaggcuucccacacgcugggcuagcucugagcuaggcuaucugcugaccuaauuccuuuagaacucacucauucccuuucuuggccucacaggcagguaucagagaccaaaauucuuuguaacugugaaaguaacuggacucagagauaaauauuuccugcuuggguaagagauggaauccuuuucugacuucaugacaauccuugguacaaucaaccccuaaaauuggagacuguugggucuucugaguaaacauucuucuuuaucauuauaaaaugacccuucugcaucccuuucccaaagaagguuuuaacugacuuuauucucuaacuuaagaauugagccauaggucuagggugacacugugcugaagugcauguaccuagcauguagacgggccuagagugaaugcccagauugcaaguaaaacaacaucaaaaaagacaaacucagaaucaaggagcaucucccuucuuagagagaaaaaguguucuggggagcugggcuucagugccuugguuuuaccgaaagagagagcagagacaaaggaaaggaaagaggucaggcgucugaaagguucccuuuccucagggcaagggcagugccacagaacaagaacaacacaacuuucugguuacugucaccuuacuuuaggucacacccgccaauuuuauuaaaaacagguccucuuucucauacaauaucuugauggcaguuuuccuucuuucugccucccugcucuacccccaucuccccucccaucgauacccacucccuuucucucucauuauaaaacaacaggcuucuaagaacuaacauccaaacauggcaaaauaaaguacaauaagguaaagaaaaccuaucacacugaaacuggaaaacgcaaugcaaaacaaggaaaagagacagagaccaggagacauuacaagaaucagaaauacccuuucacacacucacgauuaccauaaaaaaugcuaaacugaaagcucuaauaucucugcagaggacguggugcaaacccauguagaucucaugcuugcuguucagucuuuuugaaugcacguaugagcuuugcucaguugauuuagagguccuuauuuucaugauguccuucauccacucuggcuccuacacucugcuuccucuucugcagaguccuccucuuaaagauggagggaguuuaucauacuaauucaaaugcugcugaauaauuugucucucauccuuuuaaacuuguuggaaauguauaggaucaauguccugaacucuagugugggugacucuauuuuggcguaugcgcgugcgugcgugugugugugcauaaauauaugcgugucuguaccauuuauuuucauaauacuaaaaacuaaggcaaaaauugaagcucacuaaacuaaguguggaagacaucgucccuggcucaguugguaaagugcuuguugcuaagcaugaggacaugaggaaggauaaccaacauccaccaagaacugggcauggcauucuuggucuauaacccagguaauaggaggcagagauagguagauccuggggccucaaugcuuaaccagucuagugaaaauaguuacuauucuaguguugugaaaagacaccaugaucaaggcaacuccuacaaaagaaauuauuuaauugggggcuugccuacaaaucuaggggguuagucuaagaccauuaaagcagaaagcagacaggcaugaugcuggagcaguagcugagauguuugcauccugaucagcagguagcauccagagagaaagaaaugagagggagagagagagagagagagaccucagucuagagacuagaccaggcauagacuuucaaaagccucuauucccacccucagcaacacacuucuuccaacaagagcacacuucuuaauccaucccaaacaguucaacuaacuggggauccagcauccagauauaugaacguauggaggccacucuuauuuaaaccaccauacccugugacuuugcuaugugucaagaaguuacaggugguguuucuagacauguucauaauucuuucucugucuuuuguucacuguagcucuucuuacacuguauuucuagaaauaucaauucugggcuuuauauaaaacuguaucucuaauuguaauucccugaacccaaauguguguguguguguguguguacuuguagauguauguguguguacauauguguguacuuguacauauguguaugcuuguguguguguguguguguguguguuuguguuucauuuugcuguugaugguuuauauauuuuguuuuuaaaugagacauauuuuagauuuauuauggaaauguuuccauuuuuuucuaaauauuuuuugagucauuugaucugugacacuaaauauauguccguagguguauagcuaagaauaucaucaauauaauaugugcuaccgccuuccacuguaugcaucaaagucagugacacagaugacacacacauuagagacacauccgaagaagacaccuuccaucuaggcauccauuuggccuugcuuugcaguccuuaaauucaugggagaaaauguucucaaaggacuucucugcagggagugacauccuggcaggcaaagauaaugcuuuaaaguucagacagcgaugcagcaaaaucaaaacuggggugggcagagucaaccagugaagagaauguucaguacguuuagccaugugcuugggugggaaagucuuuggcuaauaagccagcccacacuacacacuuaauaaaaagagggugucuagaaaagauauagcuaaaacauacucaaguaaagcauguaggacgagauaguuaccuuagagauaaauuugaaaaccucuucacacaugcuccacuuuaccacagucagaugcaggaucaguggccauuuacccccucagaacacuaaguuaacagucacuacaaaaucacaacaacgcaaacuagauauaagacauuuacaaguaccugcaaagcaucuaguguuaaugauuauaaauuccagguagccagauaaaagcucucuuuuucuuucuuuauuuaucugcauaucugauauucaagugaaaaucaauauaccaaaagccauguaacauaguuuuggucacuuaagacauuuucaaggaaaaaaagauauacauauacacacaaaugcacaugugcucucucgcucucucucucucucucucucucucucucucucucucugaaacugaacuaagacauuuuaaaaaguauaguuuuucaccuaaccuauuauuuuccaauuguuguauuuuugcuguuguuaucacccacuaaggagcuauuuauuuauuuauuuauuuauuuauuugccugauugccuccuuggaauauuaguaacacaauuuucccauguauuguuuuagauguugccuuauauauauguaugcuuuauacauugucuuaggguuuuaaugcuauguagacacaacauagccauggcaacacuuauaaaagaagauauuuaacuggggcuggcuuacaguuuagagguuuagucccuuaucaucauggcaggaagcauagcagugugcaggcagacauggugcugaagaaggagcugagaggucuccaucuugaucuacaggcagcaguagaagacugaaugcuacacugggcauaaucugagcaaaugaucccucauaaucugccuccacagggcacacuuccuccaaucaggucacauaucucugaauagugccacucccuaugugcugagcauucacacacgugagucuaugaaggccauuccuauucaaacuaccacacacauaaaaagaaaacuguucuccuaagaaaucaauuuuaguguuauuuauuuuagagauuauaacuacaucuuccaccuuuccuuuuuucccaauaaacuaaaugcacuuuuuaccugcaugugugucauaucagccccaugaauuaaugcuguccccagcgggggauacugcuucuccuccacacacaugcugguuucuauaggugaaaagccugccucucgaaacuucuuugcuggggaauuggcguuaacuguguuuucuuuaugcaauuguuuccagacuauuacagggagugauggcaaagguaacauaugcucugagaaugggaaacacaaaauucugucaaauagggaauguauuugagauucaccaguuuaaacuauaagcaaacagaguagccuucuuaauaaaugcuccuaagacaguggacuuuuauaugcaaaaaaaucaagguuuuccccuuacagaaaaauuaauucaaagugggucaauggcauaaugaaucuauucacucuauaaaacuuaaaagaaaccguaguguuaaucuuccuauuugugagaaaguaguguuuucuuagauaggcauaaguaauauaugcauuuaaaaucaaaaugauagauaaauugguccccaucaaaauguauuaguaacuguuuuuaaauuuauuaauauccauuauaacuugaaccaucaaagaagugaagacaauuugaaaacuggaagagacaauguacagaugaguuugggaagcaacuuguacaccaaaauccuuacaauaaguaauauacuuauuauauacuuacugucuuuuauuaguauauacuaauuguucagauaucagaauugauugggaucauuucaaacaugcaugugauguacuuuggccauauccacaugcuuagauaaucuuguuuuuaaaaagcaaauuaagcaucuagccagccauucuccaaacaaacuaugcaaauggacaguaagcacacgacaagaacuucaacaacgucacacaccagaaaauaucgaauuaaaggcaccaaaucauaagacuuucaccccaaaggcacuguaaccaaaaacagugaauaagggguagccgugcuggaagugggagcccccaccuguaaagucagagugugacagacccaggcuagcggacccuauguaauaauagcauuaguaacccagaagccaccgcagcaucuaggcgugucuuuaaugauugagauaauguauguaaacuggagggacuaagaaaagaaaugaaagcauauccaugucuguguagaaacucguauaugaacguucauaauagggucauuguaagaccacagagggggaacaauccuuagacacacaaguccucaaugauauaaacaaauuguacauacaacugaaagguauuagcaaauaagcagaaagcccugaugcauacaggaagggaauggagccaugcagcauagcuucuugauaagcagggagcauuuguggaugagcaugaagguuccuuuugaaggugauggaaauggucucaaguuaguguagugauggcuaugaaacuagucaaacuuacugaacuaccaaaagggaaugaaguaagauuuguauacacagucagguaaauaaagauguuauucaaaaaaauugcagcaaagaaaaaugaagcagucagacuuucucacacccuuccuugcucuuuagagccaggacucugcuaugcccaguaagcucaguuuugcuuuguaguaggguaguggcugccagcacagaacccaccagcaacagucacaucaaagcuccaggaagugcuucuucaagaaaugcccuugauaggaagcuagaaagugcgugcggucaucauacugugauguucuagcaacuccuaaagacuugggggggggggggguaguaagcuugugcaaaaucauaacaaauuugaaaacaagaaaacaauuauauucaaagacagcaaaaaucaggcaggacaaggacuguuacaguaguuaacacccugguucugcuucaggugguauuuagauaguguucuaagguaaauauuuaauucugacuucauuaagugcauggaaagaguguguguggaggcagggggguugaaaauggcagauauaggacagaaugggagacaaagcuucuguuuccacuuugaagaugcagagaaaaagaucuggcauuuucaucagcggcagccuauuuaggagcagggagcuaaguacuguuuauaguaaaacaauccauuaagagggagugaggaaaaggugggagggguaccacaggggguguucuuuauugcuucuuuaauucaccagucuuguggguccaagucacuuuauacacacauccuacaauuaauggcaaauguuuauaaauugcacaguguggcaaagauauuuuaaaacuugguaaggauaacauggaaaaauuccuauuauacuuuauauaaguuggguucuugggcauaaagcaacuugguaacaaaugaaauauuuuaacauacuuagcaggcaaaauccccagcuuuguucccucaaaaagcaaaggaagacuccucaggugcagugaauuuaugcaaugagucacuggcuuucaaauacaauaaauaugacaguuguguugacaaagucugagccugagaauucaaagggcuuagcuagcauuuaaccuuucauauugaacuuggccuauuuuacauauuaacucauuaauucauucauuaagucacucagaaaauauacaugagcucaauauggucaguugggguaaaaauaaaacugugaccuuggaacugugggcaagaaaauaauuuuucugauauucuauuauucuuagaauauugaccaccaugcacauguaaauacaaagucauucauccaggcagugugguuggaagaccugggaaacuuggacuuaauauuauacagagcuauuauaugcacacauaucugaaggacauuuuuaaaaguacuaaaccauaaauauucugauucacugcuuucucacauguacuaaaagugacuucacacaaucgcuaaagaggagguagguuuugugucuugcugaaaaugucacuuaauaaauaaccuucagacuuaaaugcaagcuaugggugucaaucauagauccucagacuuguccuugaaguugaagugggcaaugaaguaacuaaaaauuuugucuuucauuaacacaauguuacuuuaaguuuaugaaaaugagucaaaacuuucgagauuuccuaaagauuuacuuugcuuuuaauuauguuuaguguguguguguguguguguguguguguguguguguguguguguguguguugggcggugggggagggagugcacaugcagggacccuuggagaagaguugcaucagaucccuguagcagaaguuaccugcagcugugaaggaauuguugggguugaacucaguuccauuucaagagcaguucacacucauaaacacugagcuaucucuccagguucaaccuacaagauuuuaauauaauauucuuauacuuaagaaagagcauuucuuauacagcacuuaaauugagggugccaaguaaagcuuuaggauaguuuucaaguuuuauuucccaaccacagguuaaauuauuauaaguuuuaggggaaaacaauuuaugucauaauuuauuuauauaaccuaucuacucaaaaagugauuuccuguucacagaaguaugucucaacuguccugauccuauauuuugaugcacauuagguguccaguaauuauaauucaaaaaacuaaagcaaagaaacauuccaaggaccuacaaagucagggauagcaaagcagacaucugaugagggcaauuuucagaaggaaaauuugcaagcagauauuuuugagauuauuugacauuaacuucaucauuacauagcaagccuccucaauauuccucauccauaggugaguaugucaacacuagguauaguugguagaacaauggccaccaauggugcccauguugcagcaucacuaacuucaguuaauuuagccuuaucugacauuguaguaugaagguggcagauggagcugcauaaaggauaagcuggaggaaguaaccuaggcagaugaggccacccaauguagauacagaucuuaacagauggaagaaguugacugagcaacaugaucucauaccaaguaacuaucaccugcuuggauauccaugggaagcagcaaggaugacuucucaucuauucauagccuauggguuccaaugugaacucaucaaauacugauggauaaagagauugacagauugaucagacagaacaguacauuuugaaugguaguaaugaugaagauaccacugaaugcaagcuuuugaacaaagugaguuaagaucauagaagcagaugugcuagaacuugaaccuugguguucgagacaacuuuccuugaucaguauagccuccucccuccucaaagaaguuucucuuuauaggagauuauuccaagaaaccacaacuggacacaaugcagacaucaguagauugugaugagcccagauccaauagauguaucucuaucagagcuucugcauauaugacuuagaaaauauugaagaagauggggcaaaaagaguguaagagccagaauaugaggaagucugcgaaauagucucuuacaaaugacuguauaaauaagugcauagcaauaacaaaggacuuauuaacauaaaaggcauaaaauuucauagguuaaccccacaaaaaaaaaaaaaaccuguagguaaccauugacuguugggagaagaauuagccucucccugcaaugaauugcuuauugguuucuauaugaauauaauuagucucgagacuauauacacacaaacaacagaaaugagcucagugcgugcauaaacacacacacacacacacacacacacacauauaacacauauccucaaagaaaauaaagauagcagauuuagagugaggagcaaggaaggguuugacagagauuaacuuggaagaucuggauguacaaaagggaguggagaagugauguaauuccauuucaauuuaaaaaauaauaacaaaaagaaccacuuagggcagaccaaagcaaacgcuucacagauauggaguaagucugcuucccagccucugauuuucccugggcaaaaggauacaguaauuuugaaaaugacauuccagcgcccuauccauccaccacuaacaaaagcggacaagugacaagcaugauuaaucacucagccccguuugaauagggcccuguaggcccugucaaaauaaccuguggcuaaggauucuacaugaaguuaacugacuuccucugugugaucagggcuucucuaacaaaguaaacaauucacuagguaaaaucugcacagaucagagucgauacugaacacacaagauuuaccuacaaauuauguguaugguaagguguaauuugauuaguuagguaauuuuaucacagccauuucaguaggcagaaaagaaggguuuagagauuuggagaauuuuuuuuuuuuguuuuacaaaaguguuggguaaaauaaaaacuuacuauguuuaaauuaauauccaauucucuuuuggaauaaauuuuauucaauuacuaguuuaaauuuuccuagaagaaaagccuuucagguuuuucucuuuuuuagaagaauguacuucuggugagauucuugucauggucaauaaacaagauggcaggaaauagcccucucaagguagcaauuaacaugauggucccucccaagucccacauuguguauuuaauguaaagaagccauuauuauuggcuagaaugagaugggaaagcaaucucccugaagggcaugucugaagggcuuccagagauguguaaaaucgcaagaagagugauguucugaaacauuuuuuaaaaauuguuaauagcaucucaucuugauguauguaaaauauuaaagagacacuuuauauaaucuuuauuaaaauaauuaauauuuaaaauauaccauguauagagcacaagcaugacacauugcuuucugguauuugaaggaguccuugacuucuuauuauuuuccugcacacccacaggaccuguuuucucugcugagaagacauuaauuuguuauuuuccacgauuuuuuuuuuuugucuuugcuuuuuuccacaucuaauucagcuuuggcauccuaagcuuuucuuaaucaggaggugccuaagcuuuuagaacaccgaaccacucuuuuucaugcucaugaaauaguauguuauaguuugcacauaaaacagucuccccacagcaaucaugugcaagagccuugauccccaggacuuuucacuucucugggacauucuggaaauguuagaagguggaacacagcuaaagggaaggguauggggaguaucucgcaccuagccucugaucugcugcuucuuuucuaccauaacaugaagaaauuccuccaccauaugcucauacugucaccaugcucugucugagcacguggguccgagcugaccuggaugaaucucuaaaaccagaaguggaaaaauccuccuucaagcuggcaucuugggugcuuuggucacagugacaugaaagaaaugaaaacacuaaaauuguacaucucuuucuggauagagccucuuucucacucucaggcuuagaaauucucaggagagggcuguguguccuuauuauucacuaaugucuucugcucccaguccucagcacuauccacaccaugcuaucuccaguuggcucacucaauaaacagcuaaggaauaaaucaauaaaaauccuccaccuaaauauuugccaaaaauuuaucuuccacauggacuagguaauccacagguauaacaccaguguaucuauacaucgauuugaugcuauauuuuugucugcucauuugcaaauaguggccauuugcuauauuuauauugaguuuuagagaaacaaaaaugaaucugaaacaaaacucuacccaugacaacagcagcaauggcaugaaauguuccuugaaucaaggaacuggccuagcuaccuuaaauaauuugagaaacaacaaauuuauuaaaacagcgaacagacucucugggagcucaacugaaugaaccuuggcauugccauguuuucuaauccauaaaaaacaggucuuuuaauacgcagccauaguuagcccaaccuaggccaggccaagccagccagguuagccaaccccagggcagccuauguagugaggauuguuagugaaaacauucauguuguugaauuuagcaagaaaaguuauaagugcaagaacauaaaaugguuuuuauuagagacaucuauaacuucaguuuaugggacaaaucuauugcaauuugcauucuaaaacaguuauauuagaauaacaaaagaucuuucccacauuuuauuaaauuauuaagaaaugacaggggaaaggaugagaaaaucuuuucccaucauuuaacagggcauggacuuuugccuuuuacuuaaucccuuuucacguauaaaaaauuaaaguuuauugguucaugacaacugaaacucuuuuguccaugugaaaacucuagaacauggauuuuaccacgcucauuaugacaaacaacaaacaaagcagcuuagcuacgcucucaggaaaaccuguucccuggauacacucagcccaccugaauuucuaauucacuagaguggucagcuaauucaucugggcuuauuugagaaccacaauauucuaugcuaccaacacaacguuuauuuuuguccuaaacucuauuugauucuaaacaauuccuuacuuauaauacuugucuauacaucccccaggcaagcccuaacaugaccuccuagcuccucuauuauaugaaaagacucagauuuucucaguguacugaacuuucauacugcugaagauacgaaugaauagcuuucuuucaucaggagcauuucuaaugcucugugcugaguugaaugagcauguaucuugugccccauuaaaucagaaaacugugaguuucacagauguugacuuggacauaggucaucagucuaaugcaggcagaauugcuggcagauaugugacuacuaauugucuaaguuccaagguugagcaguguuacuuucucagauuguuugggaucaacauuguuggaaagaaaagcuacauggcagaaagugaccuucucuguuaucauguguucucauggguggccauaaaaagccuuacaaucuauaguuuuggaauuagaugacuuucuuugggugcacaaauuaaaguauguccuauacauuaaaacaauguaguaauuaccauucuuccaccagcugacuugauggaaggacaguaugagagaauagguagaucuuaaauauguauguauguaugucuauucuuauagaaauauuuuaaaggcccaaagacauaaucugacacaucauaaucagucuguaaagagaaagcauuaaaaaaggaugucaguucacagcugagaacaggaagacaaaguauaaaugauagaauauucauuucaaacucauucucaucugggagucuuaacauauaaacuugugagaacuuaucucaguuacuaaagaugcaucaacaguuuacaaagcaacauaaugaaauggaacacagaaaaucaugugaccuuuuucaaauaggucacaauaggcauaaaaaaauaacacauauaacauauacuugcuuaaaaacacacuguacuguuauccuaguuguguucuagacagcugaugaugaucaagagagaauuaaaaaugcaagaaacuagcugggugugguggugcaugccuuuaaucccaguaauugggaggcagaggcagguagauuucugaguucgaggccagccuggucuacaaagugaguuccaggacagccagggcuacacagagaaacccugucucggccacaaaaaaaaaaaaaaaaaaaaaaaaaaguaagaaacuaucuguuucugaaugagccagguuuuaucuaugaacaaauuacauuuuaaugucuggagaugaaguggagugauagcucaaugguuaggaguguuggaacuucuuucagaggacugggauuugguuuccagcauccaaauaguagcucaccacaauuaccugaaacuccaauucuaggggaccugaugccuucuucuggccagcacaguguucagccauaaacauaagcaaaucacucacacagguaaacauuuucaacacuaauaguuaaagucuagaaaugcauauagagauauaucagaaacuauuguucacaggagugaaagcucacaauggaaaauaaacuauacacaggaaaaaaaaaaucaauggcuguucucagauacugcagagagcuaaggccacaggggcagccacuaccccaaaacauaggacagacaauuuaaaagaaucagaguuaaggacagcuaagcugcugacaccaggauggaggacugauagacugugauaaauaauaaaagaacagagaaaaaaaaugaccaauuucuggagaauugaauugacuaccuaaaguuacaaaaucuuggacacccauaugcauuuuaucuugagaacuuccuggugaagccugggauaaacuucucugacgaaauagaaaagauaaccauuuucuaagccucucaggcugcucuuuaaaucgucucacuccuuggaaaaacaccaaaguuucagccuacguggaccaaaggguaccuguccuuccuagucauguuuccucuucaagugugaaggcagaagaggaaaaaagcuagaaaacaguauagaaaauuagauuuaaagacauggcaacaccaaaaaccuacaucagcaacauggcaugguaggacauguccccuccccagcuccuaaccacggccucaggaaugugucagugcaacuacaguggaccauugcuaagguuggaaagacauggguuccauuucaaaagcaguuuuuuagagaaguguagagacaaggaagagagaaaaaauacaaggaagucgacuaccagcacuuacaacaaccaccagcauugaacacagcccacguccuacugagacagacauuaaacaucauaaagcauccuaaugucucagggauuauucuaaguauuuaauuuuaaaacuucauaagucuugcuaacgaaaaugccuuuaaaacaauuuuaacauauuugaacugaacuaaaaacaaaucuaacuuacucaaacuuuuagagauaaagaagaaaugcuaggcagcgguggcacauucacuuaaccacagcaguugggaggcacaggcaggcagaucucugugaguucaaggccagccuggucuacagagugaguuccaauauauccauggcuguuacaaagagaaacugugccuugaaaaauaaaaagcaacaacaacaacaacaauaacaaaaaacaaucagaagaaacaauguuuaacaagacaguucaaaggucucugugcauauauaagaaauaaaaaagguuaaaaauuuaaaagucaauaauauuaaugaaaauaguagcaguaauccuagcaugcaagagguagaggcaggaggauuaaacaguucaaaaccagucucuucuauauagcaaguucagggccagauccuaacacaagagaaaaaaguaaucuguauuauuaauauaguuaugaaagaugagucauaauuacugauuccuccagacacacaaaaauaugcuaaagaaauaagucuguaaucaaauauucaacaacaugaauaaauugaaacgagccuaauauugcugcacacacuuuacuccagucuucaagagcuugagacaggaggauucugaucauguagugggauagauaguaucucaaaaauaagagcaaauaaaauuaaauaaauugaaccaauuccuugacugaauccaucagaacccacaaaaagaggagcagaugacaugaaucaucuucaucaggauuuugaaaaagaaaugagaccaauugucuacauacucauugaaaaaaacagaaacaaaaggaacacuucccaagucauuacuucaugccuaaaccagaguagaucugcaaaauauggaaacaacacuaaauaucaaaaaaaaucaauaaauguaauauguauaccaaugggaggcuaaagaagaaaauucacaucaacagagaaaguauuuaauguaguucuauacucaagauuuaaaaugucuggcaaacuaaaaacagaaauaacuuccuuaaccugauagaaaaacucuauuaacaaccuauaacaaagaaaacuuuacaccuaauggugagaacguagauucuccuuuaagaucuacaguguuaagcauguaucaaaguucuggagcaucuguucagaaugcagaaggcccuuuccuucauuccucucucucucucucucucucucucucucucucucucucucucucucucucucucucucucucucucgugugugugugugugugugugugugugugagacccucugaauuuaccuagggauguuugugugaccaugaguuugguacuauccauugcagacugaugggaucaccauuugauacauaacugaaggcaacaacuguuccucuuccaguacccaucaguuacuaacuguucaacagaaagagcuagcccccucgagccucuuccucacccaugacauggccagggccugcccugugcagcccaggguaggaauuauagcucuugugagaucacguuauggccugaugacugcuuuuuuccucucccugucuugcagaucuuauacucuuaccaugacaucuuugagauguuaccugagcccuaaaggagauggcauaaauguccuuucugacuuaucaguaaagcaucauuuaugcuaaauauuaugagcagccaugcaucuuugcauucccuauaaagaaaagcucugggacaaaagaugagagcaguaucugcuaugggaauaagcauacauauguaggcuacaguuuggugccauguuaucuuugcuaaaacacuguuucagguccuacauggggucuaugaccuccagccacgcguuuuugaucauguuuacaauaaugggcaugcauucccuccuguagaauggaccuucaaaucuaagccaagauucagugguguuuaucauauuaacaaucacgucacuacucaccaguguguguggcaggggugggaguagggcugaguuaugacacccagcaaauagauauaaaggaaaaucauuaucucaauacuuuaaaccuagaaagauaaaugucauguuuuaucuaauaaucagauuuacauuuuaauuucuuuuauauguauaugggaugauauagauugugaaaauugacaacaaaauuuuugaagaggaaagagagacuuuaagggaaaguugguaagguuaaauaaaaaaggauggaaugggguagaugaggacugaaggaaaaaggaagaaaaaggaacccauaggaagggacaaggggaaugaggggcacauggggaaagugaaccaacaaaaaaguaggauuauaaaaacaccuaauacaaucgguuacuuuaaaaaacaguaacaaaggaaaaugcaauaaaugaucauuggaaacuaaaaaguaaaagguucuauaaaagaaugaaacgguaagccacagaguaguagaaauuauuuguagaacacauauaugacagaugaaaaaacugauauuccaaaauauauuaaaaacucauaaaacucaacuauaagguaaaaaauucauacaggagagauggcuagaugaguaagggugcuuucugccacaccuguugacaugaauacaucccucggaagcaguuaauagaaggaaauaacuuucucuucaaguuguucucugaccuucauacaugcauggcuaugcuacuuccauacacauuagauagauagacagacagacagauagacagacagacagacaaauaggagguaaaggcaauuuaaaagaauuaaaacaaucuaauuuuaaauauggaaaaccuacagacaccucaguaaagaacauauauaaacauuaaacaaagaaaagacauaacaucagaagccauuagaaaaauuguaaacauaagcaaggugccacuguauacgugcuaacauuuaaccaauacaaacuaacagguuuagguaccaggaagacucaggaacauucauuggaaaggcaauaucauguagauauuuuagaaaaccuuucugcagcucuuuguuaaugaucucagaaucccauaauccagcugaauaccuauuauuccaacaguagggaaucuaagacagaaguauugugaguucuggcccaguaugauguauuaaaagagacuccuaauacccucccaaguuaguaaaaagaaaagaacuagcagcccaugaaaauacauaaucucaaaugugcaucguguaaugaaagaaggcagugcagaaugaaccuccacuauucuaugccaacaauaccacacuccaaaugacaaaaccagagaugaagaaaaaagguucaauaaaaggaauugugagaacaguauggaauguuguguauguguguaaaacuguaaugauagagaugauacacacucacagaaaucuaaaaaaaaaaaaggacuucauuuauauggauuaacagcaauauuggcuugaugauucaaguauaacagacuuaaaacauuaauaaauaaaauugaagcaagaacucuguauuaucugccauuuuucugaaacacaaacuucaaaacacauuuauacuuaaaaguaaauauaucuuuaaaauuaccuaagaaggucuuuggguaggagagggggaggguccaaaaccaggaaccagaaaccagaaccagggagaaucuguuacuuacauuucauuucgguguuugaaggacucaaaugauggauugaacugccacuuggauguagacgcaguuccaagaauggggcuugacugaaagaacacagccccuggagacugcgccuuaugaguguagccaggcuucgggaggaggacaccacuacuguaaaguauggccucuugugucaauguucaacagcaagaacaacuguauagaguagagggguuucagaaugugagauaaaauuccuuucacugcacauauuaaaagaacugauugaugagaacgcauagcggacauggaaaugggugugugugagcaugugcaugguugauguacacagcaguauuucuaagaauuagcuucccccucuccacuuggcuuuacuuccuuaguucauucacuucaaguuuuaagcccuugcucucuuauaaaagcaugcaauucaggaaucuuuaguauauucacaaagucauauaucuuuccagaagccagcucuuuuacuucaaauacuuuuuacuucuaaguguguguuggcgugugugugucuguguaucugugugugugugugugugugugugugugugugugugugugugugacugugugucuguguaucucuguguguguaugucugugugcaccugcuguggccagaagagggugcugggccuucuggaucuggaguuacaggugacagugagcucucagauauccaugcucugauccaaacucuggucuuugaaagaaaaggacaagcucuuaaccacugagccaccucugcagccccauaauguugauuuucaacauagcccucguauucgguauacauaaagggaaaguuggcuguaguggaggccucuaggagggaucccugacuguagaaaacgaugauuaacuugcaacaagccugacugcagccugacuuuccagccaucgaguagcccgagacuugguuaguuucaccacaaaagacugccuucugaccuagcaaaaaaaaaaaaaugaaguguaaaacuacucauuuggaauaaauaaugaaagaaagguugagagaugagugcacuggaagagacagaggaggaaggugugggccaaagguauacaguguggaaagaaaguucugagggcacggucgaaagacaaugcauucuaaagauuaccuuuauuagacuccauuggaucaggagccaauucauuaaacauuaauggcaggggaaugccauccauauauuauaaauagucauuaaguugagacagacagcucugcacaggucaguaugaauuaauaaaaaaacugaagcuggcauuucagaaucauaaaaggauagauuuaguagaaaauauucaauaagaauaaggaagaauggcauauauuacucuauuugucugaagaacaaacuaaaaaugagaacaaauuuaccauaaaccuaaaaauacccuucugaaugaaaugaguauuccuuaaaaauggguaucacuuacauuuaaggagcucagcggcucagugugugacauugccaaauggugaaugaaaggacacaggagaagauauucagguuuaaguuagacaaaauauucaggaaaaugaaguauccuccucaauccaguugcaggugugaagcaaagcagcagggcugagcugcucuccauacacaggucaaggucaaaggucaaauguggauccuaccccacucacuugaccacaugagccucauucaaaaugauggcuauuuuaauacccuucuuauccacuguugcuacuacacacaaagucugugauaaaaucaaaaucaguguacucaaggaugcuugcaaaaauaacugcauuuaaucauuuaucuuucugacaccugucaaacugcccacauugauuaagggacauuccuguaugauuguucuugauauuuccuguggcagcuaagaugauucaagagucagugacccuagcuaagacuuauuaaaagcuuugauauauaauggcagaggccccagcaauccaguuacuuuucuguagcacuuggagcugagucuacgacuuccacacugcaauguuccggggaagcauuucauagucaaaccauaauagauuuugcuuauucaacccacccuaauauuagagaguucuucaagaugauaaacuaguguugacuuuguuacaauuacuuaaaacuaugagguuauagguuagccugcaaguuuuaucugauacaaaaggaaauuacaagggucauguucaucucacuucaugcaaauaauuuaauucauaucuaaacuagaaaucagauucgaauauucuccuuucccucaccuauacuuuuuaaacaaaaugccuauaaauaucuuuaucuucaaauugccuccaaauuacaucuacuuccuauuagaauuauuaacucuuagauuuauuugauguaaguaauacauucacauuuuuauuugaaagaugcuuugugggaagcccaucuuaagcucaaaccuaaggacugcauaaaagaaaauagcacuuuccuuucaguaauaacuuaaauaaguaauauaaauaauaguuucuucauaaauguaugagaucaaaacuuuuuaaagaauuucuaauaacuuugucaauugaaaugaacugaaaaauaaaagcagcuguuacugagaguuacccuaccuuaauuaaggggcuccauugaaaauuauaauuucuagccgucuccugcgagucucugacagugccugccaaauacagaaguggaugcucacaaucauccauuggauggagcacaagguccccaaugaaggagccagagaaauacccagggaguugaagggaacugaagccccauaaaaggaacauuaauauuaacuaaccaguacccccagagcuccuuggaacuauaccaccaaucaaagaaaacacauggugggacauauggcucuagcuguauauguagcagaggauggccuaguuggucauugauggcaggagaggcccuugguccugugaaggcccuaugccucaguauagcaggaccaggaaugggagugggugggcuggagaacaggggagggggggaggggauaggggauuuucagaggggaaacuaggaaaggggguaacauuuaaaauguaaauaaagaaaauaucuaauaaaaauauauggacaaaaaagaaaauuauaauuucauagucuuugacuuugguuaauuuugguacaugucugggaguuuuauucaauguuuuuguaauaaagauuauaaacuuuuuaaaaaaugaaaaaaauauaacuguagcaauguagaauagaaaaugacaauuuacccgaagauuacuuugagauuaacacuaauuugaaaugugaaugaaauuagauauaaguaaugauaccaaaaauaaguucauggcccacaaauuguccugguggccuacugucacccaaaauaugucaaugaacuacguuauaaauggaaugcaugaaacagaugauagacgguauguuuauaaaguauagcauuuuaaugaaacccuugaugacuuuuucaaguguccguuuggcuaaggagaaccauacuccacaucacucagcuuaacacugcccuagacacuucucaauagccagaauuuagaacugaagaugcaacuacagucauuuuuggagagcugauauaccacugucuuagccaggguuucuuuuccugcacaaacaucaugaccaagaagcaaguuggggaggaaaggguuuauucagcuuacacuuccauacugcuguucaucaccaagguagucaggacuggaacucaagcaggucagaaagcaggagcugaugcagaggccauggagggauguuccuuacuggcuugcuuccccuggcuugcucagccugcucucuuauagaaccaagacuaccagcccagagauggucccacccacaaggagccuuucacccuugaucauuaauugagaaaaugccuuacaguuggaucucguggaggcauuuccucaacugaagcuccuuucucugugguaacuccagcugugucaaguugacacaaaacuagccaguacaaccacauuaaacucugauuauuuuucuggggagggguggucucucaucauucuuuuauggauuucaagcaguuuggaugaauuaggauaauuaacccuggaagguaauaagaguuacaaauacuugcccucaaacaaauauauuuuucuuguuauuuuuauguaucauucuauuuucuaagucccuugguacuaugcauauuucacuaaacagaauugaauuuuuaaaugaaguacuuauaaaggacauuuucaauauuagcauacaucaacaauguaauuuacaguacuucucacaauauuuuccucaaaguggugcuuuaugaguuuaaacauauuuugauaucauagagagcuguaucugaauuuuccuuguaacuagcaagcuaaucuaguauagcaagcauaaugaaaauguuguuuaaaagccagacagaagagcagcagagaaagccaguguuuacuauuucaauaauggucuucuaccagcaggcuuuuauacuacugagguccuucuucuuuaguauucuuucucuugaacaucauugaaagauaggugcauaaucuggagaucaauuccuucaauuugggaauauaaauucaaguauaagacagucccuaccuaagucuguuauuuuuagaugaucuuuccuaagguuuuuguuuuuuuuuuuuuuuuauuacaaagucagugauauucuuacacuuucccaagcagacaauuccuuuuaaauaaaugcuauccuggugacucuucauuuacaucagcgggauaauuuauuaacuaguaccagcacuuuuuguucucacacagaaaacucuugccacuuuaugaauuuucuuugugaacaauaaacucagucaaaucaucacuaaaauggggacaguuucaucaaagugacuguaaaugucaagggaagccuucugcugccccuccaggcccguugcccccacccaccccagcucuguagcagaacaccuacuguggucuucccuuccccaagggaucacaaagauccucuccuccagccuuccucuccccauucaucuuucauccugaccucaaauaggagcagacauucucuguaaauauagcagcugagcaagucagagaaacuggcaagcuaacugaagacuuucaccacucccuauaaacucaaucccuaccucuguagggauuugcucuguaacagaacaaaugcuuuccauuuuuaucaacauccucauauuauuuugcugaacaaaagauaucauucugaauauacacaagacuuuuucaguaagauagcauuugacacucugaccucuguuuaaaauacaugcccgaugcuuauuguuuacuugguguuuucuugaaaaucugaagcaaucaaaugaguugaucuauuuuaucauuuuuguccagugccagugguacaugguauauggaagggcagaaaagaagaggguaaaggggaacgggaggggacgggaagagaggggaugggaagggaggagaggaaaagacuggaauuagugaaggaagaagaggcaaugaacgaaauaaagacaauaagggacacagcauccugaauuucuguacuaacuuaauaacauaguauccuuuaucaacagggcuagcaucucaccuugauuuugucauucaccaauaucaggaucuugugguugacuaacaagcccugugucagcuaucuauuaugacuuaacaaaucauucucaaaguucauauacaacuuuaucuccuaugguaaaguuacuggucagggaauacaauagcagcuuaacugaaugguuuugacuccagguccuagaaaguagagagcaauugacuccuuggagaaugaagagcaaucugcaagcuugacuggggcuggaggcaccaucuauaggauggcuucuugucaagcacagggaauuggugcugguugcugggaggccucauucuuguuccugaaguuuccugugggacuccugaaauguccucacuaauagugaugguugacuucccugcaccgcugcaaagugaguuuucaugaugcagucuuagaauaaacacacacacacacaccacacaccacacacacacacacacacacacacacacacacacacacauacacacacacaggcuuucauucuauucaguuagucaaagagaucaauaccuuacagugugaaaggagacaucaaaggggaagaugaaaaaggugaaagucauugguggucucccaagagguuaguggcuucuaaggcaggcuaccaagacauuaacuucauaaaaacauugauggcacugaguuacccaggaaucauuugaugaaugucagauuaauuaagcaaccuauaagcuuuauaggucgaagcacaauaaguuaguuuuuguagaugagucuuugcacaucuccuaggaugccucugaguauguaauaaugcaucacucccagcagaagaucucaguuauacugcaauacagcaaucaaaauauguuaacacauauuuaccauuugucauuuuauauuuaguuguuaaauaagacauggcaguagguacuagauacuguguuuucaaaauaauuaaaagcucaaauaguauguucagauggccauaauuuuaguauuaaauaauaucauaaauuucuuuuuacuuauuugauuuacauguguuaauuuuaccuaauaggucucauuaugguauuuguauacauaugaaauguauuuuuaucuucuucauucccauuccuaucuuuuacugcucuccugcugaacugacuccucuuuugaauucuucuacuuuacuguauuugcuagguuuuuuguuuguuugcuuuuuggugcccuagucaguuccaucagaguugcucacagagugcugggugagcaucuaucuguaggaaagugggcuccuuucuuaccaguggcugugccacucaaggaucugccuguuucccugcuagcaacuaucaacuaccuauacaucugcaagcaggagugguuucuugugcccuccuucccucuggcuacaacuguucuccuaaugggccugaggguggagagucucaugggcccuguaugcuugcugauccccuguuacacaggucuugagcugucaaucaccauguuaugaggugaagaguaugagagcaauggccuguuugaagacaacgauguaccaugcucugugcuuccccuacauucuugcugccuugucuucugugcuauccccaggggcgagugggugauacaaaagucuuauuuauggcugagcacucagcugucccuuaguuacagaacuuugaccaauuaugagccaagcuauaguuacagcuauccacuguaaacgggggcuucucuagccaaaguuggugaucauaauaaccuaaggggauagcuuuuuggacaacuacuuagauggggauuugaugaauauaccauguccauguagaaaacaaaaucucuacuaggccuguaaacccauggauguuauagacaucuauuagugaagaggucauuaacaaugccaugacaaacaguggucuuuagaaaauaaucauacuguaaaaacaggccaccuucuauuuaggugaauaagcagaaacauaauuuuaugucgcugucuugggucacaaauauuaugaguauuaucuaccuauggaccaaugguggccacuggauccugaaccaaacuuccuauucauccgacacuuaaaaagaaagacagagaggagaggagagaagauccaguguuuaauuucuucuaaaaauaugguuuccuucuuaguaaaaugucuauaguccauaguaucacccacugucuuccauggaauucucauuucaaaguaaucauuccuuggauugcacauacaucuccauaagacuuucauuuaaauguaugcuaaugaaacuuuaaaccuagauaaauacauuuauagaagugguguauuaaaaagccauuucaaguuugggauugaaagaaccuuuaauuuauagcuccagaaaaauauccauucuauggcucaaagauccucauggauuauaaaggaggaaaugacuaacagaaaaggaauuauucaccacauuauuaaacaugacaaaaagcuucugaauuggagcuuaaaacgggcuauuuaagauuccagcaaucccuaggacuuuggcaacaaaaauguucaaaagccuuuuauagcugcugucagauuuuuguaaagcaucugagauuccugugaacuuauuuauauaacaagcuggaaccugaagcugacuugaaagucuuucuacucuaauuauuuagaauuggaaaugccuagaaacgaugcucugccuucucccaagaauaucugccugcaauggcggcuucagaaacaagcauuuggaagcaagaaugagcauguagccacugcagcuuauuacaaggagcaguuacagcggauacacaaacuaugguuuagaaaagcaguuugaaagaacugcuauuagcuauucucucuguagcagcacauuguaaauggcugcucauauuguucccuccuggccuacuauagcaguuuauuucugaagcucuauaguucauguguaaucauguagcaaaauaauucaggauauaaugacccaccaggaucuuaacugauugaaguucuuaucauaguacugugccuacugcucggcauggcuucucaaaugaauccuuuaaccucugcgccucugcauuccaacuugacguaaggcucuucuacuuuacaagagucaguauuuacuccaagcuauaaaaucuaggagaugcgguccaaaugaugacaugaugaugaugaugauggugauggugauggugaugaugaugaugaugauauaaauccugagcaggggcuuugcuucacagcuucuaaaaaagcuucuaaugauucuucccaguuucagucacacucauuuaauaagccccucuuuuuaagauuugggcuauaucuaaugauuacauuuuaacaaauagaccacaauuuguuuguaaaugacuaugacuccaaccuuuguuuuuugccugagucuucaugcuugcucuaccacaaaaaacuagcugcccuccggauaacccccuauggcaaggacucagagagcaacagucagucagacuccccaggggagcugaguccugccaacagucaugugauggugcugggaggaagagugucuggugagauuuggaugcugaucugggagauguugcaugacugguccaaauuccagcucuagcaagggaaggacuaugacagguacaugaagcagccccuccuagcucccaggccuuuacuucaucucuugcaccacacuauauucauucuuucccaaacaaugcauugagcuuuuaccauuuggaaaccaggaugucuuugcccagagaugggaaggcaugacugaaagaaguaggcuuggcacaaaguagaaaaaguuagcggaggagcuggcaggguggagcacucaccaaggagccugcagaggagcugccagguggagcuuuccuugaacugccugcacugaaauccccucuggucuccugggcugaugaggaauguccaagcccugaagcccagagaaagucaaguggccccauaucacauuuccgagauugagauaguuuuacuugaccuuucaauuuagcagacauaauaaagcaucucaauauggacucaucccucacuaaaaguggaucuuaaguccaguaacugauguuuuuauaaaagaaaagaugagagagacuggggaaagaauuuaguuuauaagguucuuacugccacaagccugcagaccugaguaccuaguacccacauggaaagaacuaagcaugguagucuaugauuauaauaauagcauaagggagauggagauaggcagucgccuuugguucccugacaagugagcccagccuacuugacauguuaaaagacaaaugucucaaaaguaaaaaugaaccauaccugaaauugacuucuggccucucugugcaugcauuuacacauggucacccucuaugcacauacacauggacacacaugguaauccugcucaccacauacaugcaaaugaaagggaugcugaacacaaagagauuuuuacaagaugauaugaagacagggucaaacacaggcacuuaaauguugcaaacuuaggaaacaacagagccacuaauagccagaagagacaagugaggauucuugcuaagagacugcagaggguguguggaccugcccauauguugaugaugaaaguauaauguaaaaacaaaauucuaggccuuuaggcccagguuugggaaugugaccucugugacuuaaugcuccaagguaugcuaaucauaaaacagauagcgacauuccuccacccaccagauuccuggguucaaagaguguucauucaaagaaagucacccugaccauugcaggaacccgcuaugcaaaugugcuauuguuagggacucuuagaaacugucuugagagauaaccagaacaauuaccagguauuccuugugacucuugugacuuugcacuuccuugggacucuuaacugguaucuuugguauuuuccaacaaagcccuccccacuuccuugaguugugguuucuuccuuuaaauacccccuuacccagcuacucugugugccacaguccucuaccccugcgugguguaugaccgugggcccgagagcgcucuugaauaaaaguccucuugcaguuuucagcaagaucguuucuuaugugauuuggggugucgccucuccugagucagaaugugggggaguccucacguugugggucuuucaaugacaggcuucuggccucuaguaccauaaaaguaaguucauguuguuuucagccaugauguuuguagugguuuguagcaauucaaagcaagaagcaaguaaugcuagaagucaacaagagacaggaacuaccaccucuacugucaggaccaccuuaacagggucaguugcuccaggucaagguacgaggaccaaggcgcauguaccuaguaaagaaagcaauaggauuucaccugcaauccaaaaacaccugguagagguguguguaaaaauaauuuucuauaauaugguauauaauuuauuuuaaaauaggaaguauaaaucaagauguauguuauauuguaguuaugaauaccaucuuuagauuaauauagucccaggcauaaauagauccacacaacaaacaaacaaacaaacaaacaaacaaaacaaaaccaaauagcaggguuucuuuccaauucaaaaauaaaagauaaaagucuggacagcaagauggcucaacagguauaagugcaugccaggcaggcucaguucacuaucuuagccccucagugaaagagaacugucuccuaaaagccauguuuuaaccuucccaugacugcuauggcacauaucacacacacacacacacucaaacacacuuuuaauugaugagccuaggaauagaaaguggcaccacccuaacauuaaaauuagcuacuuucugccugccuuuauacuucaaaaccaaaccuggacaguauguuuuauucuaaggaagccuuauaaugaguguaacacaugcaugacaauacagcuaggaacauaagauuauucuguggugugacaacagacaaugcauuuaaguggugggucagaguuucccacaccagaucaacuauaaacagagacuauuaaacacagaaagucaaaagaugaaacucaaaugucagagagcaaugggaaauacuuccugugaagaaaaaaaauguaggauguuuuugugauaggaauuaccuagucaugaaauguaggaugcuuuugugauaggacuuacauaguccuaaaaugaaacagaauggguguuuuuauugguuuuuuucauaugucaauuauuaaaucuagauagucaauuaagauacauauaccaaaccagagaucugcuguaugcaucaguguguguaaauauaucauaaacuauugaauuaaaacauuaaaacauuuuccacagcaaccuaaaguuauaccgagacuuuuuuugguuccuuggaugcaaauacauauaguagauuaaaacccaugaugcauucaaagcauaaaaucaccucuaaaaacaaguaauuuacagauaguaaacaaauacaguacauuacauaccuauguuuauagucauuauuuuccucauauaacauuucugugggugugugugagagaaaccuggcauucuaaaaugucaugaauuuccaaauucugaucacuaagauuucucugcuuauauuaauggagugcuuaugucuacuuugcaaaaccccaacugaaagaucacaauaaggcaauuccagauauagcugcaaagucacugucccugugaugggaggaaaacaucuauuucagggaccucuucugaccagacacugcauaauaagcauuaauggaagagaggucagggguagacugaaggucacuuaacuguaugcuuucuucacaacaaggcagagcugaagagucugaaacauaccugaaagauacaguuggaaaagaaguagucccuuguuuaaagccauaaaauucaauccgagaaaguguaauucccauucuguugcccuuccagaauuuaggggaaauugacugugcucacaggaaagaacuaacugagaugaaagaaucaggagcguuuaagagaagggucucaagugugcuuacaaguucagauccugagcuuucuggucaugcuggccauguuuugcaugaauuaaaucccacuguggaugggaucuaucaucauggacagcaaaccuaaguuuaaaaaacaaacaaacaaacaaacaaacaaacacauuaguugagaaggugaauucuaccucauguggcaccacagaauucacuagaagguaaaagcacugcaaauuacauuuuagaaagcaauuucagccauauguucuaccuugaaaccaccaauucccuuugaaccaauguucauuacaaacucuuuucaacaucugccuaagagcaacacagcaccauguuuucaagagcucaaaagggaaucuaagcuacacaauaaagcacaagggguugggggagggucauuaacaacugucauuguuaaagggaaaugcuggucaguuuuaugcauuaaaacagcccaugcaaaacauauuugacuaaauaagauaaauagcagagcugaucuuccaugaccaaguguacuuuagagaugccgaaaugcaucugacacauugaaauaugaagucaucaaauuuuacagcuggaaaagccucaccagaugaaucauucugaccucuccagagaagaccaggcuucaagagguuugaagaaugggaccaaggucagaggaaagcugguaccagagcuuggccgcaguguggauuuaauuucauuauuccacacuuuugguuucuaaauaccuacaagcuugaaugcaucauuaaaugagcacaaucaaagguuguuccuaaagaaacaauugcacaaguaaaucaguuuuagugaggggcaaacagcaacauagaacaugcacagggcagggucuaaaggcucaugggaagauugccacuuaauguugcagccauaaguuucaaaacauuucuccuugguuuucucuuuugucguauggaggauucuuagaucccucugcacaguuaggguguagcaguaacagaugggaugauguuuugucaguuccucauacaagcaaaaauaaaaggcagguguuucaucagaagaugaacuccuaucuaccugccuccuccaacagagcccagucuuuccuaauuuaccaugauuuucuccauugacucagaaacuaugggucuacuuguacaaacuacagcuauagaaggauuugaacgcccaucugcuccuacauaucaacccuauugauagacuucuggaguugucuccaaaauguuuacucuauuccaugagcccuauauucaguguaguccuuuguccugucuauucuaucaucagucacuuugcaaauguuccugauuucaagcuccugacuacagagcagucagaucaucucccgggagccuaauucuuaucuucuaaacuuauucuauauucucuuuggauuccuuagaugccuuugugcuucuuguauggaggaguauccuugacaaucaaauguuucuuaugggaauuuauggacaugguugaucccuacuuaguguguuauuuggggagauaauugaaccuuugggagacugaaucuacauggaagaagugggucacugaaggcaugcccaucccacgcucuccucuguuuucuguauaccagggcaaaauuggacuccuccaccacaugcugccaauaucauaauucuguccuguaccuggagccaagugaccauggucucaauugucuaaaaggaauugcuuccuccuuuaaaauauucucuugagucuuucauccacagcuauguaaauuaacacuaucacucauucauucaaaaagccaaaaugauuccccuuaaaugauuucuuuaaaaaaaaucuuauuuaaaacauuauuaugaacaucuucaaaaggcuuacaaccaccaaauaaacaccaacauuuuaaaauagaaaaauaucuguauggugaaagauacuguuaaacuagaggaaaaagaaaaaucaaaacuguaaaugcagcagagauuagguauguuuuacuaagagagugauguacaacuggaauuaccaagacuaacuacaagucugcacaauacaucuccaaccagacagguuggaucuaacuacacaugguuauccacugagccugacucuucaauuacaaacucaaccccauguguucaacuuguauacccagaagucuacuccagaaacagauaaaaucugaccuauaucugucaaaaguagcucacugcucugucugccuucccaaaguuucuggcucuucucuaauucuucuugagguaucccauagaucuccuugggcaggguuguacauggagacaaacacacacuagaagaagcaaucaauguaaucaaagcaaucaacgcuagcuuuugccacuuguuagaggacaaggugcagauuauuuuuuaugcuucugcauucccuagaauuucuaaacaguaaaacauacucauauauuacaucugugguuuuuuaaaaccauugaauaugaacuguaaccuuaccaauuaauaacuauaaguaagaaucuuaucacagagaaaagauguuggcuacgaggauuaacaucuugccuuggccauauguguauaaagcaguuaugagccaaugucacacuaauauguuucacauauauuuuaauugcuuuuuaaaaaaaggaucaagagguuccaaguagaaauuaacauacaugcauauuauagguauuaauagcgugugccuguguuuguacauauauguguaugugcacuguguguuuauguguauaauuaugcuaaugcauguauguacauguaugcaugcauguacauaugcauucaugcguguaugugugcauacaugugcacaagaccucugugcauguguaugugucuaugagagaguacagcagaagaaauuauucuagcacauuccuaaaucauauuccaauuccuccugcaagaggcauuuucauggcuaauuagagggaugugaugguggacaaaccaucccaagauuugacagucugacaucuaaagaaaagccaaccugaaacugcuucugaacucuguaauggagaugaauacugucuaccagaaacugcucuguggugagacaugcucacaacuugcuuugguccucucucacugcugggcacaugaauagcaauguuuuaaaaccuacuuuccaguuggguauuucugggcuggcuuugaugugugauuuguuuucuuuuuggaccauguguguaacuaucuaugucugguucugcagauuguaauugagcugaaaagcuuuagauaaacauucuaaaaggcaucauugaacaaaaauaugccauucuucagagggguaaaguccuggggagucuccuagaaucacucuaggacuggcaaagaugagcaauaaauaaacuuaaugaaacuacugagauuugcauuuguguuauugcuugguaacucaacuuauucugacuccuagacacagauccuagaggaggaacugcauacaggggaaaccuauacuuggcaguucuuaagaggcuuguagcuauacagccaggaauacuggcuguucuuccauuuaaaucaauccacaacacaauaaguuuccacuugguacaaugggauccccaugaccucacacaauguccugaauaccgauugugacuugaauauugguuccugauugucucuuuuaucauuuaugcucucaagcauauaaauauucaaggcaugcccagcauaacaaugguacauacaauaaguaucuuucugaagacugaaaggcaaaagccacuuuugguggcugcuuucaaauacugauaacauaccagcacuuaaaauuauuaggaguuucuaacuccaagucagucuagauuuugguaauuccaacugaaccuagacuugccauuaccucaaccaccuacauuccuuuacuuuugacagaucucugcccaaaauauucugguagaaaauaaaauugcaacaaaugacccauagggauaaauguuugcacauccauagugcuuacaagagacuaggaacuacacaagcauugcuuaaaucaauacauuuaaaccucccauuaaccuuggagaugguugguuuuucucucauuuuauauacaacauauauuugcauaguuucuucaccauaauaauucaaauagauuuuucagauaaaaccuacuaauagcuuuuaaacugcagaacaugaaaacacuuuaaacacaaauuuuaugugguguuacaaguuacaugguuuaaauguaaaguauacaacacagguucacugugcauaaacucuugugaagggugugagaucacucauuuuaguuuuuggcuugacacaacauugaaucacuuggaaagacagucucagugaggacuugucuaggucagguuggccugugcacauacaugucuguaaggaauuuucuugauugcuuaaugaaugugacaggacccagccuaaaguaaacagcaacauccucguauugcaggcuccaaguuguauaaaaguagcaaaaaauagccaagcacuaggcaugcaugcauuuauguuuucucccugcucuugaauaugcugucaacuagcugccuguaguuuuugccuuaauucccugaaaaugauaggcuauagcuuggaguuguaagccaaauauaaucuuuaucucuuaaguugcuuuuugacaagguauuuuaucacagaaacagaaaugaauauggacugaauuguuauguggggagauuauggaaccuuuuggagauggggcuuagcuauagguuauugggagagagaagguugaggcuaccagccuaagagcucuuucugugucucugucugucugucugucuaaccccucucugcggcacucaaucuugcugucucugucuguuucccucccugcauuuuccuuucccaucagcuaagauauaacaagcuguaccacguguuccuaccccgugaacucuaccacgcuuuccucacaaugaugggcuguaauaucuuaaacagaccccugauaaacccuuugucuuacaagcugcuguugagagggauguuaucagaaaaaugggaaaaacaacuauucaagcaaauuccaaccagggugagaauauuucugugauaaaucugaccacagaacugguuuuuaggaggaauaggaaagagguugggacuauaggcuagagaaacaauggcaugguacauguggcaagcagagacuaauaagccauucugguagaagucugcgaggccaggguguugauagaaaggugaaacauggaggucagaucaugagggaucuuagggagaaaaugaacucuauugcaaauugggcuauaaaccauuuauuuuauauucugggcaaguaucugguuauguucugucagaauuccaaaaguaauggaauaauucguuuggaagcagaaacuuuaagacagcauagcauggaaguugugguagagcuguucucuaccauauuaagcuucauguucuuuagccauauuaagaauaagaauuaugaguagaaagcaaagaacuaggauguguaaguauacaucuuacugaugaaaaaaaugagggggcacaguugaagcugcagaugagcccggugggaacacaugaacuauguuguuaaagggauuacuguuuccacaaagaagccuuguacuuuucauuagaacauuagguaagaugcugcucaggguaaggcuuuacuuaccgaaggcauaaaaaucacacauucuuugaaaagaaaauggccuaaugcuggaauccugaggguuccuugcugcaauauggcugaugcagacaguguuuucaugcaucagucauaugagcacucggagauuauggcagccaagguccaagggagugaggguucagcuauaucucaacaugcuaguagaucauugugcauaagaugaugaugcuucaaggauaugggauccaggacugacagaaacacugagaguuguguuaagguuucagagaaucacaaguaaggcuacuaagaaucaggggaagauuugcagagauacucuaagaggccaauuugggaagcccugaagaugaacucuaacuagcaguaugguuuggagaugcuaggaacuuggaaaacaugaauccaggaaagcuagaggcaccaaacagagccagaccaagagaaaaguucuauguauugacaaguuaagggcaguuagagcaagguuauccaagggcacagugccuccagucaugcuaccauauguccuagaugcaaaccugaaguacaggaauuggguuuugaucucucuuugguucuauuuuuccuugcuaugagcccagaaaaugggaauaguuguucuguaccauuggaacuacguauuuuuuuuucuucuuucaaaaucuuuuaaagguuauagcuaagagcuugccuugaacucagaugguacacugaacuucugaauaauauggggacugugaagacuauggugaccuuuaaaguuucacugaaugcauuucacauaugacucuaugaggaccaagguacaauauuauaauuuggaugugaaauguucuccacagggcucauaucugaccccagucugaugacacuauuuugggagguuauggaaauuuaagaagguggagccuugcaagaggaaguagauuccuaaggagugggcccugauaauugcagauagccucucaccuuccagcuuugaaacucuccuacagucuauauuacaugauaaugcuuccaugauugcuggccucuuaaaucguuaggcaaaauaaauccuccaccacuuaaguugcucuaucagguauugugucauaguaaugcaaaagcaauuaauaaauacauaucaauggcuacauggggacacacucuuucagcagcucuaaaauuaaauuuuagcugcacugaguuuuaaagaauuaauuugcugaaucugggaacucugcauuagaaacuauauuuuaaucucuuauugacauuuagcaucuuuaacccaacagccaaucagacuguaguugaauuacacaucuccauaacuaaaagaggaaaaaauugucaaugaagucuuccauaaaaccuaaaaucauaaaaacauuauaggacaaaaauuggcuucuucuuuuuuuuuucuuuuuuucucuuuuucuucuucuacuaggcauccugaagcaguuaugaaggauucagauguggacacaucaauucugccagcugucacauuuucugucuaaaucaguguaaauccuaccugggagucucuaagccacuugauucacuggaauuuaggguuaggucuacaagaaggcaauauucuuuuaucaugauuauaacacagagcuuguuaaacagcagcaugacuaucccucgccaguagauguuauuagacgcguucucacgaccggccaggaagaacaccacagaccagaaucuucugcagcaaagcuuuauuucuuacaucuucaggagcccgaguguaagaagcaagagagcaagaagcaagagagagagaaaacgaaaccccgucccucuuaaggagcauucuccuucgccucagacgugucacucccugauuggcugcagcccaucggccgaguugacgucacggggaaggcagagcacaaguagucauaagauacccuuggcacaugcgcagauuauuuguuuaccacuuagaacacagcugucagcgccaucuuguaacggcgaaugugggcgcggcucccaacaucucccccuauccuuuuaauaagagcaaauaggccacccauauuaaugagaguggagauagaggucaaauccccaguguguagguaaaggagccauguacaggauuagcucuuaggcucacaggcuuuuacccagagcaacccugaccugcucccgugucguuuugccugggggaagggaacuaggacacugaaccuucaugaaagaugacaugucucccuagaauaggcucauauaugccgcagagccuuuccauugcagugcuuagccgugcaacucucucgggcugcugaagcacacucacucuaucccgugcaaugagacuagccucaugggauauaagagcugaguggccagcgaccuauugccuaagcauagauauaucaggggaagcuccauguucuaguccugcaagcgccugggcaauaaccaccuugucucuccuaguuugggccuuaagcuuacagaccaaucaaagaagcaacacuaauccacagcaaaguguaucuccaaauaauauuaaucccacccauuuuuuaaagaaggaaaaugcugaggagauccaauuggguaauccuuuggucagggacagguccaagcgcguggaguugaccugaagucucaauucccgaaggaucuguucaaauucagccauccaauucuguaacauauacugaaaaagacuuuuugacaaauuagcugcccuaguaaauuuaacauacugaauggaaauaacacacaaucccggaaacuuuuguucacaucucagcugagcuauuugucauaauacaucuaguuguaucuggacaagaucuaugaguugauuaaccagcaugagaccucucuguaucuugacauuagcugaggccuguucaucuaugacuguagucacugaggcugacaaaguguuaauggugucaguugucuggaccuguccagacagagccaaggcugucugaaucaaggcuaaacccaguucccaguuagugguaaaaaaaacaggaggauacuugagcauuauacaucaccgucauugggaguggaaaugucgacauuaucccccaacgcugcucucucuuuauuauugaugcccuggacaucaccaagacgagggacaucaguauucccuuggucagucuggauuuuucgggugagucuuucugguacccaaaauggguugucuucauucugugggaaaacacagacagcuccccuggaucuuaucaagauaggauccgggccauaccauuuauuaucaaggacauuuuuccauuuaaccaucucauugggccuaucuggcucugaacaaugacguucagccgcaguauggccaugagcaucaauauuuaaaaaauugaguguaaagagugccaaagacaccgacacucuuggugcucgggguacagucuccucaaaaguuccccucuucuguuuuauaagauagguuuugagggugcgaugcgcacgcucaacaauacccuguccuugaggguuguauggaaguccagucagguggguuacguccaucugacggcagaacugcugaaauuuuugagacguauaagcugguccauuaucagucuuaaggagucuggguuucccccaagcacuccaugccucaagacaauguugaaucacaugugaggcuuuuucuccgguuaacggagaggcaaacaugaugccagaacaugugucaauggacacauggagauauugaaguuuuccaaaggaagaaacauguguaacauccauuugccagaccuguagaggucgaauaccgcguggguuaauucccacaugaggaacuggcaagaacucacagcagcuuugacauugaguaacaaugucacgggcuucuuuucuugucaaggagaaacgacugcguaauguuucagccgucacaugaaaauuguuaugaaaauuucuugcagccucuaccggggaugauagggcagcagccaccacuuuaguggccuuaucugccaaaucauuucccagagccauggggccagguaggccugaaugggcucuaacaugaguaauauaaacaggagaucuucuagauaacaaaacuaauuguaucugcugaaaaauauuggcaacucuacuggaaggcuuaaucacuccagccacuucuaaaagauuuacugcauuaaccacauaacaggaaucugacacaauauuaagggguucuaaaaagguuuuuaaaacuucuaagaccacuaaacauucuaccacuugaggugaauuuucauuauauuguuuggauaccacuuuaccauuagccacauaggcaccuaugccaguuuuugauccaucaguauauaccacaaucccauuuuuaaguggguuucuuacuguuauuuguggaaaaacaacagauugauuuugggcaaacuguaagauuggauguuuuggauaaugguuaucuauuuuuccugaaaaggagguaacuaaaacugcccaaucauuagaugcggcugccaagguuugaaccugugcagcgguauaagguacaauuaaaagauauggacuuugcccaaagugggugauugcugcuuuuaggccuuuaagggcaagcugugcaauugcaucaggauaccaaucuauuauuuuagcuggggauacauuuggauggauccauaacaauggcccauucugccacaaaacugcaguuggcaauugugcugucuuaaagacacacaaacugaaaggcugcgaauccucaauacguuguaauugugcauucuguaaggccuuuuccacuuuuuguaaggccugguuagcagcuagaguaagaguccuaggggaggagauaugaggaucuccuucuaaaauacuaaacaaaggccuuaacucagcggaaggaaucuuuaaaaaaggucugagccaauuaauaucucccaacagcuuuugaaaaucauuuaagguauggaggugaucucuucuuaucucuaccuuuuggggcacaaucuuaucuggggacaccacagagcccaagaauuguccuguaucagaaauuuggaccuuuucuguggcuaucuguaaaccccacugacuuaaaguuuuaaguagaaaaggauaugccuuuuguagcaugguaaggucuuuauggcacaggaggaugucauccauguaaaggagcaaaauuaaagaggggaauuguucccucacuggcaaaagagcuucuuguacauaaaguugacacauaguaggacuauuggacauucccugugguaagaccuuccauugauaccucuuaucagguuccaugugauuaauagaggggaugguaaaggcaaaucugggccuaucccuuggacacaaagguauagaaaagaaacaaucuuuaauaucuauaauaauuaaauuccagccacgugguaaggcggaaaguacagggagaccccucuguacugggccaaauaaguucauuugcucauuaauggcucugaggucauggagcagucuccacuuuccugacuuuuucuuaauuacaaaaauuggaguauuccaaggugagguagaggguucaauauggccuaauuuuaauuguuccucuaccaguugaaucacagcuucuaguuuuucagaggauaggugccauugaggaacccacacuggguccccuguuuuccaugguaugggucgugcugccccaauggccguuauggaaaacccagacccugucugucuugguuuccauuaggugagaugggcucuauccuucccuguucuugauguccuaacccuuuuccuucuuuauaacccaucuuugccaugauauuuuuugcuuuagcugaauacccucccgauggggcguuuucauuggacaaaauaaggcccaaaugcugcauaauaucccuuccccagagguuaaccgggagugggagcacauaagguaugaauuucccuugcuguccuucagaggauucccacgucaaggcaauggagcuuauagugggacaugauugauauccuaggcccuguaaugaaugagaugacucuguggugggccaugcuuugggccaccaauguguagagauuauacuuuuaucugcuccgguaucaaggaugccuucaaacucuuuuccauuaaucuuaaggcggagcuuaggucuaucauuuaaagauacaaccaaauaggcagaaucauuuccugaggagcccauuuucuuuaucucagguccugcagauuuuucccugguauuaucagggaggagcagcagcugagcuauccuaucuccuuuacuaauagaaaaaacgcccuuagggcuugagcacaggaccuguauuucaggggaauguugacaauccauaacuccaggguggacuacuaagcccugcaaggugagugaaccccggccgagaauaaggcccaugguucccgggggcaaggaugguauaggcuccacuggcaccggcugaauacucauuugaggcauuaauaggaagucggaggcggcacgcagguccacccuugugggucuuccugggucgccucucugacugcuuccuggguccugacaaaccgguucccauaucuuugagggcccugggaccgagggcccgaugacccguuuuuuggcacaucaguugauugacuaucaggugggggaagaauucugcccuuuauaucccucacagagcgacacuggucagcucuaugauaacccuugccacacuuagagcaaagagugagagucccucccuguuuaucuggagcucugcaaucuuucuuaaaaugcccaggcuuuccgcaguuaaaacauguccucugauuauuucugcccauggagcgguuuugggauugaaggauggcagccgcuaaaccugcauugcugagaggucccccaagcucucgacagacccugagccagucuuguaagccuuuguucuuucuuggggcuauggccgcucggcacuccuuuguggcuugcucauagauuagcuguucuaucagaggcgcagcuugcucugacucuccaaaaauacgcucugcugccucugucauucuggccacaaaaucugagaaggauuccugaggucccuggacaacuuuuguuaauugaccagugguuucaccugcucgagagagcgccuuccaggcccuaauagccguggaagaaaucugggcauaagcuccccaaugguaguuugucugaucagcagaauaagcucccugacccguuaacaagucaaaaguccaaucucucugcucuggagucaaagcagcugcguuugcucgggccugcgcuugugcagcuucgugccaaagcgcucuccauuccauauauuugcccauacuagggagagcggcuuuuacaaccguuugccagucagcaggaguuagugccaugccagcgagccugucuaacugcaccaagguaaaauuagcauugguuccguauuuacgaaccgacucggcaauuucuuuaauuuguaaguauucuaccggagcguggacacgcccacccucggcuccuucaaagaccggaaaugccuguuguauuuuccuuuguuccucucugggaaugaaugagucugcgcacugccucucugcgcacugccucucugcgcauugcugacgcacuacgcagggcggggacuccgcauagggcggaccuugaagccgacugcccugaggccaaucagcaaacuggccuucgccagccgcuuuuggcuuuuuucuugaccaauuagcuggcugguaaugggcugcuucuuccucccagucuguuuccucagaggaggauucuucaccugcuucagagcuacuaagagcuggcuccccgagcccauccagcgaugagcacaggcuccuuuuccuagagaccuccgcuaauugaucuuucuucuuuucccuuuuuccucuuuuucuucuaaucucucuccagguauuccuaccuaaccuuaacuuuuccucggguucaagacccuuggaaaggccuguauacuuauuuuguguaccauauuuccucuuugcuccuacucucucuccccacuuuacuucugauagcuuguccugaauuucaucuagaauccgcccuaucuuaaccacuugauaacaugugaaaaggaacaaaagggcuucuaacacuagaaaaaauucaaggccaaauauaccuugcaaagccauuuuccacuuuacuucugauagacugucuugaauuuccuuagaaaguucaagaucagacuuaccucguaaagcuguacucacugguacucucguuccccagcugaaaaguucugaauucauacaguugaauccuucuuaacagucuguguugugggaacacuucauaaccgcgacccgcaguucugguucuggaaugagggaucuuccuugcgccagucccgaguuuuuucucgucccggaauucggcaccaauuguuauuagacgcguucucacgaccggccaggaagaacaccacagaccagaaucuucugcagcaaagcuuuauuucuuacaucuucaggagcccgaguguaagaagcaagagagcaagaagcaagagagagagaaaacgaaaccccgucccucuuaaggagcauucuccuucgccucggacgugucacucccugauuggcugcagcccaucggccgaguugacgucacggggaaggcagagcacaaguagucauaagauacccuuggcacaugcgcagauuauuuguuuaccacuuagaacacagcugucagcgccaucuuguaacggcgaaugugggcgcggcucccaacaaguagagaucaaacaacauaauaaacagaaaacacuguuuccccaaugugcuccuugucaauugguuucaguaaaguuaaucaaaaggcaugauuccacugcaggagaaucugcugaguuggacacucugggaagagaugggagauaggaauaagggaaaaguucuuucagggacacacacacacacacacacacacacacacacacaccacuuuaaacucucagucucuguugcagauucugcuucauagagaaccaugaacuacugccaacaagcagauagcuacuuucugcucaagcacagugcaucuuccaucgccauuuaucaaaacauguugauuuuuccugcuuauuaugaauauuaauaaauuagaaucuuuaagcugucuagaaagaauuaagaaauaacugccaggaguuugcuagcaaugauauauuuauauacauuagagaagagccauuaacaguaauuaauggugcuuuuacaucucagaaugcauuucaauugacugucgauuuguuuuggaggugucugaaaucauaaaauaaaucucauucuaaaugacaacuuaguaacuuuuaauaauuuuaaacucuaaugcacuauuuaaugccuuaguguuaacacacuguuuuaugaagauagcuuuuaaauuuaaaauuuuuauugaacuuuauuaaguuuaaugagagugcauugcuuacguacugccuuauuuuuaaauguuuauauaaaggucagaauagcuaauuuuaaaguccuaauuuuuaagaacacaaauucuguuagauaaugacuccauagucaaaauguaauucuaccacuuuuucuagauagccuauauuuaaugccaugaauaucuucaugagagcuauggauguacaaguuuaagcaagcuguauugccaucgugagacagcacaggcagaaauagagaauaguuuaccaacccccauuccuuccuuccuugacuuggucugacuuugacuagaacuagaguacacagagucuggcagacucaacagagaguauuuacauccaccaaauuccacaggaagcucaaaugagaaaauauaucuuccuuaagucaguauauuccacaauauuccgcuggcaacucugcaacucaggauccauuuugcuugaggaaaugaagaguaaaauagaaaucguuuuugcugggagagagucgagcauaugugaaagaaagauuugagucaaaauaccaagcccagcaccuaaccuuugcaugcaugguagaaagcaaaaaacagauaugggagacauguuugaacaaguuguguggguaucacugagucccaucaugccucuucauggagaagacccuuaacugcucuugcuuaugguucacaguccaccucauuuccucaaggacaaccccugaaccugcugaugaggcccuagaacauucccucacaaaaugcacccaaaacaaaaaagggcuuccuggguacugcuuucaguaugguaggagaguuuauaaggcaaaaauucuaaauauaacacagaacauaaacucauuauaggaucuuacaaauuuaaggaaaguaugaaauaaugaugucaagcacacuugguguguuuacaaagaugcucacugcuugcuggaucucauagaguguagacaugguauuuguauggugugacaaagggguuuguuuucccagcaucaugaucagagugagacagucugagcuuccuuuuuaauuagaugaaagucuaacagaaaucuaguggucacagauuuugucauuuucauggguuccucaagacuugcauaucagugcagcaugcccuauucuugcaugaaugcuucauuauuuuccaaacaacgaggauaagaacaugaaagaaaaguaguggugcaacuaugcaaucagaugcacacgugcugaccucauagcuaggaaggcagaacaaaccugugcuuccagaaaaacagcuguccuaaaaauucauacuuucucaccaucaacagggaagucuaaugucaacaguagggaaauucgccaaccacaugcuacuucgcuaucucaacacagaguuuuaauuuucagcacccuuuccuuccaaaagacaagauuccuaccgaugccuguaucagcucaucugccccaggaagacugagauaggacggccacauagcuuacuuaacauuaaaauuaauuuucagugcuacaggaaugacucgcaaggcaaccacgccuagcaggaaagcacuauuuuagacccaugugaccucagaauaugcagggaguuguuguacugaggugauuauugcuaauaugaacaggagccagaauuuacugaguggccauuacaagaugaacucacaugcacucggcuuaaugucucaucucaguaaauccugacaaugucauuuugaaggacuauuagccacaccacuuuccaaauuuggaaaaccacaaaaagcucagugaacgucuugcccacagguuuugagaccagcaucucuguuccauauguguagucauuggauaucagucuauaacagcuccuauuguuaucaaaucaccucugagaacucagucuuaugaagcaucaaccucuucauguguagcauguggaauacaggucuacuuacacaaaagucaccugugggagaaacagucguccaaaggcgagaauagagcaauugauuggacaauaccaaaugagcaucccugaaaacugauagauccaagucuauggacugagaaaauuguauuuauauauuuaugaauauguagagaucaugaauauauauuuauaaacauguaauaaauuuuguauuaauaauauauuuuauuauauauaaauauauaauauaauauauaauacauuuuauuauacauuuauauguuuuauacauauaaauuuauauauauauauauauauauauagauacauauauauauauguaucuauauauauguauauaugaaaaagaggccaugaauuugaaucgggaugauugcagggaggaaagagggaaauuuuauaauuauagucugaaaagaauauaaaaauauuuuugaagacaucuaacauuugaaaacaggcaauuaagcuugcugucuuccuauacugucaaauuucuucaucuuacagggcuugacuuuuugucuaagggcuuauuuuacaacugagcaaugagaauguucuacaugggauguuacaggccaaagggauauucuaucaaugcaagcaucuaucaaauugcacaugcauacaugccugucaaauucucuuugggcugauuuuaauuuugcaccagguucuccuucaacuaaugaacugcaacaaaucuugacacucauccguagcacauuugcacagcacccagaauuugucuuuuugcaaauggcuuucaaaugggauuguuuugagaacuuagaugauacccaugaaauguucaacacaggagcuguauuagauaugauccgguaguuaacauccaucuuauaagagcuaucuaugauugucuugauaauucgucaccacaaauacccuacuuaaacauaucauauuagcaaugguuaccuacucauacgcaaguagucaacugagaggaauuaucucagccacucugagaacaguugcagaauucuagacuguaacugacaucugagacuucuguaaauccuggcccugagaguaaauauuucacaaaucccacagccaucacagacauucuguaagacucccugugcacagaagguugugcuccagccgagcugcuggaagccaauccaucaucaccucugguaaacaggauucauuagaugguaauugacaguuguuuccuuucuaagugacuacucuacacuuaaauuaugcuuugucagggaagugguagcaauuaauuaccgguaaccuaaauaccaacuuugcuuucaguggaagguuacagaucauucaucuuugggucacggaaguguuagagaggaggaaaaaauacacugacccagauauauucauuuucagauaacaugcuacuuacugggggagagagagucucuagagcaguggcuccaaccuuccuaauguugcaaccuuuaauacaguuccucauguguggugacccccaaucagaacauuauuuucaaugcuacuccaaauuuguaauuaugcucuguuaugauuugugaugcaaauaucugauauagaggauaucuaacaauaucaaagguauuauaacccacggauugagaaccucugcucuggaugcccaagaaacgucucuguuuccuauuuugaggcucuuaguucauuuccuuuuacaguccuauaccagugauccaaaaacaaucuauuacaacacaagaggcauugaaucuuaaaagauaaaauguagacucauuauaacucuaagacaacaaaaauuuccuuuuuauguuuaaaacacaagacuggugauacaaagcagaccuuccccaauuccauggggguaccccauaagucaccuucucuuagaaacacagccgaagucucaacuggauucuguaugacaacccagucugagacccacuucuuuauguacugaacugacccuaagcuuauaagagcagucuaaccuuaccaccaucacuugagagcccacacucuauuauuacaucagagcucuuugggagauauguuucucaaacucccacagucauuuucauccauuuuugcugucaugauagucauuugaucuccuggguuuccaccacauugaaucacucgaaggugauggucaguuuuuaauguacuuacucacaugcacuuccaacugguuucauacuuacugagagaaugacaaucccugaagaacaacgacaaguccucauuggauaauuaauaaucauugaggacacuagcucuaaauucaccacuuaggcagagcucgagcauucacaaaugguuuuaggauguucaauaccaaaacauauagcauucucaccuagaucucagugugagguuuagcuaaauggacaagaugcaagacaggacuagauggaggucaagucaagccuauggcccggguagaacaagcaacagagccagcaauagcauagcuuaggccuuggcccagggacaggauugacaguggaggaaaagacuaaaaggugaaggggcagaggcaagaggcccagggcaauggcugaggcugcucauagucauuagagaaacaagacaacacugaagacuguagcccagugguggaaagaaacaaaaccacugaggcacaaguacucccagggucugggaagacaacuagacacugaccagagaggagaaagaaaaugaaggacucacuauuuagacuuuuaucuugaaauuaauuucaaacauauccacaugcccuaacuacuaaaacccugcuuggcuggaguuaucaccucugaucuuugcucuucugcucaccugcaagccccucauuucaacuuuaucucauuguugccaucuuucacuugccccagagaaaaauaaguugccccagggcauauuucucaagaacagggauauuuuucucucuuaucuccguugcacaguuacaacuuuacuaaaucugacacaguuacaauagcuuauccucucugucacuuugcuucucaauuuugccacucuaaugacaccccuaugucaucccuugccacaauaaaaaucuaguaucuaauucagucuucauuagucuucaugucucuuuacccuccuuuaaccuuaacauuuucccauugacuuuuucuuaaaagcaaccuauuucccucccauaaauuuuaaaauugaauuacuuuucuuuagagcuucucugagguacuugaggacuuuuccaguuucuucuuauuuuuucaugugacuggcuuguugugucguuuuuguuuguuuccuuauaugagaacuguuucuuucucuuucaagguaacaucagagcaucaacaaggaauaagucacauuuuauguauaauguguuuaagccaaauuugacucaugauacugauugauuuuuuuugauaagcuuuuggauucaugcagucuauccuggaauuccucauugcugaagagacaggugauguuugugggcaguuuggagcaucauuaauaaaccauagauuauuuguaagauagugucuccuguagucugcacugucuuugaaaccccuguguagccaaggcugaucuugagcucugauucuccuggcauccccuaccuaagcacuaccugccacgugcugggauugcagacaugcacugccacaaggauuuaacugagcaugcagauggucuucuuuuuaauucuuuaucacauuuccugauuaaguuaugagaggaacauacauugccuugguggaggacagaaggcaacuuguaagaauugauuuucugugauauauauccuagagaguggacucagagagucagguauggcccucaagccauggcgccagcucucaaguccuguuuugcuuuuggagauaggucucacucuaguccaggcuggcuuugaaacuaugccucagccucccuggugcuaagauuacagcuggaugcugccuugcuuaucuucugagauguguuugagaugagauucacagacucacuguauguacucuucaucuaagacucucuuggucaugguguguucuccuuaucauacaggaaagcuguaagcaacuauuugcucaggacuucuccacugcagaguuacuauuauccuuuucaccaauuaagacagcuuaauacauugacuguguauaaggaaaugaacuaaguucguuacguuucagcuguaugauaccaagcugcauguuuagaaggaagcuuacagugguguucuguguguuuuaagcaaugggacauguugagccucacauaauugcucacuccuguugucaaagccagucugagcuguaagcuucuauuaugcguggcugugguuugugagacacuauuguaccuacuccucuaggccuccucagagaaacagcacacagaauaaccaauaaauguagccuuuugaaaaaugguaaggcaucucagauuacucaaacugagagacauuuuaaagcaacuggggugggcucgggggguggguggugggugucagggaaaugauucugacucagaguguaaaauacuugcugugaaagcauggagaguugaauuuggaucauugacacccaugcaaaaggcuggaagcuguggcaaaaauaagguagagugcuagagagagggggugggagagagggagaaaaggagagauggagacagacacacacacacacagagacccuaugucagccucugaccucacuguguacacacaacuauagaucaaaagcacacacacauacacacacacaaagcaaugggcccaaccccaacauuuguacaaugauggaaaucaagucccaaggacaaaaucacgauuuuuccugagaucacacaguaaaauaauccuuuuuaaaauuuuuuugauauuuucuugauuuacauuccaaauguuaccccuuuccuaguuuccccuccaaaagcccccauccccuccccuuccccccuguuccccaacucacccacuccugcuuccugguccuggcauucccauauacuggggcauagaaccuucauagaaccaagggccucuccucccauaggaggagcacauggcccccgagacagggccuggcugcuucugaacaacagguguaugauaucagaauagaugggugaauggauggauucacacccagauaaacacauaagcaccuugagcauauaaacagcuuaaaaaugcuuaaaaaauuauaauuucuacaguuucaguccaacucauugucagacaauuugcuaauuauaacaaauaauaagaauauuguaauuuuuuuauauucauggcaaaauacauaugagacccagaguagaggucacuuaggacaaguugguaugauuuccccaauuuaccaaagagaaucaaaaucaguuuauauuccucaaggucaugugcuuugaggcuggagguauauagauuaggauucaguucuuaagggacuuguuccuggcauugucaauaguucacacacaaaguuagucacauauacauacagaaaaagauacacacacacacauacauacacacacacgcacacgcacaugcacauacacauacacuaguaauuuccuaugggauaaaugcuugugcagacaugggugccagcacacauguuuauuagaauuguuguuaaagccuguuuccuuaaaaucaaguaguuccugaagcauucacacaucuaaauuacaggaauguccuuuuuaaaguugcuuguacagaagaacaugggcugaggucgaggcuugagaggaggagagagagcaggcagaggagcaccaagagcucccuaugagauuccauagccuaccccuuccacugcaugugcuauauuuagcucaggccccagcacuaggggccugaugacaccaguagguugucaucgaguaaggugcaaacaacucuccuuugacaaagugauagugcuguggugcugccugauggcuuuacacaucucaaagcucaccaagugacaaaugaaaguagggccuugaaaacaccgugacaaggaaugacugccuacacccuuccugauguccuacgggcagcaaaacgauggcauuuugcaaauuaauuaaagagaaaaucugagcuaucgaguuuagcucuuccccaacuugacucuguaaaaugaacuuugaaguuacuggcacaaaauugagaugugaccuaacagacuucuuccaaugagacguacaaucuuguuuaaagaacugcucugaguccaaaugaugccaggcaagggugcaguaauuauccaugcuaaagaugucuccaacacuaggguugaaaccuuuuugauuuguuugaucaugcagcuuuuugugugcacacacugcuuucugaagcugucagcaucagugucauguucggauaaagcuggagaguuuaaaaggcugugugcucacucuggcuuuaguuagcuugaauaaacauuucuagcagauuuccuauucguucugcugcauaaacauggcuguguuacucuugucucuugcuaagaaccuucacaaugaggccgaacaggaaaagauuucuaauaguugauuaauaagaaauacaguuucuuuuugaaaacauuauacuuugacuacagagggcaaauucauuacccgugaauugaaagacgccaagaguuuccacaguaucagaauccugauuuggcuucaaucugacaguuaacucugggcguuaaaugauuaaauagaaguccaagcuaucacaagauaaaacucaaagcugagaaacaucaaaugaaaugagaaaaagucacaggacuuucaaacucaaaagaaaccggcaaaguaugaggugcauucugaagagugugauuucaaaugagguuuccuuuaacugcugcuguuuguugcagccuuacucaacauuccagauagucuccaauagaaaagaauguuuugagaaaaaggagaccaccauuuucccugagcuacaacaugccugauauggcugaacaaaacugguccaauucuuggcccugagaaauguauauguggguuugugucuccucuccuugagcacagugaacccaaucaugagugcugauguguugcauaaugcagauuuucaugaaugcacugcucuuccaaucgguccuugugaaugauagaacaaaucccuuaaaagaugucauguaguccucaaugugcccacguuguaagaaauucaugauuuuguauuuacugucuuaacaaacuauuuaaaacccacauuguuguaugguaauaagucugaucucuauaaagcuguuguguuacaaggaauccaaagagugaagugcagccagagacagacugagaaugagagggggagagaaacagugaagugcagccagagacagauugagaaugugagggggagagaagcuggggagcggggaggcagacagauuagcucagcaucauugaccuaagucacccaacauggagucacuggaacuggagccagcuuugcauuaugcaacaucuuaucacaauccuugacccaugacuucauuagaugcaauagcaacaacgauaauaauuaguuuucagcuauucuguuuuggaguuguuuucuaagugauagaacacaugaagaagguuauuccuauacauuuugaaugucuauauuggcaugaaaccaaacaggggguucacaauguaacaugaaauguaacuugaggaaccaaguaccccaaggacaucccuugcauuacacguaugcagcuaccauccugacuuuucucauuguuaguuagguugaccaguucuugaauuucauguguaggaaaucacuuaagguuucuccuccaaggccagccccuuccaaugagauucugucuuggauguucuuaacauuccugaaggugcaauagauagcauggcuuuaacacugcaaaguguucacucaugcauguccccuacaacuauuccuacuaguguggauggacaucucagucauuuccagcuuaggaauuuuauggcucaagauguuagaaacaauuuuauauauucuuuaauggcuaagugaaaccauuuuucuuagauauaguccucacuguggaguugauggauugcagggcuggacauauguaugaaaaaauuuacucauauuugaugacuuaugagucuacucaccaggguuauggcaucauaucaggcaaauacuagcgaauaaucgugccacauaaagcuguuuuguuuuguccuucuauauugaccuuuccugacuaagcaugcaaugucuucaguaauguccacugucaccaacaugacauuguucuuggaaaaauccuaucaggcaaagucacccucuaaaacagcauugcaauaaauauguagaaaugucacuuuuuucauuagcugaaagguuuuguauagcuuaaggauauguggaguaagcugacuauaaaaauagaaauuugacgguggggaugugugugagugucaaaauaauauuagucuuuucugagugcgugguagaagaaugacacggcauccaccagcaugaguuuuauggaucugccucuuugccagaugccaccuuuuauaaacugcuuuauaaaaacauaacagucuaaacgcaguuuguguuuaucacuugauacauuuuggugauaaacuaaggguuggcugaaaauuaaagccuuacagccuauucauuaagcauuuaggacuagugaauaagaaaaaaaaaccuugcaaacuauuaaaucccaaauguaggcauaugaugguagcagcagcacuaguguccacugagauaacugcauuacaguuacagcuaaaugaugcaguuugagucacuauaaaugugaggcaaaucuaggaaguuacaauagucaaagauaugcucaaaacagacugacacccuuuucagaauguuugcaaucucagcauagcacagguuacauaggacaauuuguauuucuaauaaguaguuuuaugaaaggccuauaagaacacuaugguacauacucccuguuuucauuauugauggauuauaagaggcaauguuucuugaaauguagcaugcacuguuuuuaaaacaucaacuauuuuacauucaucuuauccuuaaaagcauauaugaauacccacaaaacaaaaccaaauaaagggcuuuugaaaaucaaccuguauaacaaaugccuccguaaauaaacuccugaacauucuguguucccugaaaugucacuuguauucuuuguaauuaguaaguggucauagaugcugucuuagucaggguuucuauuccugcacaaacaucaugaccaagaagcaaguuggggagggaaggguuuauucggcuuacacuuccauacugcuguucaucaccaaggaagucaggacuggaacucaagcaggucagaaagcaggagcugaugcagaggccauggaggaauguucuuuacuggcuugccuccccuggcuugcucagccugcucucuuauagaacccaagacuaccagcccagagauggucccacccacaaggggccuuucccccuugaucacuaauugagaaaaugccuuagaguuggaucucauggaggcauuuccucaacugaagcuccuuucucugugauaaccccagcuguaucaaguugacacaaaacuagccaguacaauugaccccuugucaacuugacacacaaacacaucacuaguaaaccucaacccuuacauucuuauucauccccaagaucuaaauaacuuuaaaagucccacagucuuuacauauucuuaaaauuucaaucucuuuaaaauauccaucucuuuuaaaauccaaagucuuuuuacaauuaaaagucucuuaacugugggcuccacuaaaacaguuucuuccuucaagagggaaaauaucagggcacagucacaaucaaaagcuaaagucaaucuccaaucguccaaugucugggauccaacuuacgaucuucugggcuccuccaagggcuugggucacuucuccagccaugcccuuuguagcacacgcgucauccuuuaggcuccagaugccuguacuccacugcugcugcugcucuugguggucaucucaugguacuggcaucuccaaaacacugcaugaccccuucaguccugggccaucaauugcaaccgagccugcacuuucaccaauggccuuccauggccucucacagugccaagccucagcugcucugcucaacuccuucaugccuucaaaaccaguaccaccugggugacccuuacacauuaccaaguccaaccacagcacaagguacaacuuuggcuauaucuggaaugcagccacugugcucucauaaaacacuucccagaagaugucaccucaaugaugcuggucucuucuuaaucaccgcuaauuucuuagcuccagcuaaccagcaucaauagucccaguaaugcaaaguuuuugcuuuaguaguucugguaucuuguuaaucacagcugauucuucagccccagcuaaccagaacuacagaaucuucacaaucaaaacagcaauggcccugaaaagagucuuuaauuuucccucugaaauuucacaagccaggccuccaucuucugcacuguucucaacauuaucuuccaagcucuuacaaaacaucugacagagcucuuaacaacaaauggaucuucaagcccaaaguuccaaaguccuuccacagaccuccccaaaacauggucagguugucacaggaauaccccacuccugguaccaauuugucuuagucaggguuucuauuccugcacaaacaucaugaccaagaagcaaguuggggagggaaggguuuauucggcuuacacuuccauacugcuguucaucaccaaggaagucaggacuggaacucaagcaggucagaaagcaggagcugaugcagaggccauggaggaauguucuuuacuggcuugccuccccuggcuugcucagccugcucucuuauagaacccaagacuaccagcccagagauggucccacccacaaggggccuuucccccuugaucacuaauugagaaaaugccuuagaguuggaucucauggaggcauuuccucaacugaagcuccuuucucugugauaaccccagcuguaucaaguugacacaaaacuagccaguacagaugcaaaugucaaaacaaaaacaaaucaguccuuuacgaaaugauaaggugggcuuccucugcuuaucugauuccucuguuccucaggagucaucccuagggcuccuggaauucuucaaucugugucuuuucugaagcugacaacaugcagguuguauuagguagauuugaacaagaauuuuguucagaaaagaaguaacacagugauucccguccuuacccaucaguaugccuaagcacaacuuagaggccaucggauugucauaggcacuggacauuagggcuaugaguuacuaguccaagauccauuauggcaccucugaaaaauucaaaauacuauugaacaguacagcaauaagagagcuuuucugaacauuaaaccacucagaauuauuuuugaggguccugauacaaagcaaagugugccugucuuguccuuucgaaaucauacccaagaaccagaaagaauaaagucaaacucaacuucagauuauuuucuuuauuguaucuaaaacaaucaaucaaacaagcaagccaaaaaccaaccaaacaaaaaagcaacacugaaucaagaguguaauuaaaguaaguuggaaaugaugggggaaauugcaggaaaagcaagggguggggaacaaaaauucuuucagagaaccaaauaagaccucaaagcaaauaaagaagcaggccuugccuaacauuuccaaguuucugccccuccaagccuugacauaaaaccugaaccuuaucagaagggucaugaccucuauuacuggcuuccuagccauuugauggaaguggagugcauuagacuacagucagcaagacugugugauucuugacuccuguacucacuaaucuacauuucagaagaucuuuguuagguucugauugcuugugaaaugaauuaucauaaauuuaaugacuuaaaaguccacaguuacucuucucuuacuguuccggucagaaaccugcaguuucaugggccuaagcucaagcuguccuuccaucugauuaaugccggggguuccagaagcagaugucucugagauuaucgccuucucucuuggaggaagcucugucuacaggauguuacagggacgguguugaaacaggaggguuuucuaguggugaaggucuuucggacacagaauguuuuaaagaaagcugaacaauuccauccagcaggauaggucuuuacauucaggaaguaaacucaaaagauuucaggaaguauauaaaaguggccagauucacuagccuucucccucuccuaguauauauaagcagugagggaagaaaaucagccaagggagaaccucaccaagcuggcuagauaugacagagacaagcugagcugccugaagaggcucaggccaacaccaaugaccugccucgaaagaacauucuccaauguggugaacugucuuccacuugugcaguaugauacaguugaauuugauucauuucugcuccuaucaguaauucugugccuacaucccuguaaguccaacaucacucauuguuacacugaguugaacuuugguaauguucuuacuuuaguccauuguugguucccucucuuagguaaguagacauuuguucaggucucaccaggaauacugucacuuaagaggcucaaaggggagaacgccccuucuaugucuucuaguugucuguuuugaagccuuguccccagcaucaaagauuucuguccuuugcuuaaguuuucacuggcuuguuuccaauugauuccuaccuccauuuuaauaugaucccugucacuauaccaagccuaccaaagcacuauaggaucaucucugggccucagaauccuugcagaacaguagacacgugccuucuguuauacaagcuucagccacaacuuccagacauuugggugugagcaucuuuggcauucacuacucagccuuucaggaucucucucucucuucuagaacuaauccuuucauuugcucauguuuacaccacugguuaacaagucuaacagaaaacacaguaaagcauaaacauuugaaggaugagccgacacguucagggcaaauauguaaccuugcuuuuugcugaaacugagaacacacuucgacaaggagguauuucuugagguggagguggugaaguugggcugagcagacaugcuggagcaucauauagcucaagaaaacugucccccugugaaaucagaagacgcuaucacuuacuagagugggcacacuagcuugcuggaagauauaggaacgugccauguaagcacuuaaauagcaagcaggucaggucugacagcugcaaggguauaaggcaggaggcugaaugacuagagggauugcccuggaagcuuccagaaaggcugugggaauaaaauauuccugucaacuagagaaggugcuaguauuaugugaaauugaguagcugacacuggccuuuucaggcuacaaaagucuccugauucuaaggaagacuucacauuccauuagugauauaggagauggguagauacccacacaacuuagguaacugaacagaggaaucguugaggcuucaguagcaaaauuucuuuaguugcacuucaaugucucccacaugugguguucucaaggcaguguuugaauauaucauccaaccacccauuaaguuaauccaucuaaaauaaacuuugauauuucggaggaauuuacccaaaaguuuuuacauguuauagcacauguaaccuuuucccugucauuuuauguguuuacaugcagagauaaaauuacaaguuaggauuucuuuuaucuuaauuuuguuuauuuucuauguaaaacucuagaagaagauaugcucaaugaaugaacaaagcagguaagugugugacugugggaucagggugacacugaugugacacuuugcaguuaagaaaauauuuucaugacaaaaccucaaaauaagauuuaagugcaucaaguaacccaaagaaucaauaauaagucaccgaaagaaauggcuaaauggagagcaaaaauuaugauuuuagagaaucaaucacuccauccacugcaauaccauuucuacuaguuuaauuaauuuuuuuuccauuuuucaacuaagucucaguuuguaacaagcccaggcuuaccuggaacucacacacuuuguagcccaggcuggucaggaccucauuuacuauguaucccaggcuagccuggauguuguuaucaguucuccuucccaagucuaucaaguaauaggacacaggcauucccaccauggccagaaauuuuaauucaaacaucaacacuugucuaggcacuauauccaugagaaauuacacaaccugcacagaacaucugaacugguugacaaucaucuuucugguaucacuuucagccagucacauaaauuuuaagagaauaauaaaauuauugaccuaaaacuacccuaucaaaauuuuaaagagauuuuuauaaaacaugugguauaacuuauuuaaaauuauagcuaacuuaaaaagauggauaauuauaauuaagaagauauaaauuuggaauggagggauauauuaauauuuuaaucuuccugauaauucuuuuaaauuacccgauauuuucauucuagcaaauauugccucaaggacucaauugaaacccacauaauaauagucaccauuuaacaaauuuauuaaauaaaacauuuucaauuacauaguaaaucuaaugagauggccagaauaaaaggagauuaugaauuucacugaugaugaagcaaauaaaaaauggucucugaacuucuugacugugugaucacggacacucaaagcauguuugauuuuugucuuuucaguaagucuggagcuuucucaacacgauuacccugugaaccauuccauaagaaggggcagcccaucgcucacuuauucuuacagcaaccuggaggauuagccuacuuuagaggcgaggaauauggugucaagagauuaaaauccuugcacaagaucacagaaguggcagagcaguccucaaaccugcagaaaacuauaggaacaccccauauuuagcaauauucccagcuagaugcuaguuauuuauuuauugaccaaucaacuuauuuuucaaaacauuuauccauuuauuuauuuacuuacuuaauuacuuacuuagauauuggguuguugaacccaagacacaaaauaggcaaguacuuuaccaacaauccacaaauauaaaaauaaaauucugaacaacuaaaagacuucugacuuggcuaauucaagaugcuagaacaaaauaucuuugucucccagucaaacuugauauaaacaagagaaauguauaaaucaguucuggagguuagaaaguauaagaccaugauauaggcagugucuggggagucugguucucugccucuuggugaugcuuuuuuuuucccuuaugggaggcaaaauagcacuuuugaacaucuuuguaagguagcugauucuuaugcaugaugguggagccuccugucagcuaacccgaucucaaaaggcuccuccacaacugcuuucauguuggauaucagguucauaaaauaaacuuuguaaggacaaaaacauauaacauuaucuaauaucugucacuacuuuucaaccuagauuucagaucagaauuacaguauguguauguaugugugugugugugugugugucugugugugugucuguguguguauaugucugugugugugugucugugugugugugugucugugugucugugucucugugugugugugucugugugugugucuauguguguaugucugcgugugucugugugugugucuguguguguaugucugugugugugugucucugugugugugugucuguguaugugucuguguguguguaugucugugugugugucugugucugugucugugugugugucugugugugugucuguguguguguaugucuguguguaugucugugugugugugugugucugugugugugugucuguguguguguguacucauucaugcagggaaugcacauguggagaagacugacagcagguuucuuccucaguuacuuucuaccuuggauuuuuguguuuacacuacucagauaaauagaguuuuuaaauuuuaguauauuuguaugagucuuuuggauauauauauauauauauauauauauauauauauauaugugugugugugugugugugugugugugugugaaucuguguguguguaugccauguacaugucuggcgcccuauguauccaagcuggucucaguuacaguccuccuacucuucagucccccaugcuagcaccccagguagucacugcacaugcagauucucccuagucgcuuuuacuguuuucuuuguaaaacuuuauugauuccagcacagcaaugauuauguugcccacccauguugaagaaaucuugauguuuguguuucaagagacccuggagagcaucacuauggaaauguauuuauuaaccacaguacaucacagauacauaugaugcauggaacuccuacaagguuaagguacuuucacacaugucaccacacauggcaucuuauuaacaaaggucauggagaaagacugguaauuaugucaaauuaagguuuaagcuaacaggcacaaaggaacaauuaacuuccugaccuuguagaccaauucaaacauuauauuaccuaauccuuuuauuuuauucauaauaagucuaagguuuaaggauagaugcaauggcauuucuaagauggcacaguuaguaaauaagagcaaagggcaagacauuggcuccuguacuccugacauaaugcugguguccacucggcucacuucuaaccccaucccuuacaagccagcagguuuacugguaagcacagguugcuguagccggugagacuaauaaagaaaaucacaugaucauaauaucacguccccagcaauuucuacugcaauuuauacgggaguggcagaggaggaagugcuaacuuugucccagugauuaaugcaauauaaagaaacaacuacugacuaugaugggagaaaagguagcccacauccagaccuuuuaggucaaggaagaauacaguguaucacuccaauauucucuauaugugaggaacauguuauuaaagggguaaacaaaaagccuggcaacaaagauuuauuaaaaaaaaaaaucaagacucaccauaauugaauuggaauguuuuuugauggaaaagacuuguccccacccuuagucacaacugugacuccaauaaaacuaaguccuaagugugcaaagcacaugacauauccucaaaguaagcagugaagacuuccuaucuccucacaagcagccacaaggcaacucuaauagacaccagucgccauugcggcucuagguuugcgaaguuuucacuugauuguuuauaaaguaugcacuugauugcaugugaaaugcgaacuccauuggucuuacaggacagcgggcauugccugcuugcuugaacuucccacaguuugccuucugcacauugcaggaauaccuggagcaugagaauucaggaaucagaagagagagcaucacuggucagcuucgacugcuucuuuagcgcaggacccuuuuauacguuaacuuguuagggagauuuccacaaagcaaugucccaggagagcaaggaaaggggaguuuaucugagucauuagaccugucuuaugucauacuacagaguggaauggaaacugggacauccugggcuguccagauggaacaguagugucugggcucacaugcugcagcaaucucuuccacccaaaggauuagcucauagccacaauuuccuacuuccuguguuaguuuaccauacacuauugugauugaaaaggcaaccguccauuucuaccacucuagaaaacccucagugcccccuacagaugguuaaccuuguuaaccuugaaacaagcagauacuaaacaccugcuguaagcuacugcugcugccugaggcucugagccgggggccagcaugcugucuguuuuaaggaagauuagcaacaaaggugguaaaaaucucccccuggcuaaugagaagggcuuaaagaaguaguacaaagaacccaaaaacuugccagaaaugccaguauccauagcauuacaaaugugcucugggccauggaaauuuuguugauggaaucacaccaccagcaacagcuacagugaugcugauaauucaaagcaauuucuauuagaccaaagcagcaugcaaaacacagagaucuguaaggcacacacucaguuagaccucaaugaccuugggaggcacuuggaaggagaguuugccuguucuucuccaaggacagaacaggauuugaucucuaaaagugugaucccagagccaguguucuacacaaauaaccaguuuccauuggcuccacuagagagguugagguaauugaucugccuacaucaacagacagagcugcucaggugaagagggaaucacagagcugggcugcaccuccauccccuuccugaagguucucugggaggcacuguuagacauaaauggcaggaaaaauuguauguggaucuacuauuuggguuaauuagaugaccugcagaguaguaaucacuuuauaccuuagucauuugcuucuuugacaauagucacuuuggggaccacagagauggcucagcagguaaaggcauucggcugaaccuaaugcuuugggguuccauaaaagaaaacugggguuccaccugugagaacuauaggguaaaaguuaacaaccaagucguaaagauuguccuucacacacacacacacacacacacacacgacauuaucuaucaucuaucuaucucucuaucuaucuauaaaacuuguuuuucaauaaaaguuaaaagaaagagagaaaauaauuuaagggcucuucaguguacuagacuggcaacacucuuauuuaauaagcacaguugcugugccagucaacugauuuaagucucuccccuuuuaccuugaaugcaaaucauuccuaaagucauuccaugcccauggacaugcagauauuuauggacuggcuccauaaaaggucauauagaggugauguauuuuuuuguacuguguguuaauaugucucccuaauuuucauucgcagugcuuauugaaggacaggcugauauuucaugggaagaaaaaaggaccaaaccauauuuuucuaauauaaaaaaaaauguagaggaguagaagaaaacccacuuacucuaagaauguagaauugggaaggcaugcaacauauuucacaauuacauuuuauugcauccuauuaaguggccagaggguuuuuuuuuuuuuuuacaaagcaaagaagaucucaaauuaaauuacuauuauuaaaccccuuaagccucauagugaguuuauguuacuggaaacuuuugauaaauuaaauaacacgcaguauauaaguaucuagauaaaaucugauauauuuaaaauggcuuucuuacauaucuauaaccacaauguaacacucaaaaugucuuagauacauuuuuucccgcagugagaauauuuuauuuaaauucauucuuguagaaaucucauuaaugagaucugcagagcaauaaucuagcauauagaaaugccuugagauguuuuuuuuccucaaauuucuucucuaaaguaauucuauugcuaaaaaauguauuuuuauuuugaaucuaauagagguuuuagugaauaaaauaauaauguggauaugaggcuaaaucuucaguaguaaaagaaaauuuaaauauaaaauaccccggcaacaaggagauuaacaauacagaguugaacuguucuggacucuucagaagaaaauuggaucaguggacagugcucccugagcagggcauuuauugcaguggaagagaugggguagguuuucuuuccccagauaaccauguuauacuuuccuugaauguacuuacauuguggacuguguaauagcucuugaaauguuuccaaauguauguaauuaucagccacaugagagcacaguuguacuuagauuuugcaauuaauggggaaucacaugcagauaugaucugagggcacuucccaucacuaauacaauacagauaagaaccugacccugggcuaccaauaaaugcagguucaaaccauauacaugccagccuuaccccacaguaaacgaugguuauuauuuaaaagauacacaauuuuauuuaauagaacucuugucucugcucagaauuauugguauuugugaccagugacagaaggacaaaguaugcuucuauauugucacauauaccugucuuuauggaaaauacuuuuaugauuuauuuauggugucaauuuaacuagucuugaauuaccuggaaagauggaaucuuaacugaagaacugccuuagauuaaacuggcauaaacugauggucuuuggguagccugugaugaugucuauacgucaaugucuucauuguuaauuuauguaugaggguccagcccacugugggcaguccuauuccuaggucuuggcuguaaaggaaagcucucagugugagccagagagacagccaguauacaguauuucuaaaugcuucuugccuccaacuuccuguguagcuuucucgaaaugaggaacuguaaccagaaagugugagugauggcauuuaucacagcaacggacaugaaaauugaacaaacaacaauauaaagcauguuccugaaaguauaauuugacaaggcuguguaguuuuuuucuaguuuuuaucauuauuauuauuauagguguauuuaaauaauagaaaaaaagaaaugaaagaaaaucuuuuuagaauuguuagauuuaauucgguaagcucuggcaaugcauauuacaugaauaaaaggagacaagugguaagccaugacagagacagagacuguagcagauagauuagacaaagggcucugccauguaggcacuucccagaaaccccugcaguauucccuauauuucuuccuuuagccuuuuuucucccuuuacuacucuaccagguaaugcaaguuuuccaucuguucuucuuuauagccuucuuucucuucugcaggcaaagugcuccacaaagcugguuaggauguuuguucacaucugggucccagccauggaugaugaaugguccccaccuuauuugccaauauauuuccaggaucuaguccaagggucugccaccuuuaucagcaagguggcacacaauagauguuuuaggcuuuguaagccauacaaucucuuucagcuacuuaccucugacacaagaggggauagaauaccuaugggcaauauguaaaugaauagguaugguuguaguucagcuaaacuuaauuuucaaacauaggaaugggccaguggaugaaaaggcacacaauuuuacugaaugacuagggagucgcugguaaaggugaaccaucauuuagacuaaauuuuauuggaguauaccgaaagugcacuuaacauguaaauaaacauaaauccuaacaccgcauagaggcaauuugauucugcuucaguagggaggacauuugcccagcacccaguacaccagcccuucgccuacagguuucuuuauaaugcagauacuggguuuuauuaaauagcuuaaguagguuacuauuaaauaacauggaauucuauagcauauucaagguuaagaccaccugcuguguguuagcugaacagccaguuacauuauacuaaggucuccgaggaaauucaaacaaaauucuuaugcuucccgugaaaggaauguacaaaaagagauuauuuacaaaggaucagggagcaggaagcaacaggaagucaaucagaagccacagcagaaaggcaucccaaggucugccuacaugguggauuggucucuggagccgagagagcaguaagggcugguguguagagucguggcuacugaaggagucacugccacagcagaaggauggaggugguguggagagaagagaaucuccuacuucuaugcucugauucucagauuucuuuucuuucuuccuuucucuucucuucuuuucuuuuccuuucuuuuuaaaaauuuuuuuauuagauauuuucuucauuuacauuucaaaugcuauccuaaaaguccccuauaccgucugcccacccugcucccuaacccacucacucccacuuccuggcccuggcauuccccuuuuucauauccaauuucuucucauuucuguccuauggauugcacugcccauacuuucuuggauguuggguuaaggaauguguugucuagaaaagaaaucugaacucaccagauugaugcaggaugggguaaagcaaggaaugcugguggcaguggcaugcugggcagcuaagggcauuugcugucaggccuuauuaccggaguucaauccucaggaccuaucaggcaggagaagcuaacuccaaccaguuucuacuguaagacucuggggagccuuagcuuacuggggacccccugagugaaccucuuggagcugggauagaugcaaaaagcaagagggauuuauuguuccagugcacugggguccuuaagaagagguggcagcccccagcacccguuuggcgaguuuuuauaugguuuucaggggcagaauagagcaucaacaacuaggcacaauaugaucggcagaacagugcacccuuuaaacugauuggucuuuagggaaugaggugacaaggacuucccuugucugaagguagguaggcauuggucuguccuguggaauguguccccacccacaggucaguuccgacccugugggcugaggaauguuaauuagccucucccuucuggaggggugaguguuccaugaccuucccaaaguuccugggccagucuuuucacuacacaccucgauugucacauguauacauacacauacacacacacacacacacagagacagacagauagacagacagacagagagaaagaaauauuacaugcugaaaaacuuuaaauaauuggccaguuaacaugaggaagaaaccagucugucuuuguaaguacaaaaauaaaaugcucaggaagaaguuuuagagcagaucacagaaggccccaccaauaacuggcucacauccccuuguguugaacccauauuccaggacuuacacuaaaccaaagcuguguuuuaauuuaugucaggguguuuuacagggucaauuucccacacccagguaacaguauauauauauguauguauguauguauguauguauguauguaugcauuuauuuauuuauuuauuuauuuauuuauuggagcuaguauuaccucuagaaucagaaauaaauagaagacagcaccuuuaauuuucaaauuacaauguacacuugacaaauaaccauugugaaauuaguuaguucagaacaucaguacacaauggaagaaauccaucuguuaucugcuugguggaauucuuuuaucucaccaacuuuaaaaacaacccaggaaaauuacuauccccuaguauaaagccuuuugaauuucauaugcauuuaauuugguaaaugccaacucaaggacaagaaucaugacaaauagcuguuucuuucaaauuaaaauacacuguucaaugaacaguauugacauuccguguaccuacuuacauacaaguuucauacaaucuuuuucuuuuaauuuugaaaaacauuuuaauauuuaaucucucucucucucccucucucucucucucucuuucucucuuucucucucucuuuuucucuguguguguguguguguguguguguccacuguucucuagcugggaauucuagccauuauuuuguuaauaaccaaaacagccuccugcaaccuccaucacagcuaaagaguucugggagaggccggggggggggggggggggggggggggcggaggcuaggaggcuauaggggcuuugaggauagcauuugaaauguaaaugaagaaaauaucuaauaauaauaaaaaaaaagaguuccaaaauggccauauaucuaagggaaaaaaagaaaagcaaauaguggacauuaauauuuugcuuauccuaacagggcuauaaccuguggucaugauguugaccuagcugauagcaucagcuauaugucacagucacaaaguuagguaauuauuuggaugcagaggaaguagguggguagcuugcuacaggaggcaaagguagucauuugcaugucugccuuuacucaagaguguuugugcaaagagcaacagguuuuuuaaagaccugcucaccaucucuucuuuauggucacauuuuguccugccuugugagcauugucccgccacagucacaacuuaagaaacccagaagacuggacagacucgagcuuuagaaucacuagugaacaaugcuugucuuuaaaaauauuuacaugcuaaaugauaaggaaauguagcuauuaucgacaaggcacaaaaaggaaagacauaaaauccuuuuauuugauauaaaaaccuuaaaaucuacuguccaaauaauuacuuccagcugaaugcuauacgcuaacauauaaaauacagguuuuauugauagaguggaagcaguuauccaacauggcuuuagaauagagaaaauauuucuguuuucaggucuucuuuuucuucauuuucuuuguguuuuacaaacaagcaggauccuaguuuucucagcaauucuaagcacaucguucagacugacagagcaaguauuccacacaauugguucccuuggggucaagccagagaugcucaaucaggauucaaacgggucauaaacccuucauggaucucucucaaguggguggugauggcucccuagggccucucaucauuugcugcgacagucaagcacuugucauuagagacaaacacucugucugucuuagagacucauccaguugacucuuacagcaaccagagaggagaggcagugguguaaagaaguccaaagagaaaaauuagacaugcgugccuacccaggcaugauugcucccugcauauugcauuucuacaucugcacuuucagcuccuccauaaaacucgguaacucuuuaucuaccaugauugcaggcauccaaauccuccugagagggcauauauuuuucaauaguucuaaaacacugaagccacugcugggaauuuguccuaaggaaauaauuggacaagcacuuaaacgauauauguacaagguucagguggugcuguguucuuuacagaagcaaaagauuagaaacacauugauaccaauuuugguuuaguuguccacaaucuaacuuuuaccuguuauaaugaagucuugccaccuacagccaagagucagcuacuuaugucucuagcccaaagaaacaccuuggucccaucugcuuuggaaaacagagacaaugcuggagguguuugaagcugaagaucugacaccaacucauugcuccggucaucugaaugacagccagacaucagcuuccagugugcagaugugaagacaauucuguuuaaaaucccuugggcuuccuauucacauuaggauccuuuggauuucucagcauggaaagauccuaagcaacucacacuuagccacggcccugccuugccuaccuguugcucaagccacccuggugucacacaugacaaauucuaccuuuuuaggccuuuccaaguauuguucauucaugguaccuagaacugucuccuuuacugacuggccagaguagcugguagcuauucauuuuccuccugauuucucuuucuuuccauagacagauauagugaaacucaacacaugugaucuuaagcaacaaguucccuguuuccugguaucuuacacacauucuacucagaacaccuguauauauaucuaucuaccccacagccauaucaaucaccuugggauaagggacagagacucagucauguuuuagguaguaaagaaucccaccacaaaccauuugcauccacuuucccuuaugaucgacucuccugggaugguaggcagguauagauggcaucuucuacacuccucauucauucauacagaaauguuccucgaagauaguauaguuuaugauccucacaguaaguugaaaguguucugaguauacuugucaguucucaacagguuuuuauacuucaagcauaaacacgaguaauaguucaacaaaggaaauguauggcagagcagcugucauuuaauucuuuuauaauuuauuguuuauuacuuuuacuaccuguuagguauauuauauguguuuacucaguugguauccacacauggcuugggaagcaugcccugcugucaccccauuguagagaugaguggaaagucucagagauauucagaggaucaucuuugauccccaggcuacuaaacauacuaucagaauuugaacugggacagccuagcugccacauacauaugguuuaaacacaagugauguugccucuacagcauaugcuagauaaauaaacacugggccuagauacguuacauaguaucugcacuaagggcaacuuggguauaugguaucauuagagaaagaaacugguggauaaagaagcagagugacaacacacuaaaacagaaacugauaaagccaaggugaacugguacauuauucuccccagaaggugaugcaggcgugaacugguuugaacagucacaauauucaaucugauaaacacaaaaggcucggauggauauccauguacacuuuuugugugaucugccugucaguucuagccuucucaaagauuuccagcuuaaacaaacagacagacagacaccacacaacucuauggaagagauuaacuucauuucuaacauaauacuuuacagguccaaccuccagucuucuaagccauucuuugacucuucaguauaaccaagaaugugcuccccacaaaugaugacaacauaaauaaagucagagaagcugaaauccuaucucagccaacucagaagaauauuuuuacccuucuuuaucugagaaccuggcuuggccgacaguaugucugcuccuagacaucacugaacaaaagacuucagaaaccuuaggaacaauuuauuuaaagaaaacuccauuuccaggauccuaugucuguguuccaagguaauaaaauauaaaugagaauaagaaacaagcuaauaaagcgaauugaaggcugcacuucaauaacaagguuugggagccauuuacuagccaugcagaucucacucucaugacuuauaacaucggcugaauuacuuaacagaaaugaaagcucauauugcuucuguuauccgauauagaugcuuuuuggagcugaacaaugugacauuuacuucagagcacuuguaucuaaucaauacauaaugcuaaaugugauuuaaaaucaauuuaauugucuucuuacuuucccaugagucaagagggagaaacaaagguaccaucugagauauaaacuauucagcucuuccccaaagaaaccauacaucccauguuucuaacggaguccaagaaggagauacacuugguuugcccuaggaacugaaaaaggcauauuguugaaacagcuaguacaaucucuucuaauaauagaaaaacaaaacaaaacaaaacacuccagcucucuuaguuccaaccaacuuaaguguuaaagcaucuuuacuuguuguagaauuucuccaaauuaugggaaauuucaaaagaaaaaacugaaacagaccuauaauacauauacuaauucuauuucauccaguauuuuauauuucuagacagauaucccccuacauauauuucuuaucaucaugauucuauucaauuuguagcaauuacacauauacacugggcuacucuuggcuguauauacagugauuuacuguacauccauccaaacacuaauuacugagugccaacuuucuucaaggcuuuaucauuauuuuucaaagacaaauaagguugagugauuuuaaaaggaacaaaaucagaauucgaacuaccuaguaacacaacaaacucuuaagaaaaucaaaguguaugaaagaauauauguuucaagacagaaaguaagcuguguuuaaauuucagacuucacuuuaaguuucacuuuuaaaaaauuguacuuugggccagcagguaaagguacuuacagccacauagcaaacauguuuaccugaauuccauacuugugacucauaaggcaaaaaggagaaaaccaaauccuacaaguugaacugugacuuuaacacacauguccuggcagauacauacauaaagacacacauagacacacacacacacaugcaugcacacacacauauauaaauguagcuuuuaaauugauuauaccagcugacuguacucucugcauugacuuuuuuuuuuuuaccaacaggcaagugauuguaugaauauauuaagaaauuuuaaaauuaguuuccucacaagaacagaaacuaaccauaagcaacguggccacacaaaacuuauuuucaaaacuauggauuugacugacaaaauuauuacauaaucacauuuaaugaugaucagaacuaguaaucaaagugcauuaugcuauaauugcuuuguuuuguaaucuuaggcaauguggccaggcaugguugcaagcagcuggagcuccaggugccugggaagcugaggcaggaaacucagguaagcuaggaguuugagaugagcuuggcaaugaauaagaacuucaucuccaagacuacacacacgugcacacacacacacacacagagaaauacacacacacacacacacacacacacacagaaauacucauacauacacacucacacacacacauaaauacgaacacacccauacacauagagguguacaaauacauacacagagacacauacacacagagacauagagacacauauaaacaaaacuacauauauacauagacauacagacuuaaaucuuuucaaauaaauaauagauguauaaaauuuugaguuuauaguuuuuuuaaauguuggauuuaagaagaauauaacaaaaugauuuuacuuucauaagauaaucuauguuuagcaaagaaacagaguguaugucacgagaaaacagcauuuuuaugguuuaaauacuugaaaauguauaauagcaaaaauauucaaaaugucuucagaaguugucacaacauauaaaaccuugaacuguagcaaaaaucuagauaaucuuucagauaaaauacaaauguaacagacaguagaguggacacucaaggcuuagaguuugacaaguucuaacuuaucuauuggcaaacaaaccuagagaucccaacacaauuuacuggccccaagaaguauguagacuccacacuauccaauagcaucaccgcugucuucaugucaucauucugcccuugauagcucuuccagaucacacucccgaaacauuaaaugcaccuuggauuccaaagacucaucacagucagaaaggacacaagcuaucucacuaacucuuuauacuagcuacauauuaagaauauuagauguuauaaguugaauacacuaaauuuaauuccaucuucuuuuacuuuuuccuguguccucugggaaaaauaaauucuauaugacuuguguucuacuccuccuuaauaguuuugguauaguauguuuuuaaaggauauuauucuugaaguuguaaauaacaggcuugaguaugucaaauugcuaauuauauuuuucucaaugaaauacacucuuuucgaccuaggauauaaucugacagauaaaacagaagaugcaugccuucucuaguacugauuuuuucagauaacagcagcuguuggccugguuuuccacauaucaccaaguuucaucaaucaugaaagaaagaaauccucccugaguuuuccccacauguuugacauugguggcaagcugugcuuccguguguacgcugagaaucagaaccaagccagcuugcuuucuggcugacugcuugucacuacuccugcaauauggcaaacacagagggcuuguguuuggagaauuuagaagcaaaugaaccaguccaggccuagacaaaacccugacccaaaggaacuuuuagacaaauauuucuucuccuuggcaguuaugaaguagauauaugguuaggcccaaaaacuuguuaaaaagucaaacuguuagaggucuuggggaugaugagacggcuuuacagguaaaagugauugcugcacaggcagaugacaggggcucaguaccuaaauccauguacaagcagaaggagacagucauguucccaauguuauccuuggaguuucaaauacacauugcuccaggaauaugcuuagaaaacaucacaauaugcacacacacacacacacacacacacacacacacacacacacacacacugaugaugcagaagaagaggaggaagaggaggaagggaggaggagaaguagaaaucucuucuugaacauaguuuaguuuucuuaguaauuucaagaucccauuuguuauauuuuauucacaagcaucaacacagcugugaaaaccaacuaaaucuuugcuacccaauauauguuucccaaguuaaacaugcuuaguaaaauuaaauaaaguuagcaaaaauuagaaguucacucccucagucucagugagcaugguucauguagaauacaacacuacaggcagcugcgaugaagaacacugaaguauagaaugacaggcaguaagcuagcaacccagaaaaugaagagagaagcccacagcauggagaaaggcaagugacuaaagggaagauagagaugaauucagaggaaaacacaucacugcaguugcauugugacaaaccaaacauagggguauuuucaguggcccuuggguaaucucauuugucagacuuagagguguaacuagaaaguaaaauaauugacagaucucucucucucucucucucucucucucucucucucucucucucucucucucucucucucucucucucucuccaaauagcaguuuaugaaagaaugaggagaucagguugucuacugguuuucucucacugaagaguugaagccaugcuugggaccuaaauagacuaauaguucaaagccuuucucuagaaauugaaaaacuuggcuuuuauggcuucacuauugcuggccacgucuaccagaggcuccugauuuucaaagccuaaaugagauaauguuaaaucuaccugaaggaauaauuaaggcaaccauuauccuuuuccccccagaauguaaaagguuauuuauuuacugauuguuggaaaguaccugucaccuuguaguccugcuuggaaugcaacuuguggaagucccccugccuccgcauuccuagugcugagaugccaagcacgugccugcacaaccagcucagucauucuuuuucugcuccucuuugcuauuuacaagugcuacauacauuuuauccuacauaugcaggcaaguauaccucaagaaaaauaccuccaaacuauagcaaaaauaccacaaacuucccauaucucccacagucugcuuccauagaugacaaguuacucauguucacuguauguauuaucugaaaacgauggucucugauaagcccagcuaugauacugagaaaguauauugaaaugcaaaagauacagucaagacuuucuuggagauggcaugaaauugauuuccaagauuucagagauggaaaaguauaggccaugagggccuaugauacagaaagaccucaaacacaaaacagcuuguauucuugaacacuguacaaccagacuuggaacauuguaaaggcccugccgucuagcucacaguauguaaucacauauucuugucaagcccaggcaauuccaccagucuguuaagaaauaaaauaaaaaacccaauuucucauuugcaagacaagguuucaaaauaguuuuuuuucacccauuuacguagagcccuggagagaaguuucauucccaagaugcacugggaggcagaugaaauuuauuuuucagagacguuuuuaaaaagaagaguauagauuuaugcugaacuaaugugauuaaucacaggaaacuccuagaaucccaacauauuccauugcaaaaguauaguuguucuauuaaccaauauuauccaaauucuuguguaauauguuagaagccaucaguguacgaucuuacccacaaaacuaugcaaccaaaacucagucucuauaaauuauucaaaacauuuagagacuacaauaucuuaaauauucaaauagauacaacauuuucucauaccuccaaaugacaggaagcagcuucaucgcagguuagcuuuugaaaacgaguucagagagcauggccaucacaugcggccuuccgguuucuagagcucucagauggcccugaagacagacacagcacaugcuauuuucugaaggaugcagagucucugaacaguugcaguaagcaagggaacauaggauacauagcagacgauugugaugccaguggagaacugacaagcacaugugccaggccuauuacaugaaauaugagcuaugcagccagccuucaucucauccuuagagagggccagaagcaggggaagagucagcgggaccuucccugaacgucagcacacuacuaagagcagcaugcuccaugccuccuuuucucugacagagacaauacuuccuuucccaacauggugugaaggagaagacugagggaggucagaagcuacugccugguucauacaaacaaacaaagaagcaaaauccugaacuccuguucucuauggacccauauuuauauuuacuauuuaugauauauguuuaugaauauguacauuuggcuuuauuauaauacagauauauagaugauauacauauagauaaacacauacauauaaacacaugguuccaugauauaagcacauguauaaaauacauauaaauguaugcauuuaaauuugaaaagaaaauuauuuugcucuuucauuuucauauucuucuuuggauuucaaugaaccuuucuuccuacuucccuuccuucuuuccuuucuuccuucuuugaucccuuccuucucugcccuccuccuccucuuccaauucucauuuugauuucauuggcuuucacuacuguaugccugauccauguuaaaaaaaaaaaaaaaacacagagaacugccuaaauggaauuaauugcauuuccaguuuucaucuaacauaacccaaggaaaguaccaccuucccacacagcaggaaccugugggaauuguccuuucgcacacauucccuccccacaagccuuuccuugacaucagcucucaacaccucagaauggugucacagggaccugagccaaucuguaccaaaaccugcuccuugcucucauuuacccucuugaaucugauucccuuccucugcaagaagaaccccaucugcugggaggaaauauuugcagccaacaugacaagaauggaaucccugcuucuaacagcugugaaucaaaacuccuaugccugaaauuaacuaugcugugcuuccaaacagaugcaugugcagaaucuugcucaaacacucuuguuuccagagccugguggaaaccaggcauagaggaagugcagaggaggccauucgcuggcagugcugguacucaaguucagucucaauguucccggaagcuuccaaaugcaaagcaauacaauaaaaguucacaauccucccuguuccagaaagaggagcuucugaaagcugccaaucacucacuggaaacagugacuaaacagauggguuuugacaccucugguuugauuuuaaaugcaaacaugucaauuugugcucugggacagguucuucacucuccaaaucuuuuguggggggggauauguagaguuuuuauuuaauaguuguguucccugaguucaguuguucugccuaucaauuaaggcaaaggagcuuuuuacacagauaugcuuacuacacugaaaccuaaaguucuuaaauacaucacuaaagucucugcaaaagucuacauacaaagggacauuugaaauugaaguugaagaugaaucuguguguuucuaugaauaagaagagcauaugcaagcuuccuucaagacucugcacagugaguaagcacacacuaucuuuuuacaaucagaaucagcaaaucaguaucccaccaccacugcucuagacucuuaaucuuaugcccaacuucuuccaugcuugccaauugcaggcgaaagguuauuccuuguucuuaagagaccaaggaugggacagauaugaacuucaaacacuagauuagaaagaugaaguguauacaaaggaaaccaccagagaauauuuuaagcaaaaugucaaaauauucacaacgauggacuguugguaaucacuuaauuauugaaagagaauauuugcuuuuaguccacauggacuugugauguuuugagcuagguauguccacauaccaccuuaguuuauauggcauguauuaaggcuuguuuucuuuuguagucauacguuaauuuuuaaaaaaaaaauguuuuaaaauauuguauugaguuuuaaaauggaguaauuaaaaucugcucaacgccaaugcuguguuuuaagcccaagacacaugaacucuauugaagccaguauacaaagagacaaaagcuauaaucuagggauaauuaaucgaauggaaaaaaacuucauucaugaauuauaacuuucuaccaaaaucuuuagugcauuugaaauucugugaguauccacacacuggaaaugacaugcucuguauugcucguccaucuuuuuagauagcuucucccagaugaaaggugcuuaauucugagaaggaugcuacuguucaguuugucuuauaagaaauauccaucuuucccuaacuccagaguuagggugacucaugccguuacuacaguggguuagauagaauggcuuuuccuccugucuuuguauuuuagagagcaguaggcaaaggcuguguggaagguuccugagaagaugcuuaacaacuggcuggguuggucucggacauauagcagggcuacauuuaaagagcagaaagagcucuuuggauagcauagcagacagcugaucucucaacaugauuucaaaggcacugaaaagaugagcuaaucccuucaucaggcugagagaacaucugagagucuugccuuggguuuguggauccuugauguuuggacuauaaaugcuaauuuuucuucucuauguugaaaaucaaaccuaggccucaaacaauguaucacaaagcuccauucccagcugauuuaaaaaaaauaauccguggaaaauauacaugguaugggauuguaagcauaucuaagugcagaugcuccugauuuaugaggaagcuguauaccacauaaauccauuggaaguugaaaguauugcagauggcaguguguugaggacacacagccuaauaaacauuacaggucauuaacaacacagucaguugcacagcaccaguuguuucuggaagcuaaacuuacuaccuaugucugguaucauaggacaguuuacucauauagcagauagucuggaaaaagaucaaacuucaaaguuccagguauaaguucuauuaagugcauauagguuuuguaguguaguguccuacacucaaaaaagccaaaccauaacaauuuaggaggcacauggacuguauagccuuauaaggauguucuaaacagauuggacauccucaucacagccacaucaaggugaguuacaugaggacauuaaaugacagcuugucaacucucaucaaauggaaucugaugacuuaaagccaauguggaaaacaguaaaaauuugagauuuacaaaguuguaauuuuuaauggugagucaacaauuuaacuaacucucagaggaaguuaaaaaaaauaccaucuggugacauuggaaauugauaauuagacaaauuccauuuuaaccaaagauauuacaagaaguagggagggaaaugggaaugugcauacuuuuauuagcugcuuaaguaagagagaaauucagcauuauucuuuucauuuuugucuauauuauuuuagguugcaccaugaguuucaccagagaagagcuguuugguuuuccuacaagcugauauuaauauacagugaacuaugcacuccugacuucucccaugaaaacaagagcgacagccucuaaaagagaacaugagcuaguggagauguguuuaugaugacaaccaagaggcaucccuacauaccugcucuguccucuuuguccuuacuccuuauucagggaccuggaccacacaaaagccacuggaaauauggcaagagagcaaacuaguaugucucacuagcauuuguggauuaacaccuaauacuucagaaaaugaacucaguugucuuaaccuuccuaaaacaaagcaaaacucaacacugugcuuaagaguguggcuuauguguauaucaacgcucccucugucaagauccuagagauaaaaaggacaaagaugacauagugaaaaaaagaaugagucucuagcucagucugaaaauaaaaaaaaaggauaaaacaucaaagaaaaagaguuacauaagagaaaagaguuauauaggaaaugguccuggucccuuccuacaucaccaacccuagcagaaaaaaacaaaugaacaacauagaaggcaugcauauuuauuuagaugcauuugagaaacagacagaggagagagagaagugugugugugcaugcgugcaugugcuaaaaaugaccuguagcauuaucagaaaugcugccuuacuucuuuugagacaguaugucucauuggucuggagguuaccaauuaagcuagcauuauugaccugcagguccagggaucuuguuuucuacacccaugcuggaauuacaaguuugugugauggacccagcuuugacauauggguugcaguccugaaagucaggugccagcugagacauugcauagacugcuauguugucuucugguguuuugcuuucaagacugugugaaugucauagucauacccuaagucaucaugagaacggaugaauacaggagaaagaaagcugcauuacccuacaacaaucauggguggcauagaauccuccagccccaaagguugaguggacaacagcaaccugggggcggucuaagagcugccacugaacucccagagaagauguaagaaaacuaguaccugucuccugcauaucaggguggaccagauuugauguuguucuauugcuagaacacauauugccaagggaaaaauuaaguggaauucauaaaacaauaaaauuccuuuccauuaaccugacagcauggguuucuaaaauaagaaauuaaauuccagcaagugaauauaauuuuauauauuugacuuuguguaauuaaucaugccgucuauauggucugucaaaaugcagcuuaauauacuagaaaaaagcagcagaacggcccauucugaauacuucacuacugagaauacccacaaaagugguacuaauauuugugaggagauuuuuaccucuguauuuauugaauucugaaguuucuguacaucuguaagaauaggagaucaaaggcauggguggacagaguggggagaggauauauguaucuaaaagcaaccuucuuauaacagucaacuucccuagcagcaggccuuagaguuaaggguaucaggcaguuagaagggagauacuucuaggcagcucacacuuauccaucccaccacauuauucaguuccaucugcagcauuggagaaagaaagguuugacacacugucacugauaaguuauuaaugcugcucuacauuucccaaugcucccugucaggauuucuguagccaaacucauaaugucucuuuucuuuaagaugaucuaagcuguaaugugaaauauguugcccuacgguagaauagccagcuuauccaucuauagucuaagucuucaugaauaggaucguuucuaacaauaaacuuuucuuuccuaguucagcuuuccuuggugaaagcucugaauuccacuaaguuuggacagaaagagacuucuaauaacagugggcaucuagaauaccauugagugagcuuccaguggcuuguguuuauaaaauccuguaucacuuucucuuguaaccugccaucacaugugacauaauuuaaugcgacagcuccaauuuuuaaggaugccauuuugcacuuugcuuucaaacuccauaacuacaguuuuccaacaggaucuggccaaccucaguggagcagacggggaacuguuaacagguugccaacuuuaaauuacuguugaguggcuuagcagauccucagaauaaguccuuuaauaaccaauuaaucauuucaagaacauacuuguuuucugccuuuacuuaaagaaggcaauuuuacuaugaacuccuaauacuucuccauucucuuccuuauaguaacauuucuacaguguaugugcacacaugcgugcuuguguguguguguguguguguucugccaagacauuagcaagcacacaaaaugagauguguuuaauaaagauagcacuacuaaaaacuucuaagagugaacguuaggcaccuaaugccugcaaauacuuguacuucacaucuauuuucucucugugucaucaggaaguucuuaccuugugugggaacagauugaggugcacacccauggcagcacagcagaaaauaaauuccacaaguccguaucuuugacaauguauguacacccuaaaaauuauuucagguuaagcuauuucuugagcguguaaaggcaaccgucaugaguuaggaaaagugaggaaauacuacagaaauagcaggagguuugauuuuuuuagagagcucuucaaauuugugagaagaaaacauguugaauuuguggcuugucagggaaguuacagaggggaaaagggccuagauucauaaguaucuguaagacuauuucucuaaaugaaaaagaaacccacuuaaagcugcauauguggcagaagauggccuagucagccaucacugggaagagaggcccguuggucuagcaaacuuuauaugccucaguaagggggaacaugagggccaagaagugggaguggguggguaggggagcagggcaggggaggauauaggggacuuuugggauagcauuugaaauguaaaugaagaaaauauguaauaaaaaauuaaaaaaacaaauauagaaaugaagaaaauacuaaucacaauagguuuuaccaagaagacacuaaaugguaaagguuccaaacauuuuugugcaaacaagauagaaaaaugagauaucaaaaggggaauugauaguuacaacagcauccuauagaaaugggguauggaagagaacucuaacacugauggugccuuauauguaagacagaaaaaucaaagcucacacuguugcuaaauaaaaagugaccaaaguucaguauuuugauguaguuuguuuuguaaaaauugcuucccuaauuuuuguuuuuauuucucuggucagggacagggcuuccguguacaaugcaugagagcuugaguucaaauucucagaagccaugcaaaucuagauguaacaucaguggccucgugcugagauaggaugugagaccgagaaauccccagaaggucaaaguugcauauacagcaacaaacaaccaaagagcaagcugaccucaguuaagguaguggggaaguacugauacccagauuuguccuaacacacacacacacacacacacacacacacacacacacacucacacacacacucacacacacacucacacacauacacacucacacacacacacucacacacacacacucacacucacacacacacacacacucacacacacacucacacacacauucacacacacacacucacacacacacacacacacacacacucacauacacacacacauagcagguuuauaggggcagauuuuucaauagauuuuccuuccccuuuauuuacaaagaagcacauuuucuauggauauaugcauacuuaaugccgucuauuggcauaucaucuugaacuagaacaucuuaacucaaaauacauuaucuucugauuaguaaaaaucgacuugcaacuauguuuuuaugauauucuucauuuuuuuucaugcaaagauucccaaucugccugccaauugaacuguccuggucaugaaacauuaccuucucaguaugugguaugcccaucagcaagaacguagcaagacgugcagacuaacuuuauuuauuacauuugcauugccuacaaagccauuuacuuaauggaugagucucauuagcaguccaaccacaauauacggaauacaaugauguguuucauggguucauuaaaauaauauuucaaaggagucauuagaaaaaaaagaagcaaaggauucaacagacaguaaguugucugcgaauaaaugagauggaaccaacauguuuucuaguaaguuagaaacauguuuacaaauauauuacagccauuaaaacaggaaacagcaacuuagcaagugcuggggggggggggcgauuacucaugcaauuuaccaaaacaaaacuguaauacuuucacaccaauguuacuguagaugcgaauggcuauaguaacaggaaugggguauuuauuaagaaggaauuuuuuuccauauccccaagaagauucuuccauuugaagucaaauuuaagacacugaaucuguguucaaaucacugauuuguuccucuuauguaugguugugucaucuacuggacauaugagucuuuccaguuagaggaacaacuuauaguacaguggcaaaaauaacucaucccaaagccuaagaauaaaaagcagcagccagcagccacuaaccaacacccaaacagugucuguuuaccccuugcagcagagacacaaagucucuagcaucuuuccacaccugaagguugaaugacaucuguccaacaaugauguauaauuaaauggacaacaggugcuacuuaaacaaaaggagcuuuuagaauauaauuauuccuucauuuaaaaaaaaucgaguauuucuaccuuugagcaaaacaacaaacagcaaugggcaucaccuuuccaacacugccagaguguuucacaaguuaccuugggaagaguuucuaaggucucagagacuauauuaaaaacaaggauuuuuuuuucucccacagaaaauaagucccaauuuaaaaaauagaaagcuaaguaucuaccaucuaauucuuuagaagggcuuaguuuucuaguucugagacagcuauuuagaaccauaucugcaugcucacuaaguacccuugggccagaccucaggcuugggcacguguccacagaugaagauccgcaugcggggccaucuuccagugaguguucuugcacugagcuuucucucucagccugacuuacuuggaucaucuaugugacuuugauuuagucagugccacacuagcaaacaauccuccagaggccugaaaagcacuggcuaccucugcuuggcuccuccucucuuuuuuuuuuucuuuuuuuuuuuuuuuuuuuuuuuuuuaguguguguguguguguguauauauauauauauauauauauauuuuuuuuuuuucuucucauggcugauacuguuuucuuuuuuuuuuccauuuuuuauuagguauuuaacucauuuacauuuccaaugcuauaccaaaagucccccauauccacccacccucacuccccugcccacccacucccccuuuuuggcccugguguuccccuguacuggggcauauaaaguuugcaaguccaaugggccucucuuuccagugauggccgacuaggccaucuuuugauauauaugcagcuagagucaagagcuccgggguacugguuaguucauaauguuguuccaccuauaggguugcagaucccuuuagcuccuuggcuacuuucucuagcuccuccauugggagcccuaugauccauccauuagcugacugugagcauccacuucuguguuugcuaggccccggcauagucucacaagagacagcuacaucuggguccuuucaauaaaaucuugcuaguguaugcaauggugucagcguuuggaugcugauuaugagguggaucccuggauauggcagucucuacaugguccauccuuucaucucagcuccaaacuuuggcucuguaacuccuuccauggguguuuuguucccaaaucuaaggaggggcauaguguccacacuucagucuucauucuucuugaguuucauguguuuaacaaauuauaucuuauaucuuggguauccuagguuuggggcuaauauccacuuaucagugaauacauauugugugaguuucuuugugaauguguuaccucacucaggaugaugcccuccagguccauccauuuggcuaggaacuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcauggcuccuccucucuuuaucaauguggaaguaugccuggccuggauugcuggaggaugagaaacacuuggaagacagcgaagacagccaaggacaauaguuuagaucaucuuugaucuucacuagccagugaagccaccaacaugugaaugaauuuugcugaugucaaaagagucaccuacacggagcagggcgugguggugcaugccuuugaucccagcacuugggaggcagagcuagguggaucucugaguucaaggccagccuggucuacaaagugaguuccaggacagccagggcuauacagagaaacccugucucgaaaaaccaaaaaaaaagcccaaaaaaccaaaaaaaaaaaaaaaaaaacaagaaacaacaaaaaaagagucaccuacacgacgauugcaaaacacuacagaaguaugagcagugggcacguuuucauugugcauuauucaacaucuaacacauucacacauuaccauuguucucuguaaagagacuuauucucuacaaauaguggagcaaguuguauacaaaucaaaacagcacuguuuuuuacuaaagccauuaauaaagcauuauuugugccccacuuuuuaaugagaaaauauaaauaagacuuguacgagaggugucguaacucaggagaguacaugccuaccauguacaaggccagagguucuauugacagaaccauauaaaacagacaggugcuugaugcuuuuauacucuuaggcaggaggaucagaaacucugagcugcauagcaaguuuaaaggguauuggagucacuuuuucaucuaagaaacaaaagcagaagcagacauauacacaucuucugaaauuuuaaauguuagauacuaacagggaagcaauuauaagacuucugaauucaaugucuaaucugcuaauuuuccacacauguccuacauauuuagaaagauacaggauuaugugggaugagcagauaaagaaaugguguguaauauacuuuuauuguguagcuuagauugcccucagacuggcuaucuuccuacuuaaaucuugcauugggcucucuaguuaaaacauggcuagaacuucuggcacccugcaaccuauuuuugucccuggcuugaaaacaguaaguaugaaggauggauaaccccugccauucuuugcaguauucauggccuuguacauaacccuucuucuugguuuggaagaggagaacauggaaagguaacagagugcucauggcaggccccaguuuaugaaaagcucacuguggggucuuucucacuaguuacacuugaagaagcaagugcucuugagucccaaacucgcaagcaacugaauuuaaccaguaaccaauggaagcugaaagaccuuuuccaauccaugcugcuuaguggcuaccucauuuccccuacaaaaaauguggaggaaagccugauaguguagguuuguuuuuagaguguggguguacauaaagguuucuauaguauaggccaggcccaucucaaauugauagcuaucuuccaacugcagccccugaaugcuuucaacaccugaauuucacucaaacuguaagggaaaaacaugccuuguuuuauaccaauaaauguggguugcuacauagcaauagauaauuaacacaaagaaccuucuaccaaaugucaaccacaguacuacacacauugcuuagcucagccgacuuuuauuuucccuaauaagacuugguuagugaaggaagugauucacagaaugacauuauaauacaaggucuuuaggucauaggagaccaauaucuucgaguuaggaagucgccuuguaugaugaugauaaaggagcagaaucaccugucauguucaaagcuagaauaagauguuacaugaucauaaauaaaauaauggaugauuuaaaugagauacaauauaauaagugaagaacaauauagugugaggagaggcaagaggacucauacaggacuuuuguaauacucuucaaccugggacacuugaaacugcaguccauggucccagucaguucccagucacuucccagcacugcagcugguacucuaguuacugccaauucaucugcccucuuacgcuauacuuuaaaaaacaaaccguuuuuuaaaagauggagaauaaaaugaaaauauagccuacucagucuaauaaugaaaucuggcagagauguuaccaaugaucuuugucauuuccuauucuuaucuugucccagagauuucccucaccaaugauuucucucuccaagcccucucaccccucacuccugcucugcucauacuggaucgccacugcaauuccccuccuugcccccucuccuaccugaggagugacagcauguguugucacuugaguuuuugaucuuagccauucugauugguguaagguaaaaucucagguucauuuugauuugcauuuuccugaugacuaaguauguugaauauuucuuuaaguguuucucagcgauuagagauuccucuguugagaauucuguuuagcucuguuuccuauuuuuuaauuggguuauuuggguuguugguguuuaauuauauuuaacuuacaaaaccaacaaauugcauauauacugauacacacagcauucucuuuauuuucuaagccuaaacaugaccaaugaguaugcccauaaagauuuugcuuuaaagcccugacauuacaguagagguucccaaucugugggucucgaccccuuucuaggguggaacaacucuuucauagaggucaccuaagaggugauuuacauuagagagauauuuauauuauaauucauaagaguagcaaaauuauaguuauaaaguagcaauaaaaauaaaauuuuauuguugggggucaccacaacauggagaagucuaugaaagggucacggcauugggaagguuaagaaccacugcuuuaaggagaccuggcaaacccaacaacccuugcuguuuugguaacaaccugcacaacugucagguuuccugugauagaacuaccucuuuuggagacugucuuaucuacugucauaauugcuaucugaaauaugcaauuaugacucucauuuuuguauuucuagcacuugagaguauucugccuacagaacgugccugauaaaugcuauuaaagagaaaauaaaagaaaucuguuaccugguaguguauaagaagcugggagggaauccuuuaacaaaaaacuuagauaauguaggcagaaagaugcuaaaagcguuuaaacacuaaauccuuuagcucaaagccugaggcaggggucuucaaagauaaaagaacacagaacaauuggaaacuaaaaaauuuacaaccuaacacauguuaagaauuggaagaaguaucauaggucuccaaucuucccagcuguuaaauguuuucacauauugcauagcuuuaacauaaagaacaguggguuguuguuggguuuuuuuuucuaaaaacauuuauucugaaaaauuuauucugagaaacauacucacccaguuucuuuaggugcuaaaaaauaaggcauauccugugggacuagcuccuucuggucagagugguccuacaacucagcucacacuucagugucaaucagcgcucgauaacacaacagguggcacaccagacagccuuaguuuucaaugaaccacuuugguuuguucacaauguuucaaaagugcaaugauauaaacuuguaaacauucuucgcgaaggcacuucaaggcaacugauuuuuauuaaugugcauguguguaaagugugcuuauguacauauguguguguguaugugugaacacacauguguucagauacauguacaccugcgcauaugcacaugcaggccugaggguggaccaugggucuuucuggaucuccaccuuacauugauuguuucucauuugaagguggaauuccccaauaaggcuguuuugcuuguugcaggaucuucugucucugucuuccuuuugugcaagcuaccaugcccaccccccacccccacacacacacaauuuacccagcuucugacaucugaacucucuccuucacaccugugcaacaaccacuuaaacccauuagaucugucucccugguaugauuuuauucuugaauuucuauuaugggcccaucuuuugggaacuuuauggaacauuucaaugacagagaaaauucaggacuauuuacuaggaaaauaaauacuuccucucuuccucacccacccuguccaauugcuccugaacuuuaggauccaugugcucuucuguucacaagggaaguucugucuguaaggauuucagugguuagacauugaugaaccauuccaagaauacugugaguuccauguuugcuggaauagaccaucaguacucugccacaugcugcaaaggaugaagauuuaaaacggccuaaagaaguuucccuuuuccccagagcacagugggccugaccucagagcagguauacuguaucuccuccugcuggccagucuaagucugaauuacucucuuuguucaaucaauuuagacaacaaauuaggcaugaauacuguuuggcauaauagcauuaaucaaacaaagaagcaagcccuuuuuguuuugcaaacauaugacauuuugcaagcccaagagcuuuaauaugaaaaaggaguuacaaauuaauacuaaaaucaacucuagauauuaagagcacaaauaaaacuaggcaauucauacaaaaauauucaaguggcugaaaagaaauuuuaaaaaggacaaucuuaggagagaaauaauucaaauuaauuugagauaucauagucacaauuaaagucauggguuauuuuuuuuaauaauuauacuaagaaaugugcaaagaagacauucauaacacaaugagguuuucugcuggagaaaacuguaguaauaggcaacaaaagccuugauaaacuuguacauguauccugucuggcuuaccaacuacaucuccauggaaacauucaaagauguucagcaauuugcaugcuaaggucauucugccaugaaaaaaaaaauguaaagauaccaugauaaagaucugccaaaauuaaaaaggcacaugacacaauaaaaugucucaugaauaauaccauuuuaaugccauuggcaauacaaugaaguagaaaagauguagguaccaaauauguuuaaauacaaauacuauuauacuuuuaaaauguagaagugcauaucaaagguauucuguacuuaaaaugauguaaaucacuacucaugaagggcagauguguuagugcuucauuuccuuuguucuacauguuucauacaugugugguccagcgggacaagggaaauguggaaaauguacgacacaggacuggaagacaugacgcucuucaugucccuccacauacagucuuggucuuuaaaaucuccuggucaaauuauucuuaagucucaaacccaauccaaccucaacauuucguucugugagcaucaguuagaauaucacugcucaaagggcaugaagaaacagauuauuagaauuagaaugcaagacuagcaaagucacucaccaaauuuaauccuaacaaaaggaccacuuuaaagaucagacaucaaauccauuuaacaugaucaagguuagucuacugcugaaacagaauuuuucauaugagagaacauagaauuucauaugaaagucagcugauucagucugguuucuguugguagacaugcauuuaugcauuuccucaauuaaccauauauaucuaccuguacauacauguggccugaauuguugacuaguacugaacauaugcuauuaucuauaaaaauccacauuucuguuuguucuuggcaucguuugguacuuuguuagugaguguaaaaugacucagucuugauggcaugggugcaacaagguggccccuauggcccuguggaccuuucacuucugugguucucugauuauuauaccuuacacugcuaaacugagcuuagaacuuaggauaaguauaaaucaguuuucuguaagcucaauaagagacuuguaagaaauuuaaaaaucuuuuaaaccaauaacacagccuauugugguaaauuuccaacucaaauaagcccaggcaaugaaaacacaacucaauuaauaugaauacaugcugugggccucgauugggcagaucuaccauuacacuaccaucuuccccauauaagagaucccuuagaacuugugguuuuuccaggccaggugcuucugcucuaccguccuucuuccuccuccucugucauccucucucucuuucucccauaaaaccuucagcuccaccuuccccucuuucucuauccaaucaccagcucuagccuuuauuuauaaauuaagaugggaagaagguauacugggaaucaccugagugcugacucauuccuuguucacagccccucacaggagaauagaauuaacaucaaauacaauuaccuccauggcuauccacaagaacagccuaacaaaauacugcccgcucucaaagaacugucuuaggaucuguauucacuugucauaccgcacugggacaaaauagucccacugauggcccagcauccauuuggacuucucaauuuacaagcuucucaucuucuucuauaaauucuuugcugucaugaacuugggagaugaucacugucaucaauaggaagaugcuuuaguaucacagauggcuguccuuuuauaggccaacuuaaugacuuguucuuaucuaauuugucaucuguuauuuaguugucauuaugaacuuuuugaguuuuauauucaucaauuuugcauguugacuaaacagauggcuucauuuuuuuuuaaaaagcaaagcaagaaaaugacauuaaaugauuaaaugauaaaaaugcaaguacacacauacuuaaauauaccuaugugaaauaaaaauugaaagacuaaauuagaauccuaaaugagauagauuccagacucaauggacaggcaaagacacaaucaggagcagcugccugcaaaugaacaaauugguucaaauauagaaauacuauauuuccuuucauuuaucacaaccagcuuuuaaaaaucuaucuugacaaauagagauggcaaaugccaacugguacauaucaccuaccaggacaguccuuaugauauaagacacgguuguagucucucucugacguuuauaauccuuuuuagaaaguagguaauagacagguauucccauauuucuaauuuucuuccuccuucucauccuucuuauacuuucauugauaugugaauuauuuguuaauuaauaucuaaacauacgguauguaaaggcaaauuggaauauuugaaaauaaugaggucaaaguucagaagauaaaacaugccacugugacacagaaaaguacugggguucacauucuaccagagaaggcaccuggaaauuaugagaaacuaaagauguuauuaagugaggagguaauaucauaggagcaauugucuaagaaugugauguguuuaauuugccaaaaauugagagauuugcuuuaucagucccuuacaacacugaaagguaacaagacagaacaucauaguaaacuccagugcuccagaaacaguuguucauguagaguacaucuuccaguguugaaaugcauaaaacuuaaaguaacuccuuuucuaacucaacuucauucucuucacaguagcaaaccagaggaugacaauacaagaccugauccuguagguucuucaaaggagaagaaccuaauguagaacugaguuuaccagaaaggacaagucccuugugcuuuuuuuguaucugauuauaauggagaauugcaagauuaguacagauaaaugucaugccauucuaccccagucaugagugggugcauuccuuuaagauaauggcacccugaagcaacccaugucugucucucaauagaaggccuacaaaagcuuugauaaauuaggaggcaaacugucaaaaugaaacuucaugccagguaccugcauagaucuaaagacuuuuaaugagaccuggaaugagaauuugagucuucaagaauucuuucaagucuuuagcacaaauguuuuacacaaagaauaugugucugauguuaagggugugccuucuuaaaaacuggaccacguacuugcauguaauggacugauaagacagaacugaagaauccaguccaaaauguaccagugaugcauguaaguaaggcagaaacgguguagaaggaaaccacaucacgcagucuggcucagguucaagcuaguuuucuuccuuugugaucuuuugauccaugguaaguucugaucugaccaaaacacucagaaugcauucuuaaaugauuaaacaauuugaaacugcuucaaagaaccugguaucucacaaacaagcacuggucaagaccacuuuuauggaguccaguacaauaaaugauguuccguggacaaggcuuuuacaugcuaucugcccaugaagacuggcaagggagauuaucccaauacggaauuacauauuagaugcuucacuuagucacacugcuccauguaguauauguuuucacacucauauaagucuaauauauuucaaaauagauguuguaaggcugugagguaugacccacaaaugacuuugauaaagguaauccaaaacccaucacagcugugcucuggaaagagcaucuugcucuggguagaacaucuuuugaggcuaacuuggucuucucuaucuuucugucucuuugguucagaugugagauaugauuucucacauugcucaccugaugaguggcucucaauaucugguccaggaggagaaauacuccaaacauguuagaaacuaaaauuguacaaccccaaucuagaucucuuaaaugccagacucuggagaugaaguucacuagucugagucucaagaagccaucuggaaguuuugauaauauugugagagacaggauauugaacuguagguuucuucaggggaugaugguucacuuagcuugcaucccuucacuuuacuguacccuuggcauucaagacacuuaaugcuuauaaauucagauauucugaagacagaacucacagcucaugccucacuuucuauacaaugaucucacaccaacucauacaacacagggguucuaagaguccaguguaugccugagcccaucaacauugaaccuccaaaacucucccuuccuauacauguauacccacugacgugacugcagcaggguuuguacccuuugaguauccaugggaauauuuuuaugaaguuugaaggaggaggggacauaaauuggauuauguuggagauuuugaaaacucaacaaaauuugauaaggccauaaaaguggaauccaugauugcguaguauuacgauuagaacacagaaaagaaguuagagggauggcacagugaguucugcucucauggaagacucagguuugguuucugguacucauaguaggcaggucacaauugucucugacuguuccagaaggguggaugucuucuuuugaccagagaauuucccuucuagaguuaugccaaagaaugcauucuauaaccaggcauugcuuacuguguucugugauccuuugauacacccaaaccaagaaaguacuguuucagugaggagguuuggaagacaaagagaaagaaaauggcuuuauucuguucacacacuuguuauaaacaauugagauguguaguauaccauuauaauuaaaauaacaacaaagcuagcggaagauucaggacacuauuaagaucauggaauccuaauguaagggacagcuucacuugcagaguaaagaaauggaagagaacaaaaugcaagcacaaaucaagagguuccaacucccuggcacucauaccuuguucugccaacuugggccuuuguggcauguuaaccagaauucugugcucugggcuauaagcugacucaacucugugccaacugcaggacccuggggaaauuauucaccugcuuugugucuaaguccucugcaaaagagagaacucauguuagcuaacucagaauugaugaaagauguaaguuaaauaaaauacucaacauauguuaggcuucuuuugcucuguauagagcuaucuccaaagacaaaggaacauucaucaauucauuuaacuugcaugcagucuaucugucuaagcaauaggacagaaaacaaaagauaaacagaucauuacguugggaacagugucccauuggggcuuauucagcauuagggacacagcagguuuccaaaagugcaggcagguuguuggauuuuaucacaguacuaacgaacuucucccaaaagccaugguugagaaugacacaguagagacuuuggcauuacacagacuugaguagacuagaugacuuuaugaucacugaauaacaaaacuacaaaaaguaaauuucccaaauguguuguugcuuugaauauugaaaugccuuucauaauucguuaguccccuuucuccuucaccauagcaaccuaggcauaucacuugucuuuagccauagaggcagaaacagaaaguucaaaugcugaucacaggguauuuuuguagugacaugaaauuuaaagucuauuuucauagagccugcaaagagaccuuccucagcaagaauccaaaguacauuuuuaccuucacagacagggcucugucagacaccagugaaaccugauguuagugcaacacucaaaaugaggcaauuggcagaagcagggaugcaaauccaccaaggaaacacugggacagccaaaacauuuuuguuccaaggaaguaacaguagcucgcaauggauuaagaaugcagccaaacaaaaagccucgaagagaugcgcauaggggaaaguuccugaacagaacagcaauggcuugugcuguaagaucgagaaucuacaaaugggaccucauaaaauugcaaagcuucugcaaggcaaauaagacaaaaugguaaucaacagguugggaagaucuuuaccaauccuaaauaugauagggggcuaauauacaauauauauaaagaacucaagaaguuggacuccagaauaacaaauaacacuauuaaaaaaugagguauagagauaaagaauucucaacugaggaauaccgaauggcugagaagcaccuaaaaaaaaaaaugguuaaaauccuuaaucaucagggaaaugcaaaucaaaacaacucugagauuccaccucacaccagucagaauggcuaagaucaaaaacucagguagcaacagaugcugaugaggauguggagaaagaggaacacuccuccauugcuggugggauugcaagcugguacaaccacucuucaaaucaguauggugguuccucagaaaauuggauauaauacuaauggaagauccaucaauaccacuccugggcauauacccagaagaugcuccaacuuguaauaaggacacaugcuccacuauguucauagcagccuuauuuauaauagccagaagcuggaaagaacccagaugucucucaacagagaaauggauacagaaaaugugguacauuuauagaaugaaguacuacucagcuauuagaaacaaugaauucaugaaauucuuagacaaauggauggaucuggaggauaucaucccaagugagguaauccaaucacaaaagaacacacaugauaugcacucacugauaaguaguuauuagcccagaagcucagaacccaagauacaguucauaaaccacaugaaacucaagaaugaagaccaaaguguagacacuuugauccuucuuagaagggggaacaaaauaccaauggaaggaguuacagagacaaaguuuggagaagagacugaaggcaugaccauccagaaacugacccaccuggggauccaucccauaaacaaccaccaaacccagacacuauugaugauagaugccaacaagagcuugcugacaggagccugcuauaguugcccccugagagggucuccaagugccugacuaauacagaaguggaugcucacagucauccauuagauggaguacaggguccucaaugaaggagcuagagaaacgacccaaggagcugaagggguuugcagcccucuaggauuaacaacaauaugaacuaaccaguaaccccagagcucccuaggacuaaaccaccaauccaagaaaacacauggugggacucauggcucuagaugcauauguagcagaggauggccuugucaguuaucagugggaggagaggcccuugguucugugacgguucugugccccaguauaggggaaugccuggaggguaggguguuuucggggggaaucuaggagaggggauaucauuugaaauguaaauaaagaaaauaucuaauuaaaagaaaagaaugcacucaaacaaacaaaacacacaugcaaggguuugagcauguucuacaauagccaucuucuagccucuccauguaggguucauuacauuggacuuuguggucuucauguucaugccuguacccuacccaaguaagcaaaauacuaagcaacagaagugccagagauuucacuggagugcuauaagaaauaauccugaaaggccauugauagaaaguauaaacugucugggguucuaccagacaaaugccaugugaacaagucaagcaagaagagggaggaggaagaggaggaggaugaggaggacacguucaagaaggcagugaggacgauauggaagauagcugagaugcagaccuccucaguuaagaacaacguugugguacaacagaaagagcugauuguuuggcccugggaugcuuagauuugaauucuuuuacacuuagauagaauaugauucucccuaagauuuccuuugagcaccaacaugaaggcaacccuagcuaucacauggaauagcagcugaauaucaacguccaugccuucggugcauggcagcauagucacuggucucuuccucauuauuuaucuuaaagaauucuuaacuucaaaaucaucacauccaaaggaacauugcucuucucucagcagcucucuucucagccacucugcucugucauagaaccucuuuuuccccauuuguaccagcaagcaauaucugauugagcacugccucaauuuuauauucagaauuaguauacaaaaucaugcuguccuuacagcagaaauuaguugugccuaucucacaaucuugguuuucugucccagccaaauauaagucugaauuaucacaaaagacuucuucuggccuuuuugauuaagagcuuucuuaauagcucucccuaacacugugcuguauggcauauccuguuggaacacuucugaaauguacccccaaaaugguacauuucccacuacucaguuauuacuucauccuuucaucccauaaacaguuucuagagacccuuuagauaugaaucacaugcuacauauuagggacacagaaugaauaagugguggcuuaagagugcaauggggagaagaaagagacuguaaccuaaacagagauaaaaauaugugcacuaacuuugaaggauagauaggagucagucucaugaauagugcuuccuuguaggggcagcuggagcaaugagaugucagcaaugugaagaaugggucuuucacuccuccaagauauggaacaaaacaaacaaacaaacagaucuaaguuuguacauuuauucauugacuuuguaucaugugcaaacaugcaagagugaggacaaauuuuagaauccaguugccucuucccaucauauggguucccgggucagucuuggcagcaaaugccuuuacccucugagucaucuuacuggcccucaaaaaaacccuauacuuuauauaugaaagcauucuuccuucugugcacaaagugacaauguauucacugcagcaguauguaacugaggauuaucccagaugcagacuuugaaaauaaaaguuacauuuuagguaguucaauauauauagucacaacaguuuuaaaguccauccaaguaacuuucaaaauaguuauuaaaaucacacacacacacacacacacacacacacacacacacacacacaaauaguagcugauacuuacuagagaaacucacuucacuguuguauucuaauauauuccuucucccacccauaauucauauccauuuguuuauuuccaaacaaggguacauuacugucauagacaaauucuggccucagaauuuagaauaccaucucugucaggcaaaauaucuacuguucauuuguagacuuccaaagauuuaauacuguuuagauucuucaaauuuauuuuuaaaccauagucacuaauaaagccagcacuuagucugauauuuuaaaaugauuuaggucugaauguucaauaacuucauuuaacucucauuccauuuagauauagaacauuuuuguccuuucaugaaaauauuuaacaacaaauuacaguucuuuaucuacuuauuccacacagcaggcaauguuuguagaugcuaaagccucuuuaauguacacauaauauugaugagcaauuuggccucuacugaaggccccaaacacugguguuugaaacaaaacacacaauucacugcaguaagauagccagucugcauuuaccaaggaguagcuauugcuuucuauuuucucuuuucacuuuagaaaaaagggcccugcaaaccucacaugucugucaccuucucuaugggggcaaucaucacaaaaagauaccuuuguuagcaugcccuaugcucugccuuuuccauauuauaugucucaguuuauucuauagcaaccugcucagacaagcucaggaagacuagcugaaugccaccccgcuaccaaagggcuggaggaacacuuuaucccacacuucuccuuuauacggugcuaccccugccccgcuuguguaggcagaugauguauauauacgcaaaguagcacaguacagauguaugcauggaaagcuuagcucugaggagacuggaaagggagggaggguuuuuuguuaguccauuaucaccuauccucaucagcgaagugcuaaucuguaaaaaugaacucaccauuccccuaacaauacugaaugcuagcagacgcugggcuggccauuucaauuccauucucagaggaucaugguuguuaaugcuuuaucaucaguucuuuucaauuaggucaggucauaguccuuccuggcuucucaucacccagacuaauggcuucaauuuucuaggguauguuacucaaucaggagcccauuuccugauauucccuaaguagcucauauuccccaauguccuuucagauuguuuuaugaaaaaaauucaaggaaaauuccauuucaguguacuguuugagaaauauaucaguuuuacaagaaggaauuuuguucuuauuuaaguaaucccuggaaauccucagcaaaccuuuauccuuaaaaacuaacacaagaaguaggaaaacccaaaccaaaucaugugcugaugaggccuuccacguucuaugcuuacuuuuaacuuuauuuauuguuguuuuugaugugugugugaguaugcacauuucacaguacacauaugcaagucaguucucucuuuccaccuucuggugguuucuggagaugaaacguacugucuguauccugacucaugcacugacaccuuuacacucugaaccggagugcuagucccauccccuagaauagauuuauaucuaaaacgcuacucugugugucuuaaacacuugagaauuuuaugaacacauuggccuaaauuuauuguacaugaaucacaaaucacagugguuaauuugcauucauuauuucaguaugcauuguuuaaaaaacaaaacaaaacaaaacaaaaaaccagccagucaaaaaggucgagagagggcucaguggguaaagacaucaaguuugaaacccggaguuuaaucacaaagauaugcacaguagaaagauagaaccacaaauauaguccauagauguuguuuucuguguaugugucacucaugcacauauacaaauaauaaauaaaugauuuugauuuuauuuauaguuuuuauuuuuucuuuuauguauaugaguacuuugcauucauaucuguguggcacaugcaugccuaauaccacuggacgucagaagacagugucaaacuuuagcugggguuaugaacgcuugugagacaucacauaggagcuaggagaugaacccagguccucugcaagagcaacuaacacucugcaccucugggccaucucucuugccccaaauaaauguaauuugcaaaauuaaaccgugauuuaaauaacuucuguagauuuuauagacagacaaaaucuauagaaucuacaauugaaccuuugacacacaugaaauauauauacacauauaaucaagacucacaggaacauggacauaacccuaagcaguuuccugggcacagguucugcccuaagaccacuucuauagcagaugcuagauuucugccaucauggauucaguugcuucugaaauuaauauaaauauaacagcagaguccauagggucuuguguugacuuuaguucaccuacuuacuauaugcacacauuaugugaguugcuuuuuggaaauggggacuagcauuuuauuacccaaaggaacauucaaguccaacuauucucacguugacugaguucuuuauuacaagagugacucugagcaucuggguagagaucuuugguaaguauaagccucgguuugccuuggcaaaaaucaaagaggaaacccacuggaucauaagggguacauuuaauuaucuaaaaaagaacuccuuaggaacuacuauccagaguccucagucaccagggcaucuauaaugucaucuccccacagcgucuauaauguuaucucucaagauaauauugagcuuuugaauuucaaauuuauuuuucauuauuuuguucuuucaugauaaugauacucaggaucuuaaugaacuuagugguaauuugaauacauauacauacaucuaaaauuuuaaugucaagcacuaucuauagucaaaguuucguccuuuuucauaaaauuggcuauuugauaucuaucaauaaacugcugaaguuuagagguugcauucaugggaacacaugccgcauguccaacaagcauacuuaugaugcuguccucgaauuuguaacuugccuuuaucuucccacucucugaaucuuuugaugaagaaacuauuuuacuuuuaagcaaguccuauuuaucaguuauuucauuauagagucaaugcuuuuuauuucuucaagauuuguucuuuaagacuagcuccuacauuuugcuagaaacuuuacaauggcauuucuaccuaaucuaugggcccuugacuuaacaauuuaguuuucauucccauuucuuccuuucuuguuuaaauugaaagauuccaauugcuacagcacuaaguucacugacaucuucugauguccacugcucacauuuauaaugagcauuguucugguccccaggcuauuagcguauugcguugauucuuuuagauuuguucuuauuuuuuaaaaauagauuuccugggauguuuuauuucaguggcacauucuccucuguuguacuaugucucuggucucaagcaagcuuguaagcuguuccagaugaucagaucaucagaagccacucucuuguaggccuuguagacgccacaugugcacauucucagcucagcauaaauggccaauggcauagaaggacccucacgaugccaccucugggauugccuagcagagguuucucccuuucaguuuaaaccucaaacugcagcuucuuccacagcucugucccugcugauugucucaagucagugggcucucugcugucuucugugagcaccccaaccucuccuauagaucauaaaaauccugcuuagcuacauugucuuaucgcccaaagcuuuaugcuuucucuagcuuuauagugauucacuguggugugacuauucagucauucuuauuuuaccccugcaaagcuauccagucuucacaguaaguugauuaaaaguuagaggaccaauuacacacauuuauuucaguugucaaucuuagagauaaugcuacucacaacaaagccuaauuaaauaaccaacaugaaaauuucaaacuuguuuuauagaguaguucuuaagccacagagcuaaagccaagcuguacauacuggcaaggacuuuuuaaaaauauguuuguagcaaaucuauauuaucauaacuaacuaagguuuucuguaacaacaaaugauucauaaccuaugucccagagcuugggaccuucauucucucuauaaagggcuuccuuuugcuuacauaauuuguaagaagaggcaaugcuagaaaacuuuaugucaucuguauuaacuuuauggauguaugcuugaauuaacaacauuuuuggccaaaauucaaaaugacuucauguuuucugaagccaaauuaauuuagaacuugagcucaggcaaggaaaucaggccuaagagccgacauuaaaacauauuuccucucugcaguucuccaggugcuacuuaauugucuuaaaugcuuacccccuuuuacuguagaugucuuccugcuaucaggccuuucacuaacaauuacuccaccaaacauucccaaaccaaugccccaaggucuagccuccguaugaguuuaaguaacaacuuagguguccauucuguacucaaugcuuucaaauguuucaggauauaaaauuuguuaucucccaugaccuacuacaguuuuuuuauuauuauuuuauaacaguugcaauagaaaccuaagugcuuagaucuaaccaaaugauuauuuuuugauaaacccagaauuagaaaucaucuuucauuuccuucuuugaaauuuucucucaaucuuaaacucauucacuauacagagcaggaagcaaccagcuguucugucuuugugaaguacuguacauacccuauuagggacauauacugaagucuaugaagagugugguggaaaagggucaagacuuuugaacuaggucccaccuuugacgucuauagcagcugguuaauaaagaugugaacagcucaggauguuacugcuucuaauuuuagacauuacuuagucagcauuuccuaugaaaggcaagguaaggaauauucacaggcauggugacacuuagcugcaggaucacucuggaauauuugucucuggguccucacauagaugagacaaccuggaaacaaggaugcaggaucuucacugagaaucccugcagauauccagcucugcccuugccucugacaucaaaugccuuucuuucuuagaaucaacuucuuguuuauagagcccugucucuaauguugcccaaaguuuaacacuccaggauuuguaacaaaauaauauuagaauccucuugugaaagaaacaaaagaauauucuacuucaucauaaaguaucuguuaacuaggcaugguggugugcucuaauaaucuuaacucucaggaggccaagacaggaagaucacaaguucaaaccuagcccagaucuacaaggcgauucugugagaaugaauagaugacagacugauagauagauagauagauagauagauagauagauaguauguuucaguccauuggcagauauccaaagaaauuaguaugauguacaagcagaccaauugaaccacugugugucagaguggauuuuucaaugggcaguggcaguuagacccuuccuuuugcuuucuaacaugaaugaaaggcaaaaauuguauuucagauucacuaucauucuuuucuauaauuucauucccagaauauaguaaaauuauagcauuagucccaaacugcauuuuuaaaagucccuaucaguaacauauuaacaacugauuuuauggucuuuuacaaagauacuauaaagguugauagaacaaauaaguggcaaguaugucagcuuaguugagcauuuagccucucccuuauuagcaggguaaugcccacauacuuaccuaguaacaaccuuacuuuccuagcagaagccuuacaauuauguaaaaauugcugagguacugcugguaacagagccuguaucuuacuaucauaguuucuuugagcuuagcauugauaacaucagucuugacauugggagacaacuuugagguggcauagaugcuuacucuagcuuuaucaagauggucugugagcgugugcuagaacugaugucaaugccuugacuaugacaauaccauucccaaggcccgaggcucugagcuuggccaacacuuccaucuccuuuucugaauugucauaaaaagaaaugcaaugauacccaacauggaagauauagccucacccauucaaccaccgcuaccucuagcucccuauguauaagcauauauuaguggaagguaaagccagggugguggcacaccuguggcuuaucuaguuagauauaaaguuagcagcauggauucauuugcuucuuuccaccuccuuuucaguuucuuuuccugguuucuuucccuccuuuaccucugauauggccauguuugaagauucuccaucauuacuccagaaaauguuucacaagugcaaauugggccugaacuacuucucugaacaaacacccagaagcucuuggguggcaaaaauuuaugaaaugaguaacaucugcuuccauaugcauuaaccucuuuguaacaagcugugucuuuuaucuucuguucugaauuuacuuuuauuuuuccuuaucuauagcucugacuuucacacagacucuuuaaaaacuguguuuggagucugauaugaucagugcacuuccccugaaauuaaaguuucuuuugauauugaguucaguacauucagaguggaaaucaaaggauuaggcugguuauaaagauuuaagucaacagagaagaauuuaauccacuggugcugaguuucauaaucaaacagugaagaacuuguuuauauucuuaaaaaaaaaaucuaccaaaccaaaaauucagaauaucuccaaaaccucgucuaccuuauuuacugaacagauguggaauacuuuaaugugccagacacagaaaaaggugauggagucauuaaucuaaacagcuuagaaccugcacuuucauucaguagcuuccaguucaguagacacugguccuagguuuaggccuauaaucaccugauuguacuuguaacagucacagagugacuauggagcugaccagaucuauguauggggagauggaagagcauuuagugauggaaggaugauggggauauacagcacugaagucaagacccagugaaugauaaggccuuggugagaccucagauaaucagcaucagaugaaaaagaagccaacuuguuuaaaaaauaaggaacaacagagaaagcaagacaaagugcuaugggaauagucaaagaaugugugcaggcuugccuucacaggagaucagagauacucugaagaaguuagaacuucaugcagaaaacaauggggggggggcaugguaguuucuaaaucagaaguuggaugugaucagacugagugcaugugcagauuuuccuggcuaaugcaaugacuaaggauuucuggaugauaagugggaucgcaguguuuaaugcccacgguuacuaggaaaaguaccucagauaccauuagacuaaggaacucaguacaagagccuacaccauaguccaacugaagagucuuuucuaaauuccuccuguaagcauccucaugcaagcaguucuggguaccauggacuuaaagguuaaagacaguaagccauaaagcaguaagucugcugaggggcugguguuuagacaacuaaucauguugauuaugaaggugaauggauagagucuaugugcucaguccguucugcuacuuaucauuuuugaaaacucaguaacuuuucuaauaagagugauguaauacuagaauguguucacuuugggguguguguguguguguguguguguguugaugugaauggagccccuuccuguaugauaggcaaguacuuaaccacuuagucauagcuucagucuuuugaauuauuuaguuaauauaaaauaaaaaucaaauuucaccauguuugauauuuaagcugaagagcuaaaccaccaaacacagcaaucaauccaaaguccuuuggaaacuuaacaaaaggacaacugaguuuaauuauagauguuucuuacccaaucauucuuuaaaagcguauugaaaaugugugccaagauucaacaucuuagcuuguuaccuugcacaacugaaaguaguaauuuccuguuucugcaaaaauauucuaucaucugccccaacaguagauuaauuucuaccucuggcaauccaauuuuaggguguuuucuucaaucuuacuuaguacaugacuaaaauguacuaaagccuuuaguguaaagauaauguagcauacauaccauuuaaaacaagaaguuuaugugaauccaaauagaacguggacauuaaagauucagccuguggaacaucaaccccaguucucccaccucuuaaaugcuaauagaaaagaaaaacuuaauaaaaaauaacaugugcaugcauaaacacacacacacagauacaugugccuacacagacacauacaaaccacaucgccuacauugagucuuuuaggcugaacaguggcauuuauauaaagaccaaucaagaaaggaacaaaaauaauacauauauccaaguaauaacuugauucagaauccuauguagcccaaagucaaaagcaaauaccacacccagugcucccauaaguauuuagaguguuucuuuaacauugaaaugagcugucauggggcugcaucuuccugagguuccuauuacacuggagggucugcuaaucacuggaguaacccugccaaguuccuuucuauauucuauauucgguuaauagagugggagggaggagacaaaaguaagggaaggccagaaauggacggagucaaugcccaggauaaagagcugagucagagcugggcagugguggugcacaccuuuaauuccagcacuugggagccagaggcaggcagauuucugaguucgaggccaaccuggucuacaaagugagcugcacagagaaacccugucucgaaaaaaaaaacaaaaacaaaaacaaaaaaaaaaaaaacaaaaaacaaaauaaaaaauggaaaaaaaacaaaacaaaaaacaaagacuuguuaagagaaaguuuugaaggcuuuugaauuguggaaggaaacaaacacucaagacaacugugcaaugcaauagugaggaaagggagaaaaaggcuaaaaaaguccucacuuucuaauguaaaaggauuuuaacuguauuuuuugcaaaaagaaaggcacacugaauauucuaaaauaguuucuaauuguuguugauauauauucuugauucuuuuuuucuuuuuucuauuuuuucauuuuaaauguuauccccuuucccaguuacgcccacucucccccccauacccccuaucccaucccaccucacccuguuucuaugaggguauuccaacacccacccacccacaucagucgcucugcccucaaauuccccuauacucaggcaucaagccuucacaggaccaagggccucuccuccuaucaauggcugauaaggccauccucugcuacauaugcaccuagagccaugggucacuccauguguacuuugguuggugguuuacucccugggagcucugguaugucugguuggcugauacuguucugccuauggggcugcaaaccccuucagcuccuuuaguccuuucucuaacuccuccauuggggacccuguauucaguccaaugguuggcugugagcauccaccaucuguauuugucaggcucuggcagagccucucaggagacagcuauaucaggcuccugccagcaagcacuucugggcauccacaaugguaucuggguuuggugauuauguacaugggauggaucuccagguggggcagucucuggauggccuuuccuuccaucucuguuccauacuuugucuccguauuugcucccaugaguauuuuguuuuccuuucuaagaaggaccaaagaacccacacuuugauuuccuuuauucuugaguuucaugcgaucugugaauuguauuuuagguauuccaagcuuuuggguuaauauccacuuaucagugacugcauaccauguguguucuuuugugguuggguuaucucacucaggaugauauuuucuaguucuuuccauuugccuaagaauuucaugaauuuaucauuuuuaauagcugaguaguacuccaauguguaaauguaccacauuuucuguauccauuccucuguugaaggacaucugaguucuuuccagucucuggcuauuauaaauaaggcagcuaugaacaggucaaagggauacaaauuggaaaggaaaaagucaaaaugucacuauuugcagaugauauaaauaguauauacuuaagugaaccaaaaaauuuccaccagaaaacuccuaauccugauaaacaacuucagcaaagugucuggacauaaaauuaacucaaaaaaaucaguagacuuccucuacucaaaggauaaacaggcugagaaagaaauuagggaaacaauauccuucacaauagucacauauaauauuacauaccuuggugugacucuacccaagcaagugaaagaucuguaugacaagaacuccaagucucugaagaaaguaauugaagaagaucucagaagaugaaaagaucucccaugcucauggauuguaaggauuaauauagugaaaauggccauuuugcugaaagcaaucuacagauucaaugcaauccccaucaaaauuccaacucacuucuucuuagaguauucaugauuuuuaagcaaaugccuaauauaacuacgcuuugcuuagguagaacaauacugaaagcacugaugcagucuuccugucuuaaaacaggcauguguaggguaaugaugauguucugugguccuggagaaauggccuagcaguuaagaauacuugcuguucugccaagucugcuguuugauuuccaacaagcacccaaaugauaauuuacaaucaauuguaacuucaguucagagauaucugacaucuuugaccuuugaaggcacuacaggcauauggggcacagccaugaauacaggcaaaacacauaaaauuuuauuaggcaaaacaaaacugugcacacaauggcuuacauuuaaguuauuuucauauucuauagaccuccugcccagacucuccuacucugaguuucaaguguucauuaagucuguucccacucagauguuauuucaagacauagcgguucaguagaaaauuuaucaggaaauggaaauacaugcuguuuacaagauguauacucuuuaggaaaguacagaaaaugccaccaacauuuguuaacaucuaugggucugucccugaucuuuaacauauauauauacacaggcaggcacacacacacacagaaagagagagagagagagagagacagagacagagacagagacagagagacagagagagacagagagagacagagagagagagaccauauauacauauaacguaacugacuucaggaaaagcaauuucagcuuucucuaaaacuugcucuuacuauuaaaauaaugacaauuuuucuguaaaacaaaaauauuagugcaaaaugaauuuacacuguaguuuaagaugucacaguaaagaggacacaaagaugugcucccuguccucccccuccccccaccgcuugugcccagcuaaaaugaugcauugcagcuuuggaucaugggaacuaauuuuguaaacccuuuaaaaauacauuaacuuugccagaggcaaauacucauaaaguuauuuccuggcauuuuuuaaaauaaaagcaaauauaugaaaaaugaaagcauauauuaacauaauaugauauacaauguagauguuuuuuaauaccccucauugaagaugauauaacacagaaaaguaagcagugucucaaaauuaucaaugcuggcuaguuuuagugggaaacaugguuaucuguccuuugaaugccaauguagguauuuguuucuccauguauaaagguuaauccuuuauagcuggacuaucuuucaucauggaacugcuaacaugucggggaaaucagauaacacacagaugacuaauagucucuaugcaaaucagagcccagacaguucuacuuaugugauaaaaggcccaagaggagcagcauuugccaaagcauauccaugugaaauucucagugcaagguccuuuuccugucauccuccugguuggagaauaaaggaaaauugaauaauucauauguuuuguaacaacccauagauuaaugacacaauuaaucagugaaagguuuaaauguguuaagaaaaaaacccaacugcgucaguuuugugaaacaaauauaguacugugaaagacaacuaucucaaaacacaguuuccauccaaaccagccaucuaugaaguaauaggaaugcaugcaauucuaacacuuggcuauaauuuccuuucaggccauauuacacaugaacaugaguacuacaaaacaucacuauccagggcccguggcucugcaaacucuucucaugaaagguugagaguccuuucaauguauuauuucaagguugagaagacaagacauuuccaccaaggccuaauagcauuuagcaauaauuuaauagaggaaauguguguacaaaccauagaaccaccuacaccaauugaacacaucaaacuaauuugaugaauguagcuuauaguuaaggugauuucaagauggaugcaacauuaucuuucuuaacucuagaaaagcauguugugccuuggccugacaucagcagugccuggccuuucaugggccauaucaaccacagaggucauggucacuaugucaugaaucaggaccuggaagccuuggcuugaaaguuuguuucaucaucaugaauuaacuucaagggagacccaacacgauucaaaugcacagagcaacuucaggaagaagagcacaucccauaaaucaagcacaguguauccaccuguagcccugacagaacugcucgcacucaugucuaacacugguuuagcaaagacugaccuuugucucugguuauacaaugacaaaaaaauucauuuaauccaacaguagugaaaaugaaagcacuuuacugcuauggggaaaacugccaaagguuaauuggguuuuagauacuuaucccuaauuguucaagauuuuauccuaauaucaauuucugcauuaaugcacagguacccucaggccaugagagagacauuucauucuaaauuuaagaauaugccuccaugcagaaagagacacauuuuuucccccacagagaauugcauguaucagaauucaacuucugaggugaaagaggucaaauuaaccaaauauacucaaaauauuguuuuaagucagugaguaguugagauaucugucugguugauucugacacuacauuaaaagauuuagagcaccaguuaaauauaaaaauauacuauauaaccucuguuaggcuguugcccuuuaaguccacuaacaguauaagaaguaagaauuuuccaguaguugaaagagagaacuucggacucagcuaggguugauuuugugugccauuccuccauuuuucagaauggauaauuauuuuaugguggcuuuccucugagucugccaucaugaucucauugugcugccauuagaacuuugccucaguaggcauagcaacuaaaacaaaacaacacauugguagcuaggacuguuguuaugguaaugaagcuaccuacauugacaguagagaaguuucauagaagauauaggagguggacaguuaaugaaaaaggcucagucaaugauguaccuucuagaagauacucaugcaugaacuuugcaguuuuagagcuauuugggcuugguccauagcucauaacccuguauuaucccuuaccugugcucugucaucagcacaauaaacucucugguuucaccaagucagacuuugggaaaaggguacuuugguaucccucagcgaccaucuggggugaaagacaaguguuuacuucucccaaggaaaaguuaauaugauagucauuaggagaaugaaaauuauccuguauuuuuaagucauuagggcacaauuuuguguaauccaacaauuccuuagaagacauuucuacuuauugccacaauaauccaucugguaaguuuuagcgagccauuguugugagaaaagaaugcccacagcuuucagaacaccugguguauaaauacuuaauuuauaaaauaaaugaaauuaacugggauugauuugcauugcaaaagaauaccugagcugcaaggauaagcaacagcaauaacaaaacauaacaaaacacacuauccagguauucuuuggucuaaagaauagcuagugcuuuguccacuuggacuuauaauaauauauucuaauauauaaccuuugagauauucaacagcaauaguaauaacaaaaugaauagauuuauuggguccaggaacuguguuaggucccauauaaugaguugcaucacuuaagccuguuucugaauagugguauguuccauccaugacaaaccugacuugucuuauugcauggguauuuucagaugaauguucagacauauauuauagauacauccaaugucaguuauuauugcuacaaauuucuaaagagucugugcauuuggccugaugaggcaaggacagacacugcauacaguauuucauucacuguaaagcuucccauuacaggugacuaggugacagacagugcuuugguuuauuuaugaugggaagcuuuacagaauauuuauaaacuccagaauaaacagucucuuaaguuacuuccuauauccccauaucagcaggauggcaaccacacagagggauuuugaacacucacuguuaucacuaagguccuuguaucuugccaaaugucacaauuaauaacauaaacagcucgaaaacacgacugcggucuuucaugccauacauaaauaauucuauaucacacaaacacuguacuccugugaaucuuccaaacauaccuccugaaccugacaggguuauauuaaacugcuucaaggggaacauaaggaggaaaaaaaaucacugcacauaaaauaacaacaacaacaaaaacaacccacacacauagagccucuucgcugcuuagaugcaauuucaaaagcagaaggaagaagaucuaaaaguuauuugucuacacugacuuacauucuuccugucaauauuaaacaugccuauguuugauauuaggucucaguaaaucaaccagacacuugcugucuuaacuuucuagccacuaugcacaauaagcaguugguauauucaaaauuuuuugccuuuguagcuaggcuuagacauguguaugcugguucuauaauucuguucagaaggccuaccaguuauguccaguuugaggucucccuugccacuguccaggcuucauguagucaaggauaacuaugaaugugucccaauaccaaaacauaaacuuauuuaagacaugauuacuguaguauggggugggaggguuguuuauuuuugguaauuugacugugugguucucaagcaugaaccuugucaaauaguugaauauaccugucaccauccaugauccuuggcccuaaaauauguuccagaaaguguauuuuaaugaccuagaccuacguuauccaauauguuugcugauaucuagaaguuaaacuuuacagugaaauugaaaugagauaaagcuuggauucuacugucaaacaacauauugcaagcauccaauagacauauguggcguaacagauacuauauaaaaucauguaagugcgguuauguggacagugcuuucguaguaugaguuuccuaacuugcacucacccaguugacauauaaacucuguggucagaugguacuggcuuucuuaaguggaagaaauaucaauucuuggaauagauacacagaauauggucauggaauuauaagagaguaggcaccugugagaaauacagaucaagagaccucauauuugcaucaaccuaaaauuauccaggguaggggcaggguaggggccuaagaguguaggcgacugaaggaggacuugcuuagcacuuccaagaccauuagcucaaagcucagugcagccaaaaucaacagucaaacgagaaaauaaaaauaaguauguaaaacauaaaauaacaucuuucuauguguggcuucaaaaugaucaauugacauaguuuuucccucagaauucagaaauaaaaucauuaacagcaauaacagugacuaucuccaucuuuaaaaucaagaaacaucaucuugcuuguuaauuaauccugaaaauuguuuccaggcaauaaaaauaacaacaaaauugagugguuguuuaccuacaugaggcccauaugcugugaacauuacucacuacccuguuuucuucaacagcacuaauacugaucauguguucuucucuauacaaccaaucaguccaaugaggucuacucccaguaaucauuaaguucccugaauccauaaacuagacagugccccuccucccagguccuaauagguuagccugaauugcuggaugaaaagcgcagcaugcucaccauguacauggaaauagcuauagaaugaggucacuugcuuggaguuuuccuuaggcauccccuccuguagacacugcuuccaaugcuccccaacuuuugacucuuagagacccccugcugcugucaugauuagcuugucaacucacauucaacagugcccaaggaucuggagugaucuuuucucuucugcaguuuuauuuacuaggaagacaugagcucuacuuaguaaaccuaccuagccauuaucugacuuaaucuaaauggcuuaaguuacuaaauguaguaccacuggaaauaagaguauugcgaaggacuauuaagggaaaaguagguacgggcacagguugcuuuuaugcuuacuucccaggcaauucugagaucuguuguuagguuggaguaacaggauucauuuagguuuugaccaguaucugagaucuccucucaucaugguccuuaaugauccuaacugugcucaugauugguuaguucuuuuuuuuuuuuuuuuuuuuuauacucugguuuuuuuugagacaggguuucucuguguagcccuggcuguucuggaacucacucuguagaacuugaacuuagaaauuugcuagccucugccucccaagugcugggauuaaaggcgugacccaccauugcccagccagugugcucaugguugguuaauucuuccccccucugggaacuuuagugagauauacuguucucaaacuccuagaacagugguuaugaaauaugggacaaucuuuccccugccucuacccacaggagcauccaggggcuucaaauuuggaagggugaguaguccuggcaucuaacauacagagaccagggcauucugcugaauacacugcaauaugcaagaaaaccacucccagggaagaauuaucuagccaacguggaagagaaagaacauuggcaagggcagaagagagaguagcaguaggaaguaaauaugaucaaaguacauguaaaaaugucauagcgaaacaaauaugcaggauauaugcuaagaaaaacauaaaugaucuaaaaaaaaaagacucauuuugucuaaaauguuagcaaaaucaagauuguggaaaaaggaaagaaaacaagacaguccccaaagcuauguagcguuguguacuugauuauccagugacauauuuuccuugaucauggcuuccugaagacacgagccugagaggugcuuugucucuucauggcuuucacgcuuaaccaggucaggguucaccuuugucuuggacugguggcauacgauggcugaagucucauggacuugguaggcuaaggcuuugauaugagcgcuugagcacuugaguccugagcuugcaaacuaccauuaccauuuaaauauugcgggacuaagauuuuauuuaaaaauucuuaauaccucacauuaauuaccaaaaaauucagaauguguccaucuuuauaacacuuagucauuuucuggaaaaccuuuguguuaaaaacugauuuaguauuuuaaaaguagcucuuaaaauucuguucuaugggaauuauuacuaauuuaauaacaauaauuucauuagauaacuuaagaagaaaguucacagcagaaagcccaaugcugaagugggugguugcagcaauucuguuuaucacugaugucccuuggguucuggagaauucguuaaacaucugaagguuuggagucuuuugcccaugauacggugccaguagugucaugauuaauuucuuuuugcuguaaucaaacacccugacaaaacaaucuaagguagaaaguaaggggggggcuguuuguuugcuuugauguuugauuugagggugcagugggggugaggaugagcacuccugggagauguuuucagucauggagaccucaugguggcaagagcaggggccacauuguaucuguacucaggaagucccaccuccagugacgcacuuccuccaacaaggcuccuuccgcacaucaguagcagcuagggaccacauguuuaaauaugugagcccauaagggagauuuugcucacuaaccaugugcugccaaaaccagaaaccaccagagcuuucuucuggugguuccucaaacauuuccuuaguguuuacuggucagcaggaaugagccagugugugcaggaugggaauuggucuccucagcuuauauucagcuuuguguguuuuccaacaggaaaaaugcuauacuauguucaccuguuaaaaaugucuugcccuaagcuguuauuaacauuauuaauaagguaagauauugaaaaucauuguuuuaauaauaugggggagugccugugcuuccaagguaaguucagcaaccuuggcauaguugaauacaaucauuucuaguaguguuuuuaaaugaucagcaacagagaaaaggcugccaucuccuccaauacccugcuuuuuccaaauaguguucaggucacuuacuuuauugaacuuuaaucuugacuaaauaagcuuaagaaauccaaaaucaccucuaccuguuucaggaacugauguguauaugauauggaauucuuuuuucuuuaauuaugacccccccccacacacgcauacacacaacucuaucauuugaguucuacuguggcacuacugcuuaagagcaaccuccaugaccaucagguugaaucaacuacuacucuuuuuuuucuaaaaguaucaaacugauuuccaaauucuacucucuauacccagaguugagugcagcugucagaaacauuucuuugcaguagacauagauuaauacagaaauucacaacuugucagagauaugagagcaaguauuauggagugcccaucuauaaauggcacaucuccaucacauucuguucuccccaaaguucagagugggggauaaagacuauaagaauugguggugaaacauugugaucaagacaugaauggacagcuauacacaugaccucgcacuagcuauaguucccugcacaugaucaagacagucaacacugcaggauguagggggagaggcuuaagagcccugaccaaugacagaggagcugcuggcagcugauagcuucugggagaggagggaguaaguuuucuuuaaggacauggcuccuaguagggugcacaugcuccaguguaugaucacacacccaugaguguauaggagguagaacuuggacucagugggcuauuaagaaaauauaagaaauccuacaggaagaggaaagacugaguugagggauggaucuagcaguuagagguagaaaugaggggcuaauacauuccaaauauauugucugccucuuuuacucucaaacaauuaauaaaauauuauauugaaaaauaugaacuacauguuuuugaagaaaucuugagcuuuuccacuuggacaaggaagcagggccaagaucucacaccugauuucuuguucugaaguaugaagugacaaacauggaagauguacuugccagccaccaaucuagaguuaacacauagagcauaauuacagaaucuuggagggaauuaaucauauuugacauuuuaaacuauaguaggucaucaacagauauaauuauggaagaagaaagcaggaagugaaggagagagggagggaaggaaacagacagagagacagagagaauuuuuuucauuuuuccagguacauauaaagcuuuagcagaaacaaugucuggugaagaugaacaaagccaggauauauuuaugcauuagcaaauaaaagucucaaaaaucaugucaagggaaacuuauugugcaaagucuacuccuauugugcaaagucuacuccuuucuucaaugcuuucccaucuuuccacccgguaagguuuuguuuuguuuuguuuucuuuaauuguauagcaauggucauggccuucuaaguaaaaacauauuguuaaggcaaagaaaaaucaagagauacauugccaacacaacugauccuuggaucaauuaaaaaaaaaaagaaaugcaugcagaauaguuuaaguuuuaugaucauuaacuggucuguuguugggucuuaguggguucuacuugauuccauuuauaaaugauguaaaggaaauaauaauauuugcugugauagaguacaacuucaacauaguagugacuuuugcaaccaccagucaaacauacauaauggagcaauauccacuguuggucggguuuccauguacuuguaacuuuaauaaaugccuucauccacccacaccguguacauagcuuucauacaagucaguuacccucaaagauaaacacccauuggguuuaauauuaguguugaccuaagugggucacccuggcuaucuuuccacacugagaggaaucaauguuaaaugucagaacuacaaagauggcucauuggcuaggaacacuggcuacacuuccagaagaccugccuucaauucucaggguacacaguggcagcucccaacacucugcauauccaggagauccaauguccccuuccuggccuccauggguagcaggcaugcaagugguacauagacaaacauacaggcaaaacacucaugccuacaaaauaaaauuuaaaaggaguaucuuccccuuugaaauaauggaaaucaugacugauuuucuugauugaggcauagcugcugguauuuuaaugcuaugcauacauuaacuugucugcaugcuacacaagaggaaacuaaggcacuggacaugaccacaacuguccagagccacagagcaagcauguaagagaccaguauucaggucaaugccuuauggauacagaaaccauacccaccagaaugucuaggcucugcaagauucuuuucuuccucacuguuuucucauuucuccucucauuccuggagugcccuuguauugucagccucugacaucagaugucugugacccuuguuugucuguauaacuuucugaggcuuugauguuagaucucuggaaaccccaugagugagugcaccuuucugaagaaucaccuuucccgcagcacauuugagagauucgagggcuuggaacaccauucagccauucagaaacaaugacaaggcagugaguacugaauuauggcuguacuguaggugucaguaaaggcagcaugguauucccauugcuugcuguuccccuuuguccccugucacugcuacaggaaaccccacagauuuuccugaccccuuuaucacaguaagaagacaaggucuguucguguccuucuaucagcucuccucgugcuggaaggacuccacccuccucuucucacccaagcaacacucauauguuauuucacuugccacgagugaaagccacucaucuauccccagaauucuacaugcaauggcaaugccuagccagccacacaagcacucauucucaugaacaaaagccauacucuguguuccagggaauaaagcaccaugcuacacuccauccaucaacuguucuuuaaagagagcuaugaccuauuacaguacaaauaugcugaggacuuggggacaaugaauauucugaauaaaauucauggcagcuacugcaugagccaggauucuaagcaaguguccccagaaaagugccugcuuuguaacuuuuccucuucugaccccuuuauuuaaaaaaaaaaaucucuuuuuuuguccuuuucuuuaagucuacauguaugucaugguguggguauaggcuagacuuuaaacugaaagguucucaucuacauccucauggaacuuucuuuuuaaauaucuaucaucuaucuaucuauuuaucuaucuauccauuuauuuaauuuaccuguaugggacuuuagucugcauguuugugugcuguauucaccuacauguuugaucucacagugaccaggagaggacaucacacccucuugaauuaguuagagauuguugugagccaccauguggguucugagaauugaaccuagguucuaugcaaaaguaguccaggcccuuaaccacuaagccaucucuucagcccgacaguggaacuauucagcuccauguuuuaagggcaagcaauaacaagcauuugcuaaucaguaaaacucaauaacuugaagauaaccacauugauaguaagcaaauaaguuugucuacaacucugauauacauuccuuagaaaccaaguuccccuaacacaaagccucccuugcuugccaacacuggccacgcaaaucaguaaucugcaggcucugugaaagacacuguagauuucuucagaagcagaaggggaguuagagagaacacagagggagccaaaaauguucagguuucacuguauaccuguguggaauugccaaagaauauuuuuaaagguagagagugauuggggaagauauucuacuuugaucuucggccucuauauacauauauacauacaagaacacacauaugaacacaaacaaaaauauaaggaaggaggagggagaggaaaguauguggcaagacaccuuguucauagaggaauacccaagggauucuguugacaauuuuucagugucuucuguuuucaaauaaaggcuuucugcccagaugcuccaaauuauaugaacccaauaaaagauccugacagagaguaaaaaauuauuuaagccccuagaccuguguccgaaauagccccauuguuccaggaugucagguguuugcaguuuuugccuuucuauagcccaaugccagguguuagugguuuuugugucuuuauaaaccccuuacccauugagcucguuguugacuccucuaugugggauacgauucguccccagugcacuggucuuucccaaauaaaccucuugcaguuugcaucaagaccguuucugagugauuugggguauugccucuccugagucagaaugugggagaguccucacguugugagucuuucauuuggugcauuggccgggaaacucaaucaccccucacacccaagaaucgacuuggagguaugggauucccucuggaaugugugcgugcuggucagugucucuguucugagugucuguuuuaaacgaacgugugcuuguuguguugguuuguuuaucugugucaugucugggauagugugaccacccucgucuccaaagacccacuuggaggugagauuucgugucugaaacuguuucugugugccuucgaaguucggaaguuucuguuugcagucgcgacaucucacaggagacagagacucaagucuugagagacccggagugugauaggcagacaugcuaagaucaucaacugccgcucugcgggacuccuuggugcaagggaaggacucuaggaguccgacugggaugggggugaggauucaguagucuuccuggauuggaaggacuacauaccagcccaaccuucugcauccuuggcuugguuuuguauauuugucagucuuuguguguguaucucuagugucuguuuuguguuuuucgugacuuggaugaugagacagacugugacaaccccccuaaguuugacauuagaucacuggacugaaguuaggucgagggcccacaacauuucaguggaaaucaagaagggaccuuggcagacauuuugugcuuccaagugcccaacauuugacgugggauggccaccagaggggacuuuugacuugacuguaaucuuugaaguuaaauccguugucuuucaggacaaaucuggguuccaccuggaccagcagcccuacauaacuguguggcaagaccucauccagaauccauccccauggaucagaugguggaucccacagcagaagacaggcucucaaacccuggcucuccacagaccaaaagugaagacgaagauuccucccaaaaagaagccuuugccagggcccucagcucccccaaagaucuauccagagaucaaggggccuccugaguggccagaaccuccuccuccucccuaucccuuaccccuuccggugccugagccuucccaacaucuagaggccauccuugggcccagugauggcacagucggaggaccaacagcugggauccaaagucggcaugcacagcaucccuccacagaugagguuccugacacgaugucugccuuuccuuuguguggagugggaccaucugcagacccucacucucuccagacucuucaauacuggcugugaugguuuguauauccuuggaccagagaguggcaccaucugaagguguggccuuuuuggaauaggugugaccugguuagaaugggugugucacugugggugugggcauaagauccucacccuaguugccuggaagucagucuucaacuagcagccuuuggauuaagacauagaacucucagcuccuccugccccaugccugccuagauacugccaugcucccaccuugaugauaauggacugaaccucugaacuuguaggccagccccaauuaaauguuguuuuuuauaagacuugccuuggucauggugucuguucacagcaguaaaacccuaacuaagacagaaguugguaccagaagugggguauugcuaugauaggccugaccaugcuuuuauuugaaagaauguggauuuggggacuuuggauuuggaaagcacuggaaugcuuuaaauggggcuuaaugggucauccuaguaggaauauggaagacuuuguugcugggagugauuugaacuguguugaccuggcccaagagauuucaaaggagaagaauuuuagaauguggcauaaagacugguuuugugguauuuuggugaagaauguagcuacuuuuugcccuugucugaaaaguuugccugaagcuaaggugaagagacuuggauuaauugcauugacaaaagaaguuucaaaaaagcccagcagagacuuuguucucugguuaagucuuaggaagagaaguuugaacaagcauagcaagcuuagaaaggaaaaauauaaaauauaugguucgaguauuaaagggguaccaggaagugaaaaggagcaaaaaucucguguucuaggagauaaaagauuaagggaguaggaccuuggggcaagauccuacccagcuaaauuuagauccagguauggugauacacaccuuuaaucccaggagacaggcaugcugaucuccauguucaaggccguucuacagagaaagauccaggaaagccaagcuuaggcagugaaggaguuggaaaacagaaagccagugacaauguaauaguauaacggggucaugcaagcaucagaacucagcagcuucagccauguggcucuggcucuagaguuaagaauggaaggaacuacugggaaaaauugaugcuaguuagcuggagcuaaggaauuagcagugauuaagaagagaccagcaucacugaggugaaaucuucuggaaauuguuuucugggaucacaaagaagcuguguuccagagauacccaagguuuuaucucaugcuguggcuggacuugguaauguguaagagucacucaggugauacugcuugugauggaaugaagggaucauggagagaagcugaggcuuagcacugugagaggccagagaaggccauuggagaaggugaagccucagcuguaguugauggcccaggacugaaggggucaugcaaaggauuugaggcuuggcacccugaagagagccuaugagaggcuauuggugaagccuaguuggaguggaacaccccaguguauuggagaugucaguaccaugggaugaucaccaagaacagcagcuguaguggaguagaucaaccugagcuuagagugcuacagagggcagagcuggaaaagugaugccagcccuuaggaggaguccaaaagaucaagugcaaucccagacacuaaaacaagaagcuguaacauugaaauugccuuggagacucaaagauguuaaagaugccagagccaugggauacaugcugaggaaagcugcuaacagggaguggaaccagcccaggagaaagcaguuuguugcagucaacaaagaugaaaaaggaguggagaucugaagaccgcuuugacaucagccauggagaugcagaguuuggaguuugcccagcugguuuccugccuugcuuuggggauuacaguuaauuaaguugaaugaaucucagaagagaccuucaacuuucgacuuuuaacauuguugcaacugcuauagacuaugagcacuuugaaaguuggacuaaaugcauuuugcauuaugcuauguuaguauggcccccauagacucauguuuuugaacaggucuaugggaaccagggaguggaaugggaugguuuguauauccuuggagcagggaguggcaccaucugaagguguggccuuuuuggaauaggugugaccugguuagaaugggugugucacugugggugugggcauaagauccucacccuaguugccuggaagucagucuucaacuagcagccuuuggauuaagacauagaacucucagcuccuccugccccaugccugccuagauacugccaugcucccaccuugaugauaauggacugaaccucugaaccuguaagccagccucaauuaagugauguuuuuuauaagacuugccuuggucauggugucuguucacagcaguaaaacccuaagacacuggccauucuccuuagcugaucuauauaacugaaaaucuaaccauccuacuuuuuuagaaaaucuggcuggacuaaccagccugguugaaucauuaauguucucucaucagcccacuugggaugauuuccaacaacuuuugaagguucuuuucaccacggaagaaaaggaaagaauucucuuagaggcccggaagagugucccagggauuaacaggcccugaccaauuugcccaacaagauaaacggaggguucccucucaacagaccagacugggauuacagcauggcucaagguagggagggguugacaguuuaccgcugggcucuggugguaggucucaagggagcggcaagacaucccaccaguuugacaaagguaaaagaaguaaugcaggggccaaccaagaaagggaaaauaggagagaucaaaggcaggggagaaacuuaagcaggauucuggccgcaguaguaugagagugggagggaagagguagaucugaaaauagauggacaggguaccugggaaacagggaaucuagaacuacuaggagaagacccguucagagaacuuuggaaaaaaaaccaaugugcauacugcaaagagaaaggacacugggcagaacacuccguguugacacaaccauugggaaaacucaaaaacaaaaaaacccauaguauuugaagccacaggccagaaacaauacccuuggaccacugcacauacuguagacuuagacaaaggacaagugagucacucuuucuugaucauccuugagugucccacaccgcuucuggggagagaccuuuugacuaaacugaaggcccagaucagauucacucaaaaagugcugagaguaaguugggaaucuccugccuccauaauccuggcccuacaacuugaggaagaguaucaccuguaugaauauacgaagcaagcagaggggccagaccuaagagacuggcugaaugccuucuccagggcaugggauggcugucagaguaccccacccccaccccugugguugugggacugaagacagaugcuacccuuauagggguguggcaauauccaaugagccgcgaggcuagggauggaauuaggccacauauucagagacuauuacaacaagguauuuuggugccuugucagucgcccuggaguaccccucuguugcugguaaagaaacccugcacgagugacuaucgacuugaauaugaucugagagaggucaacaagaagguacauucacccaacuguuccuaaucccuauaaccuccucagcuugcugcccccagaaagaaaaugguauacaguauagauaccauuucaggauggguggaagccuacccaacuaaaaagaaacugccaaugucguggucaagaagauacuggaggaaauuuuuccaugaauucccaagguaauaggguccgacaacagaccugccuuuguugcccagguaagucagggacuggccacccaacuggggauuaauuggaaauuacauugugcuuauagaccccagcguucaggacagguagagaggaugaauagaaccauaaaagagaccuuaaccaaauugauaauagaaaccgguaggaaugacuggauagcucuccuucccuuugccuuguucccugucaggaacacccugggaaagcuuaagcucacucccuaugaaacccuuuauggcgggggggcucccccacucacucaggcaggggaaguguuagaauuuaauccuaguccuucauuguuugcacauaugaaagcccuaugaguagucagaaauauggccugggagcagcucaaugaagcuuaugaaccaggagauuugauggugccacaccaguuccaggugggagaugcaguucucguccgaggacaucaagcuggaaaucuagagccucguuagaagggccccuacaucgugcugcugaccacccccaccacuguuaaaguaaaaggcaucucugcuuggauccacaccucccaugggaagugagcuccugagcaacccccaaaagacugcugauccucuuaagcugcgccuaugcugccagcgcaauuuagaaaaagagugacaacacacaucagcccaugacucucacucagcaguuauucaucagggaaaauacuuuuugucacuuccaaaacugaaccccaggggcgugguggccgaagcccucuuuaauaaccacccucauuuccacuuugaugggaccguuuugcagcuaacauuuggccccgauucuuaauagguuagugaccuuuguaagagaaaggauuagugcaguccagcuguuggugcugagaccagucucugcagaaccuugaagaaccuugaagaagagauugaaguguaguucuuuuuuuuuuuuuuuucauuuuuuuuuccauuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccaugaaguguaguucuaagauuagaacuaguaacuagaagaaguggggaauaaaagauccugacagagaguaaaaaauuauuuaagccccuagaccuguguccaaaauagccccauuguuccaggaugucagguguuugcaguuuuugccagguguuugcaguuuuugccaaguguuugcggcuuuucccuuucuauagcccaaugccagguguuugcaguuuuugugucuuuauaaaccccuuaccccuugagcuuguugucgacuccucuacuccugcgugaaauacaagucguccccagugcacuggucuuucccaaauagcuugucaucgacucuucuaccccugcaugggauacgagucauccccagugcacuggucuuuccugaauaaaccucuugcaguuugcaucaagaccuuuucucaugagugauuuggggugucaccucuccugagucagaaugugggggaguccucacgcugugagucuuuuaccaacaccuucuaaaaugagugacaugaaagcauuuuaaauguaagucgaagaucucuuucaggauuagacuugaccaagacaaauaagcaagaugaggcugcaggugagccaucacuguaccuaugaaaacuaauuaauuaucccuagauacaaguaucauguuuaugugccaaguauggucuguaaugaggccuuuuccaugcagccauauuucaaaugauucuucacuuaagugaauauguuuacauuacugucuuuuuuuuaucauauauucucuagccuacaauacauaugucaggaaaaaucauucuugugugauggaucagcuucuccaugcauuuucucuggguccuguguauaccugccuauuacucucuuccaaucuguauagucuuccuuuuaacuaaauucaaucacuguccaaguucauggaagcucagaggcaagugcuauagcugaccauugcaaacagcuuacagccuuucaucuguuccuuugaaguuacuuuucaaauccucucagugcaucaaguugcugcaauuuaaguccuguaaaacuguuguuggcaaagccacauuuacuguaagcauuggcacuuggaagaauacccgagcaggaaaaugaaagucaauauaauugcaauuuaucaaccccaaauuucauugacuugcuugccucagaacuguaaaaugaaaauuauuucgguuuacaugaguagcucauagauagauucucacauuuuaaaagcuuauuuuuaaaucuaaaacccuaauauuaaaaagcagaaaagcacucacugccauuuuuuccucauuagaaaaauucuauuagcaaauacauggggucaaaagaguuccuugguaauucaucauaguauguacugaaaugugcauuuaaaccaaagggucacucaauuccacggcaagaagcuuuuuccuuuccaggcugcugcuuuuuuuuuuucuuuucuuuucauuuuaaagaaucagauugcaggugggagagguggcucacuacguaaagaugccuugccugcuguccagccugaagacuugaguuuuaucucagagucccacaagcugaaagcacaaaacugacacccacagauugucuucugauaccaacauguguacuguaaaggcguaggcaccgacacacauacacagacucacacuaaauaaauaaaauguaauuuaaaaaaauuuacuauuugugagagauagcaacauccaaagaaccuuucacuugugacugauucauuauagagacaacuauuugcuauuuuuuuagguuuacaguccuuaaaauaaucauacuaauuguugaaaaguguguguguguuuauguguguuuacaaagaauuuacaaagaaaauaaaugagggaugacuuuuucccccaaauacuuagaaaaagcuggccacguagaaaaacaacuucuaugccacauaacaugaagagaugaagacaagagauagaagaaacuggcucaguaaccuaggcauagacacucaaagcagcaguuuugggauuucgaggugaagaugaggaaaaccagaggaaugucugcuguuauuaugaucacuuuuucuaaaggauguuccauuccaguggacagcuuuguggugggauccuuagauuuucaugauaaaaauggauucuaucuacuucauauucuugacggaaauaugucauggcagucuaggacauuguggcaagagcuguuaagggaaaacuccuucuuccugguuaaaaaaaaugaagucuaccaacccuugauaaagagauaauauucuugucugcuuugcagauuaaaacauuauacacgaguaucuaauccauuaacaguuaauccaagggucuggggagagacagcucagugguuaaaaguacuuggugcucuuucagaagacccaaguucaguucuuagcaccuacauaaagacucacaaccaacuauaacucuaauaccaagugauccaaaccccucuucuucccuccauaggcaccaaggacaaaugggaugcacauucauacaugcaagcaacacacauauacacauaaaauaaauuaaaaaaauaacaaagcaagaguuaauaaggcuggaucugacaaugaccuggccaagagaccaccccuaagacacggugauucaccuaaagucauaguacagagaugggaggcacaaucacccccauaagauguguacuuguccuuccuacaagacccaugucugauuauaaaaaaaaaaaaaaaaaaaaaaaaaaaaaaaaaccuauucagaacugcuaaguauggccacacuucugagucaaacucagaaaaauguaacuucuccuaguuugucucuugguuucauauauaugccaaagccuaggcaccuuucuucugagucugugggcuuuuucacuagcugcuccacguucaccuugaagcuguuuacuaguaauugguugcuugcuggcauucacugcugaacaugucagccuaacucaaaaggcguggcuuucucucugucuuccucccugccgcaccuacucuuggcagcuauuaugauuugcagcuuuuccccccuuuucucucuaguucuaauuaaauuguucuuaagcauccuaccaagucuauuuuuaaauucuauuaugugcagcccagacaggccucgaacucaugauccuccugccucugccuccuucagcaaauccuaccagcguguucaugcucuaagaucaagaauugacaaaugggaacucaaaauugcaaagcugcuauaagacaaaggacacuggcaauugaacaaaauggcauucaacagauugggaaaacaucuuuaccaauucuacaucugauacaggcccuugguccugugaaggaucaaugucccaguguaggggaauaccaggacagggaagugggaguggguggguugguaagcagaggggaggagggaugagauaggggguuuucagaggggaaacaaggaaaggggauaacauuugaaauguaaauaaagaaaauauguaauaaaaaauucuuuuaugaagaagaauaaaaauacaaagauggaaugccuauuuuccugguaagagauucuuuuccuuggagaaucuaaggcacgauuuuuuacacccagaggcagaagaaaauaguaggcgccccuuaauaauucauuuucccaacacauuuuuaucuuuaucaauuggcaauuauaaaaauucagaagcaugccuauaaaagucuagauuuauacugcuccugaaggcaucgagaaaucuuguaugcaagcccaaguggccaagaauaccuaaagcugugguggaauaucucuaaaccacaguuguagucuccagcucucuacccaacugacuccuggagaucucagaguuuguuugcuauucuguguucuaagaugguucaaagaggauucucuuauaaccccucuggagucauuuagaaagguauauaacagaggagcuaccaaaaguaaauaaauacuguugaaugaaaaggaaagaagggucucuuuggacacggucacaaagagaaaagcuucguggaucaggguguaaagaaagggcuggaaggcaagccaguaagacuaauggacuuaguugggcaggagcagaauguagaaaugguaauauuuagugaaaaacuucuuaaaaugauugaacaaacugagacaaaugagagacaauucaaggaauggcuagaaauucucuaagucauagucccuaagaaauuucaggagaagugugaaauucgggacagauaaauggcuaccucuggcuugaauguaaaauggugucccuaggauuggguccacagcuugguucccaguggaaguguuuuguuguggaaacacugguaacauaccccuggcuaacaagccagcagagcagagguuucagaguuacagcuugauccugcuuccagacuagauuucugcuuucugucuagagucuccuccgcaggcucccaaccagugaaaaaucugcuugucuuccagaaaaccaugggccaguguaaauccuuccuccuuuuggcuuuuacuguaagacauuuugucauagcaacaagaaaaaucuaacacagguagcaugcucgaguuccuuuauaauucaaagggugggggaagcauuaacucugccuuuauuugucuuuauuuucacucuaguacacauaguggaaucagaagaauacucuggcaaagcaaagaaugaaaagcauuaaagggccauuguuaagaacacagacagguuuucacauccuaggcuuacuguaugguccuauaguauauaagcaccggggcuuucugcaggggccuuugugucucugagcaucacaguccuucuauccgaugagaccaaaaguaguaccuaugucagacaguucugagagguaagaggagggugcauuuuuaggauaauuucugaagaaggaaagaacccaauacgcacuagcuuuaaagcaauuguuaucucugccccuuauagccaccaucaucaacaguuugauuuaaaaaacaaacaaaaacaaaaaacugcugagucucaagauuccaucuguggcucugacugaagaaguaaaagcggacauaugacaaagagauagugauugaagaacagagagaacccagaggcucuagaaauauaaggagagagcucuuuagaagugaccagacagaguccacuacaugaaucugaagcuggaugguaagagacaauagggaggaaagggacagaaggaaucaggccacuaaagaggggaacauggugugguaagaucauucagaaacagcugcgggacaaaagcagaguugguagaaaggacugggcuaagaugcauauaugacagcugguaaugcuuugugaagugaauaauuccuccagggcaaggagacucgggacagagaugagccauguugccaugaacacuuuuuagcugaaauugacuggguauuuucucuaugccaggauuucuguaagcguuuuacguaguuguucauuaaguucuccucuaaccucuuuucuauuuuauagacaaauacauuaaaaauauaaaaaagcuaaaagucuuuauuugaagguauccagcuuuuuaacauuaauuuuuaauaucagcaugugaagaaaugaaucuugcugcaguccugugccagguuuuaggcaaucuggaucaaaagugguagccagggcuggggagucgguucagucagugaggaacgugccuugcagcuaugaguaucuggguucaaucccagaauccuccugugaaaagccaaacagaacaguggguucuuuuaauuuccaugcuuggaaaguagaggcagguggaucccuggggguagcuguccuugguagccagucagucuagccuauacagcaaagugcagaccagugagagagccuaucucaaaacaacagacaagcgaugucagggaaauggcaucagaggcagaccuguauguagcaucuucaggaauuuauacacaugugcaugcuccucccauacauggacauaaaguggaauacagagccuucacacugaccauucaccauuccuugucucccuaguaaaagggagcauaaauuuaaagaauggaaaauaagaaguuacagacacauguaagcaauagcucuguuaaucaaagacaguagauuuaugaaguagguauaaagucuucuugaggauaaagguuuuuucuggauaaagagaaaaacuuucucaaaagaaaggaaaggaggcuuaaaagcccaaagauaucaauugacuaaaugcuacaaaagaaauccccaaaacuaguuucaaugucaguaaaaauguagaaaaaggggucggauuucauuugcuuaguuucaccaaagaaauggacuccacaauucuagcuuuuggagucaacugcugccuuucccugauuggacagaaucauuacauuuugcuuuggaaggucaucagugcucaacuucaucucuaacaugauucuggccucuaagggguguguccuguuugguagauaacaucaguucuacaacacuggcuacagugucucaccagauacaggacaccgaagaccacacuaaaggcucccacagaguccacucuccaaccuucaccaugcuaauuggccuaaucuucacugauaacuaugcucacauaguccacauggucucauuauguagcucuggcuucucugaauggaauugacuaagaauaccaggucagcuaccaaaucacagacaucuaccugcaucucccucccaagugcugugaauaaaagccugugccaccauggcccaaaaggcguuauugauaauaucaaaaauuaucuccuggagcaugaaacaucuaccuaccucacuugaaaguaaagaaacacuuuccuugugacagcuacugcuacaugagaccauggagacuuacgaaaugccuaggaucugucccucuaauguggggaugcagagaaagacaauaggcuauuuaggaauggguggggaaucuugccucugguaguuuauaagggagguaaaaagaagaaaaaagagaaaaaaauaaggugacaauuccuuugugcuucaaaagaagauacuguugaaagaaaaucacuuccauacuggauuuaaaaagucauuacugccaaggacauuuuugacuagaaaugaaaugaaaauuaaaucauaggugcuaagggaaagaagcaugggcaugaauggaauuugugcuuuguaaauuccaucuaugcaaaacauccaaaguagauacauccacagagaagagcacagagaagcuguugggcuggagcuagggcuacagguaaggacugucugcucaacgagaacuguuauuagggaaugauggggaaguauagggaggacaccaaagucagucgcacugugcuacauucuaugauuaacuucuauucagugaaauucauuucacuauaucagcguuaaauauuaaaaacuuagaaggacaugaaccagacgguacaagccuguaauaggaacaccagggagacuaaggcagagaaagugagggcuugaaguuaaccaggcuacagaauaaggccugguuuaaaaaugguagggugguacaagcaaguggauucuucacauuaccuuaaaacauuuauagaaucagaaugaaaaaauagaacacuuuagccucuucacucuuaggguuuauucuggaaagggaaaaaaggaaaagcuguguuuguauuuugccuugauucauucuuuacaaaaucacauaaagaaauguagcagggaaacacaaggaacuacuuuuccaaagcagagacaggagaaucauuaguuucuacaccagccugggcuccaaagcaguaccuuauacacacacacacacacacacacacacacauacacacacacgcacacacacacacacacacacacacacacuccauaucugcaauugcagagaaaaaaaaagaggcaguguuuuuaggaguucaguaucuuuaugcaauaguaggauauggugucaggguuagaccuuacugacauugaaauaaaggcagagaagcagaagccagaagagaaagcuuccagacaaugcugacguacuucugcaggguggagguuaagagggccgcagauuuaggcacuaggagcuugggugcaagggcaguuccacgaaauggcuggacaagcagguggggagccagacagcugccacaauagaaggcgugaacuaaaguaugguaucagcaugccgugauguuagauccaucagggcucuucagccaacuuugcuccuaaagcaagagaccucaguggcacauuuucauggcacucucucaauaugcauuucaagaacccacauuauagucuggcacuaaccauaucgacucucugaauuggaaaguauagcuaauuagaaccuaaggaugucugcccauuuuauuugagucaacaauuuccacagccucuucucuuaaaucucaaagggucacugccagcgaggaaagagaaaacaaccacagagaaauaaccacugauagcugccaugcucagaauucuagccacggcugagaggguagaagcugguggccagguccacaggcggcaagucagaucuugagcaggaagagagaaaauggacugagaguuguaggaaauuugaggaagaaguggacacuguuacuuguugccagaggccacgagcaaggccacucacagaugcuccagugccauacagucaguccccuuaaaugaggcacacgccuguucuaugcacuaauagaacacaauacgauuuggacacaauggucuugugcaguuguaguuucucugagauauaggauacuucuucauaaauuacauacuugauaugguagaaaauauaacagaacugaguaagucaaauuuaacuuaggagaaaucagguaccuagaauugaucuauuuaauuucaugaaaguuaaauaagaaaauauuuacaagcaagauugguggaaauaaucuauauucugggacgagagaaucaguaaaguuuaacuaugcugcaaaaaaggccuuaagauaauaugaauaagaaacauuuccauaaauauauguguguauauaaauauauaugacaauuuuaauaaucagaaaugauaaaagggacaaagacugaacaacagaauaaaacuguaccaugagugcuuccuaagagggaagcuaauuaaccaugugggagcagacaaucggcccuuuuaggguaaaaaugcacuuucucgguauuuuuuggggaggggggagaagggaggugggugggaguuguuauaacaauuugcuuagcaagaccuaaauaaauguccaaaaagcaaaaguccaucuucaggcauuucauuuauagucaacgaaucagaaugguuucgugguuucagagcgccuggauuaaacucagcuuuuuagacauagcaugccuuccuucuccuuccucccugcucuguccuuugcuuucuuccucucuguuguuuucucugccaggaucaucuaacuuuuuuuaugaugacuccucccuuuccccguccccagcccucugcugaagcacgugcaguucuuucccccaaaguugagcucaugggggcaaagcuaagaaccaucuaggaaaguggcugccugucacuguaaccaagagaaagggcaccacagugaucaugugucuucugacucguaccccugggauccagaggguggaagcaccucucugcuggccagugggcaaucuagcaaucacauacacaaugaagcaaucaggaaaggugagcgggugaauauugccuuucagaggauagauuaccuuuuuccuggaaaaugauuauugacugacaaugaguuuguaauuuaccuccuuccagccuauaauaaacaaaaauacaaaguaggacaccacuuucaauagcuguguggaugauuauaaucaccuuuuagccuuaaaaccagcuccuaccucaucagcuaucauacauaauacuuucuuucuuuuuuaaugucuucuaaaagaaaagguuuuugugaggcacagcuuggcaagcugucuaaagugucaccucuuacugcacuccacagaguuuaaaguuucuuuuguagaaaucccauuucuguaguucaucauacccuuucgcugcccaccuucaggaacuagucugagacaguugguucuauuacaggaagagaacaaaggugcgccuuacauaagugagccacgagggagcuggcugguccuggacaauagcaaugcucuggcugagagaaaaguucuuuagagaggaguggaugucuuagugggucacaugauuacagaaaagccaggucuaggauaggaguugcaacagagcacagcauuaauuggaauucuucaggaugagauuucaaguggugccuuuaaauauugaaccaggaaguggggaaggagacagccucccaugggaggcaugaaaaagaaaggagacagauaaagacuguggccagaacaggagacagaaaacccugacagcagaaauuacacaggagacuggccagggacauggcaugagaaccacucuuaaagaaaagguucucaucugucacaaaauuacccucuacaauuaucauaucuugaaaacaaaaaaaccaaaaagacaaaaacaaaacaaaacaacaacacccacaaaaccuguuaaaaaguguagcagaggagacugauaaccuuggguggaaaucucaaacuccaugagggagcauuuaauccaaacuuggucuuuaaaaagcagugaccgucaacauguaaauaugagaggaugucauuuuccauuauaaacaaaagcaaaaaccaaacaguugcaauguuucucugguaagagaagagaaagagguuggggcaggagggguaaagggggcugagaaugugcuagggccguauuccccuuggcugcauagcaaccacuggcuuuacagagggcugggguuaaacaguccauagccuacuccacacucugcucccuguuaccacauaaauccuaucauucgcauggccggccuuuccugagcagcugauucagaaagcucuuacuagugcaauguuugaacgcucuaccuaugaccaaggauauugucuuuugcagcuauuuuugccgucccuguggaagcugcauaaaacuccauuuuagugaaacccuuaguucuguauguugagaucaaagccaagucaauuugcuggcaugaagcaugugagguuucucucgugguuccaugaacuggaaagguagguuagcuggguuuuccccaccugaggcaagaugcauguuucacccuguaguaauuuaaagacuuacaaggacagaacuuuggauuaagcuccugcacuagaacuccacaggagcacagaaaaaaaagccaaaauggacugacuagugcucaggucgcgugaaggggaggggcugaacuggaaauacaugaccaaugggauaaaucaggauuagugagacaaccaaguuugcaguaggccagcuccaaagauaaagacccagggucacccuacaccaaggagaggugauuucuuucuucuuuuuaccaaucugcccaccccuuaugaagaaguaacuuugaaauaaacuauaaugucuugaauuauugguuuuucuucucccugcuuucuuuagccucuucuugaggauaaaagcaacuauuuagaggaaguggugacauacaccuuuaauccuagcacucuagaggcaggcagaucuuggaguuccaggacagccaagucuauagagugaguuccaggacagccauggcuacacagagaaauuccaucuugaaaaagaaacaaaaauauagcaagauaagauaaauuaaaaacaaacaaaaccaggacaaaacaaauagagaaagggagagauagagagacagagagaaagagacaaagacaggacagagagagaaagagaggaaagaaaaagcaacuauuucccucaggccucaggaaccuuccuauuugcuggaauaaaggagugaaucaaagcuugaaaaucagauaaggccagaaaagauuuuuagaguaaauugcuagaguuuuauuucuguucacacuagcaaaguauuuuauuucuuuagaaacagaaucugaauaugugacucagacaagccugaagcugacaauacucuuugccccucugccagugcugagugaccagguaacaucaccacacucagcuucagguuuucagacuccuuuuccccagacuuuugcuuagguccaggaaacaggagucaucagcuacaagguagagccaaggaaggagagaagaaagggauuuuucuccuuuucuaugaccuucuuaggaccucuuaguaaaggucagcccuuagguggccuucauuuuccagacuccacuggaaaguugggucugguucucuuccaggcaaauauacagugucuuucuacaguuucagcucccugaacccuucugauacuuuugauucuuccccuggguggaggguguagcucagugauggagcauuugcucagcauggaggaagcaugucagcauggucuagaugauacacacaaaaaaaugagaguguuacuaauaaagcuaucuucucguaaauccuugguacuggguuucucaccuggacucucccugagaaaucaagaaucuguguacuagaaaagguagauggauagaaaagacaaagggaaaugaugaguaaaagggaguucaaaugagucuggaaaaagauuuuagauaagcgcaaugucauagacugcuccuuccaaggcuugcuggccuuaaucagaugcugcccaaguggcugagugcuguggccauuucuuuucugaagccucucauuucuuguguaauuagaaaugugccagucugugaugauggcaaccuucagaauggucagccugucccuccccaucccuaacuacagacacaaacgccugccugauuaccaagagucuuauuaaggggcuauuguuucccacagcacucugacuccuccuaucuccugaucuuuagcaucuugcauucuacuuaaagaaggguuuucaaugaaaaagaaaaucccuggacauccacaucaagcuguauucacaacagugguaaagugcauuuggucuugucauucaaaggcuuuguuuucuucucuaaaucuaagaauaacuugcaaucaguugcaaaaaaagagaggaaguuuuccaaggagcaugcugugacagaagucaaccaugacaccacaaggcugcucacacucuccuguggccuccauuuaccuugcucaaguuuucugaucacgaucgccauuacuauaaacauuagguacaacuauuaucuuuggcaaaacuacacaauuuggcccuauagugucccuuaaagaggacaucaguucuacagacugcccaaggccucuaguggcuaagauaguggacaaaaacaaacuucauuuguaaaagugauuagcaauuugccccacccacuaaaucccucuuccaauaauaauauacgacauauuucugacagauucauaucgucagauuaccuaaauuucagagcaaaacauuugauuuugaaggaagaauauuuuaccuuuaguaaaacagcaugagcuccaaggacuauaaagaggcuaaaacaaaacaagagcuucaguucccugaaggcuggggagcuucacugacucuucauugguaaccaugguauaugguauggagaggauguucagucgauggaaugaaaagaauggcucugugacugagugucuugguaagauucacucacugucauaucaacacauggagcaauuaccugcuuucaaggaccaccuuuguuuagggaugcucuugcccagagcucuguucugauuuugcagguaucuguagcaccaugcaaugguuuagagagaaucgcugcuuuagcacacaaaggagacacucucaucuacacagagcagaaugggagcuuaccauuaagacuuccucaagaggcacuuacuuccuuucaagacaaaagccuagguagacaaaaacaggaaagggggcauugaaaugacagcgugagaaagcagaguuauagccacauaggccgacgaagaggaaagcaauuuagaagguuggucuucgggcaguuuuaaaaacuuauuucacaaccugaagaugcuuggguuugcuuucacaaacccugaccucugcuguauuuaauguccacucuagagaaucacccagaaccaugucuggaaauaaauguguauaucugugacuggagcaccaagggcacugguacuuaagcaucucuagcaauacuuaagaugccauguugaaaagugaagauaguuaacuacagagggcucagggagcaaggacaacagaugacacuuacagagccauguaguggcaaggaauucuuuaagagcgacuuauaccuaaaaaucuguacuggcaacuuaccuagucaagaauauuaaauguguaaaaucaauacaagcgaauuaugaauuacaaguaucuuacacuacucuaguuuaccacuuuaaaaaaauguguccuuaauaaauauuucuuuugguaauauaaauaaaauagaauggggcuccuuucauccuaucaggaaugcuuuccuuuuaaaaucuccuaacuguaaucuccuaacuauaagaacuagguucuccuacaugcaaacucaaauguguuuuuuccuccucuuuguauaaaacacaauaaugcaggguauggcugaaaccuauuacagcagccugggcagacugcuggagccaacucugucacuaauucuguccugcagcuugcaggaaaguaaaggagaggcacagaacuucaaauaaaucaauuuuguuuauuagcuuccuuucuuuaucguuugcuuuuacuguauguuuuguggaucgaguuaaucauuuucauguaaagaucaauuucaauaugcgcuuucauuucgcagucgccgucagauacuaucgagaaagcgcaucugagaaagacguggaaguauacauuuguguugcuguguccaggguccaugccacaucauucucuauuucucauggaaguaucaaguauccagaaacccugcuuuguguuguuagcagcuguuuaguucaaaugugucccgggcaaaaccaaguaucaaguguacuucacaauuuaagucaacuaaauccccaccccugucucucucuccugucugacucugugucuuucacugucucucuuucuuucucucuuucucugucugucugucugucuagaacugcagaauaguuugaauuaugguguccucacaaggcuuuuaauaccaccuuccugucaguagccuucaguggauucugcuugcuguacaugcccccagaucacccuuaucccacuagcugauagggaaucaacuuuuucccuucugucucugucccucccucugucccucgucccuccgucccuccgucccucccucccucucuuccuuccuuccuuccuuccuuccuuccuuccuuccuuccuucuuucccuccuuccuuccuuccuuccuuccuuugcugcuuaagguaucuacaucuauacauuugcauauacccaagcaaucuuguuacuaguaaaauaagagacuauuauuaagaaucacaugacugacacaaaucuccuccuauuuuauuuaacuacuuaccccuuuacauuuuaauuauuggcuuuaaagacauuuauguugaggaagccuaauaauaugagauacugagagauugucacuguuucugcugcugcaggggcugccuccuacacaccaguguacaugugaagauaggcaagugacuccaccuuuuaaaaagcccuucaaauguauguggacugaaucuaagaagacuucugaaacuucugagucaagaaaaaagggucaagggcagcauacauacagaaacacaaauaguuguguguaaguaagcacaagcacacauauaacagcauuucucuuucccuuagugaauucuugauuggcaucaaguuccacagaagcagcccugggacaugcugaaccugcugugagucagccagucucaagcuaaagagacagacuaccaagggcagcacacgccucauuuucaagaacaccaagaggaaagauuucaagucuucaacggcaucuuccugcaaaacacugcacauuuauucuaaaaacauucacuucaaggaagcuauguucauuacauucuaagucauuguguucaagucaacuaagugucuuggacaugcugucaaguucccacagaguuccuccacugagaaugaauuuuaaaaugagggcaaacuuggcuuccaaccugaguauuuuauuuuauuuuuuauuccaaauaaagaacaucuugaaacagcuccuguaacucucaauccagacuugccuacuguauuaaaugguagcuguguuucauagaaaaugcauagcguaccagucuacuacauggacaauccaaugaguugggauuuacaaaaggaagaacaguugaggauuauuaaggaucaaagauaguaaaugugaaauagguucaaggaagagucacaauauaguggaacauaaaaaagauuuagucaggcaaggccauggaugaaaaggaaggccaaggguugaucugagagaaacugauaguguaaagugaagucauccaucugggccaaauggucaucuguuuaucaauuuggcauuuccuaagaucuaauggcguuauugauacuauauaaauuggaaaaauaugacuuuaauauugauucaguucuacccuggcaucugaccucagaaggaagaucaauucccauuaucagagaauguguuugaaaaaaauauauauuagaaauaauacauauacauauauauuagauauuuauccuucaaaacaauuuauuucugaaguaaaacaaauaagcaguuauaucaacaucaaaauaugcuaauaauauaaaaccucugguuuucccaacaaagcaauguguuuaguaaucuuaaucuuaguucauccuauacaguacuaaacuucuauuucuccagcuuuucuccucagugaauauaugaaacauuauaaagauuauucauuauguuucaaaagaaucagagauaaucuaucaguuuaacagauuaaagagccuuaaauaugaagcaagcuucuaaguucaacuucaaaucaggguaaaucugaacaacaaaaaaaugaacaaauaacagcaaaaguaccauauuaauucuuaauaauucuaaaaaguaguggaaaaaucaauggcaggaaagcauccagcuuuuuugccuuucaguuuuuggcuugggaaggcgaugguggaaaauguucuccacucaucucaaauccaggcucccaaauuccaguggucucuaccuugcugcccacaaagucaggaaccugagguacaacuaaagugagguugaugccacaucugccuuggcucccaagagagguccccugggucugucuccaaaaugaaguugaugaugucauugccaagguaauaagugacuagaaagcucagauugcagugaaauuaagcagucugaacagacauguuccaaugagguggugcccucugcguuggccuaaucaucaaagcccucaagaagcccaaagucggauagaagcagagcauuaagcacaauggugaugucacuuuugaugagauugucagcacugccaucaaaugcagcauugguuuuuggcuagagauuauucuagaacuguuaaggagauccugaauacuacacagucuguggucugcaaugugaguccugccaucucaugauaucauaaauaacaccaucauugguacaguggaauauccagcgauuugaggagugauaagagaagacauuucaauaaaaggccauuugauagaaaaauauaaaacaaacaaaaauaaaacaaacaaacagaaaggaagggaaaaaagagggagagaaaagaggcucuauaggucagaugugcaagcauuccuguccauagaaggaauucuaagaaauuacaugugaacagguaaauuacaucaugaaaauaauacauguguaaaauuaugaaccugauaacaaaacagaaguaugauaaaggacuagagagauuccccagcuguagaauauaguaaagggcaaaaauaaacuucaauaggguauuuuaauaguagacacagucaugugaaagaauaagcagagaagaaagcaggacaugucaaucagcaagcuggaagaagaauaaguuggaacaaaggugaaggaggacuauggaugugugcagcaccacccaacaacacacacacacacacacacacacacacacacacacacacacacacacacacacacacaguauggguaugaaaguccccagggaaugacaggggugaugagaagaaagccugcuuaaagcaauauuauaaaaaugucuccaacuguuggaggcauucagcuuuucuuugaaaauauaacccaagucaacugcucuucagucagaauaauuauaaaagaggagaaaaaauuaaaauuggaaagaagaggcaacaggaguaauaccauagaaauaaaacagauuguaggugacucuuaacaauuacacucuaacagaucagauaaucuauuagaaauggacauuuaucaacauauaaccuaccugaacaaagaaggaagagacacuccgaaccaaccugugauaaguuagaagaugagucaauagcaaaguaagucccugagcuagcugacuugucuaaaggguucugccaagcauuuaaaacuaauacuaacuuuccucagacuccucccaaaagauaaacuuuaggaaaauacuucgaaacuuacauuuacaaagccagcaucgcgccaguaccaaaguuguccaaagacaaaacagaaaaaacaugacggcagauagauguaaaaaauccuuagcaaaucuuuagaaaacugaauucacaacacugauacguuguaaccaagcaagaauagcccuagaggcugagagauugcucuguaguuaaaagccugcauuucucuuccagaaggacccaaguuugaucccaguauccaugccacaugggucacaccugccgggagcuccaguucuagaguauuuccuccuuugcucucuccaguaccuacaacucagggcccagacacacauauacauacacaagaugaaaaaugaacuucauguuuuaaaaacauuuacccuauggaauguaaggauuauucauuuuaugcaaauccauuuauacugugcuucaugucaucauuucaagagauguaggaaaagcacugacagaauucaauauccuugcacgauuaaaaauuguuuucaauaaagcagacacagaaagaauauaucccaauacaauaaaauccaucuaugccacuccuaagaugauaaaagcucaggaauaagagaaugggcaucuuauguuucuauugagcaugcauaacacuggaaguuuaggucagaauaauuggggcuggaauaguggcucagcagugaagagcuguuguuggacuuacagaggaccuggguuugguuuccagcaggcaaauaugaccucaagccaucuguaacuucaguuucaggggaucaaacaccuuguucuggccuacaauuacaucaggcaugcugugguacacaugcauaaauauaggcaaaacacuugaacacaagaaauaauaaaucuagauuggaauaucagaaaaggaaauaaaagaaucaaaaauaggagagaaaaguaauuauuacuucugucuguugauaucaugauuuuacaugcagaaacuuguauuccaccaaagaaacuagacuauagcugaacacuaguuuuuuuaauccaugauucuagccacaugaaaaauuaaggcaagaauauuacgucaaaguacaguagggacaacauaacaugaccucaucucacauauaaauaaaaacugucuuaacugagaagcaaauucaauaaugcugaaauuaacaaagucauccuguaauccuggaagcauuuauguauauucacaauaaacuaugugaaagauaaaucaauaauucuauauaugauaacaauaagguaaaacaucuaaauuuuuaaaagguuaaaauucauaaaaaauuguagaucauagaaauauaaaggacugcugucuugcaauaaaugguauuuaaauauccauauuauccaauguaaucuacaaauucagugaaauaauuaccacaaucuccaagucacuacuaaugaaaaaguggaacuggaaaaaaaucuuaaaaaugcauaaaacacguacagaaaaauaaaaggccauagucaauaaaaacaacaaaacuuggggaggagacagagcuagcgacauauaacuauaugacuacaaaaucuauugcaaagcuauaguaauugaagcaacaagauauuggcacuaggguagaaaaccaagagauacauucaaaggguuuugggcaauuaauuuauuacaaggcaucuguucuuaauugaagugucuguugcuuugauaagcacagggauagaaaagcaauuuggaagaagaaagaguuuauuuggcuuauaccucucaguucauaacccagcacugggaaccccaaggcaagaacucggaggcagaaacugaaccugagaccauggaugggcacugcucacuggcuugcucuccagggcaugcucagccugauuucuuuauacaacaguuucccagggaggguaccacccacagcaaaacaggccuuuccauaucaaucauuaaucaauaaaagguccgaaaaguuugcccacaggccagucugguugggucauuuucucaaaugagcuuccuucuucagaaauaacucuaauuuuuacuaaguugacaaagguggauggauguuuggauggauggauggauggauggauggauggauggauggauggauggauggauggaagaaauggauggauggauggauggauggauggauggauggauggauguuuggauggcugauagauaaaugucagucacagaacacaaaauugagaauagacaaucucuucaacaaauguguguggaaacugauaauucggaaguagaaugagguuggacccuacuacaguucaaagugaaauauccccgugaggcucagguauuuugaugccuggucuccagacggugcuuuuaggaagguggaggagucuucaggagguggagccuaaauagaagaaguggguagcugugaagugggccuuauggauuccagccuggccacgauuccagcccaggcucucuccuuucuccuuggaacaagcaccucuugcacucacaacuacagcuucaagcugccccugccaucacagagaaaagaaaauaaauccaugcucucuuaagcuguuucugucagauauuccagccuagugaaaagaaaagaauaaaacugacccaugucaucucauuuccaaacauaaaauaaaguuaaaauagacugagcacuuacauagaacaucuagaugagacaacugcauugaucucgugggaaaaaugacuuaguuuucaugccaaaaccacaaauagcaaaaguaacaaugaauggaguagcaucagagccaagcaucuucuuggagcaaagauaaagcuaguaaagaggagagaugaaacacagaugggaaaaaguauuugaaaggcguagcucagcuccaaacugcaagaagcacauagaaggaaguaaugcaaucaguacggaauggguauguaaccuccauguaaguuucuccaaaugagcacaugaauagggagcagauacacgacaaaucccagcaucauugugcaucaagagaugcacacugcaaccacaaggggauauuacccacauugauuaaauggcuucuacccauaagacacugggaggcaaugaugcagagaaggaaaccauacacauuguugggaaaacaagauauuauggucauucugaaaacuacuguggagauuccuuagaaaacugaagacagacuuauaugaggaacaugaauccacuuuuguagacauauuguaagaaacugcauuaauauaugaaagcuguaucuucauccaaugcucauucugcacuaugaccuaagacaaggagauacugaguguccaucaucagacgaauggugagggaacacguuuacaacaauaaaucauggacuauuacacaaccccaaaagcagugacacauauuggcauuugugacuaugaaucugucacugaauggaugaacauuuagugaaauaagccauccauagaaaggcaaauauaauuucaucuauagguugaaucuaacaaaaucaaacuuauagaaggagcuauuagaaugguuauuaccaaaggcuggggagggaggggaugggaaaagagaagauguggauccuguagaucagacaugaacaagcuuucaugagcuuugcuguagaaauggugacuaugugaaugcuuuguguauuucaaacaacaaaucuguuuucaacaaagcaaauuaagucugagauucaucagucauccuguaagcauuccacauagugaacauguauggcguauuaugcuauaucucacaaacauacuuaauuauuuuacaauccaaaauacaaaguucaaaaugaagucuaauucagaguacugagaaucugcuguuuagcugcgugcaugcggacgaggagaaaguaaacaugacaucauguuuuacccgacuuuuuggcagcaacauuuuggaagaggcaaguagauauggcaucuccaacagaccuaggggauguuccuugagagacuggcaggagauuggcaucauggaaaguaguuuaaaauaacuauaagcucuaaggaguuauacagaggaccaaagcgcagacagucuacauuaagaaacgaagacaaccuagcuggcuauguugggcguuuuuauauucaagacugacaggaguuaauuuaaucccuuucauguaaccaucaguaaauguuuacaagggucuagggggaaaaggcaagaaugcauuuuaaaugcuucauugaaaaaagauaaaugucuaaaguuuucagaucauguauuuauuuuuauaaacaggugacauauguauaacacauuuugauagcaauuucuuuaaauacauauuggcuacuauucaugaauuguauaaaaguaguauagucaauuuuuuucauauguaagaugaacaccauagcuuuuauuucacuucaauaauacaacuuaguaaacuaaaugauugccuuggaauuaaccauuaaguaauacagaggguucaagaucuuaaaauuaauuuuucaaauauuaagcagcuuaucauacaaccuuaugguuuuuucucauauggaucucuccaaacauagaaucaagaccuaucucuucucaacaugaaguaaucagaggguagacucaaaaauuuugucuuuguaaaauguauccaccauucuuuccuuuauugauucuagaaucaaggggcaggcaggaagcuuaguuagguagaaugccaaaugucauucaaagggacuaaguuggcaagaaaugacgggguaugcaucagcuccagacauguaaauaaaauggguuuuauauuuauauggccaugaaggaauucuuggggcaaaagcuccaaaguacugcgccauucacaacacugaugccagcauccuuuaugagcuaggaaagccuucugucgguuccaguuuacuccauaucaugauugauuucuauuaagaaggaaaagcuauucuucauucucuucuccacuugaacauuauuaaagagcucagcauuugcugugggggaaaacugcacauuauuuuucaugaccuucucuccccugacuaagaaaauaauccacuuaauguguccaggaggacaauaacccuacugcuacaugagggcaguacagaauucuagggaacaaagucauuuacaaaaacauugaggaguuugccaaacacugugggguuuacggggccauugguaauuacuguguauaaugcauucugaacccgcuggcagugagcugccugaucuuucugggcugugucuuucaacugaaugcuguuuguuuucuacauaacaaaugacagagaggguguuggucuauuuuguacagaacuuaaaauuuugcuuuagguuaugacaaaauaugucagucagccauuauaaaacucaaaaucauuucaauaagccucagacauuauguuauuuggggcaacauacaaaggcuauagaugucuuguugcuggcaugcuugagcuuggagaaguggcaauacugaauucucuaguacaacaguucucaaccugugauugcuaugccuuucagggucaaaugacccuuucacguugguugccuaaaaccaucaaaaaaauuacauuaugauuuuuaacagcaaaauuacaguuacuuucucaaucacaugcaagaacaaaacacuacagccaguucuacauugguuccccaauguguuucacuauguacaucuuucuuugccugccaagauucaaaucuaguuugacuugaccuuugcauuaaucucccucccucuauagcuuuccaauagucuccacuucaauaacuguaauuguauucaguaucaggcaccaguggacaacaaaggcaucugggaaucuucacuuuugacucacaaccaugucuguaagagggauuaucuccauaguauagauugacuaacucuagaucauagaaaguaaaaccucucucagguaugcucaugugacaggggaugugugagucacuuggaauguaaaauguccuaucugcccaacuacacacauacacacacacacauauauacaaacacauagacacauacauacauacauacauacauguacauacacauaaacacauauacacacauauucauacacacagcacacacauacacacauguacauacaaacacauauacacaugcauaaacauauacacaugcauacauacaaauauacacacauguacaaacacauacauacauacacacauauacacacauauucauacacaaagcacacauacacacacucacucacauaccacacauaauugcaugcaggcauaauugcacauaaacaaacacacacucucauguuggacacuugguccccaacauugguucucuccucagaggcuguagaaucuuugaugcagaaagcacaguuguauauuaugucacuggagacaggccucuguggcuuauaguucaccuuguuucuaauccuguccugcuaagauguaagguguuucagugugacacuaaguuaaaaccacacagaaacuuugcuguccugauaguaauagaaaagucuacuuuaacucuaaauaccuuuuguuggauacugagagcacagaauuauguccaggccuuaagaaaacauucugaacaaaagggagagggaaugcaggaagcagaugagaaaagcauuguaaagugcauguguucaggaacugugcacaugagcuuggugaugaacaagaccaccagccaugaguaagcagggaacagagugagaggagaugcugcugcagagggaaaggcagaaccaggagguggcuucccuaccgauaaccucagcaagggagcaucucagacaguugggaugacuccgcugguggaguugaagagcucaguaaagaaggugcaugcaaauuccauuccuggcugccugacccugaucuaacacguuagcuccucacucugaacaugcuagaugaauuacaagcugucucuucugaaacuacaaugucuauaaugguagucauugccacaggaucugagagcuauagaauaaguuaacugcagggggcucccucuccucucugcaccucccuuccucucccucauucacguagcuuauaaguuauuucuauaaacuggugauaaauuaguuaugaaacugguaguguguggaugucuacaucaauaacgaaacagcaaacaagcaaaaaaagugaagaucagaagaaauacaaccucagucacuuucuauuaacugaguguucacucauccauuugcuuaaauauuuauuuaauaucugccacaugccaagaauugcgcuguugcaugcucagagaugcauugcaaaaaaaaaaaaaaaucuuaaguacaaagcuggcugggaaauagauacuacucaaauacaaaaaaaaaaaaaaaguguggccaugauauuuuuaugauuuauauuuuuaauuuaugcauguaaguacaccaucuuucuguucagacacaucauaagagggcauuggauuccauuacagaugguagugagccaccauaugacugcagggaauugagcucaagaccuuugaaguagcagucagugcuccuaaucacugagcaaucucuucaggucccauagcuuugagaaaaacaacaaagaccugcugggcaggaaauagguaaagccagagaagcuucugagagcaaccuggagagucuagcugugucucgaggagagugugcuaaaaucaaaggguagcacuaccccucaccccaccaccaccuacccaagaacucuguggagaauuggcaguucaaacaaguaggcugauacuguuaaugccuuugcacuaggaagccuccuugaagaaccaguggucuagaucacagcccuggagggagucaaaggcaagagcuaaaguugaagaacauggcaggagcugaacguccucacaaaugguagggaacagaagucacaucaguucuaggcucaagauggcugagaccuugaagugaaaauacaaugaucaaggcaauuauaagccaaucaauguauguauauauauauauauauauauauauauauauauauauauauauauauauauguguguguguguguguguguguguguguguguguacauauauauguguguguguguugucugauuguguaaguacacauacgugugcaucugaauguacaugaaaaccagaggucaauguuggcugucuuccuccauugcucuguauuuuuuuugaaagggggucucuuaagggaucucaccaguuugacugggcuggcuaucuagggagucccaggaaucugccuaucucuacaucuccgaugguaaaacaaccaauacccaccacaccuaucauuuaaauaggcacaggaaaucucaacugugguccucaugcuugggagggaagcgccuuaccaacugagccaucuccccauccaaugacaauuacucucaggucucuccuaagaggccuccuauuaccuguuucuaagccaagaaaauacaugaaguccagucagggacuggugagagcuaauaccuauaucaaacacuguuucaggaaacuauuccugaauuaacacaguauaucucaugcaaagacuggauggcaucauagcacauuuaacagcuaaaauaaaagagauuaaagggagaacacugccaccaagcauacaguguuauacggacugugacaagaaaggcaucucugucagcagccuggaggugaguacacaauucuuguaagagggguugacucacauauagaaaugauguuauuuauuuacccuaguaugcuuuaaacuauucaacuggcuuccaaaggaagauaucuuuacaaguaguuuuggguuuugaauagacaggaagucauagauguugauaguuuaauaauuuuuaacaaucaaucuucucccacgucaucuagaaacugcuggaaguggccauuccuaggaucccaaguccagaaauguucagcauaacugaauaacuagguaccccauuguugacagacuacagaucacaguuugagaaaugcccauggaaggucuagcucccuguucaggagaaagcccagcugaauaauucacaacuuucagcagggauacaaguguuuuuaagguuacuauguacuggggccuguacugcacaaugcuuaaaaguaucucuuuuaaucucucacaguauuauuaaucacgcuuaagggauaaggaaaaugauacucgaugauguaaaauaauuuuuccaaugucaguuacacagaaaauuaguuuuagaacuagaagguaaaauugaggguuuggcuacaauaacagacaaacuuuacuccacugugcuuugcaggguauguuaucauaaaaugauugccuagccuccauugguucuccuaaaguacuaaaugauaagggauuuagccccaaaacaaaguccaauuauuuccuuugaaucugcuuggauacaugauaauauucauguucuagaaaccaaguuuacagaucaauaugcuugacaaagccauuauacauuugucuucauagaauggagagcagagauguacauuaacaagaccaugugucugggauggacguauagcucagcagugacaugcugaucuaucauucuucugucugaaaugcaagauuaauuaguuguuugauuaauaaguaauuaggugauuaauaaaaacuuaaagacaggacucuaauggcucagcuacauaaauguaguugauauaaucuguaagccucucuaaucuauaaguaguauuaauaccuaagaaauuauauuauauauuauuuauauauuacaauuauauuauauauuauuaauuauauauuauuuacauaugacuauauauacuuauauuuuacauacauaugggagagagggaggaaggaguguaguguuaugcaucauuuuaaucauggaaucuagcaucuguacagauauuugauauauacuaacuuccucuuuguuuauuaauuaaaacauuuaagggaauauaauauacuugauaaaauagaguaaaauaaacauugagaaccaaucaacauaugugaaaaugguuaacucaauuguaaucuuaggacaaaagaaauuaaaccauguuacacugaacucucuagaaaaaagucaguuuugauaauagaaaagaaacauaauauuaaagaaauuuaacauauaaauggacauuugauagauuacuuaaauuuuuaaaugcugugauacagaaauaauauuucucaauugccucugagaccagcagauaaagaagcagaaaauuaucuauaaaggggggcugcagagauggguuagcaguuaagagcacuggcaacucuucuagaggaccaggguucaauucucaccacugucuguaacuccuguuccaagggaucugacacucucacauaagagauauaaauguaggcaaaaugccaaaguacagaaaaaauaaacaagaaaaaauuagaaauuaucuauaaaagaacaaaacauaaauaguuagggauuugaaauucuuguagucucuuauaccaacucaagauggccaugauugugcacaagcagaaaccaauaaugcauacauggggcaugacugaguucuaauacaaguuuauuuguauauacuaaaauguauauuccacauaauuuccaguuauugagaaguaugcuucaucuuuugacucuuuccaaccauuggaaaaugaaaacaaacaaauaacaaacaaacaagcccuuacuagcaguugggcuaugcaccagaaggguggugugagcaauuuggcuaagagguugagggcaguuuuccaguucccaccgaagagugauucuccuagguguguacaagugccaggaaagacaguuaagaguucccaggaauccugggacuauccaucaguucaacaucaggaaaagggcugaaugacagaggguagauacuuaaucugucacauuauguaaguaaaaauggacaggauaaauuguuagcuacuaccauaaaacguauauucaguaaaaaaaaaaaaaagcaagucggcaacuacugaacgacaaagcaaaauuagcugacagauaagucaccacucaguccuuguacugaccuggcacuggggaaacuuguaaagggauaaggagagccucagaacagcggaugagucuauuugccuuaucaucuaccgaaacagacacaggccuggcagagcaaagauggcacagaaaaucgaacauaauguaaagaacacacagucauugagaguacugccagacucugggucagauuccuggugcaauuguucaaggccaauucaaccaucauuaaugaucaugaggcugauggggguggcaggaaaacaggauguuaacuuaaaguucuguguguccagggaagcugauagacaugggguugccuaaccagaucagggaagaguguggucacagcacacacccugccucagcucauuacucaauacuugucaaacaugauuaacaguccugacuaauuacaugggaagagcaucucuggcuguaaugggucccaaaggucugcaacauugacuucauuuacauguuucuucuuuuacaaagucucaggcaaacacugccaaaaucuacuaaguauuuuaugaacucugagaugaucaacucagagcuucaaauacaccaguaucuucauacccagggcagggagugauggggcucuaacugcagugaauauucugaggcugcuaccuguaugucuuaaaucaauuaucagccuuuguaguuuuggauaaaagauggggaaauauauuuagacaacaaguagucuaacccuuguucuuucucuccuuaaauaaagcaaaauggucaaaauggaaaaucuaaaagucuuuagaaaaauuucauaaauguuaguuugaaauaccaaauaugaauacauuuuaaauauguaauuuuuaaauaagcaguaauauauuaauauaauuaaguucuuuaaaguacuugcucaguauauuauuaguuuaaaugauauguaagcuauuucuacguauuccacauguguaucauauacacauacuugacaacaacgugaaacagcacaguaaugguguacaguucuuguuuauuuaaaugauuuucaaucuaaauauuaaugaacucuuuccuaaaguaauucacugaaagucaucuaauucgcccccucuauuuuuugugacuggcuaacuuacauguguaaguaacaucauguguaaucauccuuggcagacacauacaauucuuaauaauugcaucauaacaauccugguauacauacagcagcuuauucaacuuguccccaguacacaaaauuaauuuuauuucaacuauagagcugcaguauguguguguguuguguagauuuacauauauaugaauagauguauguauaaaauagauuuggagcccuuuguaaaaugcuauguguaaucucaacaucuacugaaacagccaaauugcucagcaauaaauaugagucccaacauguuugcacauucugagaagcaguggaugcuauuauguauuuuuaaguggagcuucucucagaggugagaaaaucuaacugauuuuacucagccauucucugagauggagucuucuucuuuccuggaucuuuacaauuuucuuuuuccgagagccacucauucauaaccggugcccaacuuccaggggguugauuuuaaaagccuuccuuuauggaagcucuucuuuucuaagggguuaacuauugguuuucuguguaggauuuacacaaugauuucucugacuuacuguggaaguagacagcacuucaagccauucuugaggccagccugccuuacacacaccugaagguccauguccccacaaacacuuuacauuaccacagcuaccacucugacagcuaccgcucccgucugucccccaacccuccuguuaucacagcuaccuccauaaagaacuaaaauuucuccugacccuuuccuuuuuuuucaaagcgggaauaaagcuuggacugaagcccauuuugaugagauggcuagaaaaacugcuuuucuucauuggcguuuugaaaauauugcucggguguuuugggacccauuuguuucuacugccuccaucuaucuuugcuuuauggcuuuuggcggcggcugcguuuuaaguccgugugugguucugcucaacuccgacucuguagcugccagucugggucugguuucacugacuuacuauaccuaaccucauuccuccucuggauucugaacccuaucugaaaaauacacuuccagcucugagaugcguucauuuaucgauugaacauaguuuaguucaauaaacauuuuagccuaagugaguucauuuccaguagcacagauguuuucaaaucaguucagaugguaagacucgggaauuuuuaugguuuuuccaacuacaguuagguauugaaacagauauauuuguauugggaaaaaucacaaugcuaauaaauauaauuauaacauaaauuauugcuuuauuugugguauaguaggaauucuauuuaaacuauggauauuauauuuacuauauagagcaugauaauaguaaaauuuaagauaccaggucuaaaaauaaaguuuugaaagauacuuucuuuaauuuuuucuaauuaauaccaauuugcaguauuuggcuaguuuggaaguuggcaucaaauacuaaagaaaauuauaagggugauucaagacaagggacauucugguauauucucccugguaaauuaauaaauacaauugauagucucagugggugucagcauugccaaguggggcuagaguuaagguucagagcgugaggagugcuugcuugucuuguaaagggccuggguccauuuuccagagcccacauuacagcucacaaccaccccuaaguccagcuucaaggaaucugauguucucuucugaccuccaugaguaccagguaugcccauggugcauauucauacaugcaggcaaaacauguagacaaauacaauuaacaugaauuaaucuuuuuauaaaaugucaacauaaagagacuggcuuagaagcuguugccauauucucucauauaaaacuaccuaagggccuauagcaaggugggggauggguggcaauaggcuauggagcauucucugagaggcauuuuagagggaaaacuaacagaauuugcuagagaaaagagcacuaaggcuuaacuuggcaucuuaaauuuuucugaccaguuaucagugcuacacauuaaaaucucaaccugguuauucauacacauguguggcagaccuucugcugugacuuuccaaauaugacuccaguuuucaaaugauucuuguuauuuauaugucucaaacucuaaauauugacaucuuggcaauauucugaagauguaugugcaaaagugauauguuauauauggagaaaauagccaagaaguugcuuaacucucagagaaucuacagcaguaugacaugggauugguaggaaugucuccauggccccaacccaaagcuuagacauguguccaguuuagaucuggucugggguuuucaaagcucuucuccugguuuaucauaucugacauaucuaaaaagagucaaagcuggacuguuacguauuacauguuacuuuugguuuugaugcuuuuguuguuggacaauaaauugugauuugcauuaacuaagggaaacuuuuuuuuuuuagguauuuauuucauuuacauuuccaaugcuaucccaaaagucacccacccacucccccacccacccagucccacuucuuggccuggcuuuccccuguacugagacauauaaaguuugcacgaccaaugggccucucuuuccacugauggccaacuaagccaucuucugauacacaugcagcuacagacacgagcuccaggggguacugguuaguuuauauuguuguuccaccuauaggguuacagaucccuuuagcuccuugguuacuuacucuagcuccuccauugggggcucuguaauuuauccaaaagcugacugugagcauucacuucuguuugcuaggccccagcauagucucacaagagacagcuauaucuggguccuuucagcaaaaucuugcuaguguaugcaauggagucagcguuuggaagcugauuauuggauggauccccggauauggcagucucuagaugguccauccuuucaucucagcucgaaacugugucucuguaacuccuuccauggguguuuuguucccaauucuaagaaggggcacaguguccacauuuuggucuuuauucuucuagaguuucaugcauuuagcaaauuguaucuuauaucuuggguauccuaaauuuugggcuaauauccacuuaucagugaguacauauugugugaguucuuuugugguuggguuaccucacucaggaugaugccauccauuugccuaggaauuucauaaauucauucauuuuaauagcugaguaguacuccguuguguaaauguacuacauuuucugaauccauuccucuguagaggggcaucuggguucuuuccagcuucuggcuauuauaaauaaggcugcuaugaacauaguggagcauguguccuucuuaccgguugcaacaucuucugcauauaugcccaggagagguauugcgggauccuccagaaguacuauguccaauuuucugaggagccgccagacugauuuccagagugguuguacaagcuugcaauccgaccaacaauggagaaguguuccucuuucuccacauccaugccagcaucugcugucaccugaauuuuugaucuuagccauuuugacuggugugagguggaaucucaggguuguuuugauuugcauuucccugaugauuaaggauguugaacauuuauuuucaggugcuucucagccauucaguauuccucaggugagaauucuuuguuuagcucugcaccccauuuuuaaugggguuauuugauuuuuuggaguccaccuucuugaguucuuuauauacauuggauauuaguccccuauuugauuuaggauagguaaaaauccuuucccaaucuuuugguggccuuacaggcugagaaagaauuuagggaaacaacacccuucucaauagucacaaauaacauaaaacaccuuggcgugacucuaacuaaggaagugaaagaucuauacgauaagaacuucaagucucugaagaaagaaauuaaagaagaucucagaagauggaaagaucucccaugcucauuggcaggaucaauauaguaaaaauggcuaucuugccaaaagcaaucuacagauucaaugcaauccccaucaaaauuccaacucaauucuucaaugaauuagaaagggcaauuugcaaauuaaucuggaauaacaaaaaaccuaggauagcaaaaacucugcucaaggauaaaagaaucucugguggaaucaccaugccugaccuaaagcuguacuacagagcaauugugaucaaaacugcaugguauagcaacagacaaguagaccaauggaauagaauugaagacccagaaaugaacccacacaccuauggucacuugaucuuugacaagggagcaaaaaccauccaguggauaaaagacagcauuuucaacaaauggugcuggcacaacuggcaguuaccauguagaagaaugcaaauugauccauuccucucuccuuguccuaaggucaaaucuaaguggauuaagaaacuccacauaaaaccagagacacugaaacuuauagaggagaaaguaaggaaaagccucaaagauauggguacaggggaaaaauuccugaauagaacagcaauggcuugugcuguaagaucgagauucgacaaaugggaccucauaaaauugcaaagcuucugcaaggcaaaagacacugucaauaagggcaacuuuuaaaacacaguuugaguuaacuaagauugaaacuggcaugucucccucaugaaguauggagcauagcaauggcuuucauuucucagcugagugaaagguuaagacugacagacaucaugccucucauaccucuaaucuuuuccacaaauaucucaguugaucaucucauaauaaaaauaaaucacacacucaaauagugccuacuuccuauaaaccuaugagggcaguuuuuauucaaaucaucacaaaacuauaaucugcccuccuggggagugucuaguaaugaggguuauuucuuugaauauaauguaucugcaugaucaaaucaaaacuaaugguccacaagccauugaguuuucaucauuaaucaacuuucauaaacauaacaaaucaaguuaguuuaaucuuaacguucuuuuuauuccucacuucauagugauuaucuuuguaagagacacgagaaaguuuccaaguacugauggcuaacuuucagucuuugucaacuugacacaaaccuauauaacccuagaaagagggaaucucaaaugaagaauggaggggcuagcccauuuuuagcagugcuaacccuaggaaauuguuucuggguugccuaagaaagguagcuaagcaagccagggagaguaagccaguaagcagcauucuuccaugagcucugcuuuaguucuugcccucagguuccuuucuuaaguaccucucuuggaaucuuggcuuccuuccaugaugaacuauaccuuugaaagccgaauaaacccauuucuuccccggguagguuuuaucacaacagaaaacagaugagaaaggcaaccuuagaugaacuuacaguuacuugcaaggcuuucauaggcaagcaguuguguugggcuguucacuguuagguuguaauagaugcuggaugcuagaauucuaaaugaaaacagacucacucagguuccuagucuuggcauugagaaaauucaggagaagaguacuaacauguuuaguuuccagugagaacugucugcuaucuuaaauaaugauggauaugucagagauggcauacguaugggaacaugcuaaagaugccacacauacgggacaugucaaagaugggauggcacauauaugagacuauaugaucuuggagaaauuuaacuccuucuagaaggacccagucauuuccuaaaauacauuauauuacuaaaugaccuaccacuucuuauuaacaucauacugugguucagauuucaacuugagucucaggaaagacaaauuaagacaugauggaaagacaaauuaggucaggugaauacuggacugucuauguuccccauguguucaaauaugcaguugugagcuguaguuggcucucauagaggaaugaugacuuuacugccuucaugaggaagugggaggaaagggggugacaaugaugaaacaaugcccaggcccuugccaagaucuugcucucgggaagucaguacuaucuaugcaagcucauggcacucucucaucuuggaacuucaucuuucaagauuaaaauauaacucaagaggcaaacaccucuuuuuucccccuuaagaacuuuaggaaguaucuccaucuacuguuuuaauuaagugaaauauauuuuagaaagugagaaauuuucagggaggucauagauuuaucaucauguuaaaagucauaaaaauuacaguuacaggcuaaguugaacgaaaauuacauaccaccccauuaauuauauaaucaauagauauaaaagaaaugaggaggcaaaugguggaauuguagcuuaaaucaagucaauacauauuuauuggcaucauuccacauaaaaugcugugaagaugguaaggcauggcugacugaugcugugucuccaaagggcuuacugccuggcuuugggacugauaugcagcaugcagaaaugcauguacccagcacaaaaagcacaagggcauaccauagcauugugcaaauaaauauccagaagcacuucgaggaaaagagguggugaccaugcucuuaagaagcucagggccucugaggucacacuuccuuuuuaaauuucaacucuagaguuuaaauuacugacuguagaugaguucucgguucucauuuuggauaagguagguucugauucacacagggauuuuaagaauuaaaugacuuaauguuugcuaacuacuuaauaggaugucucugcacacaggaagugccaaaugaauguuaagcgaauagauuacaauuggaaggcuagaaaaguguccuguguguggcuuggaaguuccugagaguuuuagugacauauuaaaauugagaaaaagcauaguuacuuuccucuuucugcaguuccauuccccaucacuccaaagugauagcuuucaagucauaagaauuagaaacaagagcuuaaggugauggugggauacuuagaaucccaggacgugggagguggaagcagaaaagucaggaguucaaggcaagucucagcuacauaaugaguuagaagccugcccaaaaauauaagacuaugucucuaagaaagggaaauaaauaaauauucaaaagcauaaacguuccucgccuugguuaaccuaaugugauaauuuuaucuuaccagucauaauggagggacacugcugcuucuugaugaggucccauucauuguuugcauagucuuucauuccuucagaaggaucaacuccagucccucaccagccaccuccaguucugcaguaaguacugaagagacccuuacacuuccauucaccauccaguuuucacuaguuggcacuuggcuaaaccacugaccacaauucacuauuugaugguaaguuuuuuccuuuuauaggcuccaucauucucauuaaaauggugacuucuggaaguaagagauuuucuguuuugcacacuuaucuuuugauauuacuuaguauuuccaaggugaacaugcacuguuagacuccaguugucacuaguggguagguuggugaggcagccucaggcuuucuguuccagaugcuuagaagcaguguaauucccucccuacugugcggagagaucuuugaugugauguaauucaguccugugauuauuauuguuuauugcaacaggaaaggaaguuuagaaacauaauuaagauauaccauacuuagcuuuguauuagcucaaagacacuuuaagaucaaugagucuaacuaaucaagggagccccuucaaacaaacuagguaggauuuucucccuaaaggaaaaauuucaaaguggaaaaaaaaaaagaagagaagagaagagaagaggagaggagaggagaggagaggagaggagaggagaggagaggagaggagaggagagaagagaagagaagagaagagaagagaagagaagagaagagaagagaagagaagagaagagaagagaagagaagagaagagaagaagagauguucuaucugaccauuuauaaagccagcucccaauauugucacuucagggaaugccauguggcaaggagcuuggaguggacacaagcuuacaaccagcaagaaaacaaacccuucacuccaacaaccacacauaugugcagaaaaggaagcccuuuggcaguaacuccuccuccacaaaaacauuccaggggaauacaaaacuggcuaccacuuuuacuagagcccucagacagcaauaucauagagacccguuagcaacacugccugcuuaaaguguccacccucugccaaacaacaaucaucacugauaaagaaauugaggagauuaaaauggaaaccugggaggacacagaaacaaagaaagcaaagcaaggagaaggucaggcacgcuucaucuuagcuacaaucaaaaugaaggaaaagugucccguaggcugaagguaguuuuaaugagcaauuccucuugagauccaugugcugccccugagaucagcucugcuucucggguaguuacauuccccaggggagcaccacucaucucauucugugucucccaaagaacuauccaauaugaacuugaaucuguuguaacaaagggaaaaauaaaauaauuggacaugcuugacaaccugcauugagcccacuugccucaaagcuguaaauaguugaaaaucuaauauuuaccuaaugcagaugagcacuugucuacgggacagcuucaaagcagccacuaaacagaugacagcacugagaccuacuuuauuaaaaaucaaauagaagggaucaaaauuccuauaaauaugcucacuuaagugaguuaaaaggucuucuguguauuuuuccaaucaucauugccaaggaagucagaaaaauccuacauauguucuggaagguugguaggggggagcaucuuuuaaaaacuguguuguagaaaagagagcaugcuggguauauagaugaagcacaaagaaauauguguauugacuaggaagauggcuggggguaaaagaucuucuaagcaaccaugaggaacugagcuccaauccccagagucuacauaaaagccagaugcauccugugagugucuuguaccccucugggagaggcaaugaagguggaaaaucccaccuuggacgagguagcauggaguaugcacaaaaaagcaacccugucuuaaagaaaguccaccaccuuagguugucuucugacuuguaucauauguuucuauauucagagagagaaugugagagacagagagacagacauauagagguaaagaaagacagacauauagauacauacacacacauggggcagcaaaaagaagauaggcacaguuucaugcccaagcaaaaacaauggcagacucaagaaaagacuagauacaaaaggagcgaagacaccagguugucucacuggggccccagcagaacuaccacugauuauuguccuaaguaggccuugcccuaaagaaucucaccucucauacucaaggcucuggccagggaaacacagagaaguguaaaagauguaaagucaaguagagugaagcaaguuaccaacuagcauaaacggugugauuugcacacauuuguugguauugucuccacagcaacugcugaggaaaauacucuuacagcccuuuuauagcagaagagcaggugccaaggacagaggugggcagggaauuguucaguggggcuguggcagcggacuuggacaugccuaugacuuuggaaccugccauguagccugaaugcaacuucaggagagagcaucaugcccacuccuagcugaugccucaaguugucuccacccaccugucugggaaguccugauggcuuugagaauaauauguuccaaguaaccauaaaaccaacaaacugcacagcacaggggaaaaugugagcaacagucacuggucuuuucuggagauucagaauagaaaaaaccccacugcuguuccucagagcuacacgggacacugagaucaccaugugucaacaacucaaagagcucccaguugcaggagucuccagaaaugaucuuuuuuuuuuuuuuuuuuuuuuuuaccucccacccaucagcacccuuacugcagcuaaaaauguagccauuuucugaucaaacauuacuugucuuauuucucagaaagaaagagcuacagagguuuaagauagaaaccuauuucugacuucugcuucugcaguucuacacauaguacacaucauauuuaaugcaucucacuccuaaguaaacuagaucuuacauagccucucuucguuuacuaugcauuggggagaacugcgcucuauauccacugugaacuaucuucuuccacuguaguucgguuuuauauuauuuuacaaacaacauuagcuaaaacauauuauauuuuauuauuauuauuauauuauguuuuauucucuucacccauugucucuugagcaacauaaguucuccucuguauuucggcaaagucucaucuggcauuuguuucugcuuucugcacuuaucucugucaaggacagauaauagucaugcugugauggugccaagcuuuuacugagcauugugggauuauaucuauaaaaggguuuugaugcacuugaccaaucuaagagcucuuuguaucacuuccacaaauuuucaaccccucgcaugaagccaguaguucagagggcuaucagcuucagagcugcaauaguuuccaaugacucuaaaauagaggcucucuccuuuaugaaaacccuggcuuucacaacuuguuuugcuauaauaccaugauuaagaaauaacaucaucaacauuauacuaccgcucagaccaacacucuuguauuauaacauucacuuaugguauuggccagaugauuuaauauuuaaaugcuuuuguuguugcuuuugcuacugcuauuguuguaucuuuuuuggcauuuugagacaggauuucacacacuccacacauugacuucgcucuguagucaaauauggcuuugaacaucugacccuccucccucgaccccccaagugcugguauuauagcaaugugcuaauaggccuagcuuucuugguaccguggacugauccuagaacauuuugaagacuggccaaaugauugaccaccugagcuccaacaccagcaaagggaauagcacuuguagccggaauaaaauuauugucugacugaaugacuggccugcccuuggaauucaccaucaacaucauuaccaauuacacucuucuauguuucuugauauauuuuuaaagauguguuuucauacugcucucauuuauaaguuagguuaagauaguccaaagcacuugcugaaagaaaugucaaacaauucauugacugaucuauuauuuucgguuguauuuuacugaguuauaaacauuuaacacaagaucuaugcucuuaaaauuuuaagugcacaacacaguauugucaaguguggauaaaaugcuaugcagcugcucucugacacauucaucugcaugucuggcauggcacucccgcugcacaucagcucccuguccuacccuaccuacaggcuccugagaacuaugcuuucauugcucccacaauaccaccaucuuucaugacuaagucuuucucuguuaagguugaaaaagucucuauugcaugucuacacuauaccaucuucacuaaauuaucccuggguauauucacuacauugaacacaacugcagcagacagaguaaugccaauaucuauuugagagccugguuucaauucuuaaaguaaauucucaggaauggggucucugggucacauaguaauucuacuuucagguucugaggaagcuccagacuguuuuccagaguggcaguacugcauuccugccaguacuacacacccuugccagucaccaugacucuucaccaguaccugcucucuuccuuuaaaaaagaaaaaaaacugagauuauaucacuauauuucuccccucccuuuccucugaccaaacucuccuguaugcugcuccccacuccucaucaaauccacagccuuuccuuucauugauuguuauugcaucuaucuaucuaucuaucuaucuaucuaucuaucuaucuaucuaucuacauauauacacauacauauauacacauauacauauauacacauauauauauacauacauacauauauguguguguguauacaugugcguguguauguauauguauguguacuacuaaucaaagccuacuccaucucuauaaucuuauuuuguaugcaugcuuucaggauuuacuguuuggaacuggacaaugaauuggcguguucuucccugaacaagacuaaagccccacucccagcuuuccuuaguugcauauagauguuugcauagaguugaggcuucacgagcuuuccccauuaacuuugacauguccauuggugucauuauuguucagcucauaguuggauagucuugauggucagacuuuaugggaauugccucugauauuguuaggagauaccauuucagaacaaaccccaugaccaucuggcuuuuauaaucuuugcauuauauauaauucccucuuccacaauguucccugagacuuggaugagggaauauuuuguagaugaaccauugugaccaaguguguauguaugcauacauacaugcaugcauguuauagacuaagugucuauguaugcauacuuacaggcaugcauguuaugggacuaagagugaauauauacauacucacucacaggcacggguauuauggacuaauuguguauaugugcauacucacccauagucauggguauuguuggacuaaguguguauguaggcauacucacaggcaugaauguuauggacucugugugucuauguguguguguguguguguguguguguaugugugugcaugcaugcucuauaugccacugauuuuucauuugcaguuucucaaagaucuuuuaauuucauauaacuguuagccauuuauauucuuuuaaaaguuuggcuauuggcauuaaucauuuaaaaauuauuuggggucaguguucagacuuugcccugcuuacauauucugauaguguuuguguaauaagccaucauuagauauguaguuuagaaauguguucuccuucuuuguuguuucuaguguauugacagucuccuuggaugugcagaaauaugcuaguuugguauaguuucauugaucuacuguugcuuuuaucucuugugucauaucuaagaaauaauugccugagucagugucaugaauacuuucccauaugguuuguucuagaggguuuauauauucuagccugacaucccaguccauugugagagauuucucauguguuauauaagcaaggacauuagacacccccacccccaaaucauccccaaccaguuacuauaacagcaucugauggcaauugucuaucuuauauguacuccccaaacuaccucaacauuugcauuuccuucugggaaucugucacuguuguuucccucaguccaccucucagcaaaugucuucuuccaaaucuauauugacaccaauauuucaaagugauucucuaugguuuauacuuauuuugaaaacaaaaacaacaaacaaacaaacaaacaaauaaacaaacaaaaauaaugggugaguuaaauacacagcacagcaggacucgaaagcauccaggauugggugacucuccuuucacugugucucccuccuucuucaucuugguggcucuuggaaaaauucagagauucccccccauuacucacaugaggggagaguaggcacacuuuaaagagucuccccacagacagcgagaaugauguugcugccucccgguugcuuaagacauugccucaucugcauuaccuugucucuacuucagcuuuuaauaacaaauucaaacugucauuucucuaaugccaugacagacuuacacuagcacuacucugggcaaaugcuuccuucccaaagagcuacuagaaagaauaauuucccuucaauuuccuccuguauuuuaccuguuaauuauuuucaaacauuuugcaguacauugccugguccuauuagacagaaauucuugcuuuaguucugaaccauuccuacccacccucugguaaucacauuuacacuuuaaauugucaguuuugaaauggcacuuuacuaacuguaguagucauaguuaaaccaagggaaggagguaucauuugcacaguuuuucucaucucaaacauguaucagagcuguuuguucuuuuucaacuuuaauucaguuuauauugccuccaaacaaacaaaucugagauuaaaauacaaaauauccuuugcuuuagggucuuugaaaugaagcagguauuuuauaccaugcauguuggaacuguacugacugggcagaaucaauggcaaagaagaaaaacacuaauccaucaaaggaccacagccuaucaaucaguuagcagcaaaaugacugaguugcccaucagcaagccaucacacacacacacacacacacacacacacacacuucccugugugaugucugcaccacacacagugcuacugaaacacaggcuaccccaucugagccuucauucaaaugccuauggaaaggaacugcaaaaccauaaacuuccagcccuuuaagaaccuucaugauggauaaaauaugcaaauacagucaccagcauucccagggaguuuaccuuguaaaugacugaguguuauuggaguugacuuuuaaaugaaaaauuuagauaagauagcaaagccguuuuucacgacccuccugauaugguccuggaguugauauaguagugagaaauuauauacuucaugaugcaauaaaaauguguguggguuuuuuuuuuccaccaacuugguuuaugaggauuaguguacaugccugcugaaauauugagcaaaaugucaucuacauaggugaggaaagcaggguuguagaguuccaggaauuauguaagccuagacauccuucugggaccuuuucaaaguggaguucaauccuauacugaacuccuuuuauucaaggcuuucucaauagcauaugcuggaggccugcuauggauaugcuagauguuaucuuaggcucuuaggaaauugaaguggugaaaagaaagccagaaaacugcauucaugcagcugauauugcaaucaacacuuuauucauuuguguagaucgaaguccaaagauauguauuuucguuucugaaggauuugacacugaaauuaauucaguucagauuuuuuucauuuuccagcagaaugaaaaauccucuucagaaaacguuugucugauacaggagacaaguguuaucggucugagagacuuugaacuacauaucuacuuccuagaauuuucccagacuacaggaaguuauucuaaaauaagaggcugacucuaacugguaacuccuauuuuuuauuucccacuuuuacuuuugcuggauucuaucuguguucugagcuugcagacaaggucugcugagcucuuggaaucaucacagcucuauugaaauugggcaaaguaacaacuaaagugagaucauauaccuuaagaaccgaucacugauggucucgaucaauagccggcgucaauaaaccucaggucuauggagacccuugcuggagccagguaaguguuuuuacagagauagcaauguuggguaggcagagaaagggggcaaauuugcuagagaaagcaaaugauuacagaacaaacacaaaucauaaauaagcacucuauaacacuacagaaugcuguauguucuuaggaagccuuccugacagccauuuagaaacuggaaagugcugauuguucauucauccaaaauguacugaaucuuugucaacgguccacagcauugacugucucagccaccaugcucaggauggcacaagccaucucaucuaaucaaugagcagacuugcaggucagauacuuccuucauccucauuaugaguagacaagagaucugaauaguucaacugaauuaagaaauuccaaaagucaauuggucuuccaugacaggacuacaaguuaagaggaaaacaugaaauuggaauggcucauaacacacaagggugaagcuacauuccacauucaacucugaaucaaucacagccucagcuguaguaguaguuagcacuguagaauucuuaaauaacuguaagaauggcaagggcugcaguuagaucagcucccagcagcuuucccacuuaaugaaguagauccugucacccuagacuacagguguacaauuguaggucagagugcaaggacuuaaacccagacuugcacauauuugaaaugcuauacuuuccagccaauuuuuccaacuuacuaaacuuuuugaaaaggaagagaaggaccuuaguaugggcccuucucugacccauagcagccugaaauuguaucuacauuuucucucucucucucucucucucucucucucucucucucucucucucucacacacacacacacacacacacacacacacacacccuccagggaaugcuuugagacuuugaucuuaucaagcugauucugucgaugauuguucugaauaaaucagggacacuaucacucauucugcuucuuuccaggauccaaauguucauaaugacccaaagaccaaagccauguggccaggaggaagucacaggauaggaagucugauacgggcugugcaugcuguauucuuuagccucccuguccccucuuauuucccaugucucaguuagucaugcucaacccugcuuuauauucacagcuccagagccguuugcuuacucauaguuaccagccuacaacuucugcacuggggguggggagggggaggacugacacaaaauuuagacugcugucaauuagccaagcaaagacuuuuguaguaaauaagaucucagagucugugacagaugcugaaaaaaaaaaaaagugugcugcccuugcuuagcuucuccucccacgaaaaguccaguauucagagccaucugccuguuuccagagccagauguuaccucagacaagaggaaauauccuauugcccaucucuacuuggaagaggacagagauauagauacagauauagauaucaaugauauagacauagauauaaaugcagaaacagauauaaaugauuuagaugacauagauauagauaucuccuccacaaaaaaauuaguuaugucaaauuaagcaaauggcaaauaauauuguuuuagacaauaaaacuaaaggccacauacauuguuaacuauguaccaaguccuaggcuggaacauaaccuacauuauaugccaacuaucucaagaauccuacaagcagucuuauugcuauuucuugcaaagaagcucaaugcauagucacaggaauaucuguucauuuauaucaaauucuaagcccaaacuaugcugcccaaagauucucuaauggaacccaacauacacgauauuuauacacuugaaguaauuuuucucauuacuuugcaacuauauuuuaaaacuuaauacagaagauaaaucucuaaaauguaugguucaaaaguauugucaccaaagcaggcucucacauacagaaugcucuuauggccuaccuccugcaauugcacagcaugggaucuuagaccaaauguaguaucacagggcaaaagcagcagaaagaaccaauauuuguucucuccauuccaaaaugauucugaaauuauaagcaaauccagccagaguaguuucauaacuggcuuguuaaaugaacacagaguauuuaaagaacuggagucuuagaaauuacuuaaaaggcucauaccugcugaacaauacauauaaacuuucucccaagaauuuugagguagaagagggaacuucuacucauugaacaauaaaguagcucauugaagaacucuuuuuaaauaggcuggagaaaaacaauagacucauuagaacaauuuaucauuucaaacuuccuuuuaacuguuucuuuuguauuuguuuaccuuacagaauagaagaaaggggggagggaagcaucuuaccuacccaaaacacaauacauggcacacuuuaagauagucacauacaaucugauuaaaccuggaauuuuuuuuuaucuuaggaaagccuuuguuauauauaaauauuaagcugagaaguucuugaguuugauaagaaucuagagauaaugaauuguuuuucuugagaacuucauuuuaugaugcacgaagugaugucuuuacaaaguuuggcuuuucaucuaccuuuccaucauccuaaugaaagccaauuuauuuuucucuagucguucuuaacauuccuaauucuaugaugcuuuuauacaguuccucauggugaccucuaaccauaaaauuguuuuuguuaugaaaauuguaauuuugcuacuauuaugaaucauuauauaaauaucugauaugccagauggucuacagugaccccuauaaaaugggccaucaacucccauauuaacaaugacugcucuacacuuaccuaucaucgugggucauucagccucacagucacugucaaccggaugggagucccucuuuuucaaggagaaauauucuuagcaauugcuuccuagcacagcugagucccugauaucacuuuccuaauuaggacacagacguucacagaguaucaaaaucucuggcuggaaggaagauaagguagguguacaggaucccguaaucacaggaccacagagacagcugaacuaugaggaauucugacacaaccaagauuacaggaagggcaggcuccagucacauagcaaggguagguagcacuagagauauucagauggcaggaggcaagcauaagaacauauacaacagaaaccaaguuuaaugggcauaaucagaacccaauucuccccccauaccaaguucuggauacaccaucacacaggaaagcaagacucagaucuaaaaucacuucucaugacaaugauaaaagacuuuaagaaggauggaaauaacucccuuaaagaaauacaggagaacacagguaaacagcuagaagcccuuaaagagggaauacaaaaaucccuuaaagaauuacagcaaaacacaaucaaacaacugaaggaaaugagcaaaaccauccaagauccaaaaauggaaauagaaacaauaaagaaaucacaaagggggacaacacugaggguagaaaaucuaguaaagauaucaggacucuuagaugcaagcaucaccaacagaauacaagaaauagaauggagaaacuaggaaucagaagauaccauaggauacaaugacacaauagucagagagaaugcaaaaugcaaaaagauucuaaacaaaacauccaggaaauccaggauaaaaugagaagauaaaaccuaaggauaaaacauauagaagagaacaaagauucccaacuuaaagggccaguaaauaucuucaacaaaauuauagaagaaaauuuuccuaaccaaagaaagggauacccaugaacauacaagaagccuacagaacuccaaauagacuggaccagaaaagaaauuccucccaucacauaauaaucaaaacaccaaaugcauuaaacaaagaaagaauauuaaaagcaguaagagaaaaaggucaaguaacauauaaaggcagaacuaucaaaauuacaccagacuacuuaccagagacuaugaaagcuagaagauccugggcagaugucauauagacccuaaaagaacauaaaugacagcccagaauacuauaccaagcaaaacucucaauuaccauagagcaaccaagauauuccauaacaaaaccaaauuuacacaguaucuuucuacuacaaaggauaauagauggaaaacaccaacacaggaagaaacuaguagaaaaagcaagaaaguaaucuuucaacaaaccuauaagaagaaagacacauaaacauaagugcaauccuaaaaacaaaaagaacaggaaguaacaaucacuuuucuuuaauuccacuuaacaucaauggacucaauuccccaauaaaaagacauagauuaacagacuggauacauaaacaagacccaauauuuugcugcauacaggaaacacaccucagugacaaagacugacacuaccucugaguaaaaggcaggaaaaaaacuuugcaaggcaaugauaccaagaaacaagcuggaguagccaucguaauaucaaaauugauauucaaccaaaaguuaucaaaaagauaaggaaggacacuucauacuggucaaaggaaaaaaucuaccaagaugaaaucucaauucugaauaucuaugcuccaaaugcaagggaacccauauucauaaaagaaacuuuaccaaagcucaaagcacacaucacacuccacacaguaauagugggagacuucaaaaccccacucucagcaauggaaagagcauggaaagaaaaacuaaacagagacacauugaaacuaacagaaguuaugaaccaaauggaucauauaacccauuaaacaguuauuuguaaaacauuucauucuaaaccaaaagaauauaccuucuucucagcaccucaugguaccuucucuaaaacugaccauagaauugguaacaaaacaggccucaacagauacaagaagauugaaauaaucacaugcacccuaucagaucaccauggacuaaggauggucuuaaauuccaacaaaaacaacgaaggacacacauacacauggaaacugaacaaugccauacucaauaacuuagucaaggaagaaauaaagaaagaaauuaaagacuuuuuagaauuuaaugaaaauaaagguacaacauaccaaaaccuaugagacacaaugacaacagugguaagaggaaaacuccaaaacaaauuggagauaccuuacaauagcagcuuaacugcacaccugaaagcucuagaacaaaaagaagcaaauacacccaagaggaguagauggcaggaaauaaucaaacucagggcugaaaucaacaaaauagaaauaaaaaagaacuaugcaaagagucaacaaaaugaggagcugguucuuugagaaaaucaacaagauagauaaacucuuagcuagacuaaccagaggggacagacacaguauuggaaaguaauaaaaucagaaaugaauaacauaacaauggaaaccauggaaaucgaaaaaaaucaucagauccuacuacaaaagguuauauuaaacuaaauuggaaaaucuggaugaaauggauaauuaucuacacacauaccaggugucaaaguuaaaacaggauuagauauaccaucuaaacagucccauaacccugaaacaaauagaagcagucauaaauagucucccaaccauuaaaagcccaggaccuggguuuaguggagaauucuaucagacuuuuaaagaagauauaaugcuaauacucuucaaacuauuccacaaaauagaaacagaaagaacacuagccaauuuguucuaugaagccacaauuauguugauacauaaaccacacaaccaacaaagaaagagaacuucaaacuaaucucucuuaugaacauugaugcaaaaauacucaauaaaauucuagccaaucaaaucuaagaauacaucaaaacaaucagucaccaugaucaaguaggcuucaucccaaggaugcagggaugguucaguauacagaaauccaucaacgaaauccaccacauaaacaaacucaaagaaaaaaaaacauauggccauuucauuagaugcuaaaaaagcauuugacaaaauucagcaucccuuaauguuaaaagucuuagaaagaucaggaauacaaggcccacaccuaaacauaguaaaagcaauauacagcaaagcaauagcuaacaucaaacuaaauagagagaaaauugaugcaaucccacuaaaaucagggacuagacaaggcugcccacucucucccuaucuacucaauauaguacucaauguucuagcuagggcaauuagacaacaaaaggagaucauagggauacauauuggaaaggaagaagucaaaauaccacuaugugcagaugauaugauuguauacuuaagugaaaccaaaaauuccacuagagaacuccuaaagcugauuaacaacuucagcaaaguggcuggauagaauuaacucaaacaaaucaguagccuuccucuacucaaaggauaaacaggcugagaaauaauuaggaaaacaacacccuucacaauagucacaaauaauauuacacaccuuggaaugacucuaaccaagcaagugaagaucuguaugacuagaacuucaagucucugaagaaagaaaccaaagaacaccucauaagauggaaaaaucucccaugcucauggauuugcaggauuaauauaguaaaaauuggcccucuuguugaaagcaaucuauagauucaaugcaauccccauaaaaauccaaaucaauucuucauagaguuagaaagagcauuuugcaaauucauuuggaauaacaaaaaacccaggauagcuaaaacuauucucaauaauaaaauaacuucugguggaaucacuaucccugaccucaacuuguauuacugagcaauugugauaaaaacuguaugguauugguacagagacaggcaggaagaucaaaggaauagaguugaagacucagaaaugaacucacaaacauauggucucuugaucuuugacaaaggagcuaaaaccauccaauggaaaaaaagacagcacuuucaacaaagagugcuaguucaacuggggguuagcauguagaagaaugcaaauugacccauuauuaucuccuuguacaaagcucaagucuaaauggaucuaggaccuccacauaaaaccagauacacugaaacuaauagaaaagaauguggggaagagccucgagcaaaagggcacagggaaaaauuuccugaacagaacaccaauggcuuaugcucuaagaucaaggauugacaaauaggaccucauaaaauugcaaaguuucuauaaggcaaaagacacugucaguaggacaaaacagcaaccaacagauugggaaaagaucuuuaccaauucaucugauagagggcuaauauucaauauaaaaaaaaaacucaagaaguuagaauccaaaaaauaaaauaacccauuaaaaaugggguacagagcuaaacaaagaauuuucaacugaggaauaucaaauggccaagaagcaccuaaagaaauguucaacauccuuagucaccaggaacaugcaaaucaaaacaaucccgagauuccaccucacagcugugggaauggcuaaaaucaaaaacucagguaacaguagaugcuggugaggauguggagaaagagaaacauucuuccauugcuggugggauuacaagcugguacaaccacucuggaaaucaguuugguugucccucaggaaauuggauguuguacuaccugacaacccagcuauaccacuccuaggcauauacucagaagaugcuccaacauguaauaaggacauuuacaccacuacguucauagcagccuuauuuguaauagccaggagauagagaaaaccuagauauucuucaacagagaaauggauacagaaaaugugguacauuuacacaauggaguacuaaucagcuauuaaaaaugauggauuaauaaaauuauuaggcaaauggauagaacuagaaaauaucauccugagugagguaacccagucucaaagaacacacaugguaugcacucacugacaaguggauauuagcccaaaagcuucaaauaaccaagauacaacuuacagaccacaugaaggucaagaagaaggaagaccaaagugugggagcuuugguccuuuuuagaauaacaaaauacucacaggaacaaauauagagacaauguguagagcagagacugaaggaaaggccauccagagacugucccacaugggaacaucccauauauagguaccaaacccagacacuauuguagaugccaaguaaugcaugcugaaaggaaccugguauggcugucuccugagagacccugcuagagccuuacaaauacagagauggaugcucacagccaaccacuggacggauugagggguccccaauagaggaguuagagaaaggaccaaaggaguugaaggggauugcaacugcacaggaagaacaauaucaaccaaucagucccccaagagcucccagagacuaagccaucaacaaaggaguacacauggcuccagcugcauacauugcagaggauggccgugucaugcaucaauggaggagagguccuugguccuauaaaggcucaauagaugccccaguguagagaaacugauggcugagaaguuggaguugguguguggguggaggaacacccucauagaagcagugggagggaggaugggauagggaguuuccaagggggagggaccggaaaaggggauaacauuugaaauguaaauaaagaaaauauccaauaacaaaaaagagauaagguagguguggucuacaguaaauauaacaugguuacuucugggugguugggaagcuuugccucuugaugaagaggcacaacaugggguuuucaggcuaagacuacagaguccuguaaaguaaaaaugcauucuuucucuaugccacagucuguuucugugugcaccucagugacccuagccccacccaaugauuccacaugguucauauaagugaguguucuagagaaagcuuaacaguuucucacacaacaaggaccauuugauaaucuauugaaauaguuuugaaagcuacauccauagagacucagauccuccaggauugcauaagacucauuaauaugcacuucuaauaagcucagagguaacaucacaggucuuccugagauucacugcagcucucagauuccaaagcccuuggggucagagugaaucacugacuagagaucuuguucuagggcccagcuuugagaagcacuuaaaaggcacuucuuagugaagguugauuuaagaaaaucauucugccucaaagacaggcuauucucuccuaugaaaggagaaaaaaaauggaacuugauauaaaggcuccucacuuuaacuguuaagacaagccaacacugguacauacagacccaucucauuccuaauucucgaucauggaaagcuguaagcaguuugaaugugaaaaagaaaagaaaagagaggagaggagaggagaggagaggagaggagaggagaggagaggagaggagaggagaggaaaggguucccuguauguacccaggaagccacucaugggccuacuguuuaaaccugccugaaguugauuguuuuuaaucuccuacuuccauaggcccugaaaaucuccuguuuuuccaaaaagaauccaaacacaaaaacauaugugauuuugcuagcaaaccuugcuagcuuuaaauaaaaaaaaaaaaaaaaaaaaaaaaaaacccaaacacuuuuguucuuaauauggucaccuauugucugucuuucuacccugugcaagaaaaaaagguaaaauuauauugacaucuccuuaaaaucacccaaaagccacagugcuagcaccauauccaugccuuuaauuugcucaucaauauggagccacauagaaggccaaaugccuaaagaaacccaaagcaaacagcaacaauaaauaggauacuagcaguuacaacuuaaaugucuacagcacaagaaacauaguuuaaaacaugaagugaggagugggguggagagagcaagccaacuucagaggucuagccuuagcucuaauucugaucacacugauggaaucacauuacaauuguuucuguuguuaagucuccguuccuuuauaugaccagugguuugagagaagcaacuuaucuuuaccuaauucaagaaggaagugacucuaaggaagugacucuaagucagccuuuugaaggaguccaccucccucuggcugucugcacaccgucaguuugggccugugauguuaaaaagcaucucuuguccuucauggaugcugaacuucaauuauuuuuccucuuggugcuagagaggcuaucagaaauugcucugcuucuccagaacguuuuuucuuaguaucauucacuauaaaacauaaaauuuaagugaauuugcauuucaagguggaaggguggagcuacuauccuaaggcuuaauauuuuucaggagcgguugcuuccucugacucuuggcugcuuuccugcccugccugucucuucuaccugaggagaccaucaaacauucaaacauucuucugcuuucuucuuaugccuggcuucucauguagacaaaggcagugugaaaaauauuggcuuacuccuccacagcugccauuuucagugaguuaucauauucugggagacuaaaauugcaaaggagguguucuucacuuuugucaacauugggcuuuuuaguguuuacagagaagugcugcuugucacaaaccacuccaagcacaccaaaggcagaugucccuauacagauuuaauugccauuuaaccauuucaccaagaaauaauguuuucaaucuagaauuucagauuuaaaaucagauuuaaguaauuaauuuacauaaacaacucaggacucaguuuguccuguaagacagauugaauaugugauacuauauauccauucuccagucaaaauacgacuacacuaguuguucacguucagugaucucuuuugagauagguuucccugcaauuuuuacaacuuguugaccacccuaaaagaaaucucaaauaacuuuaagucagcauuaucauuuggaguuccugagaacacuggauaaacuuuugaugauaaauggacaugaggcacagaaaucauuccaucuuacacagcaauaaaaaagcaauaaguccccugacucuuaugcuuaucagggagcaaggaugagaauuuuguugguagagaaucacagaaugguugccagugauaguguagcucaaagcagaaagccaaguaaaugggggcaucuuccgauagcaaacucuuagaacaacuuaguaaccuagaugaagaucuauacugagagauaaagaacaggcuaucccuuccugggacuucuaauguacuugaaauuucacccacagaagaaaauaaggcugacaagaaagauaacaaauucucgucauaaacauauuaauggcucuuucugacuauuguccagaugauagucuaagguaugaagagcuguccaccacucaugcagcuugcgauuccagaggacuugggauaggauugcucauagagccuacugaugugaauucucuaagacugucguuaacuauaaugacagguucuugaugggaaaguucuaaaaucauccuuagaaugcccauccuccauuguguuuucauaacgaaaacaaaacaaaaacaugcuaccuagauauuccuuauagaaaagauauuagaaagcaaagucuaaccaacugcuugauuucccaguuacugaauuuuaagauugagucacugaucauagagaccaggaaacacaaaacaaugaguuuugcaugguauacugcaacaaaguguacuaacagaggggaaaagacagaauuuccuaaaaguacaaggcgccaugccaaagauacuacaugaaguguguucaucuucacaacaguucuguaagguaaaucuuaauuuuuguggaugaggaaaauggagaccagaguagguuaagaaguuuaguagauuagucaagguuagggaaguagaggagagggaauuugaaacaugaucuccugcuccaucaaaagcucuuagccauaugacuuuacuggccucuuggacuacauugaucauuuuaaugucuaccuguauauucaucacacuuuacuaauguaacuauggauuauggauaugugcacuuucuagcugcucuuaaaauaugagcuagauauaaaauuaaugacauccugggggcugugauucuucccucgaacaucucacgaagaaugugguuuauaaaaucuuuauaucuaguugaaauguguuuaugaagcuuugccaggaaacucacuuuguguugguauuauacacaggcgguauaaguuacuauaggcuuaagaaguuuccauccaagugucccaucccuucacauaauucccuagcucuugaaaguuaagugccuaguccauuucucuuuccaagugacuaauccucuguaagggucuaucacuuaaaacaaaacaaaaagggggaaaagugaaaaaguuccagaucucaccaggugucugguucucuccaugcugcuguuguguggagaacaugugucucugaagaggcacaaaaaauauguuuaucauuuagaaacaucacacugcagcuggaaguagugauacauucccagaaccaggagacugaagaauaugaauagggagcaacauggcuacauuaugagagaguaucacaaaaauaacccaauauaaaagaaacagaaaaagaaacuucauaaugcaaaccuguauugugaugaacauucacaaaguauagaaaaaugaaaagaauauuccauccucuagggagaaaaaaaaaucgccccgugagccuuagucuuccucaguggaaugaaacaagcuacuucaugaugcaggcacaugugaaacaccucagaguuucuucaguuauaagaugaauguauauaugagagauggugagaaaaaccaaauaaucacacuguagacaacuauacacauguguacaaauagauacauacacauacauguacaugcaugcacacacacacacacacacacacacacacauacacggaggcacacaccgucuaugucucuaggagcaaugaauaccaaggagcaugcaugugacaaagcagcaaacaagaggagaaacccacuaugccucccuggagcaaguaagcuggggagaaaacaguggguuucuauagugauggggaaaggauagaguagaugaugcaauggaauggagagaaagaagaauccccacaccggaagaauggaacgacuccugcaguauucccauaaugcacuacaguguugagaugaagcagcaagaggcaaugacucaugucauagcugaaauucauuugucaaaagugccaagggucauaaaccuaaaacagcaaggaaaaaaacaaaaacaaaaaccuggacucaauaccaggagcaccuugaaaaaaagguagugauggugcaucuuuaguauaauuguucucaaaaccuguugaccaucauguguugccaggaaauuugggucccucuuugaguucuuagucucacaaauaaaagaguuuaaggauggacuccaaaggaagcuugaggacuauuugcugaaacuuuaaagcaaagaacugguggagcagguaggcuguaaaucuuuacaggugcuuugaggaagacaauggagaaagaggagaaaaagccaugccuuugagaguuaggcauggagguucagcaagcauucacacugcaaaaggaagauaguagcuucagaaaacaaaaaaguccccacguaccagggaaaguauaguugagcacuggccagugcugcaaagacagacauaaauggagagagagugagaguuaugccugucuaagucagcacuuagaaugggggcagaccucagugugcucaguggcagcacggcagcaacuggaaaaaacagugguucuguggaagaaaagcacauggucucaagaagggaauaauuacucuuccaccucuuaggugaaugggaggcauuaggugaauccaccuccuaaggggugaugguuuuguaaggugauugacagguccaacugaauaaauucucauguuuugaguagcuuggaaaguuggucucuacccaggccagagguagauuauauucucuugaacaggaagaaauagcuuuuccuuaaugggcaucaacagaacacugaucaaggcuaauguaccaaaacgaucugguaucagaaccuuugagcaauuuaccaaaaaccaaguauacauagagcauaauggauaaaucagaguucacaaagaagcccauuaauacucaaggccugugcuuauugaccacucuccugcaugcgcucuuuguaccauugcaacacauacacaggaauaucuaggcaugcauuucugaaaaggaaaacaucacuaugcuugauuacaugggggaaaugucaaguaggcuauacauuucaaaagcaugugaacagcauuuuuuugugcagugagagcacagaagauuuuguuagauaacacuugagcuuaaccaucagaaugacaagacaaugaaaaaguuaaacuguaucuuuacuuuuucccauucagaauaauuuugguauuucaaaaucauucagaaaaaucuaugcaaaaacagacaugucauguuagagucaaaagaagucauugauauaauacauuguaauguauuauaaaauagaaaauaugugauucaaucuuaucucaugggagguuggaccuaagcagguucaucaucacaaaugaaaggggcuggccuguuuugugaccaauuauauggucaaugaaauucuugagcaaauggauguaucuggaggauaucauucuuagugagguaaucaaaucacaaaaaaaaagucucuugauaugcacucacugauaaguggaagcccagaaucuuagaauacccaagauacaauuugcaaaacacaugaaacucaaaaagaacucagaccaaaguguggacacuuggccccuucuuagaauugggaacaaaacacccauggaaggaguuacagagacaaaguuuggagcugagacgaaaggauggaccauccagagacuguccaacccggggauccaucccauaaucagccaccaaacccagacacuauugcauacaccagcaagauuuucugaaaggacccugauauagugucucuugugaggcugugccagugccuggcaaacacagaaguagaugcucacagucagcuauuggaugaaacacagggcccucaauggaggagcuagagaaaggacacaaggagcuaaaggguucugccaacaauauaaacuaaccaguacccccagagcucaugucucuagcuguauauguagcagaagauggccuaguuggccaucauugggaagagaggccccuuggucuuaaaaacuuuauaugcaccaguacaggggaacaccagggccaagaagugggaguggguagguaagaaagcagggggaggggaggguauaggggacuuucaggauagcauuugaaauguaaaugaagaaaaaacauaauaaaaaauggaaaaagaaaagaaaggggcuggcaaagagaaucauauggaggguuccuuagaaacuccgcugucuccaacccaagacuuucuaaauagucguguaagagccacaggaauaggauccacugugaacccagaagccagaggucagcccucagaagcuguccuagagaaacucuaagaaucccugacaugcaaaaagaugaucaauaagagcuacugcagggugaaugugagagaagugcuucaucaaucuacgaagcucagcacuuaacagaagagauaaaggcgccauagagggagggguauuugcagaggagggaguaaccugaucauucuaaguuuuuuaaauggaaguuuaaaagucuaaagacaauuuuuauaaaguacaaggcuccuuaugugggaucauagggaaagugaagacacuaguuugcauagaugauguagggaucuauuguugcagggaagacuuugcagacuggucaaacagacucucuaagcagaaaaaacucauaagcugcuuugaaauaguuuggugcugcuaaacuguaugauggaaacuuggauccuggaguucuuagcacagggaugaagacaacgauaacauugauuuugaauaaugaauaggauuuuaaauuaaacuggcaaaagguacauauuuguuaauaaaaaaauuaaauaaagaaauaaugauccaguagucaagaaacuucccagcacgcacauggugguucacaacauuuguagcaccagcuccaggggauccaaguccucccuucuggucuuuucagcauccaagaauguacauggugcaaaccaaacacaaaggcacagaaaugaaaaugaacaaaucuaaaacauaauuaacuaaaagcuaggauggagaguaaaugcuuaauaaucaagguucauggagagaaugaguuugggucuagcaugguccauggaugggaccuugucuaaauaauagcaaacaacaacaauaaauuauuauuaugauuccgcguuucuacuacauggaaauauacaaguuccuacaaaaaaauucuugugaauugaauuuuucaguagaaaaauguacaucuaacuuuauaaucaaacaaggcugacagaccaauuaggacuugugaguguggagaguugugaugcugcaggcccagagccaaauuauuuggggcuauuguuaguccccucaauauucauuaccaucucugugcauguccugauauucuuaugacuauuagguaaauuguuuuggaaugaauuaagaacuaugaguuuccuccaaacccaaagguuaagaaagucaucagacaacaucuaaaauccaacacuuggauucuucaacuugucuauaaacaccuugcaauuuucaccaggguauauggagagccuugauuuaggaauucuuuuauucuugaacuucuuuuauucuugaaauacacacacacacacacacacacacacacacacacagauauacacacacacacgcauaugcauauauguauauauacuauaucuauagaguacauaauacauaguauauauaaauacuguuuauaguauauaauagaauagcauagcauauauagcauauacuauauauaauaugguaugugcuauauauuauauacacacacaaauauauauaugaggagcauuccauaguuucacuucaaguccauggaaaauaccuugaguaaauaagacuuucccuagcaacaugaaacacuuccaaugagagucaccccacaggucuccaucaguucagaguauaggccugaugcuuugauaugacaggaaagagaaagcugcaagcuugguaaagaaaacuguuaacuaugaugacuagugaaagauacaauuuuuaagcucaggaugauauaguggacacccagccccuaaucucaagcacaggucaguggcuagaacuccaaaugagauuuaaaggcucuugguuuucuaguuuaucugcucagugugaaaucaauaauacacaguucuauaucuauauuucuguagaauuucccauauaaauaaaugcccaaaccuggacagggaggggcgaugcucauuacuugucuucauuuuagacccugaauaacugaacucugguuacaagccaaagucuaauaaaggcagcugcagucaaacugaucagucaucugccacuaacaggcuaagaacuaacaaccuuccuagaccauacaccagugacucagccugugucagucucaugccagugacaauccuggaagugacugagaauucacccaucuuacagacgcaaaagcagaggcuuagggaaguucaaccacaugcccaagaagacuugauuaguucuguuucguuuuguugucuuuaaguccaacaucacugcuuauuaggaaaggauucaacacgagauacuggcauaacagauaccuaaagaagaagacagugggagagaacucucuagcauacaacuggccuuaaguuugaucuccaccaccacagaaauaaauaaaagcaacugugauuggccagaccaaggaagugucaucaaaaguauuuaaaggauccaauguaaugaauucaaggcaguaauuacuaauuagcacaucagucucgggcuguagauggaugcugcuacaaugcuacagugcuacaaugcuccaaaaucuuguuuccauuauuaguuuccacagccacucucucuucagauauauaaaccuacaccugguuccucaagaguuagcacaugauuuuaaucaaaauggucuggaauuaauuauuauuucuaugguuucuuacuaacaguauuuaaguauaugagauuuuaaaacaaggaacauugaaaggauggaaaugggucuaucaucuagagaugauaugaggacccaggugacuucccauugcuaaaacugaacagggagucacuuuaguuuacaugaaaaguuugaaacuucaaacaagguaaagcuuggucaaaaguuuacaaacuucacgcaauaagcuaaauuuguauuuuagaaaauacugaaauaaaaauagucacuguuagaaagacuugacacauugcucucucaugauccaacuuauaauaacaaagauuuguucauaaagauguaauuauaugcuauuugaacgguuuaauuauuuuuugccugaccagauuuacuuuuuaauuaccugccuugcagaacuuaaaugugaaugcuccuaucuuggcuuugucacccuucuaugggcaccuuuuaaauacaguccauuucuugguguccacagaaggauggcaaaacaaacagaagcauuuguauuuuuagaucucuacuccuuccucuccacagcccccccccccccgugugcaugugcacccacacagguucugaauguguauggagauaccuguggagcugagaagaucagucuucuuguuguuccucaguugucauccaucuagauuuuauaauagggucucuaacuugaguaggcugguugacccagccacaaaaaccccaccuaucuccaccuccccaacuuggcacaugaauuacuuuuuguugguguuuuuccccauggcuucugcaaaauggauuagagauuuucaugcuuucaagucaugugcuguacugaagugucaccccagccuuguagguucagauuucuauagacauaaaugaguggguuuuguuuuaaaauuauucaguuaauacauuuuguuuuacuuuuaagccauuccaagguagcuacuuuucagaaucagcucugcacaguggcugaacuuggcccaauuguucucugcaaauuccuacugucucuuccauugcaagaaccaccaagaaucuguuuagacagaugcagacaucuccagcagcuaacugaucaagaagggaacuagaaauaaacaaugauaaaaaaagaaucagaaaaguggccucagggcaagucugcaucccaucauaccuguuuucagucucaccuuggauuuagguguguuauccccagugaaguuuguccccuucuacauaaugcaaguccccagcucaaaggguuugugaggaugaaaggaggugacacugggaugcuuuuuggggauguccaaccgaacacuuaguauagacgccuugaauaccagcugccauuagaaucauaacacuauguuaauacuuuauacacagagagugugccaggaugacauauauaaaugauguucauaggaaaacuaaaaaagaaugcauuucugaaugagcagaaggugccaaggggagaggaaguuccuguguaccuaaacucuaggaggaaaaaaaauguaaccagaguauugcucaagacagaaguucagggcaagaugaggcauucugugaagcaccuguuucgucucagugccagaucacaccggaaucccaaccauggugauguaugcauagcgaucuuuaccaucugucuucauaaagucauuuacuauaucacaucuuuacacagggauggaugcuccuuuauuacauucaucucuucagucugacgugaagagaaagcaaccagcaagcagcuucuauuacucugguaagugccaccaaauaacauuuuggaauguuucuucaauugaaagcauaugaaacuguuggagaaaauuccucauauaaaaacucaaaaucagaaacccuaauauguauguauguauguauguauguauguauguauauuuuuccaugcauacacacacaaauacacacacaaauguuaucaaguuugucuuguguuggccuucuacugcuaacccuuaggucuggcauuaagaauaaaacccugauucuuaacgcguuauuugugugauacuggagcaaugcacauaguaaaaacccauuucacauggguuaugacuuauguaugugagauauaauuggaacaaauaauuaucuugucuaaguagggaauacugagaacagcugcucuguuuuacuuguaguugugaccacacauucaagacuuauuuuaauaaaaguugaucaauagaaagaaaggcucuaggacauggcugguaucagagaggaaauuccuauaugaaagaauuuuaagaaauuuacuugaaagaggugagaaugcauuauuugucaaauaugcuuaucaaauacaguccuaauaaaauacuauuaaccacuaggcugacuguguccaaaaagugaauggacucuuguaauaagcugauuaguauguuaauccugaaaauacacagguaucuuguacgcaaagacauugccagugagcuagaguauggaaagaacugcccaggcaaggcaggcugacucaguuaacucacagcugaucagaaacuugccgcuggauaauguugucucagagguagauuuguacaacagaaaacacacagcaugccauuuaaauauuuaugggcauaaauauuuuaaagagucugugucuuuuucuuuuucucuuucuuuuccuuuuucucuuucuuuuccuuucuuuauuuuacuuaacucaagcucuaagaguaacagccuauauuugccuuuguccucaagucucaaagaaauccaggacaaaagucugaguugacuauuuaacacaucaaaggggaugcuggccaccaggcuccaagcauccuaaguaccuguuaccuggaguucugacuucucaauacuucuuaucccuacucacuucccuaagccccuccagcccccaggcuuuguuucccuuucuuuccuuuuuccuauuuacagccauuuuggcuauguggggcucuccuggcucucaguccucucuugauucccuuugcccuucucgucuucuuuuucucuuuccuucuccucuucucuucuguucucuucuuuuccccuucccuccuuccucucaugaucuagucugagcugcuggccaucuguagacucuuacagaugcuucuggcuggauucucccucauauuuacaauaaaagccuucuccugaaccauaccuagauggagccaugucuucauuuuuauucagucuuaggaaccagaagugaagggggaccacuauuucucaccaaagcccaagaacaugccauuucucaauaccauuuaagacuuguucucaaagcugauguucaccugggacaugacugucaguucugcaacgucacauuucagggagcaucaugucccuucuuaaaaaacaaaaacaaaaacaaaaaagcccaacacuaauuaugguaguaccuuauuuagucucuugcuccaagaggucagcauuuaaacauauuuccucacaaucuacugcauuucagcuauuaaauuaaugguggcaucagccugcagcacagaacccucuaaaccccuacuggcuuguuccuuugauuagccuagaucaaggugguggcagcuauuugcaggcagauuagagggacucagauuuauacugcugucagugcuagaagcugcugacagccagcauguccaaguacaucuaugacagagcauugagguuauucuuaaagcugguuuauguauaaucagaaguccauaugagugguggggugugacggccuuuuacacacuuccagcacagcccucauugaacuucuagucccuuucugcacauacccuguuagccaccagaauucccaacaggggugggccucauuugggagcagauugcccucucauguacuuuugucucugguagaaaggcaggcauaucuuaguccucauccuucuuuaaaagaaaucuagcacauggcacuggugaguuguuguguugaggaauggguaguuuccagaaguuuuaaggaauaauauuucugagaaucacuggaaugugucagaauauaaagguguggauacaugcaaguaaauaauuuaacagaagaagaguggcaggcgauauuccacuaaaauccugugcucaaagugaauuaaucacaggccucuuugacuaugguuuuccucaacucuaaaauaggucauaauaccuaucaaagaaucagcuauuaaaccauucaguauuaagcugaaaccagaggaagcuaacuauauaauauggauuuuaaaaaaaauuccaugaggucuaaaaaacaaaacucauuauaaaguuguaaacaauuuuccaacaaaacagucuuuuucuucucauucgauuauuuugacuuaauauuaggcugcuguggauuaggcugaauuuaaugaauaaauuagaauuaaauacugcauuauuuaauaauucauuucauucuaaggcaccuucaauuuuuaauagccuuccuagaauuacaaaaagaaaaauaaauaaaggaaaagaauaagaaaacauauguuguuauuauaaaccacauucuaauuuccaaaauguuuaaauguauuggaguacuauagagcagaagaauuuaugacaugucaucaaagaaagucacuauaaggccacagugucaaucagacaaagaguggaaaucuacagaauaaaacuccuuuagaauauuucaaaaaucauauaguuggagaaaccugaucuguacagcccuuuucagggaaguccauauucacagauuaaacaacuugaacuccuucuauagguauaucuauucaacuuguuuuucacuggaggaguaaacauaucagaacauaccaugaucaacacagaaagcuccccuaguuaaggaaaccauuguccaaauguuaucccuugucagaagauaaggucugcaggaaagaggaguccccacuccuugaaccaacuacugacccugagaaucauaagauggcaggcuagcugguaugacagcuucugaaaacucuugugcccccccucccaucucaugauaagagugcugagggugucggugcucacuacuguagccagcuuccugaggguucuugggguccacacucagacccucccucuugugagcaccauacuccuugagccagcuaucuccucagccagagaaucauaacuucaaaggaaacacuuugugacuacuuauuuguuguuuuucuaaaacuagacaugcaaaaaucacaagaagagccaugaauuuucagguaacauuguuaagaggagaaauuauugagccuuuaaaauucauguuaacuuuauaaaucaaauuuuuuuaguuuuuaaaacccaaugauaagacuggaaacagaguaagaccuguuuauucaggccaaccuugguaaaaauaaauacaugcaauaaacacagaauacaggcagcuuuaauuucacauguggcccagaaagacccauuucucccccaacauguaucaucccacaugugcugugauucacaauccccaaagcaugaaaguuuaaauucugaaucaacugacuuggauucauugcaauucugauccaauaguugcuccaaaauagaugcaggcuagaagacaguuuucccaaguuaaaagccagauggcacuuaucagcuaaauauuuuuccuuucuuauucagaaggaaccucauguuggaaauagugaaacaccuuauguaagagaagacucuaaggcuuccuuagucaucagucccaaacugaugacucuauaaaaaggaaacauauuuuaacuuuuuuuaaagugucaaaaagguauauauauaaaacaacauuggcagaugaauccauucuuugaggcgcuucccuuaacauuaaaaaaaaaaaaagaagaagaagaaaaaaaaaagaaaaaaacuucuauuuuuuccguuaaauucugcacaauccaauaaucuaucuucucaguaaaaauuuaaauuuuugagcuaauccuacuaguaccaaaaugucugauuauuuuauuagguaaucuguuauauuauucaauacuaaguuuuauucauaauucuccauuugauauguucaaauagcauaaaaaauuuaguucuauuauucuuuuucucuauuuuuuauuggauauuuucuuuauuuacauuucaaauguuauccccuuucccuguuuugcucccuccuggaaauccccuauccuauccccccucgcccugaggguguuccuccacccacccaaccacuccuagcuccccacccucgaaacccaagauacauauucugugauauucucaagauuaccuauagugauuucucccaugccaugaacagauaaacuccauagcacccuauggaguuguuuccauacuaagccacucagccagaugacauguagugacuaagaaaguggcugagcuugcuuucuucucuccaucauaguuccuguucucuaaggugaaaggugcuuacuacaguguauccugcauauaccaaauuacaguggcuccuccucuccaguguaucacacaugcuuacgacguucacagugucaauacuucauacuauccacaccaagauuuaauuauuggagauuauggcuuuuuggggugcauacuuccauguuugcucaugaggccuucccagucagucccuugcuuaaugcccuuugagagcaucacuguuuaggacaaaggcugaaagggguacgcagagguagauuaaggguuggagaucauacucaaaccaugcugcuaccuaacucaaacagcucugcuuucaaucuguuugaugcacaggauuuccauguacaaugacaaccaaugauggauacuaaagaggaaaauggaccgucaugaguuuaguagaugugaaacaaaugcucacaagacaguuuuguacuguugucagaauccugcaauccuguauaggacggcucacccuucaacaaaauguaaaacacaaaguaccuuagccaucaaguaaaaacuauuaacaucuaugccaagagccuacuucuaagcccugugcacaagccacaucucaguguugacucaacuggagguugaaguguuuacaguuugucuaacugugggccaaggccuggauagcacuuuugcuaaacagcucuggcagugggcuaggcaccauacaaggaacaggagugauucuaugcaacaaagucuauacagaccucagaagcacagaguucacagucucacagaagugugaucguugguuaaauuaaguagcaagacaagacagaacucucucuaugguccuuguauacugcauccuauggguuucauucugcuaucaaugcauuuaaucccuaccauauucgaagaauggagcacaauaaucauagguauuuuauagaggcuccacugagucacaaaaaucccucagggcuacugagugccagagucucguuugagucuagaagaggggucucaguguccaagagcucuauuaccacaucuuauucccucucccaaauauuauccaaaaauugacauaagauacaccugagacaaguccacuaaagugaagcuuggggcacuuagagucuauacaaauguaaccuuacugaagaaaugacacaggacuggagagguggcucagccuuuaagugcuagauccacuuccaaaagguucagaaauaauacuggagcugagaagugaaggaaaauaaugaaaaggagugaagagugggguuaggaaggaugguuggcaaaaauaacuaacuaaguaacuaacuaacuaacuaaauaaauaaauaaauaaaaugaaugaauaaauaaauaaauaaauaaauaaauaaauagcucuauggacccuuggugacaaaggccuaggaaagcuagagaacaaagacuccaccccuuagcacaaauaauagaggaagauggcagguacauaggaauggugacugcagggaagagaagaggagcuaccaggaagucagugaggggaccaguagagaccaaacagcuauagacacauuuucaaauacugcuguggcaauaucuacccagcaggaaaaccucggucuacacaagaguguuauagcucucccaacauggagccaagcacaaaccagcccuguucugaauuguuucaugggcuccuaaauacaucaccacgguaugccagguggucccuacuggcagggcugacaggcaauagcuccucaggugaacuccugguuuuguugcuugacaauaucugaauuccuuaggcuuucauguagaaagggaacugugagagaggaaaguuuaaaaauaaggcuauugucuucaaaacuucccaauuguaggugggagaaauagacagcuauaucacauaauccugaacaccaugggauguucguucacacuuaaaaacauuuagguguuauuucauguaaacguugagaaggaaaaagacuccuguuauggucucuugggagucaaguugcugcuuuuuuuuuuuaauucuuuuaaauaauuucaaauagaagacacucuucuuuccuuccaucuguuuuauuuguuguuguucuuaagaauuuaaucagauuuaugaagacuuaucauugacagacgaaucacugagcucugagggagcucagagcucugaagacauucucaaucaguccagguggccaggucgguacaccacugauugcuuugauaguuacugaaugcacagugcccucucaccucccaucagaguuucugcuauucccacuguggagaaagcagagaaacauggaggaaauccauuguugauuuuugaaggagcuuaaauuucagagucccaaucaccauaggcuuguaaaacggccugugcagaagcagguuuugaggaguugcuggggugacacuguggcuuugagcucccacagagacuguauugggacuaagaccuugggcuugaauaggggcuguuuucuuaacuucucuugaauuuggguuguucuccugggcaucagcguucacauaagugaauuagagaagguaagauuacauaauuagcacaaagcccagcaccgggcuagcagcuacuuaucuaagguguuuguuuguuuguuugacuuuaaaaauccacuuuuacaaaaauccucccucgguuacaagaaagguuaccaaaaggccauuugcucuguaucugcaagagcuuggcagugucacuugaacagacuuagacgacaaagucccauguuaauugguccugccaguccuuugaaaagcacagagguaaacagguagaaugaccugcuuaaugagcaagcccagggcuaaaaugaguuuacuaagagacacuugugugucuaucaaguaaguauuacucaggaacagaaaaagcuguucccuggucucugugcauccccgccacaggagaaagccugcagguucagggcggagacugagcacuccacuguugaaugaucagcuggaaaaucauauuccaaauaauccaauugauuggaaaucaacagauuauguucuuacuaauuuauuaaccagauggauucuuuggccuauuuaucucuccaaaguccaagcccucucuucagucugcaaagcaucuuacaaaucuuuuguaugaagaccaggcuaguccucacugccuccagcuauaaaaugucacuugcuuguagguaacauaacaauauucaacauucuuaaagcucuacugacagaacagaagaauagcuuaugcguccaaaagacaucacggcgagcuaaauugagagaaauuuuaaagagaagcaauauuaccauaaucucagauuucaagaaaaauaaaugccucaaauacugcuacuccuuuaauuuucugacaaucaaacauuuaucucuguucacauucuauaauaggaaugccucuuauuugguucaucuuauaaagaaugaguacuuuuaggauuaauaaguuauacuugcuagaauugauccuuuucuuuaaaaaaaaguuuaaaaaaaaccaaacaaacaaagauuccacuaauuacaaaccaaagugagguacaggaaacauaccucaaaggagauggaagaaauaggcacauguacuucaaaguggugcuucucucugcuccccagguguugcucuaaaaaugugcaccaacgcuaagacauccaucugcacauagguaccuggcuuccucaauaauauucaauucaaaucaaacaguaauuaaagcucuuaauuuguaugagcacuguuccaagauuaacuaaagggcuuaggggagcuaaaggaggggcaaucaauuaggaaccuauuaaaauauucagaggggaggagggagcucugagugagugcacaucacaggauccugaacuugggauauggaagugaaugcaaaggggaaagugagaaagguugcaggaagaaaaaagaaugaacaaggccugggcagaaguuaggagaguggacagaauccugugugacccaaagccugagacagaaaagaccaucaacugauagaagaaauggugaaucuggaguuuugaugggaagggguuucauccagaaauguugcauuucauaugaacaccucaccucacaaaaaauuguagauaacacuggaagacauaucagagauggagacaugauucugggagacaauuuuugccaccuuauacucacaaauaaaaaaaaaaagauaucuccaugaauucagacacauuuuucuuccuaacagcggcagugacagaaucaggacagucacugcugcuguucacccagcaaucaagggagaugaaguagaugaggcagacagagggcaaagaggggcaacacugacagaacccacaccaaagguucaauuuucuucuggcauagugagcuaaauaaguuuuccuucugaaguuuauuauuuuucauccaaagaaaaaugaacauauauucacguuauaauaauaugagaaauucagaauuaaugaaaaaacaaaaacaaaaacacaccccugagcccuggaaucuuaggucagcugacuagacugacagaauggauggagcucuauaggcuucuguccugcccauaaagaauaaaaaccccagccaugcugaccacucaguuucaggccaaacuagugaccagauuuagagaacucuagaaauucuguaauguucauuuuuauauuucaauuuuuuucuuguaugaaaaaucagaugaggaaauaauuaauuauauuuucaaaaacagaaaaacuaaggcagaagaggcucaaucucauaugcccuucacucuuuuuugaaaaauguuccuuuccauuucuaucccuguaauuuugggcacuucagcuuguugagcuuuuugaguucuguagccuguaucuuggguauucuguacgguuuuuguuuguuuauuuguauguuuggcuaauauccacuuauuagggaguacauaccauacauguccuuuugggucugaguuaccuuacucaggaugauauuuucuaguaccauccauuugucugcaaauauccaaaauauauaaagaacucaaauuaaucaccacacgggguggugguggcacaugccuuuaaucccagcacuuggaaggcagaggcagguggauuucugaguucgaggccagccuaguauacaaaguaaguuccaggacagccugggcuacacagagaaacccugucucaaaagaauaaauaaauaaauaaaucaccaaaaaacaagcaacccaauaaaagaauggguauagaacuaaacugagaauucacaacugaggaaucucaaauggcuaagaagcaucuaaagaaacguucaaauccuuagcaaucagaauaaugcaaaucaaaacaaccggagauuccaccuuacacaaaucagaauggcuaagaucaaacccucaggugagaacacauguuguagaggauguggagaaagaauguuccuccauugcuggugggauugcaagcugguacacccauucuggaaaucaaucuggagguuccucagaaaacuggaaauagaucaaccuguagacccagcuguaccacucuugugaauauacccaaaagaugccccaccaugccacaggggcacguguuccacuauguucauaguagcuuuauuugugauagccagaaacuagaaacaaccuagauaucccacggcagaagaauggauacagaaaaugugguucauuuacacaauagaauacuacucaacuauuaagaaugaggacauccugaguuuugcaggcccuucacuuuuaauagaauaaacgucuaucuuuuaaagaacaccauuucaguagcccacacaacugacugaauuaucugucauugcuaauuaacauuugagaacuuugcucaugaaagaaaaaaaaaaaagauccaacauacacuucuuugauauacgcaggucuugcgaaaaaugaaagacuaaguauagcaucaauaauaguuauagcacccacugaguaaucaauuaccauacagugggucagagagucugaacucauuggcuacaacuuuuacaucaccuauauucagugaaaacuguggagaugucaaccaacaguuugggggagguauggaacucuguuacuuaaauauguuucuucuugaaugacacaauaccuacuauggguauaaaaacauucuuuuccauauuaauaaauauuuauaagcaaaaaacaacuauuaaguucaaagaaaggaaggaugcaauagaaagaagauggauuuaauacuuugauuauuccuuuaaaagucaaguuccaucuuugcuagaccuacacuaaccacacaagcaaaggacaacugacaguaucauuuuccauuaggcacuccaagcagacacagaggaccugccaaagcuauauugcagaauauucaagaaaaauuccaaggggaccauuacuauugugguggccaaauagaaaugaagcuuucauggauguacucaguuguuucaccugcucagaccucauguuccuucaguggaaaucaaaaggggaagggaauguacccaucucaaauucuguggugagcauuuuacagaagaagacacaguggugauacacacaugccuuuaauuccagcacacagcaggcagaggcagguggaucucugugaguuuggggccagccuggucuacagaguaugguccagugcagcaagggcuaugcaaagaaacccuuucucaaaauaccaaaagauaaaggaaggaaaggaggaagggaggaagggaggaagggaggaagggaggaagggaggaagggaggaagggaggaagggaggaagggaggaagggagaaagagagggagggagggaggaaggaaggaaggaaggaaggaaggaagggagggagggagggagggaaggagggagggagggagggagggaugaaggagacaacaaagaaucuaucaugggaacuggugcauugaccaugccagagaugucaccaucaccacuauuuuuaguguuagccaugacuucaaagacuuaaugcugucugggacaggcaacuagaggcuaugaaaucagcuaaagaagucuugucuccaacuuacauuuaucuuauuuaugaaguauauacuuucacaaaguauauaauauacccuaaggcaauugucaccagauaucaaauauaaauaaaacacuccuucuguaggagacaggaaaauagagcuaagguauccauaugacuaaggagaaagccaacaacacagggaacgcugauuaugcuaccaugaaggugcuucaaacacaaaaguaggcaacaguuccaaacucaaaggaugaaaugcaaaugucaaauaccuauaaaucaguauuaagagagaugcuauuugaagggaagacugugaaaggaggaaagagacuauugccaucuggagacagcucugacuuugagauuuauacaugucuccaaggucagauggaaaggaauuuucuuuucuagggagaagcagacaagacuagcaagaauuggaauggaaauguggaaugagcaaguagccuguuuuacccugagaucagcuaauuuuaagaagggcgucuacagauaggcuguucugcacucaggugguuuuagccaagguuucagaggaagagucaaggaaagucugugaaauuuaagucugggcagacaguugaucaguggguacaaaauaguccaugugguuauuuacaaugcauaaaaugggaauguggaagguuuacuucugagcuaaaaaauauauaaacaggguguggugucucaucgaagucauggagaagagugacucuugaccagucauucucagaacaaaaauagugugagcuugacugccucucugcuugucuuccuucugauaguccaugcuucucucauuguugucaucccccccuccuccuucuccuccuccuccucucucuuccucucucucucccuucuuuccuucuuucuuucccuccuccuuuucucucuuccuuuguucccacacagagucuuauaaaggaauccaggcuggccuugagcucacaucuuccugccucagccucugagugcugagcaugcucaaguuacuguugggcuuuaacacguucagcagagaugucucaacuuacagcccuuuaccaaaaucacugggcucagguuaacauggacagaaggcugugauuuaaagacaagaaaaggaacaggccccuaauauaauccuggucucaaaguugucccccaaacagaaaaaacucagaucucuucuggccaaugcuggaacaacaguauaucaaaaguauauagucaguaaaaaauggccucaaacagaucacagaccugcucucacuugaugguagaaauuuuaucccauagaaauuacauguaaaguaguucacuguaacugaaggaagauuuuauuaaaauggagacacuuuguucaagcacauugcuuggagucccuuccauuauggcaauacccaccauucucuauguaauguuuuuaauaagguuggcugucuuuguuacgguuaauauuucugugaugaaacaccacaaccaaaauguugacaagacaggaacccaaggagggcaggaaccuagaggcaggaagugaugcagagaccauggagcaaugcugcuuacuggcuuccuugccauagcuucccagccugcuuucuuacagaacucuugaccacagccuagggguagacccaccuauaauacacuguacugugguccagauucuccaucaauauuuaagaaaauuuccuauaggcuuaccuacagcccuauuaugaaggcauuucuuaaauugagguucccuccucucagaugacauuaucaagaugacauagagcuauuaaguauacuugcccuuucuuucuauacugguaaugggugaauuuuuucagcaaccaguaucuaccauaaugucucuaucacaauuaccauauaauauauauuaggauuacauauuaucuauguaaguuuggauaagaguagacccuuuaggcucaaauauuugcaugcuuagucaucagggagaggcacuacuugagaaggauuaagagguguguccugguuggcaaagguauggccuuagaaaaggaagugugucacuagggguggcugugggguuucaaaagccaggcccaguagcuuucucuuuuuucugcugccaacagucagauguuagcuacuucuccagcaccaguucugcagguuugucacaaugauuuccaccugaauaauaauggaauaaauuuaagauuuugaaagccagucccaauuaaaugcuuucuuuuauaagaguugccauggucaaggugccucuucacagcaauagaauaauaacaaagacagaauuauuucuauaaacuucaguauuuuauauaugaugcuaauauauauacauuuuagaaauuuuuaguaaauaauuugguaucucaacugaucucauuuaugcuuuucuuagaaaaggaagaaguuuguagguguggugguuugaaugcaauugaccugauaggcuaauaaauuugaauacuugguccccagcugguagaacuguuugaggaugaggaugugugauccuauuggaaaacaccaugugacugaaaguaggcuucacaguaucaaaaaaucccugccaccaccaguguacuuucucuuccuucugccugagaacaaacugugagcugucaacuauuccugcugccaugccuuuacuccaccaucaugaacucuaacucaucgaaaccuuuaagugcuuuccuuuuaguugccuuggucaugguuugccaaaguuaauaaacagaaaaguaacuaauagagaaggcaaucaaaaaguuggucagagaaaaaaaauuccaauauuugaagauuuuagaagacauuugauauuguuuccaggucugaucacucacucaugacucuuaaagacauauuuuuauuggacucagacucagaaguagaagcucugacucugcuugcugccuugggccucaacagcugagguacaguaucugucaguccaagaaucuccuucucuuuuuuguuuacagcaacaacuuuaagaauacucauugggggcgcggaguuggcggacaccccaaggucccuagaggacucuccacacgaucuuaggaacacuggugaguggaacacaacuucuguuccaauccaaucgcacaggaccugagacagcauuagggaagcagaaaacccagccuaaucagggucaccaagucccuucugauuggcgccaguaccuggucaccuugugugcagaguuagcagacacccccacagucccuagaggacucuccacaagaucuuaggaccacugaccagacagccccauguuccucaaaggagacaccacuuccaggcacuguaacaugcccaggaucuuugacaacaggaucccaggauaaaaggagcuuggucucaccacuauuucagggucucagaggaacuugacugccaagaacucugacacaccagaaucucagguucacaggagcccauaagcaaaggaucacagagaaagcuggacucugaggaguacugaaucaacugggguuauagaaaagacaggcuccaauaagauauauugaggacagcaaauacuugagauaaacagauggcaggaggcaagcauaagaacagaagcaacagaaaccaagguuauguggcaucaucagaaccaaauucucccaccauaacaaguccuggauacaccaucacacgaaaaaagcaagacauggaucuaaagucauuucuuaugauaaugauggaggaccuuaagaaggaaauacaggaaaauacagaugaacaccuagaugccuuuaaagaggaaacaaaaaacugccuuagagaguuacaggaaaacauuaccaaacaggaguuggaauugaacaaauccauccaggaucuaaaaagggaaauaaaaacaauuaagaaaacccaaagagagauaacucuggagauugaaacccuaggaaagaaaucaauaagagcaucagcaacagcauacaagagaugaaagagagaaucucaggugcagaagauuccauagggaauauggacacaacaacaaaagaaaauacaaaaugcaaaaagauccuaacucaaaacauccaggaauuccaggacacaaugagaagaccacaccuagggauaauaggaguagaugagaauaaggauuuucaacuuaaagggccagcaaauaucuucaacaaaauuauagaagaaaacuccccaaaccuaaagaaaggauguccaugaacauacaagaagccuacagaacuccaaauagccuggaccagaaaagaaauuccucccaacacauaauaaucagaacaacaaaugcacuaaauaaaggcaaaauauuaagagcagcaagggaaaaaggucaaguaacauauaaaggcaggccuauuagaauuacuccagacuucucaccagagacuaugaaagccagaagauccuggacagauguuaaacagacacuaagaggacacaaaugccagcccaggcuacuauaccuagcuaaauucucaauuaccauagagggauaaaccaaaguauuccaugacaaaaccaaauccacacaauaucuuuccaagaauccagcccuucaaaggauaauaacagaaaaaaaacuaauacaaggaugaaaacuaugcccuagguaaagaaaaaaaguaauccuucaacaaaccuaaaagacgacagccacaagaacaaaaugccaacucuaacaacaaaaauaauaggaagcaacaguuacuuuuccuuaauaucucaauaucaauggacucaauuccccagcaaaaagacauagacuaauggacuggauacacaaacaggacccaacauuuugcugcuuacaggaaacccaacucagggaaaaacacagacauuaccucagagugaaaggcugaaaaacaauuuuccaagcaaacagucuaaagaaacaagcuggaguagccaaucuaaugucgaauaaaauugacuuucaacccaaaguuaucaaaaaggcaaggaggggcacuucauacacaccaaagguaaaaucuuccaagaggaacucucaauucugaauaucuaugcuccacaagcuagggcagccacauucauuaaagaaacuuuuguaaaccucaaagcacacauuacaccucacacaauaauagugggagacuucaacacaccacuuucaucaauagacagaucguggaaacagaaacuaaacagagacacagugaaacuaacagaaguuaugaaacaaauggauuuaacagauaucuacggaacauuuuauccuaaaacaaaaggauauaccuucuucucagcaccucaugguaccuucuccaaaauugaccauauaauuggucacaaaacaggucucaacagauacaaaauuauugaaauugucccaugcauccaaucagaucacgauggacuaaggcugaucuucaauaacaacauaaauaauagaaagccaacaaucacguggaaacugaacaacacucuucucaaugauacauuggucaaggaaggaguaaagaaagaaauuaaagacuuuuuagaguuuaaugaaaaugaagccacaacauacccaaacuuaugggacacauuggaagcauuucuaagaggaaaacucauagcuaugagugccucuaaaaagaaacuagagagagcacacacuagcagcuugacaacacaccuaaaagcucuagaacaaaaaagcaaauucacccaagaggaguagauggcaggaaauaaucaaacucaggggcaaaaucaaccaaguggaaacaagaagaacuauucaaagaaucaaccaaaugaggagcuaguucuuugagaaaaucaacaagguagauaaacccuuagccagaugcacuagagggcacagggacaaaauccuaauuaacaaaaucagaaaugaaaagggagacauaacaacagauccugaaaaaauccaaaacaccaucagaugcuucuacaaaaagcuauacucaacaaaacuggagaaccuggaugaaauggacacguuucuaggcagauaccagauacaaaaguuaaaucaggaucagauuaaugaccuaaacagcccuauauccccuaaagaaguagaagcugucauuaauagucucccaaccaaaaaaagcccagaaccagaugggauuagugcagaguucuaucagaccuucaaagaagaucuaauuccuguucuucacaaaguauuuuacauaauagaaacagaagcuacacuacccaauucauucuaugaagccacaauuacucugauaccuaaaccacagaaagauccaacaaagauagagaacuucagaccaauuucccuuaugaauauugaugcaaaaauaaucaauaaaauucuugcuaaccgaaucaaagaacacaacaaaacagucauccaaccugaccaaguagguuucauuccagggaugcagauaugguuuaauauauggaaauccaucaacguaauccacuauauaaacaaacucaaagaaaaauaccacaugaucaucuugauagaugcugagaaagcauuugacaaaauccaacacccauucaugauaaaagucuugaaaagaucaagaauucaagacccauaccuaaacauaauaaaagcaacauacagcaaaccaguagccaacaucaaauuaaauggugagaagcuggaagcaaucccacuaaaaucagggacuagacaaggcugcccacuuucucccuaccuauucaauacaguacuugaaguccuagccagaggaauuugacaacaaaaggagaucagggggauacaaauuggaaaggaagaagucaaaauaucacuauuugcagaugauaugauaguauauagaauugacccuaaaaauuccagugaaccagugaacucccaaaccugauaaacagcuacagugaaguagcuggauauaaaauuaacucaaacaagucaauggcguuucucuacacaaagaauaaacaggcugagaaagaaauuagggaaacaacauccuucacaauagucacaaauaauauaaaauaccuuggugugacacuaaaugaaguaaaagaucugcaugauagaacuuuuagucucugaagaaagaaauuaaagaagaucucagaagauggaaagaucucccuugcucauggaugggcaggaucauuauaguaaaaauggcuaucuugccaaaagcaaucuacagauucaaugcaauccccaucaaaauuccaacucaauuuuucaacaaauuagaaagggcaauuugcaaauucaucuguaauaucaaaaaaccuaggauaggaaaaacucuucucaaugauaaaagaaccucugguagaaucaccaugccugaccuaaagcuguacuacaaagcaauugugauaaaaacugcaugguacugguauagcgacagacaaguagaccaauggaacagaacugaagacccagaaaugaacccacacaccuauggucauuugaucuuugacaagggaaauaaaaccauccuuuguuggaaaaaaagacagcauuuucaacaaaugaugcuggcacaacuggcaguuaucauguagaagaugacgaauagauccauacuuaucuccuuguacuaaggucaaaucuacguggaucaaagaacuccacauaaaacaagagauacugaaacuuauagaggagaaaguggggaaaagccuugaagauaugggcacaggggaaaaauuccugaacagaacagcaauggcuugugcuguaagaucgagaaucgacaaaugggaccucauaaaauuucaaagcuucuguaaggcaaaagacacuguaaauaagacaaaaaggccacuaacagauugggaaaggaucuuuaccaauccuaaaucagauaggggauuaauauccaauauauauaaugaacucaagaagguggauuucagaaaauuaaauaaccccauuaaaaaauggggcucagcgcuaaacaaagaauucucaccugagggauacugaauggcugagaagcaccugaaaaaauguucagcauccuuaaacaucagggaaaugaaaaucaaaacaacucugacauuccaccucaaaccagucacaauggcuaagaucaaaaauucaggugacagcagauccuggagaggaauuggagaaagagccacacuccuccauugauggugggauugcaaguuuguacaaucacucuggaaaucagucuggcaguuccucagaaaauuggacacaguacaauggagaauccagcaauaccucuccugggcauauauccagaagauguugcaacugguaauaaggacacaugcuccacuauguucauaacagccuuauuuauaauagccauaagcuggaaagaaccagaugucucucaacagaggaauggauacagaaaaugugguacauguacacaauggaguacuacucagcuauuaaaaagaaugaauuuaugaaauuccuaggcaaauggauggaccuggaggguaucauccagagugagguaacccaaucacaaaagaagucacaugauauguacuccccaauaaguggauauuagcccagagccuuaaaauacccaaguaacaaguugcaaaacacaugaaacucaagaagaaugaagaucaaaguguggucacuuugccacuucuuaaaauugggaagaaaacaccaacggaaggaguuacagagacaaaguuuggagcugagaggaaaggauggaccauauagagacugccauaccgagcgauccaucccauaaucagccuccaaacucagacaccaacgcauaugccacaaagaucuugcugaaaggacccugauauaguugucucuugugaggcuaugccagugccuggcaaacacagaaguggaugcucacagucagcuauuggauggaacacagggcccccaauggaggagcuagagaauguacccaaggagcuaaagggaucugcaacccuacagguggaacaacaauaugaacuaaccaguacacccagagcucgugucucuaacugcauacguagcagaagauggccuagucggccaucauugggaagagaggccccuuggucuugcaaacuuuauaugccccaguacaggggaaugccagggccaagaagugggagugggggggguaggggagugggggggauauggaggacuuuuggguuagccuuugaaauauaaaugaagaaaauacuuaauaaaaaauauuuuaaaaaauacucauugacaucuagauugcaucccugaacagauucgugcuuccuucguccaguucuccuugcuuuagaacaagaaggucccuugcucagcagcagacacaacuugccuugugagaaaacacuuugccacaugggaaaacauuguuuaucauucccaucacugauuaggaccauauuacccaucuauuauucacccaaagcaucaggaacugcuucuguagcagugugcuucucauagaaauuagagaaacuucaauguaaccaccagaugcuucaaugaguuucugacaagugguagcugggaaggaaauauucaguuucgucuugacacagcagaccuccuagcagcugccacagcaaaauugcucaggguuguucuuuguuuguuugguuuguuuuuucuuuguuguuguuguuuguuuguuugggguuuuuguuuuguuuuguuuuguuuuuuugguucuuugaaugcacuuucauuggucagaauuuuuguuuugcuuuccuuuugacagacugucuuagaaauauuuuuauaccuauuuccaaauacaagaaaaacauaaaauuggcuagcugugccaacuggaggcuaauaagagaauaaguuauugauuuguuguuuucuuuguuagcuccugauuuucuuugaagacauauucaagagggagaucuccgguuuuaaauuugucacugaauuucugauuguaaucagcauuccaauaaguguucuuuaccaucaguauuacuagcuccugcauacugaauacaagucauccuacugaguaucacacuagccauagcauguaguaauggcuauagauuuccauacaauccacugcuaaagaguuucaaguaaauguuugcauuuuagaccuaaacuacuaaaaacuguacaugauuaauuuucuggcugagcuauuuuauucuaaguaauauagauacacguaguuugcauggaaugcuugaggaaucaaauaaagagccuguauauuccugucuuggggggcacaaagcucacaauuaauuuaaugaucaacucaguaccuaaacuggccuaacaagauuagagagcagugcugagugaaaggugaauccuuuuggugggguuugguuucuguuuuucccaccguagaaaguagacaauggcgagcuagugaagcauggagauucuuuguugacuaguaggcaguuaccuauagucuucgugguagaaauauuaagaagaguuagagcaauaggagaggaaucagcacaggcacacgaugugcuuggcacuggaugggccgcuugcuucaucaucuaaucuuucugacaagcaagucucagcgugcccacauacacaggaagagaagagacagaguucccaagaguggaaaccaguaaguaacccccuggaagucagacugccaagguccuuccaauuaaaugaccaagucuugccuuggccaguauauuagagaauaauccuagagaagaauacacuuaaggauaagugaguauagcaaaugacagucugccuuguguacuuaaaaggucagguuuugauaugacucuaucaccuucaaacuaggggcuccugcagaaaguguccuguguaaacagaauaauauacuuaguauagccaaaauuauuggaagaccaaggaggaagaugaagauggugucaguuaugauaaugaugaugaugaugguggugguaguaguggugguaauggugacaaugcuugcuacgacuacaaagaauguauauuaaaaccaucucuuuuugagcuuuguaucauauuauauauuaugauaauauauaauuaucauauuauacguuaugauaauauauaauuauccauuauuuauuaaaauacaucacacaccuccaguuguauugcauuuucuuuuuuacaaggugcacugccuuuuggggcagguauggauaaaggaagagaauauauuaaacaacacaguauguugaagguguauggaaacuauucauaacagacacugaaaauucccaaugaugcagagggcaucucacugcacagcauaucaaaucaaagccacaugcgaaggaguaugcuauugaagaacaaagcaauauaacuauuguuuggagaguuacagaugggaccugguaaaaggcacuguauuaauuauacuguuuuccauggaacuuuccuaagguaacucaggacagcaaggcuguagaacauucacaaugaaacugucaaagaggacuaaacuugagggaccuuugggaaaaaagagauuugaaaauaauguacugccugcccgugguucagacaugccugucucugcaaguaugaccacauuauugauucuccaauguagaaaggaaauaugacuuugucccuuaacugacaucaaaguuacagcacaaugcaucacugcauaaaagcacuugcaaagauuuuuuuuuuuuuauuucagugucccauacaguauccucagagaaaaucaucaugccuaguauuuuaagaugugggcauucgcugcuaaaauaaacaaacaaacaaaaacaaaauucaagagugaggccagcuaggagagagaaaauggguaaauaaauauuuaaaauggacaaauucucagaaccaaagaccuugaaauucuuugcaaacccaggaauccauagaucaggacagacuaauuccaaagaacaguuucauaugggugguuacuugucuaagguuuucuugauuauuaugauccagcagaguauaggacauuucugggcacugauuaucaaacagcauccucacaacaccugucuuuauaaacuaauauaugcugucaaggcuuaauaggcaccggaaaaagcacgauuucucaagcgugguagaagguaugcaaauauuugcaaaagacuuaacaugagagaguacauaaaauggguggaucaagcugguauuuccaacaagaaguuuuauuuuucauuaaaacauagaaaauaucuagccacgucacauggaauuuguuuauuuuucacacacaaaagaccuuaauccaaucauaaggucccagggagucagagcuccauugacauagaacauauauuauacagugcagacaaccauagucucuuggauaagaacccauaacugccuaacacugaacauuuaucaggcagguuagaauccaucagcaaacucaaggauccccagcagagcuugacuggugaggcaaagaaagcagagagaggaucugcugugccacugacaacuaaaacucuauaggcuagaaaggggcaagcucugauggcuccuccauucauuauuaaaggaauauucgggaggauaguaaaucaacaauuucacauauaaucccccccuuuggcuucaaagaugugcuugcaauaaacaagacacaaaaugcuucccguaucucaaaagaaauauugugcauuuuuuuagccuucaagggagcagccuuccacaaaugaauuuggaugcaaacauauucugagacaacuugcagaugggaaucuucucucauaucgagcauauacucuacucuuugccaccggugaauuuaacaaugcaaucagucauggcuaaguagucauagcugauaugaagaaguucacuguaaagauugucuauagcuagcaacgaggacugaacuuugaaacucucuugcugaguuuguauguuuuuaaacuguauuauagagaauuucaagcagauaacagaaacagauaaauaaaaugaaucuuggugcacccauuacucugcaaaaguaaacacuugugcaaagcccggucagccuugcacuagcuauucucaccuucuuccucauuuauagauuugggauaagcuuguagacauugcgcaauuucaucuuaaaauuuucuguccugucucucuccaaagaaaagacuuacaguuaaaccucuagaaaaaaaacgaaaaaagcuaaauuaacaauaugacaauacaaaacacccuuuaaaaaguaaaaaauuaucaaugauaaaaaucaacaauauuagcuagaauuauaaaaaacuucuaccugaauuguaaguuuaaauucaauuucuaauaauuuuguuccuuuugucucauuuuguuuuugagacaaguucucucaacaagaugcccacaaauuuauaaccuuggccuucugauccucuugacacuacauuccaguguugagauuacaaaccaauauaaagacauucaguucauacagugcugggaaucaaaccagggccucuuauaugcuaugcaaccacucaaccaacagagcuacauucccaggcccugucuguauucauuuaauuaaaaagaaaagucuuuaaacaaacucauacaaaugugcuuuaauuaaaaccacugcccuuuugcucucuccaauagaaucagcauaaaguacaaacacagauuuucaauauuguaaaauuuucaguuacuaauuuacacaaagucacaugauuuccauagauaacccaaucacaagcaggcuggcuccccuaggaagccacauccaugauggguacaauaaauacaagcugauaccugcuaagaaaugcccaugccaaauccucacuucauaguuuuuggcuucaucuuauuaagccuucuuaaaaaagagagaaagagagagagagagagagagagagagagagagagagagagagagagagagagagagauagauuagccaggcuggcaaagccagugagagccaugcucucaccacagccugcccuagcaugugagaauagaaguuugagccugcccugcccacaagggagguauaagcagggagaucagagcaaaccgcucugggagcuacuuaagguagguccagcaauugacucuggauggcucuugcaauucuaccauucuucauuuuuauguuuaauuacugcugagagucagaaacacuagcuggaaaaauauuuuucuauguaggggauccacuaauaaaaccaacacuugagagaaugcuguuagguuccacuugaaagcaucuggcaggcucacugcugaucucaccuucucuuaagauccucugaagaaaacacagaucuuauuuguagcaauuaauagauagaguuaugagaacuuccacaggcugaaaguaaucugucuugagcuucccucucaauuacccaaugccugugguuuccuguggugcuuggcaaucuaaggcuugccaacacugaggaaggagccuaucuucgacucugaacacuucaucaucacauuuuacaguacaaagcaguaagugcuggaggccaaaucgcucacaacucaaagaugaugaagucuuuaaugccaagcugcuugcacagcagucuuugcucccgauucagccuccucguuuucugcuaccucaaagacauaagcagguaacaaaguucaaguucauuauccagaaaauccacuuugccagccaaagcaaauagauuuuggaugaacauccuaaauaccaguuuaaaaaugccaaguauuaaaggacccuuuuuuuucuucuucaaguguuugcaagacugccugagaagccaacauucugugaaucuuuugcaaaauauucuaaugauaaugaagccaaaacagaaagcuugcugagacaagcugagacacuuggaugauaaaguugagugcuaccccaguuauggucagaccugugcucugguagcuauaacaggccaacaucagcuccuaguaauaagacaauuaaaagacucaaaugaauagugaaaaguagaagaguucaucaguuguguccuagcaugcagguaagguauaucuaaguguaacuaagcaggcaggucaagguguggccugcagucaccacaaucuccacccuagucuuucugcaaagucagucucaccaguagggcaaccuaacaagcucuaaggcauucuucaggagacaagcuccucuacaggcugccccagagucucagccuuuccuucugccagcaagagauuccuggaaaaauucuaauuucuuggggcucgcuguucuggggguggaagguggcaguggacaagaagcucaggaucaugucuuccuuccugccaggcagccuaguuacauaaggagacgcuuucuuugccugacauaugaaccuuucuaaggugaucaggcaacuagaguggcugaacaacugcagaauuccugugaugacgcugagauguauuuaagaugcgugguccaucccauguauuuacugauuacagccccugcugucuucauagcaaggauccagauacugcagcacugcuauaugcccugcccggcuuauguuuguuuacauuguuuuaaccuguaaaaaguuaucuuuccauugcugggaagagguaccauggccaaggagauauuuacaaaggaaaccaauuaacugggguuggcuuacaguuucagagguucauuccauuaucaucauggcaggaagcaugagacgaucuauucagauauggugcuaguguaagacccugacaauaggucagugguacuuacauugugaugcccccagugagacaccaagaugcagauccaugcaaaagcaagagguuuauuuuuccaggaugucggggucgaccuucaauuaguccuucaagaugagugacuagaaggcagcccugaauggcuauuacaaguaguuuuuauacuuuuuagggucacaguuuacaucagcaagguuacaguuaaaacuuauuggcuaagcauauugaccuuuaaaucuauugccuagcaagcaugggcagaucaugacacgcauuugaacucuaagugggauuuuccagggucaggugacuaucaagucaguauauucuccauuuuuuuuggagaaugguuuacucaagaauguuccuguggguggagacuggaacuuguccuaaccuugacucuagguuggagggggaagcuguaagggacuguaagauuggcaaaagcauuuaggguccuucacuagagaaagaguugagacuucuacaucuugaucugaagggagcaaggaagagugucucucucuucugcuuugggugaaaccuuagcauagacaucaaagcccacccccacagugacacacuuccucuaacaaggacaccccaccuaauaguguuacuuuuugugggccaagcauugaaauacaagaaucuauaugagcuaaaacuacuuaaaccacuacaaaaguuauauuuaaucauuaauugacuaauuaauugaucgaucaguugacuguuugguacacaggccacaguuuguguguuaaagucagugaauaauaugcuagauaugguuuuucuacuuacaccaagcaaguugacugaacuuggguccuuagacauaagcaucuuaaccaacugagcuguguugcagguccugguaguacucaagaagcagucaguacagauaaagauagucagguuagagagguguaccgagguucucacgcuaaaaguccuggauggcaucaggggacauuuuaauucugaagacagacauagugucucuuucuucagcugccauucuacuguguuuguuuacccacuacuugcaaaauuuaguauuuuacaggcaugcaggaauuuaaagcugaacuccaaagaaaagguauacaaaucaguccugucccacaucuaaucuaggugaauucaccuggggucaagaauccugucagaccuggaaauuuccuucuccgggaaaggaauauauuuucuuauaguuggauuuagguuuguggaauaguuuucuauauagcauaagacagccacagaauagcauguuggggaugggggaauuugguaaauggguggcagaaucuaaauaguaguggcugucauugacuuuucauucuaauuuuuaaaauucauuucucugguauacagggaaggugaaggggcagguaacaaccugauucaaagcucauuuucuggguucuuagucuaguuaauaaaagaacuucaaagaagacugagacaggugcuccagggcaauuuuauuagcauuuucaagaaaaacaauaggguaggcaagcuuuaaugcagcugggggggggggggaucagaggaagaaaaaacaucuugccuuuuugaucuaggccccaagaaagcaggcauguuuugcauggaggucuauaggcagcuauagaagaagggguugggauuuucccagaauuuccgggaaagaaugcuuagauucucagccaguguccaaaaaaaaaggaagagggggagaaaagaaaagaaacaaaaauguaaggaaaaaagaaagguucuaacucagaaaaggggugaggcugaggcugcaauucugcauguaacaugugagaggcucagaaauuaggaaggcagaaaugcagcagagguuucucuuuuucuuuuauuagauauuuucuucauuuacauuucaaaugcuauccccuuuccuaguuuccucucugaaaauccucuauacccuccccccuccccgugcuccccaacucauccacuccugcuuccugucccuggcauucaccuauacuggggcauauaaucuuugcaagaccaagggccucuccucucauugauggccaacuaggccauccucugcuacauaugcagcuagagacaugagcucuggggguacugguuaguucauauuuuuguuccuucuauaggguugcagaccccuucagcuccuuggguaauuucucuagcuccuucauugaggacacugugauccauccaauagaugacuaugagcauccacuucuguauuugucaggcacuggcauagccucacaggagacagcuaucucaggguccugucagcaaaaucuuguuggcauaugcaauagugucuguuuuuggugguuguuuaugggauggauccccagguggggcaguccaaguuuucuagaaaggguaaauacauuuucucauuaaagggauaacuauuccucccauuuucaagugacuuagauuggguggaagagaauguugucuccuggacagguguuuggcagaccuaccuggacuaacuuuuaagggaggugacaauagcaugugcuguucuaagcuuugaagcagaaagaaaugccaccuuuccacccagggccauagguuaaaagucagauuucaucuuuuaaucaggaggaaguaguugucucuuaaugagucccaaccaaacucuggcaucuuccuuuuucuguauguauauuuaagucaaaggagaauuaaauaugcugcuuaccuuucuaauguuaugaggggacuaugagucagggccaaggcugaccaugaaggccaguucacagucaaguuagucaucaaugacuuuuaagccgguuaaugccuaugguauuuucccccagaaguaagacuguaaacuaacuuaguagguagaguggaaaggagguguaaaaugguuuagggucucaacuaucauugaauuucacccauuggacagacaauccagaagacccagacggagaguuagacagcagcaaaaccaucugaguucuuaagaguauauacucagaaucugaguauauaagaggaaauuaaaauuaagacggcaaaugaguccaaagauucagaugaguugaaauguggugaugcacaccuuuaaucucaguacucugaagacagagguaagcagcuuucucuaaguucaaggcuaucuuggucuacagagcaaguuccaggacagucaggacuacccagagaaacccaucucaaagaguaaaaauuaauuguaguaaauaaaguuauagcugaaaguagaguacccaaacccccugacacuuguggcauugguccagacacaaccaaaaacguagcagcuucuagucaaggacagaaauugagacccuuauuccuauauagccccaacauauuuuaucuccuguuuucaucuucagggaaagauuuacaacuuaucagaugacccugcaguggagaguagagauacuagugaguggguacccauaacccagcaggacagcuugaucauuuuaaauccuacucuccaguuagagcccacauugacagaacuggggaauaacuagaucuuggugcuuuuccacucuguggccacauuggaaaagaaaucuuggcuuucugcuuucuacuaugaauuuuacuccuuaauuggcuuacuuaggccaauuaacaaaggcuggcuuguuagaguagcaaaagguacaagcucugccccuaacucuagaaacacugcaacuguauauaugaucaucauuauguugacuguaaagacuaaauaauaguuaacucuuucagaaggaaaaucaagauuuaaaaaaaaaaaaaaaaguccagaacauggaccuguagauacuuggcugagauagucugaauaacugcacuaaaacuucucuccacuuuugcuggucuacuucaguuuugaugcauuucuucugguuuuuauguuccacugagagaggauuuacaugcugggccaagcaucuacuaggauggaauuuauaagagugagcaugagcagcagggaggggaauuagagagaaaaaugucuucucacaauuuauaauaaguaauaaaugguacagaaauaauacuuuaacuuuaagcaaauacuauuaauucuuuccccuuccaaaaccaagggcaguggucuagcuuaaaaggacauauacacuugaccucauugaccaaggcaucagcacuaccuaggaaaaccaaguucaacuugaagcucaccaagguagauaagaaauuccauuccaaagugcagaaaucacacagcucauuagaaaauugucaaacaaaacaaacaaaccaaccccaaaccaaacaaacaaaaacccugccuuauaauaccauccaguuucuuggaggauauacuaaaucuuuuuaccacugucuuuaguuugaagaacacauuuaaucagacuaagaucaaacuggaguuuucaaaagucuaugcuauacccuuuggcagguacuguguauagcacugaccccacauacauuaacuagaauaaucuguacccauuccacuaaucacccacaccugcuuuuccauccagcugcucacugagacacucacuagaacaucugccugcucuagauaaagaugcugcacagaucuaaauuagcauaacagaguuuuaaacuauuauugcaaaagaaauauucaauacgcuaauuuccaagacucuaugccuaauuuucauuaggcauacccuaauuuuguuccccaguuuuggcaugaggaccugaaccuauuuucauagccaaaaagauggcuauagucacagauggcuagagaucauaaggaauaccuugcauuucaaguuucccagguaggaaacaggauacucuacaccaaaguaucugcuggggguuuccauuacucugagcaauacacuagcuggaacucagugucccucaaacauuaaacaaagguacgaaucaacccuucaagaagauccucuaacauugucaccuuuaaccaaaauguguaauaacugcaaacucuaaaacacuaagucaaaucaucaggaaaaagcaacauucucccaacaguuagguaaauagcaccuggugagucaagagcugguuuaccugggcauuaaggacagugccugcuguggaucaugagcuagucacagagcucaugaggaugaaugaaugaaugaaugaaugaaugaaugaaaacucucuuugggcugaguguucacauaggguucaugaacuccuuuaccaucuuagacuacaaucuacucaaugaugaagaaucacaauagugacuacugcagucuccauccaagagaaaacaaagacagcaaucagggaagcagaguggagcuccacugauuuugcaggucuucccacagggcagauuuccuucucacuuccuuaacaaaucuugcucuacuuuccagugaguucccugucuuguuuuggccuugagauaaggaaaucagaaaacccugacuuggcauugauagccaucacauuucugugaccccaacuccuccugcacucaguuaaucacaccaagaaaagcuccauugcacucuagggaggcccagcacuaaggagccuuacucauggcacucuuccagccucagaccuggcucuauagagucuuacuuguguauauuuacaaagacaacucuagguguucaguuaauauuucacaaacaccccauuuuggcaaguaacagaauagaacuggcagaaaauaaaaccuacuagcuaccauaccaacacggucuuccagaaauuauauuuuauuauuuuuauaguuagcauuuauucugaacuccuuaauuauuuucgacacaauuauccauguauuaaaauauuuaaaacuucaaacuuacuuucccaaagucaaaacuguagauacuccagaacagguaucuaucuaaccuuuuacugcuucucaaugggguccgggggggggguguuacugagcauagggggucuuacaugaacaaacuauuuucauagauagccucaaauguccaggcagcaacuuuauucacuaccaaguaucaauuaggacuguuagaaaugaguucagguuugcaaagaaaaagaucacuacugaaauuaaagugucucugaaaggcaaaacuuuacucuuagugacaguguuuuuuccccauuggcugggcuugacccacagucuuuccugacugguuaauuuuaaaagaagaaaauaauggagaaaaaggucagguacuuuaacuugagaauguaguauggagggcuuaggauaaacauagguuccauaggguagagggauucaaaauuugcauaaaaaucuuucaaaguagggggauaaaaguuuuuagugccuugucauaaacacaaguuauauaagauuugauaggaaagacucauauuucauguuucuuucaguaccaagaaaaauaugagaucuaaguuugaagucucauuuucucucaugugacauuauuacugcagaaacuguggcucccuuuuggguucuuagucucacuaauaaaaaaauuugaaaaugggcucaaaaggccacaccaggacaauuuuauuaguuugaaagaacagcagggguaggcaagcugugaaucugcacugcugcugggaugagagagggggagaggaggcaggcagaaagcugugccuguugaguuauagccucagaaggcagaguguucaguaauggaggacuagacaguuacauggaggaauuuagacaaggaagcuucagagaaaggguagggaaacccagcauaucaggaaagcaaacucaggcuuuugacuaguaucagaaggaaaaaggaaacagaagaaaaauguuauacuuuuuugaacucagaacagugggugacaguggaaguccuuuaaugaagaagcccggugggcagaugccccaugggaggggcuucuaagaagcuuaaguucaguguuccacuguguacaaauacucaucacuuuuucuuugcuucaggugagucaaaugcggggaagggauuuuagcuccuggucagauaauugacagccuagucuggcuuaacucuuuacagaggagccaugucuccagccaaguucuagagguugaccacaaucuccucugcugugguuagcagcuuucucuuaaugggacucagcaaagcccuggcacuuccaccauuucccuugguacucaaauccuaaggaagggcaaagcuaaaccuuuccuuuccagucuucucaagagaaauagguagugugauccaaagcugacuaugagggagggagccaucagcaguggccucaaaagcugguaauuucuacagcagggaagaagaaaaaggauaacugggggaagaacaggggaccagagagaagggagaagggaaggcuggaagaguguauagugagggagaauaaaagagaauaagggacagggauacauaugaauaucacuagaaaaccucuuacuccucauacuaauucaaaaaauguuuuaaaagcacaucuacuaacucaggcauuaggaacagcuaucauuuauugagugcuuauuuaguuuagagcucuacauguaacuuuaaaaauacucaaaacccacgcuuguugcuugcaguguagaaggcaauccaggguugaacagcguaagucuauuaagucaaaagauguccuuguuuguuuagacaaggguuaggagagucugcuaagaucuggauaacaauguaccacgggcacagcauuggccauugacuuaaguauugggucagaaguugaggcuaccaguuguguuuguucagaauucaccauacaauguaacagguuaagagacucauugacaaauucagacuugaaaacuaaaccauauauauccugacuaagacuagacaguaaagcagagucuguuuauauuuuaaaaaauggaaguagaaaccuuuuguguuccagucacacuagcaccaaaucuuccuccaauccagagcuccacagaaagaagagcucuaacggaaaugcugacacaaccagucucauggugcuucauaugaaaagcugcaauucuuuuuuuuucuuuuuaauuguucacuagaugaaagaaaagcccaacagaacaaaaacauaauaacuaucuagaaacagucucucagaauucuuggauuauagacaaugcacaugaaaugcuauuaucuucggccauagccagaagaugucagacaaucaauucauauaacaugccagcuuaauaaaaucugcauacaaaauuuaugaaugcaguaauauucuuuuuaucacaaguuauuaauggucaauuuaaugaacagcuacagcuggaguacguugggucuguaugauauuuuaaucaucuuuaggcauggauuuaaacauguucauuuuauaaccaucagcuauuugagauaagaaagcuuuaacauaagugcugaaauauuuuuuggguaaguuaccaauuuuguccuaaugcuauuauugauuuucuuagaauuuauuacaauagaaauagaaccaaauguuccauucuaaucauauuugcuuuaaugucuauacuaggaugcaaaaggguugcuaaaaguuucauugcacguucaguuaguuuaaaaucuuuuucuagucccuugccaacaaaagacauuuuagccuuguuuauaugaaacaauuuagcucuaagcuauuacacuccaaaaaguauccugcuggaauguugacaugguagacauacauauuccuggaauuaacaugucauauucccucaaguaucuuacuuauuuccauugacuacuugacauauugcuuuaaaaaaacaaaaacaaaaacaaagacagucuuaugaucagcucuauggauccacuagauucuuuccuaaaauuaaauuuuaacacaugaugcaaaugugggggagacaacaauauuuaagaaaguuggaaaccacacugcuuuuacugcaauaaagacacaaagcaugugcaauauuaaugacuuucaaggacaauaacuaaguguuucucacacuugagcacaggaagcuugguacacaaguuaaacugauuaugaggagucaucagaaaauguggcuaucuggaaaauguaguguaauccauauuggaaguauguccuaagguguaagcccuggcuaaauaggcagguaaguguaacguagugacaacuguguuaguuuuccaucauuaaagacuagagaaaagucauuuuuugaagggcagaggucuauuuuggaugauguuuucaaagguuuuugaucuuagacuuuguuauuuugggcuuugagugagccuugaucuuggcaagagggcagugggagaaggaagccucuuauaaccucaugaccaaaaauugaaagggaagaauaugggacuggaauccuaauauauauccccuuguugagaguuaaauaaaaaugguucucauaagcucauagggggugguaauauuaggagauguggucuuguuagaguagguauagccuuguugggggaaagugugucacugugggugugcuuuaaguuucagaaggucaagucaggccuagugguucacucuuccugcugccuaccaauccagauggagaacaauuaacuauuuccauuucuaccugcauauugaaauacuuuccacuauauugauaacugacuauggcucugaacuguaagccagccccagugaaauagcuuccuucauaagaguugccauagucaggugucucaucacagcaauaaaacucaaacuaagauacucccuagggcuguaucccuggugagcaggagaacucucaaaguucuaccauugcccagcaaugucaaguaaacacaugggcuuuuagggaucauuccacugcuauggcagucacuaaagagugaagguaauuucaguuugucuaaggaauuacacaaggcuaaugaugaaaagucugacaagcccugugcagaggaauuugauguaucgaaaugguaauuugcguucaauuaauuucccaauccuuccauuucuuguugagauacaaauauacuuccuuuaaucuaaguuugcucuagagaaauauauucuauuccugagcuaucauuuacacacaugaauaaaaccacuguaaaacagacuuuggagauuugugcuguggagaaacacugagcaagaaguuagagaaagaacuugcuucugauagaguuggugacaagaggcaccuucauggaauaaacuugugcauauuaacagaggacuggaagaagucagccauggaggguaaagaaaacaacaugcaauuauuuaagaaucauaaacauagacaaacgugaccacaauauguuuuguauuugaaauacaaauauuuguauuuggccuuaaaauauagacagguguacacaaacacacacacacacacacacacacacacacacacauacacacacacacaugcacacacaguguauaucuguaugugcgugugcguguguguguguguguguguguguguauguaaacuacuaccauuauuccccaaauuucucuaguaaagaggauauguacaaacacaguuagauacuaacuaauuaaauuuuaucuuaaacuuccugaaucuguuugacaguucucaucuuacugagugaaccaauauaugcuuaugcugugggguuaaagcaaugaacuugugaagggaacuugucaaaucaaauuaucaacaugcaaugguccugcuguugaguaucugagcugcagugucaauuuuaaaggacuguacuuacacuugcauuugcauuuuaauuaggucacaccuugaacaucaucacauuaauuucaguuuaaugcucuauuuuauugucauuaccaaaaugacauuugaaaauaugggcauaaagaaaaauaccuauacuuuugacaccucauauauauugaauauuuuauucaauauuuagaacaauuuugaauacagaguagaauauuugagauaauauugaagauagagauauuaacugacucuaaaauucaaaauauuuagaguaacagaauuuuuuuaauguacuaagaguaauuauuagauuuuuaccuagaagcauaaagaauuauuggaccaaacaugaggcucagguuucuaaaaaucaacagcacaggcauuuaaaaagucauuaugacccgguuggaucugucugccauccucgucacucugccugggacacagcuugcaaaguuaaguuaugugcuguccccugaguucuacuaucuaucucugcacugaauuuuuguuccugagaauccuucgaagacccccaagagccuccuacuacacuguguaauccugcagagacgccaagaacuaguaucuuagaaucaugcauccccaguacucuguugucuaguccacagcucccccaaguagucuuggugccaucagaaucaucuagccaacacggggagacaacucugcagauagaaauccuaggaaagaaaucaucaggagccauaaaugcgaccaucaccaacaaaauacaagagauggaagagagaaucucaggugcagaagauuccauaaaaaccauggacauaacaaucaaagaaaauucaaaaugcaaaaagauucuaacucaaaauauucaggaaauauaggacacaaugaaaagaccaaaucuaaggauaguagguauagaagagaaugaagauuuucaauuuaaggggccaguaaaugucuucaacaaaauuauagaagaaaacuucccaaaccuaaagaaagagaugaccaugaacauacaagaagucuacagaacuccaaauaaacuggaccagaaaagaaauuccucccaacacauaaucaaaacaccaaaugcacuacacaaagaaauaauauuaaaagcaguaagggaaaaaggucaaguaacauauaaggcagaccuauuagaauuacagcagcuuucucaccagagacuaugaaacccaaaagauccuggacagaugucauacaggcccuaagagaaaauaaaugccagcccuagcuacuauacccaacaaaacucucacuuaccauagaugaaaaaacaaauuauuccaugacaaaaccaaauuuacagaacaucuuuccaugaauccagaacuucaaagaauaauaaagggaaaacuccaacacaaggaggggaacuacacucuagaaaaagcaagaaaauaaucuuucagccaaccuaaaagaauggagucacaugaacagaaucccaacuuuaacaaccaaaauaacaggaagcaacaauuacuuuuccuuaauaucucuuaauaucaaugggcucaauucauaaauaaaaagacauagauuaacagacuggcuacauaaacaggacccaacauuuugcugcauaaaugaaaucuaccucagggacaaagacagacacuaccucagaauaaaaggcuggaaaacaauuuuccaagcaaauggucugaagaaacaagcuggaguagucauucuaauaauaaauaaaauugacuuugaaccuaaaguuaucaaaaaacacaaggagggacacuucauacacaucaaaguuaaaaucuaccaagauaaacucucaauacuuaacaucaaugcuccaaaugcaagggcauccagcuucauuaaagaaacuuuaguaaagcagauuauacacauagcaccacacacaauaauaaugggagacuucaacaccccacuaucaucauuggacagauccuguaaacagaaacuaaacagagauacagugaaacagaaguuaugaaacaaauagauuuaacagauaccuauacagcauuuuauccuaaaacaaaaggauacaccuucuucucagcaccucaugcuaucuucucaaaauugaccauauuggucacaaaacaggccucaacagauacaaaaauauugaaauaauaccaugcauccaaucagaucacccggacuaagccugaucuuuaauaacaacauaaaaaauagaaagccuacauacacaugaaaguugaacaauacucuacucaaugauaacuuugauaaagaagaaauaaagaaagaacuuaaagauuuuuuagaguucaaugaaaauuaagccacagcauacccaaacuuaugggacacaaugaaagcaguccuaagaggaaaacucauagcucugagugccuccaaaaagaaacuagagagagcacacauuagcagcuugacaacacaccuaaaagcucuacaacaaaaggaagcaaauucacccaagaggaguagaaggcaggaaauaaucaaacucagggcugaaaucuaccaaguggaaacaaaaagaacuauacaaagaaucaaccaaaccaggagauaauucuuugagaaaaucaacaagauagacaaacccugagccagacuaacuagagaacacauggacaguauccuaauuaacaaaaucagaaaugaaaaaaggagacauaacaacagaaccugaggagauccaaaacaucaucagauccuacuacaaaaggcuauacucaacauaacuggaaaaccuggauaaaaugaacaauuuucuacacagauaccagguaccaaaguuaaaucaggaucagauuaacaaucuaaagaguccuauauccccuccagauaaagaagcagucauuuauagucucccaaccaaaaaaaaagcccagaagcagagagguuuagugcagacauucaaagaacaccuaauuccaauaguccucaaacuauuccacaaaauagaaagagaagguacuuuacuuaauuccuuccaugaagccacaauuacucugauacauaaaccacacaaugacccaacaaagaaagagaacuucagaccaauuuuccuuaugaauaucaaugcaaaaauacucaaaaaauucuugcaaacugaauccaagaacacauaaaaaugaucaucccuacugaucaaguaggcuucaucgcagggaugcagggauaauucaacauauggaaauccaccaacguaaucugcuauauaaagaaacucaagggaaaaaaaaaaaacaaaaaaaaaccaugaucaccucauucaaugcucacaaagcaguugacaaaaucuaacacucauucaugauaaaaaucuaggaaagaucgugaauucaaggcucaugccuaaacaaaauaaaagcaauauacagcaauccaguagccaaaaucaaacuaaauguagagaaaguugaagcaaucccacuaaaaucagggacuaggcaaggcugcccacucucucccuaccuauuucaauauaguacuugaaguccuagccagagcaauuagacaacaaaaguagaucaaagggauacaaauuggaaagaaaguagucaaaauaucacuauuugcagaugauaugauaguauauauaagcaacccuaaaaauuccaccagagaauuccaaaaccugauaaacaaccucagugcaguagcuggauauaaauuaacucaaauaaaucaguggccuuucucuacacaaaggauaaacaggcugagaaagaaauuagggaaacaacacuguccacaauagucacaaauuauauaaaauacuuuggugugacucuaacuaaguaagugaaagaucuguaugauaagaacuucaagucucugaagaaauaaauugaagaagauuucagaaguuggaaagggcuccuaugcuuauggauuggcaggauuaauacaguaaaacuggcuaaugugccaaaaagcaaucuacagauucaaugcaauccccaucaaaauuccagcucaauucuucaaugaguuagaaagggcaauuugcaaauucaucuggaauaacaaaaaaccuaggauagcaaaaacuauucuuaacaauaaaagaaucucugguggaaucacuaucccugaccucaagcuguacuacagagcaauugugauaaaggcugcaugguacugguacagugacugaccaguagaucaauggaauagaauugaagacccagaagggaacccacacaccuauggucccuugaucuuugacaaaggagcuaaauccauccaguggaaagaagacagcauuuucuuuuuuuuuuuuuccauuuuuuauuagguauuuagcucauuuacauuuccaaugcuauaucaaaagucccccauauccacccaccaccacuccccugcccacccacucccccuuuuuggcccugguguuccccuguacuggggcauauaaaguuugcaaguccaaugggccucucuuuccagugauggccgacuaggccaucuuuugauauauaugcagcuagagucaagagcuccgggguacugguuaguucauaauguuguuccaccuauaggguugcagaucccuuuagcuccuuggcuacuuucucuagcuccuccauugggagcccuaugauccauccauuagcugacugugagcauccacuucuguguuugcuaggccccggcauagucucacaagagacagcuacaucuggguccuuucaauaaaaucuugcuaguguaugcaauggugucagcguuuggaugcugauuaugggguggaucccuggcuauggcagucucuacaugguccauccuuucaucucagcuccaaacuuugucucuguaacuccuuccauggguguuuuguucccaaaucuaaggaggggcauaguguccacacuucagucuucauucuucuugaguuucauguguuuagcaaauuauaucuuauaucuucuguauccuagguuuggggcuaauauccacuuaucagugaguacauauugugugaguuucuuugugaauguguuaccucacucaggaugaugcccuccaggucagcauuuucaacaaguaauuuucaacaaggguucagcauguaguagaaugcgaauugauccauucuuaucuucuuauacaaaccucaaauguaaguggaucaaggaccucaacauaaaaccagauagacugaaacuuauagaggagaaagggggaagagccuagaagauaugggcacagggggaaaauuccugaacagaacagcaauggcuuaugcugcaagaucaagaaucgacaaaugggaccucauaaaauuggaaagcaucuguaaugcaaaagacacugucaauaagacaaaauagcacccaaucgauugggaaaagaucuuuaccaauccuaaaucugaucaagggcuaauauccaauacauacaaagaccucaagaaguuagauuuuagaaaaccaaauaacccuguugaaaaauuggguacagagaauucucaacugaggaauaccgaaggacugagaaguaccuaaaaaaaauguucaacauucuuaaucaacaaggaaauguaaaucaaaacaaccgggagauuucaccucacaccagucagaauggcugagcucaaaaacucaggugacagcagaugcuggugaggauguggggaaagaggaacacuucauugcugguggaauugcaagcugguacaaccacucuggaaaucaguuuggcaguuccucagaaaauuggacauaguacuaccagaaaauccagcaauaccacuccugggcauauacccagaugauguuccaacuuguaauaaggacacaugcuccaccacguucauagcagccuuacuuuuaacagccagaagcuggaaaaaaacccagaugucccucaacagaggaauggauacagaaaaugugguacauuuacacaauggaguacuacuuagcuauuaaaaacaaugaauuuaugaaauucuucgacaaauggauggucuggaggauaucauccuaagagagguaacacaaucacaaaagaacauacaugauaugcacucacugauaaguggauauuaggcccagaauacccaagauacaauuuacaaaacacauggaacucaggaaggaagagcaaagugugucuacuucaauccuucuuagaagguggaacaagauacccauggaaggaguuaaaucaaaacaaccuggagacaaaguuuggagcagagagugaaggaaugaccauccagagacugccccaccuggggauccaucccauaaacaaccacuaaacacagacacuacuacagaugccaacaagagcuugcugacaggagccugauaaagcugucuacugagaugcuuugccaaugccugacuaauacagaaguggaugcucacagccauccauuggauggagcacagggacuccaaugaaggagaaagagagaguacccaaggaacugaagggguuugcagccccauaugaggaacaacaauaugaacuaacaguaacuccacagcucacugggacuaaaccaccaaucaaagaaaacacauggugggacucauggcucuagcugcauauguagcagagaauggccuaguuggucaucaaugggaagagaggcccuuaguccuuugaagguucuaugccccaguauaggugaauuccuggaccaggaucggguggguugggagcagggggaggaagggaagggauaggggauuuucagagaggaagguaggaaaggguauaacauuugaaauguaaauaaagauaauaucuaauaaaaaagagaaaaaauuuaagaaaauuuuaacacaagaaauacauucacaauauuaaaaccaaugaacacacacacauacacacuuacucacucaccaucaccaucaaaauaaaaguaaauaauaaucauuggucauuaauaucucucaacaucaguggacucaauucuccaguaaaauggcacagagacaaagacuaacagaugcauaaacauaauccgcuauucuguuguacaagaagcacaucucagaaacaaagauauucauuaucucaguauaaagggcuggaaaaagauuuuccaugcaaauagacacaagaaacaagcaggaauagcaauucuaauauuuaauagaauagacuuucgacugaaaaacagacaaggaaaaaacuucauacucaucaaaggaaauauccgccagaaaaacaucuuaauucugaacaucuaugccccaaaugcaagggcauccacauucauaaaagaaauauugcuaaagcuuaaaucacacaaugaaccuuacauauuaauaguggaagacuucaacacccauuucucaccaauggacgggucuucaagauagaaacuaaacagagaaauaaugaaacacagguacugauucaaauggaacuaacagauauguguggaauauuucauccaaacacaaaagaauauucuuucuucucagcaccugaugaaccuucuucaaaacugaucauauauaaucagucacaaagcaagccucaacagauagaugaagauugaaauagccccaugcaucucaucagaccaccaugcauuaaagcuggacuucaacaacaauagaaacaacagaaagccuacuuauucauggaaaaugaacaacuuucuacucaaugaucaccacgucagagcugaaguaaagagagaaauaaaauacuguugagaauucgauggaaaugagagcgcuacauacccaaauuuaugagacacaauggaaggugugcugugaggaaaguuuauaacacuaaauuugcucauaaagcaauuagagaguccucauacuaaagaauuaaaagcacaucugaaggcucuaggaaaaauagaagcaaacaaacccaggaggaguagauggcaggaaguaaucaaacucaggucucaaaucaaccaauuugaaacaaagggaauaauacaaagaaucaaugaagccaaguacugguucuuugagaaagucaacaggauagucaaacccuuaaauaaacuaacuaaaaguuagagacaguacccaaauuaacaaagucaaaaaugaagagggacacguaacaacagacacagaggaaauucaaagaauaauuaggucucacuucaaaagccuguacuccacaaaauaggaaaaucuaaaugaaaugggugacuuucuauacauauagcacauaccaaagcuaaaucaaaaucaggucaacuaugugaauauuccuauaacccuuauggaaauagaggcagucacuaaaaguuucaaaacaaacaaaaacaaaaacaaaaaagccuucugccagaugcauuucgcucagacauucaaaaaagagcuaauaccaauacuccucaaacuaucccauaaaauagaaacagagggaacauugccaaacgcauuuuaugaggucacagucacccugauaccuauacuacacaaugacuaaacaaagaaagagaauuucagaacaauuucccuuaugaagauugagcaaaaacagucaauaaaauacuugcaaacugaauucaagaacaccucaaagacaucauccaaaaugaucaauuagguuucauuccagggauacaggggugguucaauauaugaaaauccaucaauguagucuaccauauaaacaaacugaaagauaaaaaccacaugaucaucucacuagaugcugaaaacacauuuaacauaauccaauaccccuucauaaaaaaaaagucuuggagagagcagggguagaaggugcauaauuaaacacaauaaaggcaacauacaacaagccaauaaccaacagcaaauuaaauugagcgaaauuuaaagcauuuccacuaaaaucagggacaacacaagguugcccacucuaccaccaccccacccacaucuaaucaauauacuuaaaguucuucuaacuagagcaagaagacaauuaaagaucaagaggauacaaauuggaaagaaggaagucaaagaacuguuauuuguagauaauauaguauacauaagugacccaaaaaaauccuaccagagaauuccuacagcuaauaaauaucuuuagccaagugacuggacacaaauuuaacuaacauaaaucaguagccuuccucuacacaagcauuaaacaggcugagaaagaaauuagggagacaguacccuuugugauagccagaaauaauauaaaauaccuuggugcaacucuaaccaagcaacugaaagaccuguaggacaagaacuucaagucucuggagaaagaaauugaggaagauaugagaaaauggaaagauugguagguuuaacauaguaaaauugccaucuuaccaaaagcgaucuacaaguucagugaaaugcccaucaaauuccaacacaauucuuuacagaucuugaaagaacaauuuucaacuucauuuggaaaaacaaaaaaaccagaauagccaaaacuauccugaacaauauaaaccucuggaagucccugaguuuaagcuguacuucagagcaauaguaauaaaaacugcauggugaugauauagaaauaaacagauggaucaauggaauugaauuaaagacccagaaauaaacccacauaucuauggauacuugauuuuugacaaaagcuaaaaccauacaauggaagagagagggcaccuuuaauuaacgguuuauaacgucagcugcaaaaucucucugcuuaguuuuugucuugaucaucaauuacccagauguucuuuagcaaaagugagguauugaacuuucccacuccagugcucaggagucaauauaugauuuaagcaguagucaugauucuuuuaagaaugugggugccccuguguaccagauauagauacuaagaauuggcauguucucugaaugucuacaugcagaaaaaugcaaauagauccauauauaucucccugcacaaaacucaaguccaaauggaucaaagaccucaauguacaaccagauacacuaaauauaauagaacagaaagugggaaacagccuugaacuggucaguacaggagacaaauuccugaacacaacaccaauggcucaggcacuaaugucaagaauuaauaaauggaaccucaaaacugaaaaacuucuguaagucaaagaacacugugauuuugaggaaaugagagccuacagauuggggaaagaucuucacuaacccuauaucugaagagggaaauaaccaaaauauauaaagaacucaacagguuaggcaccagcaaccuaaauaacccaauuuaaaaaugggguacagaucuuaacagagauuucccaacagaggaaucuggaauggccaauaaguaccuaaagaaauuguucaacauucuuaguaauuagggaaaugcaaaucaaaaugacccugagaucucaccuuauacccaacagaaugacuaagaucaaaaacucaaaggacagcauaugcuggugaggcuguggaacaagggaaacacucccaaacugcugguaggcaugcaaaguuuuacaaacacucuggcaaucaauuuggcaguuccucaaagauugggaauuucuaccucaagacccaacuauacugcuccugggaauuucuaccucaagacccaacuauacugcuccugggcauauagccaaaagauguuccaucaucccacaaggacacuugcucaacuauguucacagcagcuuuauucauaauacucagaaacuaggaacaaucuagaugucccucaacugaagaacugauaaagaaauugugguucauuuauacaauagaauacuacucggccauuaaaaacaaagacaucaugaauuuugcagguaaauggguaaaacuagaaaauaucaaccugagugagguaacucagacucaaaaggucaugcauaguauguacucacuuauaaguagacauuagccauaaaauacagcuuuauguauuuuaaacguguaauaaucaacagacccaaagaaaccaaauaacaaggaggacucaaaggaggaugguuagucuuucucagaaggagaaacaaaauagauauuggagguugauggaaggagggaacuggguggaagaggggaagagauggggagugaggagcagagguuggaggaagaucauauguagggagagagaaggaaaaucaguggugguggcugugcaauuucuaggaugugccagagaccugggaaggggcaaggccccagaggauauauaggggcaacucuaguugagacuccuagcaguaggggauauggacccugaaguggcauuuuccuauagccaggcaggacucucaguaaagggauaaggacaauaacccacucagaaaaccuuugacccaaaauguguccuaccuacaggaugugcaggaacaaagauagagcagagacugagggaaaggcuaaccagugacugccucauaccauggguaagaauuccuugacacuauuaaugauacucugcuauucuuauagacaggaaccuggcagaacuguccucugagaggguccagacagcagccaauggaaagagauguugagacgcacauccaaauauuagaugcagguuggggauucuuacauuugaguugggagaaggauugagcagccugaagaguauagguacuccaacagagguaaguaaccuggauccuugggggcucccgcaggcugaauuauuaaccaaaaguugaggacaugcuggaccuaggcccccuacacauacauagcagaugggcaucuuggucuuuaugcacaucccccaacagauggaguauaggcuguaccuaagcauguugucugccugucuguggacuccacaacccuaaauagagggaucacuuugucuggccucaauggaagagaaugugggugggggcggggagucaaggguggaggagguaauuaguugugugugugugugggggggggugagacccagaguggaacuuccccuucucaaaggaaggggaagauggaauggcuggagaguuuauaugagggaauacugguaggaggggugcugauacuaggauguaaagugaauaaauauauagaaaaagaucuguaaauauugauuggguuucaauugaaucuguagauuucuuucgguaggauggacauuuuuacuauauuaauuuaaccaauucaugagcucaugaggaaacucuuccaucuucugacaucuuucauuuccucuuucaauggcuucauguuuuuacuauccaaguuuuucacauucuugauuagaguuacccuaagauacuuuauauuauuugaggcuauugugaaaaguguuauuucccugauuucuuucuuagcccauuucucauuuguauauaagagagcuaaagauuugcauuaguuaacuuuguauccaacuacuuugauuaaacuguuuaagauuuaaaggaguuuccugguggauuuuucaggguuaccuauguugcgggaagucuuaaaaaagaaggcauacuaucauaucuacaauuaaagagacuuuaacuucauccauaaaguuaugagaagguuauuauuugcuuuuggauguaauguguaaauaucugucagguugauuuggcuuauaacaucaguuagcugcagaaucucucuguuuaguuuuugucuugaugaccaguuaccuagaugcuccuuucccacuguuuuaagcaguagucauggugcucuuaagagcuugggugucccuauguguuagguauagauacuaagaauugccauguucucucaauguuaacguguguuucuuggaugcagcagauggauggauccuguuuccuuuccauucugauagucugugucuuguuauaugguaacugaggucauugaugauaaaugauaucaaugaaaaaauuuaauaacaagucauuuugauuuccacuuccauuugaauuaaggcauaccuucuauuaugaguuuguugcggauacugaaagaggcaguagacaaaucauaaaaagucuucucuccacuucaaaaaacuauauauucaaguacacuuuuaauaguucuaauuuuggaugaauggacucaaucaacuaaaucauuucaaaguauaaaauccagaggcauuuggucuuuuuacaguauggguucccuucaucaagaucugcuuuggaagacuuuuccauccccaaauagcauuuucaaauaacauuccagcuaauaacauccauguggcugaggaaaagggguuaguguauagcacuuauccaccaugaaugaggcccuagcuucuuuuuccagcacccaagaaaggacaguggacagcagagaaguagacauagaacugcagagacaagaggaggaaucuuggaggaaaacuggcuaauuuccucauuuaccaaugugggguuuuuuuuucauuuuccaaaaugauuuuaaaauucccauggggcuuuguauuuaauauuuaugaggucauaagggguuucacucaaauacuuccaaacuaauuagccagugacaaaguuccauuuaguuuucuuuggaggggggggggcauuuuauaacauuagaaugcaagucuauacauaaaguaauaaagggauaaaagaagaccugaaaacagaaacuauacuuggguucauggcuaaggagacuacaugaguccugugcuggcuaguuuuauguaaacuugacacgaacuagaauuaucugagaggaggaaacuuaauggaaaaaaugucucaauaagucuaaaagaaauacagggacaaagaguggaguacagacugaagggaaggccauccagacacugccucacuugagaauccaucacauaugcagccaccaaacucagacacuauugcugaugccaagaaguacuugcugacaggagcgugguguagcugucuccugaaaggaugugccacagccuuacugauacagauguggguacuugcagucaaccaucagacugagcacagagaccccaauggaggaguuaggggaaggacugaacaagcucaaggggcuugcaaucccauaggaagaacaacaguaucaaccaaucagacacucccagaacucccagggacuaaacuaccagccaaagaauacacauggagagacccauggcuccagcugcauauguagcagaggauggccuuaucuggaaucacugggaggggaggccuugguccuaugaaggcuugguaucacagcauagggggaugcuauagaggugagguaggggugggugggugugugggugggggagcacccucauagaaggaggggaaggguuggaauaggggguuugcggaggagaaaucaggaagggggauaacacuugaaauguaaauaaauaaacaauacauuuuuuuuuuaaaucuggguauagggcaaauucuuaauugguuauugaugugggaggguccagcccauuguggguggugacaucauuggucuggugguccuggguucuauaagaaagcaggcagagaaagagccaugaggagcaggucaguaauuagcauucugucauggccuuugugugucagcuccugccuccagacuccugcccuguaugaguuccuguccuaacuuccucugaugaugaacagugauauggaauuauaagacaaauaaauccuauuuucacaaguugcuuuagucauggugguucaucauagcaauaauagcacuaauuaagaccacuccgauauaugaaaucugugucaaucaaucuauguauuccaugcuauuccuaauaaguacuaccucaagauguuugcucacagaacuugacaagauaaaaaaaaaugcauuugaagaagcgaaggaugaagaguagcuuaagaaaauacaaauaaagaauggcccucuguggugaagcucggcccuuagugcagcagucagagugcugcauaucgagacacaggagaguaaaugaacucaauggacaggaaagaaacauuuucuggagaagcucauggcagaagugagguaaugcaucagauauccucuguguccuucccuagaagacuuuucauagaagaccuuuacagucucaacguugcucuagauugggaauuucuggguuggguugcaaauuauuuuaagagaccagugaguaaaagcucuacaucuaggaccagaguucaagucccauuacacacuuuugcauguacacacacacacacacacacacacacacacacacacacaacuuaaaaauaauuuuugauuaaguagaggcucugcaaacagacuaugucagucucugucacaugcccucaacccugucagggcaacaaauaaauaagccauacucuaugaaccacagcuguguucuaauaaagcuuuagcuacaaaaucagguauggaauuuaacuucagaugacauuucaauacaugaaaagucaucagaaauaauacugcuuauccuauuuuccuaauuguaagguaucuuaucaacuuuucuguaugaaucauugcuuugcccaaauuucaaccugugaagaaauuuuacaaaacugaaaauuaaucuguauagaugaaaaauuccauaaaugaugaaaaugucuuucuagauuuauagaauaccaacuucuuucaagaagaguguauaugaucugauuugcucaauuacuaauuguaauugguuccauuuauuuaaauuaggcuauuaaagauuucuguaguaaaauaaauacacauaucuuauugucaguucaaccaagggguugaaaugacaaggacagugcaauuauucucucuguacaaauaauagguuugccauuucaccugaauaauuccuuguaaucaugaauaaugauguuauuugacagccuaaugauaucaugcuguguugcuucaacccaucaaucuuugucaagaaggucaaauauuuguauuccacugcacuagccaacguugaacaaacaguuaaacaauaucacguaccuuuauuacgccuccaaauaaagccagugaauuccauuucacucaaccuaugaaaugcacaucuacuucaaauauauuaaauguacauuuuuaaacaaaguuuuggcuugacuuaaaaaaaauagccaacucgagcuauuaagauggcucagagaguaaagcugcugcuggcaagcuagagaacuggaguucaagcccgggaugcauauagaagacggaaaaaugugacucuuacuaguuguucccugaucuuaauugguuguagccagaaauuuaacugagauuaaugaaaaaacuuucuggaaacuucuguauuacagauaucugaaauaucccagaggauaucuugcaauugucauggaggcugugagaaccaagcaguaauaauacacaacacacuguaucacaacgcucacagccaagugcuuuauaguaauaagcagcucugggaucagguccagauagcuggaagggacggcacuuuucuaugcacucuuucuacagggccuggaccaaaccugggcugcuuggagaaaggauaguaagagcaaguagguaugauguugagaugcucauaugucacuacugcagacacuuuuuuguauagaugacgaucaucuccuguuuucuuuucucccacugucuccguucaggcuuacuauugacaucaugguauauaucacuggacacagagagccuccuucuuaccccuguuacugcucuaucuuguagcacagaucuaucccgcacucauugguguguguuuuagacaguagugaagaaucaaagucauuucuuccuagaagucucugcucauggucccuuuaccuaggauucucugucaauuguguuucauaggcugcucccuuuugcuuaucagggccacaaaucacauuucaccaggaaaaaaaaaaagguucucuucuguaugaaguaguccuuuguucuugaucuuguucuuccaguuuuuuuuuuuuuuaagaacuaaaucauaguuuagguuaucggcuucuauuuauauauuaaaccucuuguuguugauacugacacacaaaagugaaaguaugacucuuagcagagugcauaggaauugauauggaagugaugggggcagagggaaagggagaaaugauauaauauuuaaguaauuaagaaaaaaaagauggaacacagggcccccaauggagaagcuagagaaagaacccaaggagcugaaggggucugcaaccauauagguggaauaacaauaugaacuaaacaguacccccagagcuccugucucuaggugcauauguagccaaagauggccuagucggccaucacugagaagagaggccccuaggucuugcaaacuuuauauaccccaguacaggggaaugccagggccaagaagcuggaguggguggguaggggagcagggcgcgggaaggguauagggaacuuuugggauagcauuugaaauuugaaauguauauaaagaaaauaucuaauaaaaaaagaaagaaagaaagaaagaaagaaagaaagaaagaaagaaagaaagaaaggaaggaaggaaggaaggaaggaaggaaggaaggaaggaaggaaggaaggaagauagauugaagauacccagaauggaaugcuaagcuuagauccugaaucuccuuuagaugaagaaguucacuucuuucagacaagcugcuaugucuuagggagggacagaaaccuaauggaguuuuauaagacuugggugaauugaaauccuccagcaaaacucuguagcgcuacauugccaagugacagauuggcacuccauucucugggucaacuggcugacuauaaguguguuaacagcaucugaucuccaguaaauacuguacaaguacuugcuguuuugaagcaucauccccaucaaguaacauagaacuuggcagauaacagguaauauuccaauuuguugagcugacucaaagugaaauagaaucuuugagccagaagugcuuacaggaaaacuuguaaaauuugugaucaaaaaacugacucacacuucuaagaauaagcuauucuggaaaauaaguuuagccccaagaaaacauuucucauuaccauuuauaaggaugacucaaaaaacauuugaugcaaagggccagacuucaauacacacuuaaucuuaguugauaacauuuuauaggcagucauuguuuaucguauauaaauuauggguacauaaauaaaaaaguugaacaguaauucauguacuagcuauguagguuacaauaacauuacacaaaucucucuucuacagauauuucuuugaaauuaaaagaugaaaacuaacccagauuuucauaaggucuuccaaucaugacuaacugguaugcauuaugugugcacaucuucaggucuggaacauugccuuucuaaucuggcuucuguguguguguuacauguuaccuagaaggcuuuguuuuguuagaaauucuaauuucuauuucuuaucucaauuuucuaaguaaaaaucuuagaaccaaaaagucagacuuagccuaucugacauuuuagccaauaccuuaggugauuuuucagcucccuggaaauuugcucuuagccauaccuuuuaugaaggccuauauaaagacaauggaagaacaaagagauuguucauucuucaccugcuugcacucacuuugccaguauauucacuggagccuacuacuuugggauuccugauuauacaaaagaccaacugaaacauccagccucaugggacugagcaauuacuagauucuuggaccuuccauucacaguuggcaauuuuuggaucaguuggacugcagccuaaaaauuauuccaauaaguuccauacagagagagagagagagagagagagagagagagagaugcacacagagauacacacacacacacacacacagagagagagagacagacagacagacaaacagagacagacauagagagagacagagauucauuucaugaguucugugaccauuuaaagaaccauacuaagauggaaauugguaccagggacuacauuauugcuaugauaaaccaggccauguuuuuauuuggaagaaugcagacuuugagacugugaauuagaaaaugagaugaaggcuuuaaguggggauuaauggcaauucuaguccgaacauaggaggcaguacugccaagggugauuugaacuaugaggauguagcucaagaaguuuuagaggaggaaaacuuauaguaugaugcuuaaagaucauuguucugauauucuggugaaguauguagcuuuuugccuuuguccuaauagugugccugaggcuaagguaaagagauuucaauugauugcacuggcaaaccaaaucucaaaacucaaaaaagcccaauauagauucuguccuguagugcacucucaugaagagccuuuugaucaagcauugcaagacagucaguaagcagcaauccuccauggcuucuguacccagguacccccccccacuugagauccuguucagaguuacuauaacgauggacuauaaucuggaaauuuaagccauauaaaucauuuucuacccuacuuucuuuuuggugaugguguuuuaccauagcaaaagaaaccccaaaacacacuccccacucuguguguguguguguguguguguguguguguguguguguguguguguaacaucuuagaugaggugccuacaaacaaacauacaaaguuuacaauaauaugugauugacagcucacugaauagacauauaauaagauuucagagaaagaagcaauaaagcuguucuaacuuuucaguaacaggaaaaauuauuuucuuugaucccucucaucauacaggcaggaaaagaagugaugguagcugucacucucaguagacaucuacaaccuguucuuccugaaguuaagcuguuagaucugagaacacaggaagagagcagcaacaacuacaccuuucucagcaauuaauacacagcccgaggaagauugcuagguauucaaaaucugccccuaagucaaugcagcucaguggucucagaagaauaaagaauaugaugaacaagaaacuggacaauggugcuaccuacuucuccaaagagcuguucuggaugaccacauacagcacagcuugcaugccccuuaccauagcaccugggauacaaaucacuccuuauuucccacuuaauuaaagugaaaaaauuacuugaccuuaaguuaccuuucucauacacuuaagucuagaccuacgaaguucugaaagcaaaacacccccuauuuucuaacaccccugaugaacuuucuuucaguaaugccauuccccauuaacaggcaucauuuuauuguuuaucuuuuuuuuuuuugauauauuccuacuguguaacaaacauugugguaggcucuuaauaggaccaacucuagacccuaaauuuauugacaguaacuaaguugugugaagccaaauggcugaaaagagcccuggguuaauggcacaggcauauuuauaugcuccaaauuaacaacacauaugauaugucugcuauaaauauggucccaacuuagaaauccacuauggugauucuucuuaaauguauacuuaaguuauuccucuuaagaaguauauugugacauaaaauucauuuauacacacacaagaagaaauguccugaaaacaacaaauaaaauugcuuagaaugguucuaggccaauuuggaaugagaaaauuauguuguuagcuccaaauuuucuuuagcugaggguuugcauagacuccuuauuugacccuucacucacucucaacuaaaauggggugguaagcuuuuugaaagcuguucaaggaaguuguagugacaacucagaaguuaagagcacuggcugcucuucuggaagacccaagguugauucccagcagaccaugacuagcaccaguuccagaagauaugaugcacucuuuaagcaucuucagacaccaaguauacacguauauaccaaguauauaccaaguauauacacaaguauuggugcacagacauagugaagacaaagcacccauacacauaaauauauauauauauauauauguauauauauauauauauauauauauauauauauauauauauauauauauaaacuuuuaaaaaacuguucaauaguaugugaccaaauaggugugaauucccauuagacuauucagauguauagaccguguguguucugcagagcaucccuguaucaccuaacaguugaggugguuucccaaagagugagcaauccuaucgugucugcaucauggaaccagaagcaaagagccaaaaccaggugaaguuaaguaucaaaaagaaaaucaauguacuguuaccaaaccauugaaaguaaaauauaagaauauauuucggugggaaggaaaugcucccgugcuguuaaaagcagaauuaacagcacaucauauauggaaauuuagccugcacuauaauaaaacaaaacguuuucaaagauuaacacuuuucccucuuggcaacaggauuaagagguuuuuuucuuuuaauuucuucaugguuuuguaacugaaaaauguaacagcauuaaacuuucauucauucuacucauaagaaauacauguagaaaaaaaggaauacauuuggaaaagaaggaaaauaagucacucucuauguggguauuauggauuauauuguagaguaaggcuagauuugcugcacagauaaacaacccaucgcauaaauaauaaaguaaauaagugaacuaugcugugcauuuucagucuuuaagucuuuaagcauuccuguuauuuaaccauguucagagucucucacaccaauuccacucuuaagucuguggcugaacauuggcaauucaaguuccuccuuguucuaacccaaguauuucacaucccagccauuugcuaauuaugacaucauuaaaugacaaagcuaaugaaaggauaccagauauaauauguugauauaaagagucucaggaagcuuugagaaguucuaagacagcauauaauaccagaguagagcugcauacaaccgcaagugagaaaucaauagauuagacaaauaaggaaaguuauugcaaauuaaaaugcacuaagaaaauuaauuuuaaaaacuaacuugugaaaggcuguagaaguuuccuguuagcaacaugccuugguagcugcucuguccugcaguaaacuuaauuauggaaaucuaauuuaguuguuauuuagcuuacaagaauuuugcaaagucuaaugagaagggccaacugcaauguguucaaugggcugcaaaagaaauuuugaucuuugaguuugaagcuggaaguuaaaguggcagcuagcaauugauaccaccagaaggaccuaaagcaaccugggcacaagauagccugauuuugcaccugccaucaccucugaagguuugcaaaacuucuaauuccuucaaauuucccaaaggcauuuauugucuccauuuguuuggauacauguuguuauacaaccagaaaagaaaacaauagaauucauaaaauggaagcccagguggguaagggguuaucucagcaaaaagccuguuugcugaguaucuggaucugaguucggauccccaguacucaggagaaaccugugcauggcagcacagggucuuaacuccagccucggagaggagaguguagaaagacagguugcucagcaguuagccuagcccaaugucucaagcuccaguuuagaaagccaggugaaaaaugaaaaggauacaagaaguugagcuccaugucccaauacauggggacaaaaaaauccagcugaaauucugaggcuuauuuauuuucuucuuucaggcaacaauaaaaaaaaaaaugcaaaccagaccaacuacccaaucaaggauguuucaaguuugugauagauuugauggaaugauggaugaugguguuaaauuuugcaguuaaacuuaucuauagggggacuccacugcaaaucuggacagguuacuucccuaaauuccuacuuguaugugaguaaagugaaacugagcaaggcagcauccagccagaggugguggucaucaccuuauauaaaagacccaaaacaucagucaacaaacaucauuauuagcaaugcucuguucuccaaaaccuauuuuucaaacaaguuauauuacaacugcaaauggcauuucuagaugcuuguacccaagagagguccaccuuucuuucuucucuuuuucuuccuucccuucucuucccauguggcaggccuaaccuccccucccccaaccucucacucagcuguacuacuuuacuguaaucagaaugaauugggaaguuauaucgugggggggggggcaugaguguguacacaggcauauauguaggcaucuaugcauguguguggaggggagagguugaccccgcacaucugcuuuaguucuccucugccucauuaggacauaaggucucugacaagucacauauucagaguuuccagccaggcaagccccugugaccauccuaccagccaggcaggccucugugaccguccuaccagccaggcaggccucuguggccauccuaccagcacuuccuacugcucauuacaggagugcgccaccauaccuggcucauuucaucaacugagcucucuucucagcccuggaaacuguuuugguuuguuuguuuguuuguuuguuuguuuuuguuuuccuuaauugaaauuauucuuuuuauuauuauuagauauuuucucuauuuauauuucaaauguuauccccuuuccuaguuuucccucugaaaaucccauagcuucugaaauccauggcugauggcccugaccaaaaauauugguaaacucuguugauuucuaccaccuaaugaggaucgcauuagcauuccagaguucuuugcuauuagauggacagagagcacuuucuaaauuaacuuccacugagcugugaugagaggacaagcacaggguuaggaggugcaucauccuuccuccugcagauuaucucuacuuuguuugagaaaagacaauuaggccauuuugucgguuuuuuuuuuuuuuuucaaucagaguugauuacuuauuauuuucaggaaauuuuuacaaacacaaccaacuccaacuuuaucauuaaucuucuguucuucugauuaguuaacaaugccaagaguaaaaugggaaacccugauaguucuucugguguccucacaggggacaaguguggguaaaagaaauaaggacauugucuuccuuagaguuucuauugcaguggaaagacaucaugaccagggcaacucuuauaaaagguaacauuucauuaccuggggcuggcuuacagguucagaaguucaguuaucaugaaggcaggaagcauggcagcaucuaggcagacauggcacuagaggagcugagaauucuauauuuuguucuaaaggcaaauaggaaaagaaugacuuccaggaagcuaggcagaaggucucucaaagcccauucccacugugacacacugccuccaacaaggccauagccauaccuccucauagugucacucccuggaccaaguauauucaaaccaccacuaacuaacaugguccaucaauacuucuuacaggugcauauacagguacaugugacugauaacuuuauuacaugaaccuguuucagggagguaggaaggccagaaggcauagauuauugcaggauuaugcagagaacauaauagcaaggcaugaaaaguggaagaucugguacaaauaggacuggagaaaacacauggguaacaaaaggcuuugaaggccaucauaaaacuaaauuguuguugugcuaaauucuaugcauuaaaaaaaccaacaggggcuguaaagguauuugucaccaagccugaaaaccagaauucagccucugcaacucacauagcaaaaaaugggaccuccaaauacuuauugcucauacacgugucuauacacauguaugugcagacacgcauacacacauacaugacuaacagucucccuaguacacagaguggauguguuugguucaauaacuaacccacucccaccucaauccuuuuggguacccacucccaccucaauccuuuuggguacccacuccuugccuguaguaauaaucugccaaaauaaacaccucuccuaccccaggcaagagagccaggacugacagauggucugcccuggaaacuggacuccuggcaguucuucgugacacaggcacacacauggcuggaggugcaucauuuccauggccaaaucccaaggaaacugcuguuucugcaacuaggauacuaaagaccuccucuaaucaugauuauuucagaagccuuuuaccagucagcuuccucuaagaaucccaggaccugcuuugcaugucuuuucagcucauuacuuugacagacauagaaacugaugcucagauagggugacuaaauugccaaaagucaaacagguaacaaaugccugcauuuggauucacaucuguguuggucuaaauccacauucaagaucuuaaugcauuugcucuuccaauuccuauuaucauauuucaugugugauuuauaaaagucuaguaauuuuucuuauggcacucauguagcgcugagaacauacaaugaaauguaaucuguuauugcuacauuuucuauuugcaagugacagaugacguaaaacccugccuuuaaucaaugcuuaacauaaugacuacauugcauuguugcugagccauacagaagugguugccaccuucacacugucuucacaccauacaaagauaacacugaggucuucuagacagccaaacuacaacuauggaacaaucaaucuaauauauuguuaaauaucacuucacugacucaaccacucaucuuugaccaaaaguuuagaauucugguguuguaauucuaacauuguucaccauguacuggggcauaguacgguaaauauaagcaauaaaaaagaccaugaaguauguauaggugaggaagggcccagauuguucuggauuucaguaagggagccagugucaauucaacauguacauuguaugcaguuauauguacuuacuuuccagucuauuucacaagaugugcuacaaauaguguuaccugagcagcauucuuagaaaaagcuacuuucagcuggagagcugagaaaaaacaaaaugaacuugaaguagaaaaauacucaaagacuaagaaagccaucaugucaaaagcacaugaacaccugcaugaaggagcacugcugcaguuggacauagucaaaauagcauaucaacaaugcauuauugcucagagcugaacaguuuuugaguaaacugaaugagagacaaaaaacugaguuaaaaccuguguguguguguguguguguguguguguguguguguguguuguguauuagaagaaccaggagauaaauauucaagggacaauggaauacagaagucagaaucaacagaacaggaaaacauauggucgaaggaugcuggaugagaaggcagcaucuuuuaaacucucuaguacaauuccucaggcaagaguccugaaaaaaaagauaaaguaaauuauggaggagcagcauugggguggggagagaauugagaauugaacuugugaaaagucaaggaaaagauuagcuaucuugaagccauggcuauaagaauuauccugaaacagacuggagccuuuauaacugacacugucuauagcuagcuaguaguaacacuccauuguugcugaaagucagccaaucagaaggagauuacauuggcuaaaaaucagccuaucaaaacuagacugucauuuuucuacaugccaaucaacccaauuuuccucucacgugaaccaacaugcauucugccucuaucguggcaauguguucaugacagaaaacccacccaacuccauauuuauugaucugccuaaagaaucugcaacugaucaguuuaguucaucuuuacacgagguuuaagucuugguuucuuauuacacauaaugaacagaccacaauagcaacuacauauuaaaugaaaacacuuucagccuguuguuuacagugaagcaauccggccaucaucauuuaaccaagcggucaaacuuggcauugccaggacuguuuccaacagccugacagaauguacucugauaugacacagagguauauagacagagacacccauccuccuuccuugccagaaauauuugaccuaaauggaaucacaggaaaaccaucagaugaaucaacaaagcagaguguggcauggaacugcugcccuggaaacugcacaugauugaauuuuaugaaaaaccaagggagauacugaaauauuauggauuaaaagauauuaaaggaauuaacaaccagaugccgguuaaggacccugaauagaccugugucacagaggcaagaaaccaauuaaagaaauuugagcauggaaagaugaugauguuacuguacugagguuggcuucauuuuuuccugaugcuaaagauaaaaacuagagacuggcaaaaaaaaaaaaauggauaaguauaucaccacagggcuccauucccagccacguggacuuucuuggaugcaguaaacaggcugaaguuguuaacggaagaauaccauugguuucuguggcaaaaaggaaccucugugugugugcaugagcagcaguaggaauggucaaagggguaaaggagaaccaggagugguaagugaugcuggcacagggucuuccaacacuacugugaguuucaagcauuuguuauuuugaacacuauguuuaguacuacauuuagacuaugccagauauuuuccuucugccccaguuuucucacuaacaaucaaaauaaaucuaucauacuguguguuuguaagguagcucauacucucacuggcaaaagaauuaauccaaauaaacaaaauucauauauuuaacucuggaaacauuuuccauaugcauacauuuauacgcaugcauauaugugcacuuuuucaaagucagaauguuuuauaacuaagaauagacaaggugagaauccuuuucuaauucagaacccucgacucuuucaagccugugaagagaagaugacaugaaauuuguaucaaaggacugagaugaacgcucaaaaugcucagaggaucuucggacacaaaggacucucccugugccaucuacacugauacuagaugucugcugcugagcaggugccccggaaagaccagccuuccacugacacaacagcuuaugagcaggcuagauaaaguacaucagguuaccaagucucuaggaggagcugugagcugcccccgaggaugucagggagaaaggcaaacacaggaguggguccuacaggcaaacauguguaauauaguuauacuccauaacaggaguaauguuaaagguaugguugggagggauaccuuuagcaugcaguacagagugggguaguuagggaaacaaguccuucccaaagguaagccaaucuuugugggagaugaaguugcaaagagcgaugcuuucaagagaaaggcauuguggguaacagcugguaagaaggcuagaaaccuucuccaugcauagacaacacaucuugccuaucucuggcacaguauauaaacauugacccuugacacagugaagagaaggaggaaggaaaaucuaugcauuuacgggauaugaacgcgcaugguugggggaauucagcaaaggagggggccgacggcauuaaugucagugcuuacagacuuaccagaagacaaacacacucagaguaaacccaucccaagugaacuaaucauauaugacagacaacauccauuuuuuuucuuagcccuggcucugcaaaggaaacaagcuagaaagggaaggauaggcuuuaacuaagaaaauguuucagaagagaaaacuuuaaaaaaaacacaaaaucaguugagcucucuacuggucucauaacugucauagacuucaacaaauggagcuagaauuuuaggcgcuaucaaguuacacauuuuccauacauuagcucauauaaugcucauaacaagcccuugagacugauauauccucaucauaagaagaagguaacugaaggaaaguuaagcaacauaacuccuuggaguucacuccuggcaaugaaguaaacugugauucccauccaagaaccaaguacaaaguuuacacucuugaacccugcuucucagaggccaaugggaccuuuguccuuagguacuaaggcugauguucaaguggggaagacagcuucuaggaauuaaauacagaaacuuacacugaauuucacuuccuuugagugaaaaugaaaagcaaaauaguaggagaauagggcaaaacuaacacauaaaaaggagauuagagaggcacagcagaggucagcacacacaggagaaggcauccacacacacccuucccuguacgccccuacacugugcaaauggucagacccaugugaugccaugugacuuuuuuuuauagaaaugauaacuaagaaagaucuaaagugguuauucauuuauuuaugaaacugaaucauagucacaugaauaauauuuuacaguaacuacaucuuccaaugcaaacuguagugccacgaaugguacuguggcaccaacacacucagugugccuuacuaauucccaaagagcagucuucagucaccaaggucuggcuaccuaggaacuacaguguagggcuuaucuuuuccaaggaauaacaauacugcagaaugcauuaucaggcacuuacuagacauagaaauuguacugacauagcauuguacuguauagaacaucuuuggucacuucauucuuaguguucuauauuucaguacuauuucuaugcaaagaauauguaaaacuggaaaguccaaauuacaaagaaugacuuggauguucaauaaauuguaguauuguuuucaguuagcaaaaauauagcuacucuucuaaacaugcugcugucuggcuauaagcuacacgugaccucuucauuuguaagcucaggaauagcauucguucuguccuucaaagggcugcagagaugauaaagugaauuuuuaaaacacgccuaugaaguacuaugaaccuguuggugaguguagucuaguuaaaaguaaagaaaauaaaaagaacaaucauuaaaaauauacaagaaaauauacauaaauauuucacuauuucacggaucucaggauaggaagacuuuguaagcccaaaaaccugggaaaacuuacacuggaaaaggcugaugaguuuauucuaaaguuucuaucucucaguccuggcuuaagcaaacagaagaagcugggaucauaacaggaaaaucugcaacaaauaugacauauagagguuugucucaauaaauaaaaaaaauggcagaaaaaaauagccaaggaacuuaaaaggaaaugugucaaaauuaagucauaaauacauguaaaaguuuccccuuaccaauaagaugacacauaugaaaauccugagauguguaacauuuuggccaagauugggaugaagccaagaaaugaauccugaaguugugugagggugugguuaagauacagauccccauguauugccagaauaaaguuaacauauagaugccuaucaguguaaacucauaacauucaagcaaguaauugauuccuacuuuuaaaaauuaucagaaauacaguaauaguaaaacauucauugcauguagcuugaaaaagaagcaauaauguguuagauucauaagguauaauauuaugcuaucuuuaaaaacuuccucuaaguacauauuaaaacagcagcguugggccagaaaagaaaaauggauuguggguuaagaucacuugcugcucuuccagaaguucuguauucaauucucagccccaacauagggacuuacaauggucuauaaguccguucgaggggaucugagagccucuucuguccuccaaaagcacaaaacacagaagugauaaaaaacagacagacaaaauacucaaauacauaaaaauuaaugaugaacuaauuaauuaaccaguagaauauauuaacaaugggaugaguuaaaaucaguuuaugucucugcaaaaaauaugaaauguuaacagguuauuucugguuaauauuauaauuuuuuucuuugugugaugaguagacaguuuuauacuuagaaaaaaaugcaacuccuaaaaagugauauacuuuauaaaaacuagauugcuuuuauaaagacauaauuuauugaaacaguuaucuagcuaaaugguucguuauuuaguuacuagauuugguugagaaugccaacuggagucagguagagauggguugguggguaugaaagcacucaccauucaggccuguuuaccuaguuuggcucccuagaacccacaggugguggaaacaggagaagaaucuccuagaagcucauggcccagcuauccuggaacacacaucauagcaacgagagacuuugccucaaaauacaaagguaggagguaagaauuggcuaucugaagcuguccuugagcucuauguccacgcccacacuuacauacaucccauacauacagacaccauaggaaacaaaaggauacccaggggucuuaguuaccuuucuauugcugugauaaaucaucaugaccaagauagcuuauaaaagaaacuguuuaaucaucuuaugguuucagaggguuagaaucccugaugacaaggagaaagaauagcagggauauuaaaucuucauccacaaucauaggcagagaggggggaggaaggaggaagggaaggacugagggaggaagaaaaggagggagggagggcaagggggcaggugagaaagcaggagaccuugagcagugcaggagucuuuugaaaccucaaagccuccuucuagugauacaccuccuaauccuucucaaacaauuuuaaguacucaggaccaaacacucgaauccaugagccugcguuggagagaugacuccgcuguucaagacuaggcucacaagcaaauguaugagccucuaggggccauucucauuucagccaccccaccaaccugaugauaaacaugguagacaugauugugcucuccucaggcucucacaacuaaguggugcugaguaucuccugcucagcaaguguucuaacaauacgcugaguugugaaaaaaaaaaagaaaagaaaagauaaaaaauaaguaaauaagggcgguuucaucugagaccuaaagaaagagaaauacauaguuuagaaagcuggugcccucagaaucagacgcugcugcaagcauaagccaagcacuccaaacgaagacuucugcaccccagaggaucccuauuagcacccuguggcccugagcacugcacugaggugcuucacuuuaagaaaagacauuacaauuagauagaauacuacuucaggugacugaaguauaccugaacagguguguggaaccagucauccauggugacacacauuguacuguacaggaaccaacaaggagacagcuuaacacaggcacuugaguacugccuccaagagcuacaacaggcuaguauaggauagaaaagguuuguucaugccccuuaccaauccccaggaacacuacucuuuagggcuucguagccaacugcgauaggucccuccaacaaauucccuguucacagcuauacaaaagagacacaagcaauauuacaaacuggcccaaaccaaguugccuaucuaugcagaggacuacagaaaucuaccauucaggagcuccagaaccaucaauccagggaacaagaugccagcuuccaucuacagagcagcucccauccacguaugacucuaguguguaacagguauaguuucuccaaggcagaagaaggaugaaugucaucaguccccauaauggccacuuaucuuugcucuuaccaauuccacccuugcacaguuuagaagcauggagugcugcucagugaguugugucucauuuugcuguuauucaucauggaaguggggaaugugugucuccaacuuuugucacccgucuugcuuaggugcuagcugcuuauuuuacugcacagaauaucuuccucaauguccgucagagcccugagcauccaccaacuacauuacugacaguaugguucuauacaaaggcucugggagacauuugcucccaaagagaacagacaauaccaacuggauuucuagauucugcauucgcacugcucucggugaagcuuugaauguaauuccugcugauuuauuuuuauccugacacaucuucuuuaacaacuauuaaagcaaucaucucuggugaaaaggagaacaucaugguugacuuuuaaaguauuagcauucaacagauaaaucuuagcucccaaaaaacucuugaacuggaaauaaauccugaagaugaaaugaugucuugauaaccacagccauuucaaaaccucugagagaagagaaaaauuagcaacacccaugcaccuaucccuccugcacucauuucaccucagaaaaaauuauggcaacagccaggcaaaugugccugagucugugcagcuuacaacuuguggaagucuaguuauuccacaaccaaccauaaugguaauugagauaaaaauaauaaaggcaccaacagaaaaaugacugacaaguagaaaugacagaggacacguuaaaaaauaaaggacaacacuggaaaguggaguucgugggaaagauuuaaugagaauaaagaaucuuggcuuaaacacugauggucuuaagccucgauuuuuccagcuaaacugcucauggcucaugagugauaagaaggacauugaccucagaaaaguauugcuggucacaaaacauuaucuuaauucacccacuuaugauauuguuguagcuaugauaguauacugaguugugcuuuauagauacaacccauccguacuauacaaagggaaggcagggagguggccuccauauuaacauccuucacacagccaaggcuccccugagcugugggaagauggucucugaaaugggagaaagagauugucuacuguauucacccauaaguaaauccacuacuauacaccacucagugauguugaagauuaggcuccacgcuggaucccaggguacucugguggcuuucgccaacaguccucacacuucuucugagauggaauguucugguauguccacuucauuaggaaaauacugacauacuucuagauugccucuaugugcugcucacaucuuccuuugaaugcuuuagagaccucugcauugcagaaauaaccugccuuucuaaggccaaacauaaugugaacaagcugggguccacaaacccgaaccaagacuccugagauauguucaaagccuguagcaaaaagcccaggaaaauggcucagaucaaaaaacuaguuuaguuacuucacacugcccagaguccuuaggcugaggcccauguaggauuuugcccaagagcuguuuguacaaauuuaucauuauuuuuucagucaauuagcuugaagaaggaaaugagagcuaaguaaauaaauuagaucauuaauuugcaauaaauauaaauuaguuacacuaauuauaccaguugaacacauauacaaauuauguauauauaauaaauaacaaauaaggaauauacuaaggcucaaugagaagaaagccaucugacuguuuuagcaaacuacauauauucacucaguagaaccuaacaguuuugauauguguaugaaaauaugagauaaacauuaacugccuaccgguguucuaacaaaucuauuuuucaugccaaguggaaauuagaauauauuuuacauuauuugagcuaauuaugugacauuucuuaugaauagugauguauuauuccauucauuacuccuaauuaugcucccuuacaaguguaaggcuggcaacaccacgaccaggcuuuuccuguucuuuauaaucugauggcuugcauggaaagcaggucaaagauaugcauggaauauaaugagccaaguucagcagcuguuaaccgugacaguucaaagcuaccugagaaaacugcauguggaaauaaauagaaaugggaugagcuuuucacaucacacgauacccgugugagcagucaacaugagaaacagucaaagugcaauuuuggaacaucugaauuaucaacguacuuuggcuugagcaggagacaaaacauuccuaaugcucccccacccccuuuucuuucucccuuagcauuguacacaaccaccugcuuguacagguauugcuuucugcuguaagaaagcaaacaggauucauagccuucguacagugccgagcuuuagugcaguaccacuaaaagcccgguuauugaaaagccaguucaaucauuuucgucauauguauaaccgggucaggccagcccuuugucucauuugcuucagggcugcaguuacaagguaaauccugacaugagguagucacagucaaagaaagacagaauuaucaagcaacagggagccagugaguccuagcgagcaucugcacaugcaacucauggggaaccagccagcaaggggacagggaaccagccagcaaggggacaggagacauccaugauacaaccguagcuucuucugugaaguccagggaccacugugcacaugcuccagacaaacuauuucugggaggaguucacacauauuucuccauucuauuucaguccuuccuugcacacauacaacauaccuacuuccuucaguacuggaugucaccaaucuauuaucaguuauacacuaaaagaacaaugcaaccaaaaguaaacuuugaagaggaaaagccuggaaagaaggaauuccuuuuuuuuuuuucuccuggcacccuugauaaaugcagcuugcuaacccuaaaugcuaucccucaguuaccccugacauuaucaacucuccaucaccuccugagcuggcauuugggauaagggugauuuguuuucuaugcagucauuucuuggguaacacauaagaaaaauaacugccacacaagguuuguugccuaaaaggacuuaucaggauccucuguggaacauucuagacucuaaagucauguacgagugaacugagaagcauaauagcagccaagcuuguccuuuuccuacuuaccagcgccaugguaguagcagguggcucuacacucuuagcagcccaagaagaggggaaauuuuauguagaauucucuccuaguucauuaauacuaccaagcacacauguuugaugcaagaaucugccaacuuaagaagaacugaccauaagucuaucaacuuucccauuacagcuaggggcgaaggagcaccagaacuucuucgaagaucucuguacgaauauuuaaggcagcuaauauacagaggcucacacaaaacagagcagagacaugugcucgcagcgauuuaaagaucacaauucuaucuuuagcaauaaggacauuaaaauagugcuugugcucaucuuauuuguacaggaagguuuaaaaagaaacagugcugagaaaugaaagaucagcagaucacuaauaacuguaguuuccugaacaauuaaagaaauucccaaaauggaaacccacucaggaagugacaaauauuucugauuuuuacggaaagacuaaaagggcauuuuuaucuauaguaucuauugggugugaaccacaguuaaggaaagaagcuauuuuuuauuauuuuucauuuauuucaggagcaaacaugguucuggucugaaacaagaaaagugaacauuucucauaggaaaugguaaaaguugccuuaaaaagcauuugucgggguuuucucuccuaucugcuggggcugaggcaguucccuuuguagcaaacuuuuaguuuguaaugugucagcagaaauguccuuuaaguuaccuccucuaauucuuuacaaauacacuuuggaaggcugucccccaugcaucauccuaacauuguuugguccugauagcauuccgugugugaugcuucugguuggaaaaaucuguuccauguaauaacugauucaauaaacuguugacaaaugguuuguauaauacaguauggccagugagcaagguucgucuccgccauuacacacuguauucaaagcauccacaaacucugccauggcccucccucuuaugcuagaggugcaagcuaaagcuccuugcaccauucugaauagcaauccacagaucaauacacugucugcugaaaacaacaagacauaacaaaugaaugauuuuauuuacaauaaaagccccagucaucgaauggauuccgcucauguucaaauucauuuuucaugcccaacucaagaggagaggcagacaaagcauaacacaaggggaggggcagggagagguacuaacuguaauggcaccaauuuauuuaagcaaugaacaagggcugagcugcauugaaacuuaugaauaaaauguucaacaaaauucugaaggcacaauucuucaaaacaugucugaucucucaccaaagaagcuugaaaagcauuuuccuggacuuagaaauuaauggaucaaagacacucugacaugcuuucuaguguguugcaccacagaggccaaagccuaugcaguuaacucuauguggcaagaaaugggauuaucugcuuaaugugugaggggaggaauucaaggggugugaaugaagcauugccuugcuucuaaagcauaccuuugguccuugcucagacagcuccuuuucuaccaugaaugcuaucaaaaagccagcaguagggagaugcaaagaugacucagaggguaaagaacguuuugagcaagcaugaggacaugagucugaaucuccauaacccauacaaaaucucacaugguaacugagacggguuguauagacagaagccuccuaagaagcuacucucagacaguaagaaaccuuuacguaaauauuguggaaaauaaggacuggcacccaaguucucccugaggauguguguccacccagagauacugauagacacauaaacauuuccuucuaagucaaugaguaaaaucauaaggaaaaggggcugguggagacaacucaaagauaaugcuuauaagucacucaucagugcacacuccccaaagggugcuugguuaucauugucuagaaauaauaagacaacuauugaaagcaagacauuccauuucacauaaagguacuauaaaacugcccugaaaacacaaaacucuccaucaaagauuucuauuggccaucaauucauuuauugucuuugaauguaccccuuuuccccagucaagcaacacacaacuuaagacagaauuguaacugacaaaacaggauggggaaugucagggaagucaguuucaggacaaggcuagaaacucugggauaguacauugauaccacuagguaaaguuaacaggcccucauugcccccauccccuaacuacaccacugcauuuacucucaguguuugcacuuucuccuuuaauuucaguuacugcaguacuuggcauguuaagaaaauaguuucagaacaaguccuccaggcagaaaggaaugauuuuaugcagagacaagcaagagcacagagcuccauucuguggcagcuugggauacaggucauggugugaggaauagaguauggguugagucagcaaagguugaaugaaccauggaagaacacauggaaugucguaaacaacaaggauaucuuuacuaagaguacaaguccuguuugaccauguguaagggacaguaugauaugguuuccuggcccugaaacagagccagcagggugugggccuccaugaguguugagggucgcugugguuguaagacuuauuuguauaauaauguacauauuuucacguugcuccaagaaauaucuucucugcccagguccaaggcaguuuucaacugcagagaugagagcagccucacacaaugugcuaguucccaaagcauccugguuuucauguccuccuugcacagaagcaggcucccucuaaacacaaugaugcuugcuaauucuaguagauuuucucuauccucuuugcauucucucucagauaugaaaacugauaagguuucacuuucaaaauggugacucugggguacuaguuucaccaacuacucaggauucacuguggccaguuccuuagaagaaggcuuucacacuuuaacuagugguucuaaagaccgugaaaaagaaaucaaguuauggaugagaacucacaaagucaaguccacuccaccauuaaccaucuaacaugcggugugucugcaugacaucauguuuuccuaauccaguguaugaaggaagauucauucaccuaaauucucaucccaaguucucuuaacgcugauucaagcaagcacauggaaaaauaauggaauuuuuaccuuuauucuuuugacaucuggagguacuuuucuugaaaaauuccacaaggcaaaaugaccaccacaaacuuacaguaaaaccaaaggaagaacuaaaagauacuuuuauuuuaagaagucagggucuacuaagguucaauguuacauugaaaaaauugcaaaaagagauuugaauauuagaaagaauaauuuucacagaauauuauuuacuaauuuaucaacuguucauccuuuuuauaauuucacaaauuuuaauuagguaaaauuugugcucaggacuuugagagcuuaguaaagaauuauaguuuuauuugcuaaagugauuucccuuuuucccuucaaccaagcaaaguuuacaugacuaggaaauaaguuacucaugaaguuuuuaagaacuucaaauauuuucacugaaaaaauauuacuccaaaaauaucuugaaauguuuauacauuaaggacuauaguaaggauuucacuucaaagccaaaccaugguugaguguggaaaauaccuauuaucuuaaaacaugaacccucuuuguugccccuugcauaauaaaauaaggagaaagagaaaaauauuguggcaauuccauaaaauccacacguauacagccaggggguauauguucagcaugcuagggcaccuuuguggagugucccacccauucagaccuccaguaucgaggagaauggaauuccuauugagucuuguggaaguaaaguucuucagacaaaauaaagcaacucaaccaccacucacaguggagaauggucuagaaaccagaaucuaucccaagagaaaugacauuucaaacuccaacacagaucccaacauucacaauauguuagauuguguccccuagcaucagaagcuacacccaucaacucucaccaaugugaaugcucaaacaugagcugagcagggacaacaccaauagaugagagaugugaauggagaaagaccaugaagucuuaagccuaugcagagaaauacaggcaacuaaggauguugagaacaggagaaauggucuuuugccagggaagacauaccaauuaguuaugcaauaccaaaucaucaauguugaaaacauaaauaugagaaaaaugaagacugagauuauauuuuaaaauacacauguguauacauguauaaucauauaugcaucuaacaacaguuaaugaaaaaugaggacauuacuuugaaagagaaucagaaguggcauaugagagggcuuggagggaggaaaaggaaaaaggcaaugauguaauuauauuacaaucacacaaauaaaauauaaaauaaaauaaaaggauaaauugaacaaacuccuuuaagcaaaaaacuguccaacucuaauucuccuguaaucucuuaauugcccaucacagagucaccauccuguuucuaaccuucuauuaaaauucacaauaaguaaaaggaauucaaagugcccaugauauucauugaaccaauuuuagaaacaccuauuuauuuacacagcuaugguagugaaaaggucaaccaagaauuucauccaaagcuacaguugcuaagcaacccuccuuagaaguucuacaacauugcucaagcauauugcgggugccaccaacuggauucaaaauaaauaugaauaacaucuuaccuggacacuccaaagcaggaggaagggagauuccuugcuuaccuuuuggggauggacucuaaaggcugguucacugcuaauuugguugauugacuucaaaugcuucuuuuacagaaaaggauacggccagguacaacggguuuccuauucaccagggcgaaggacaguucaguuuugagaaaaaccacagagggcuugaugagauguuggccaaaucuaaaugacauggucucacaguaaaagcuggaagaagaaauaauuuaggaaauaagcauucaaaagagaaagcaaugaaguucauguagcacguuuaaaaaggcaaauuccauuaguaaagacucuuugauagaaugggaucccauuuaaacuggucccuuuuaauugucccucagaugaacuccagauaaaguccuccuggaauuuucccaucucgcuagaaugcagccuagauucaagugaaugcuaucaaguagaagcuggaacauucaaagugcuggaacauucacacuuuuuuuuuuuuagauauuuucuuuauauacauuucaaauuucaaaugcuaucccgaaaguucccuauaccacacccuucccccaccccacaccccgcccugcuccccuacccacccacuccugcuucuuggcccuggcauuccccuguauuggggcauauaaaguuugcaauaccaaggggccucucuucccagugauggccgaauaggccaucuucugcuacauaugcaguuagagacacgagcucuggggguacugguuaguucauauuguuguuccaccuauaggguugcagaccccuuuagcuccuugggugacaaagcaaccuuucaugccuaaaucucuggcccuucagauuguuaccucaaaccuacaaggucuuauuuguugaauacuuacuuuugcccacugaucuugucaucucuguuaauaugcaaauagccacugugaaugaguacaaaucuaauucuuaacagcuucuuuuaaaugguuuuaucuuuguuuguguaauggcaauuuaacacaaguacaaacacuguuugaccucgccuacaauuacaaagcacacauuccuagagaacuauuguaauucaauugacaaaauuagaaagaaacugaaggaaugagcaaaacaguuuuaggugaguuuccagcucucccagagagaggucagauaaugaaugcucaucuucccacaccuccuuuuugggagaggcccaaagaaaauguuacaguugauauacaaucuccccaggagcuuaugaguugagcacuuggugaagcuguucuuggaguuuuucaaaauuuuaggagaaggggguugguugcagaguguagaauagugggugggcugagcuuugaaggcuacaccugccuuuuaguggcugucucucucccuuugaucucugucaaccaagcuacagcuugcucccaccaccaugauuuucuauaaauuagaacucugaaaucuugaacccaaauaaauccuugcuacugcaagucauuucuaacaaaccauuugucagagcaacaugagagagaaugaacacaagggagaaugaagugaaacugggcagccaggaaggaccaaagcaacccacgcuccagauauaaucucaacuagguaaugccuaccaugaaaaugacuccuaagugaccaaggucccuacacuugccuuagucaagugaacagucaggagccaguggccaaccuagaaaaaauacagggaugaaagaugaaaaauaaucagaaaaaaaggaugaaguuagaaaauggaaagcuauucuguaaaguguaccaauaagugcauagugauuuauacagugaaagauaugccuguauuaauaccuguaggguaguagaugggaacauggcugaaauucuggugcuaaggacucagaugggaagacucaugucaaggauacuuguuuuuuaaaacuccuacaaccaacucauagaaauuaagggucaguaaguucaaauauugucuaaccaaauggcuuugcaggugugcucucggagaagcuaccagaaaugugaauuugcaucuccuauagcuccaaccauguuaccuugaauuuuuuaagguuaaugcaucaccauauucuauagauaaggcucuucucacucccugaaucuaggucuuagcaaucgacucaagugcccauuguccucuagcacacuacugcuuugggaguugucauggagaacaaagugaaacaaaagacaaauccaucagcugagcacugaacagaaggcucuuucuuaaagcuggacugucuauucuguucaagugugcagcugccucaccagaguuaacacaucagcaaacagagacacaaacccacaccuaaugccauugucugagccacugucuaacaaugcgaggagcaacaucucugacauguguuugcauuaaggauaauuggacaaaccuaagcaugugcucuaacugaugggcugccguuauucugagcccuugauuugcaccuucuuuggucucauuugucuuucauuuuguucuugguuuuuuguuuuguuuuguuuuuuguuuuucauccucuaugcucuaaaccacucuaucuccucccaacucagguauucacuauagcacgauuaauauaguucuuaucuucuuuauagauuugugugcaugucuucuauaucuccaaaacaugaagggcucucaaaaacauugaacuuuaauuuuuaugaauuauuuauuuuaaacuucauuuguuucuuaauugucuuauccccucaguauugcuaaaaauaaugaauggggccucauuucuucucacagcaaaccgcaguggguuuugugugcagucugcuccuucucaagaguuagucuugccacaauauuuuaucacaaauaacacugugacuucuacccuaauggauaucauauugugcuaggacaggguucuagguuacaaugucauucagcuuuucuaagauaugucuaacaguuuucacuuuuaaagguaauauccaaagacaguguuuuccucuguccuuacuaucacuuaaugcuauaugcuuucaugacugauaguuaaaaugguaacccagguacagcuuauccaauagcuuuuccuuaucccuaccuaaaccauucucacuccaaugccuaaaagagaccagaaaaaugacaguaccaguuugaacaaugaaaucauuauggauggaggaaauguuggcugacccauagaugaagaacaacaagggagccaguucuccuccagguauuacuuccagugauagguuacacagucccaaguggucauccccaaaauacauaaagcaacauuauauggacuaacagaauauauuuauaugaacauauauaugugaaucugaguguacacguauauauguguguguaacaauaauuaaagaagaauaugaaguuuaggaaagagagacauuuagagugggaaagagagaaauagagauuaugcauauacaguacucauggguaaaauuuaaaaaauaaauaagaaugguaucucucaacucacuuaucacugauacuucauucucauuuuuaaaguuacccuucuucuauucccugauuuuccagaguccacaaaauggucuaaauauucaguaugauaauuacacuuuuaccaucuguuaauuuuucuguuguugcccuaaggaauaaaaucuacuaauuuuguuauaauuaaaaucauuaauuuucuuuugauauuuuccucuaugauucuuauuuaacaaauauuucuccaucauaaggucacaaaugugaauuuuagaauuuucuucuaugagcuguuuaucuucauucuuaacacuuaguuguaugcuccaugugacguuuugcuuaaauuaugaaguacugggaacuccuacauggcugcugauggcccucacagagcuucuuugguuuuccacauaagauucauuuagaaguaaugugauugcucucacuuuaacucaaauauuuuuuuuuuccuugagaggucucuggcaauguauucaaaaguagaugcaacaaaagaaucuuuuuccucuucuuaaaauuacaaugaacuagcauaauuuuuucuuuugcuauuaagaauaauauccuucaacauuaugaacuaaccaguaucccaaagcuugugucucuagcugcauauguaucaaaagauggccuagucagccaucacuggaaagagaggcccauuggacaugcaaacuuuauaugccccagaacaggggaaugccagggccaaaaaaaaugggaauggguggguagggaagugugggggaggguaugggggaccuuugggauagcauuggaaauguaauugaggaaaauauguaauaaaaaagaaaaaagaauaauauccuugauaaguuuuaauuuaaaaagaagaaacuuguauacugagcuaggaugaauaaaaucuaaauuucccauaaauuaguacuauuuuaaauaaacaaaauucuacuacauauauuuauauguguaauacaauuuuguauucuuugccaucaaugugauauacuucauuagcagauugcugaauauauuuaacucuuccuagccacuuggaguaucuuguucuuuuguucacgaucauauuggcuuuuuggguguuguaggugaagucggccaaaaguuuuuaaacuaaacuuaacaguuagucauugucaacaucuauuuaaauguacuggcuugguuuacuuguuuuaaaagaaaauguacaccugcuuucuguuccuuuagcaguggguuucgaccugugggccauggcccuuuuauaggugucauagcauauagauauuugcauuaugauucauaauauuaacaacauuucacuuuuauaguaucaaugaaauaauuuaugguugggggucacuaugacaugacgggcguuauuaaggggcugcaguguuauuggaagguucagaaccagugcuuuagaggucagcagagcucugucaagcugugcccuuuccuacugcaggagcaaguuugacaaucaccauaacgauugaaagucucugcuuaccuaagugacuuuuuucuuguacuaauuucuaccauaaaauuguaccaauuuuaauuuuacucauaaaguaauaauauaauggguuaagaauaugauuaauaaucacuguuuuggauuuuaucaaacugugaauauuuuuuaacccaucauucaagguuuaucuguaacuuauuuuuuuuuaaagaaucaacaaagguucuucagguuuuauuaauuuggccccauuauucauuuucuauaguuuuguuucuugcuuaaaaguucuucaucucuccucuuucuucaaguuaacuuaguggaggcaaacacagauuguaugcugguucucuucaguagcuucagcuacauguugcuaucaaagaugcccauuagcuguaucuuuucuaggguuuuuguuauuucucaguucccagaaaccuugguccuugucaugacuucuauuuaacuugaggguuauuucauagugugccuuuuaguuucuaaacacuucggauguuucugcuaucugccuguuaauaggucuaauuuaccaagccauggagaagaaaaccuuugugccaguuuuugcauuugagguuucuuccugaaacaauacagaggaaccauaucccuaacucaaacacuguaaaacaaaaugcauucuguucucauucagcuguaugugcguguuuguauuucaauauauguuuuaaucuauaauauauucaauauaucaacauuauagaauucaaucuugaauucauuguuguccaaaucuuugccucugcuuuucaucucugcuucauuaguuccuaguagaacugagcuaaaucucuaacuauaguugucaaaucaauggcaaaagccauaacuuccaguuuuguacaucacaauguuauauacucaugcaucuacauucugacuuaucucacuauuuauugcuuugcucauauuucacaaaaauggacuuuuuuuucaucaucccaucuucagccuggacccuuuuuagaugcuuguaagauaaagaaaucaugcaccccagcuagcaucuuguuuucucucccuuagccaagaugccugguaaauuuaaccccuaugguucugccacucacucuuuacauuuggugucauuauccaauguugucauuagguuuggcucucuuuuuuucuucccucaugccuaucucaauuaagguaagaucucugccuuucugauuaggugaggcugggagaugagugaaccugcaggauguguuaucucuacuccucaucacugggauaauaagguguauccaaccuguccauggauucugugaauugcacucagguccucaucacguacucuauugagcuuucucuacaauacccuuagcucacccuuacuccugcuguugucuuucagauacuacacucuaccuuucucauguuugaauuuuggacauguucaaaugacauggccuauaauuucaaauaauugcauuauuuuuucaaugucacugcucaauuuuccaucuuaucaauauacugcauguucacgggugaaacacccucuuccucauacugugaagcaauggcuuccaauaucgcugccucuuuaaccugagccuccucugguuauuggugcacaauuuucuucaaaauucaguuaucccucuaauggaacacccauguaccuuacacugucuugacuugguuagaguuuuacugcugugagcagacaccauacccaggacaauuuuuauaagagcaacauuuaauuagggcuggcuuauagguucagagguucagucuauuaccaucaagguuggagcauggcagcauccaggaaggcauggugcaggaggagauaagaguucuacaucuucuucugaaggcugcuagaagacuggcuuccaggcagcuaggacuaaaguauuaaagcccaugcccacagcaacacaccuacucuaacaaagcuacgccuucuuaaagugccacucucuaggccaagcaauacaaaccaucacaggucuuuaaaaaucugcuuaguggagaaguuuccugaauauggauucccuagaaucaaaaguugucauuacuaauugauuaaaagaaucuaaauucucuacuuaucauuuuguaaucuuccuccuagauuuccuuauuuauuuuuguuauacucuaguuucuaaaauuaauuuuagaaagggucuacauguauaugcugugaaauucuauucauaauaauauauuuaguuaacccuuucacuuaaauaagcagucuguaauaacagucuaaacucuaaguuugacuguuucaaaacuucugaccuuggcuucauuguauccucacacaacuguagaagauaauuggcuggcaugcagauuacuuuuuaacacaggauguucugguuucaaaucucaaaauaaggucugcauaagggccuaagcauaagacuauauauuaauauccuuccauuaccauauaaauuaucccaaagccaaaggcuauccucuucucaagucucuaaaacaggauuucugucucuuccuagugucuguuggcuuacaacaaccccccaugcucccuggcauggaaauuucaucacuccagacucagucuccccagauacuccaucuugaugaggccuuuuauguaugucuucacaucuuauacuaauacaaacugagagcaauacaaaggagauaucucaguuggcaaacuucuuguugccuaaagcuuucagugagacucuuucucagaacacaagauggauaacuccugaggacaauaccucagaaagaccccuugcuucuacacacaagugcacacacauguccauguaucugcacacacacuauuaacagcauuaaugagagaaggugguauauuuaggguccagccuaacuugcaucaugaagcaaucauaucuacagagucuucuaaguaaggacauaugcugaagauccuuucaguggguaggcgugacugaacuaccauuucugauaguuuuauaucucauaaagugugugugaggucguugguuuccaucacauucuuuagauguuugguuuaucuucagauacucuuuggcacaugguaacacuucagcuuuucaaagauucugauaguucuauucauucuguuuuucucaaugguccaucugaguuuccucauaucuguuucauccugauguucuuugagaugagaaaacugagaugcacugguuauucauucauucauucacucagcucuuaaggcuuacuuauauccaguguuuccccuguauccuggcuacccugccgugaauuuccuuccuucuaacauuccacucuugccaauaaacucauauaguucuauuacauauuuuuacauucgucuagucugcaaacaauuuauaacacggaugcccucugaucucuucacuaauucuucuucuccuuugaugauagacauaacucuaagcacucucuuucuggaggaagaaauggagccagaguuaagaauucucuaccugauuuagcugugccauccccucucugacccucugcaauggcaugaacuucucaccuucggaucacaucuaaaaccgagagacgcugacauacauuaagcauucaucauugucuaguacauggcauaggcagccaaaauaguaauaauuuucaacuuccuuucuuccucuacaguggucuaauacugucucucugguaauuguacaaauugcauagcuaauagacuuauuuccccaaauuuuaauuucacugaaaaagagaacuauuccagagacuguaaagagaaaacaaguauguauguggucuacucugguuccacaguaagaaucagcagugugaugggaagaugcaggcauccaggaucugaaauugucugcaagaaggagauaaauauuaaauauuuuacucucauaugaacauggcaaaagcaauuuuauuuuagcccaaaguaaaacugcugaaucauuucuaccaaacaugaacguuagauguacucuguuaaaauuccaaaugaaaaucauauccagaaaaaccuauuucuuagccaacauggagauaaugauuucuggaauucagaaaaucaaggacuuaguuaugggacucacucaaagggucaugcuccugaauuauauuuauuaauagaugucagucaguaaagaacuugguguucccuccuguuauaaagaaaagaggaaguagguaugauaaccaaaaccacgcucuuauauauguaagcuuucuuucuucuucuugauauucuguggcaguaacugcuuuugcuuuuaaccaaaacuguaagguucuggaauuuccuacaucucccaaauuuccauucaugaaaaguaucaucucucuaccucccuccuaugaccuacauguguccucuguccaucugcuaacacccuagcuccucgucacucuuggaagcuaggaagaggacaugaguuuaagaacuuccucuucaaaguuaaccaaauagaaaggaacuagcacagagauuucugugccuuauaugaauaagucugugacucagcacagcugcuugguuuuguugcugauaggaauaguugagcuauaggguucauagaauaagguucaauggccagaucgaacagugacagaucauuccauggucggccagguuuaucccugguuugcuuuuaaauguuaugcuaaugucucacuaaacugccaaaugcuucaaaucuuguuccaagaaagaauagcuaacucuagaauuucuggguggaaaggggcuugugagaucacuuagauccagcagucgcacuuuagagacacugagcauguccagaaugcaaguggccuacucaaaugagcacugaacuucaguggucucauggaucuuuauaaaguguaagauuuaaggauucuauaaacuugagacccuaauuuaagaaguuaaauuauagauaacucacuuugggggcaucccuuaguauugaaggcaugagcaauacucauccuaagaaauucaacagaggauucagaauauaagccuaugucuauuaauuccacauugccucuucaagcacagacuacuaugaacugacuuuuuaauuuuuauuuagauccuccaaaauccaugacccauacuuggaaccucaggacuuccaguaaccacacgaccaaacccauaaagaugagaaauucuauaccacugacuaccaagaagccgcugggucccacuucauaguuaauaccucccuaguccauacagcaaaaaauuucuccaaggccaaugcaaagaugcuauguuucugcaagcagguuagccauuccagcucuagccugcugacuaggaacaugugcuucaccugagagauacaaacaaugcauauugugcagcacagcagagauacacuuuaacguguagaaagaacuccccuagagugcuagcuauaaagccaagcugauuuaaaucaacuugaaagcuuucaagacaaccagauucuuaggcucugucacacccuaacuccaacagaacuuccauaaggguuagacagacuuggguacaauaucuguuuucuuuuucaauugaucauaugaauguggcauguuccuuugccuguuugccucugugauacagggcaccaauaauuuccucccauagaacuucuuaaggaccuaauaaguauuugguuaaccgcuaccuuuuuaucccagcaaaaaauagccauggauguuuuuuaauggccaagagauaguuguuaauuaauacaaaauuuaauacugguaagaaacguaguacuguuauuaucauagaauggcaucuagucaguaaagagaaaauaaaauuuggcccgguacugcguagaugaugcuaccucucuugugccaugugucaguuaaaacccagcauccgaauaacaggaacagcagcuggugcuuacuuccugcuuccagccuuuaaagguuuacauuagacauauccuuaaagcucugggaggccggauggaagcagcacuuugcacaccugcccucauacacccuucugauugccacuuagaacaauuccuagauuuaaagauuaccauguucagaagauauuaaacuugcaaggcuauugaaaccaguggcuaaauaguucucaggacauguuuuguaauguguuguagucaacagucguguaggggagauggcucauuuccauauaacuucugucaauauuggacauucucuaauacgcuaaaucuguuauacaaauugucauuacuuccaaauucaauauagagggaaugacuucuucaaaauguccuagccagagcaaucuaccaugaacacuaaugucuccuaggcaaccaggaaaccaaacaugauaaaaagaaacacugcuccuuuuguuaaaagauugggaaaaaaaagucuuuuuuuuuuuuuuaaugagaaaauugaagauguuauuucauuagagcuggggggugcuaagguucacugugaauaauaaaacaaucucccaauuuuauguccugacaaaacucugugaauggcaaaacucuagauuaaccucuagcaagccaucagaugccgugugcuggacuuuucuaauggcucucuaucggugggggugggaaaaucuguacuccagcgugucugaaaacuaauuuaaugguucaauugugaguucaaggccagacuggucuacaaagcauguuccuggacagcaaaggauguuacauagaaaacaaggaaaaagaaagggaagaagaacaaggaagaggggguaggaaagaaggggagggagagggagaagaagacagggagaaggaggaaaaggaagaaaaagaggaggaggagaaggagaaaguagcuaaguuaaaagauggcagacacgcuuaaggaauacugcuggccuuugaucccucuaugagucuugugacuuacgaguguguggagaugucaacuaguugguagcagaacgaaccuggaugauaacaagagaaggaaagagcacuaucaugugagaggucuuggaaaaagucuaaauaauggcuguucagcagaggaggccuguuugacuguacucaugugaaacuuggagcagcaucaacuuuuaugauacucaaagacaaaagaagcaaaaaaaagaaagagcauuuaaaggcaucuauguaccugugcauaaggggaaaucuaaaauugauuggugauuucccucauaauuguagagucaauucuguucuuuuuucugcaugcuuucaucuucuacaagaagcacaggcaggagagucugccuagagacauccaguucucagcuaaugaauguagaugucaaugaacagaugacuugcaugccaccuugacuauaaagcacagcaguauaagugcaaaaguauagucuucaauuuuauguaugcuaaacuaaacacagagaaaaaaacacaacaauauugguauugcagcccuuuuuuaaaaaaaaucaacaucuuguuuguagauaauuaucucuggaaaucacagaugcuuagggaaaaggggcaauuucuaaacugaaagguuaagcgagauauaacuccucuaucucauggaggcuaugauuuaacuuaacaaaaaagacaacccaaguauguuugccuauugacugauagcagaaagaaaauuacagaauauugcacagggaaaguaaacucuugaacacugcuucauauuauucucugguuggucauaugugaugugcagcauccuucuucucaacugcuaugguccuucucaugaacuuuaugauaaccagguugacauauugagucaccaaccaaaaugggggucaaacucuaucagugucaauguuaagucaacuacacucaucuaguagcugaaaccacaugcuagacucaaugcaugagucccucagagguugagagacaauuagguuuuaccuuucuuuauaucuuugaaaaaaguuaaaaacaaacaccaaagcauaagugcauacauuuuaucauauuuugaguacuaauacugaaaaaauuaacuuuauauacaaauuaauacaauacaauuacuaucucugcacacaggaaaaauuuauucuaccaauuucugauucagguggacuuugugaauguuuguguguguaacaaagcaauaccacucacagguuuuugcuaacauaguguaggguuaauuacagugccaaguacagcuaugugucacuucuauucucuucuacuuuaaguggucuaucacacucagcaauuucuaguuauauuauauacaagguaauugcaugacugauaauuuuauuuacuuaacaguguaccacagaucauacaaccuagugaggggaugucuaaaacuuuccaauccaaauauccccuuaacccuccucuauaacaaauggaaaacccacuuuaaaacaagaaggucuacauccaggguuugccccaaagccaucacaaacccucuacccauugaguucuuucagauccugauaagguaucaauuaaaugagaucauaacaauaaaaugcuagccucuuaguuuuguccugauuaaagccaucaagggcaaacuuuauuucuacagcaauaaucaagguucucauucaagguuguugaaaauaagcuuccucauuugaacaagcuucuauuguaaaacaugaauuugaaugccaguggaguuuugaccuaucuucuaccauaauggguucacaaugcauugucagcuaggguuccuucucagggucuuuugauaucucacaaagaccuuccuaucucccuagacaaauaggguccacucagcacuccaggaguaauaguaggacucugacucugacucugacacacacucucucucucucucucucuuucuucuucuucuucuucuucuucuucuucuucuucuucuucuucuucuucuuuucuucuucuucuucuucuucuucuucuuuucuucuucuucuuuucuucuucuucuucuucuucuucuucuucuucuucuucuucgucuucuucuucuucuucuucgucuucuucuucuucuucuucucuuccuccuccuccuuccucccuucccuccuccuucuccuuccuucccucuauccugccucuccaccugccucccucucucucucauucccuccaucucccauuucuucacccuuuuuacucugauaggugauugucagggaaacaacauuacuacccaucuuauugcccuuuuauucuaucuaucaccauuauaauacaggaaaacuuuuaauuauuagauuauuccuuugaacaguaaugaggcucaggcugccuaccaaugaccaucaucaaacacugguaaugagcuagcacacugagacccagcaccugaaucccaucaugugaguccauuguucaggccaggugggauacuucugucuacaggcaggcuccugcaggagagcuggagguugcagggugcuuauuaugcauucaaucuggucucaugauucacacugaccgaaacaguuuuccugugugguccuagucauuuacacaccagugauuaccucccccauaauaaugucucauuguuuccuucuucuuuauccucaucuuugcuuuuaaagggcuuccuggagcugaacuucucaaaggaaacacuacuaauuggucauuuucuuauugcuacuuuugaucucuucaugaccuugaaagaaaaauaaacuccagaaacauuuggguguggguauagaguccuuucuuguuaaucccauaguggccaguuuauugccccuacacacaagaugcuagguacauucuaauggcuaucuauagucuucugagcacuacgaaagacagaccaaaucuacaggagacagaaaauauuuguccuuuccuauaggaagccuucaugaaguuaucucucuagauaacucaggaaaaugugaccaacuccaucuuuucccagacuuuauaaccuuucauaguagcaagagaacuucauaucaacaacagguacugucugcuuagacaaagcacuugaucuauaucaguuugugucaacauuguaaaucuauucagcccauauagagucaaguaaaaccauagaagugaagcaacaugacagagcccauuucucuuuagcuaagagcuuacagcuucucaguaaaccaagugaccaccaauuacugcuuuaaggacaaggaggcaggaggaucuagaaagacaacaaauuaaacaugaaagagaccggugcccaacauaggagaauuauccaucauaucucccacguguguaacucugcuuacauccccuauagcugcuucuuccuauucacaaagaucuccacacugacaccacacaagggugcucuguuuagggcuaaacaagcccuuccuuucaguuuuaugaaaguacaugaaaucauuucugacauacuacaugggggucagcacuuacacacuaugcuggcaaggauaccucucacuguauccucuaggauacaggaaagcagccaugacauagaagcagcuagaaaacuuguguacuuacuuaguauaauuuaacuuaaugugaaugauuauuuccuacaggcacacgaucauagaaaaugacauggugacaugaaaaacaacaacugugaacaaagcuacaagacaugaugccaucuuagcuaaguuuuucaagugcaccucugcucacagguuuuggauguauguuuucaaguagcuaugaaguuuacuuggagucugugguauggccaugcuaggucuuauagcggcaagugggcaggccaaguacauuaucaagcacucccucuguccgucuuucucaugacaucagagaaacaaaucaauugggagcaagucuaaucugugggugucuugcugcugagugcaauuuauuacaaucuucccuugucuaguaggcugaaaaguaugacaucauacucaaaaggcugguuugcagucaccaguuaucuguauaugugcugcugaaaagggaauuugagucagagggaaauaauaaaaauguucuccuaacauugaaacccuaugcucugcugucugucuucaagguacuugcuuuuaaagcaauuuuucuuaugcuagcuauugguaacuaauacaguugaaucuugacuuuuugacaaauaccaaaagcacugucuuaguuacgguuuuacugcugugaagacaucaugaccaaggcaacucuuuuaaagacaacauuuaaugggggcuggcuuacagguuuaaagguucaguccauuaucaucaaggcaggaacauggcagcaucugggcaggcauaaugcaggaggaguugagaguucuagaaauucaucugaaagcugcuagcagaauacucacuuucaggcaguuaggaugagggucuuaaaacccacacccacaaugacacagcuacuccaaaaaggccacaccuacuccaacagggccacaucuucuaauagugccacucccugggccuaacauauacaaaucaucagaaggaccauugcuccucaagacagcaaaaauaaaaacugguuuaauauuucucuugaaaaguuuuaacccaguucucuaagugaacuuguuuagaugacucuucuuuugagagcccuacuaggacugggcuuuguuggcacaacucaacucccaccuuuguccuugccuuugugugucauggcacaggcucugagcagcaaucccuggacacucagcugacaguacagacauguguacucaagugcucccaccccuaguccccugccccuccauuuuacuuuugaagcgacucucacauaaucucccuaaccagccuuccagucggaugcacaccagcaccacaugauacugcuauacacuaaacugcuacaaggucuguuccaagcucuuaccagauuccuuaaaaguuuaagguaguacuguuuauacaccaccaccaccaccaccaccaccaccaccaccaccaccauacaacccagagagaaauauauuuucccuccuaaacccagauguccaagagcucagaucuccaguuaagaaaguagaagccacuugguaagcuugcugcuacaugguauaaaugcagugccuuuuaccuuccauaacccaaaugggcuguauaacauccuccaggaggaacuucccaagcuaccuuucauauaccaacuacccaucaaauggcaucacuguguggcaggcaaaugauauuuucagagcagacaauaguaagccaacuggguaauaaacuuagcuggcagccaugccaagaggugggcucuccaaucagugagaacaaggacaauugcagagaguccaaaccaggcaggcuuaagauuaagauagagccuuggaaauucugcaucaugauuuuaauagcagauaauuuaaagaaaaugcaggaagaaaguagagagagagaagcgguaaggaggaaggaaagugaaagauaucauucauguuacuucucuggggagauucagguaugauuccaggaaagccugccuucuuggcauuacaauggacagacaagagccauuucuuguaguuucucugcuaaacugacagguagguagaucuagagcaaaggucccucccugcaugguucaugcugagaacucagagcagaagccaggguccguacacugaaaccuggccugcagaauauuucuaaugaaggaaacaagugugagguggaacuguaguucucuccaggguggaaauuugguuugagcaauagacuagagcagacagaaacagaccugguuacccuuguucucuacucaugcaagggcccaugcugagacaggcauauaccuguuccucuucagagaaagacugcucacccauauguccuaagaagccagcacaggggcaaaugaaacacuugugcccauguaagagacaacacagugagaugccagcacucagaccucgccccaugagggucuacugggggccaggacuggaaacuggccuccacuucucuaacauauagaacagaaacaagccagucucccugccaagguaaagagccacacugacucuaaaagucuuuaaaaggccauucucuuuuagccacacuuuguuuaauuucuaauuuuaaauuggucaaacagcuucuuccacacuaaccccauguuuuagcuuuccccuuugguuuacaguuacaccucuggccuccugaggguuaguguuauucuaguuugggugcauuuucuggccccuuccucuuuuccuucucucuuuaagugcauuugucuaucacuuccucuuuacugcucacccagucaauuuccuucuucucuuuuuuauccuugcccugauacuaacuaacccuuagucuuccucuggcuuuuuucuucccaucccuacccuuaguuauaaauaucagugcacacccuucuuuacuccacaaaacaugauauggauugaagaggcaguuuuauuuacuuggcuauacuaugcaguguuuugacucugagcauauccagucagugguccuacagacagcuuucucuuuccaccggagacugaacucugagcagauggacugagaguuuaaguacugggauacaccucuauuccugcacaaugaaacaguagcucaacuucacuaaguagacagacauggauacugaaaauauuuccacugaaagaagauaagugauuguuuuaaauauccaaccaucaagguaauuccaucuguacauaucucaacacaaaaaccacaagaaacaugagaaaucaagguguuguagcuccugcacacaucaccaauucuucaguaaucugcuugagggagcauaaauacgaugcaauccaaagaauucuaagacgacacuggcaaaauguucaagaaaaucaaaaagaauaagaauaaacucuggaaugaauuaaaaguggaaaaaaaaaaccacaagcuaauaaaugaaacaaggaagucaaugcaacauacaagaaagucccuuacagagguagaaaaacucaaauuaaaauuuggaaaugagggggcuggagagaugacauagcuguuaagaacacugguugcucuuccagaggucccaaguucaauuuccagcaacacacauggugguuaacaacuaucuauaaaggaaucugaugcccucuucugguguguagaaguuacaguguauucauauaaaauaaauaaauaaucuacaaaauaaauuggaaaugaagaacucaguaaguaaaauuuaaaagcacugugggaaguaucacccagggaucaagugacagaccgaguaucagggcuuaaagacuagguagaugaguuagaacacuuauauucuaacauaauaaaugaagaaaauaugauagaacauguaagaucuaagggacauucguaaaaaaacaaaugcauuaucuuggacauucaagauggaaaagcuguucaagcuaaaggcauagaaacuguauucaaugaaaucugacagacuauaccaucuaagaaagagaugucacucagguaucagagacacuaacagugcuaaauaaaugaaacucaaaacuuucccauuucacauuaucauuaaaggacaaaauauauagaaccagaaaagaaugugaaaagcucccagggugccaagucacuuauaaagcaaacuuugaaacauugcugauuucucaccagaaauccaaugagccaaaaggacacaaaauuauaaaguccaugcucucaaugauagugguuguugguccagguuauucaucaaggcuaugcuucagaacugauagcaaaagacagacuacccguuaaaaucacaaaugaaaugaacuguuagcuauucagccuacacuauagaauauaacuaaaggaagccuggauacugaauaacgagacacuucuaugaggccauagcaaagaaugaaccaggcuagagcauuaagcaaggauuaggaauaaaccaaacauuauaaaaacaauaaaugaaaguaagugauauauauacauuuccucaaucacuuagaaugcuaauugccucaauuuucuaacaagugcgaucaaagugguacugaagggaagaagcaguacaugcccccccccauuuguaaaugauaugaucaugcacagaagagaucuacagacuucaccagaaaacuuacaugugacaaucacuugaucaaacuagcagcuuaccaaaucaaaacaauuagcuuuuccguacaccagaaagagaccagacaaaguccacucacagagcuccccaaaugaauaaauacugagaaugaaccugggcaaagaaguaaacagcucagcugggugguggggucacguucuuuuaauccuuagcaggcagaggccagugaaucucugaguucaagaccagucugaacuacagagcaagcuccaagauaaccuggacuacacugagaaacccugucucaguggguagaguuggggucaaaagaagauuucuucuauguuuauuuuaaaacauggagguaauugaacaugaucuuagaaaaucaaaagaucuucuuuggucaaagagggaaugaacaguuggaacugucuuuauuaccaaaagcgauuuaaagaauuuaaauuaaauucaaauuuuaaaucacuuaaauuaaaauuuaagaauuuuaaugaaaauuacaguagcauuucacucgaaaauaaggggaaaauaaaccacuucaugaagaagcccaaaagaucucagagaaccaacauauugcugagcaaaaaaaaaaccaaacaaacaaacaaaaaaacaaaaacaaaaacauauauccuggaagcaucaaccuauauacuaaguuauacugcuaaguuauaguaacaagaacaauguggaacuggcacccagguagacuuaaagauuagugggacaauauagaggaccucuacauacagaagaguagaacuagauuccagucucucagacucacuuuuaugcaauggcuuacaucauucacuggaauguuuaugcaaauggggaucaugcuuaaaaaaaagaaaaaagaaaagaggcagacacauagagacaaauagcacaugcauuugcucacauguggaucaggugcaugugcagagauguaguuuuaugauacaaaagcagaaugaagauuagggaggggcagggaagagagagacagggaugggaacuucagaguaugagacucaaugugacugauauacauugugccuuugagagauugaaacacagcacuacguauaauggcuauauaccagcuuaacaaaaguuguaguuuccauuccagaaaccggcuuuacacuaaugauccauggacacuguucacauagccuuaagauggcuccaccccccucagacuaaguugcgaucauguuguacacgugccagcaccuggaauuuuucugugaggagcuugaauaacaaacuccuaggguugacauaacacguucugugaugauccucugacuaaucaucuugcuaauaaauaucuaaagaccacauuuuucucugggcuuucagcuuccaugagaacauucugauugugacauaauuuuuaaauuaguggguuuauucauaguuuuauauuaguaaaugucaagauuauuacuaaugagcaaacuguaaauccucaguaguguuaauuuuuaauuguacaaggaauuaauacaaggagaaauaaggagacaauuaaacacuucccaaggguacucauuccuaugaaauucuguggagagcaaggaaacaugaagccacauugaguguguguuuagaaaggauggagaaagcuguguagaaaggaacuggguaaagaccaugccuaccacaagauuacccuguuuacagccucacagcaucucucuggccacugcuacugcaauuucccugcuagccuuugguuugcuaaaaugcccauuuccagcaauuuuuuauuuuguaagguuuuauuacuuccuuauugaaccuuccagucuaaucaccagcucaacugcuuucgcuugagaggcuaaugcuuaguauaauacuugguucuucaaaagcuaugccaccaaaguucucuuacccaggcaggguuugcuaacaccaaccucccuuuccccgcuaaccuacugagugaaaagcaugcguaccuguggauggcucuuuauccucucaguuccagaaugugagaagcaugugccacucgugggcauugaugaaacauccuuauaaagccauccuacaaacacucucaagcaaauacaauuguuucucaaaccuuccuaaaacuuaaguuuauuugcuaagauuuuggggacuaccuguguugguggccaugggaaccaccugucuuaugauggcaagagguccuuuaugcauuuuuuuccuggaagcaugccagauugcugggaaccagauaguacccuacauuuuaggaagccaaguacagauauuucaguaugauagcucccaaaguuucuaggucacaguuaauaauacaaaagugugacaugauuugcucugauggagaaacuacauagguuuggguuuuguuugguuugguggguuuuuguuuuuauuuuuguuuuuguuguuauuguuggguuguuuguuuauuuguuuguuugagacagcacuguguagcccuggcuauccuggaacuaacuguguagaccagagugguauaaaacccauauagaucugucugucucugccuccaaagguacaugccaccaccgccuggagaaacugcauaauuguaaguguauaagcaagcuaauguaucaacaacuauaguuuccauuuggaguccuugucuucccucaccauggcuagcaacacagcuuguuauacaagauugaggucuuacccacaaaaauaagaccugaaccaauuagcaugcacacagaggaguagaggaguguaugcugccauucuaucccccaucucccaauuacacagccugcauacaugcguaaguauacauuuauuucuccacaucuuauagauggugaucuccuuggagguaggaaagggaggcuuaaguccagguuccuuaccagccuccccgugaacucugaccuaagcaguguauggaaggcaaaaccaccucuaugagugguccccauucaccuucacgaagcuacagauaaauauaaacuugaacuaggaaccaaguggauuuucccauuacuucccccgugggaacucagguugacagcaugaguuuguuucucaguuaagaauuggaagaaauguaaaauagaaagagagaaaggagacccuuucuucaacuuuagcuuaugagcuuuccaucaugagcacgugggccucagcuaguaagugacacguugucuccaggcaggggagugggagaaucauccugauguagcaugugaugugucaaggcacagauauagggaagauggcaaaaaggugccacagauguaauugagagagaguuccuuuacuaaagaaaaaauaagacugucaacugccuucauauccaaagccacuagcacagggccaaugaguauccguuaaaggcagagcgaauucauuccuugucccuguugcuaguacuuaagaucuauugaaagcacccaguaagggccuacuguuacaauccacaggaugguccauuuaaggcuccacucuuucuccaaagaaagaaucaagcuaugugauauuuaaucuaauggauaaguuacagugggaaaguggaucugaggucuucauugagguaaagaaguagaaagacccaagccaaguuuuuuuguagcuacucauucgaaauaucuggacaacagauagacucuguguguguguguguguguuugugugugugugugugugugugugugugucugugaaugaguguaugugcuguguaugugugcacaaguguguauagauguauauaaguauauggaagacaggauaauuuuugguucuccucagcuaccacauagcuaucaauuuauucauuuauuuacuuacuuacucacuuacuuacuuauugagacaggguuucucacugaucuagaacuuauuaagaggauccacuucaaaucuguuccuaaugcuuuaccagcugagucaucucucuaacucaaagacaaauucuuaucaacagaauuagugugcccaccccuccuuugccuuccaugauuaaggcaguuacagccaaguuacaaaagcacaguggcuguaaguugcuauugagagaauauaagauagucaaagacuguuugagucauuuuuuccugcagacucagaugaaaaggaaaaaaaaaaaaucaccuucugucaaggguguugaaaugaccaaaucugcaauacccaucuggacagaguacaggugaauaguucuauucugcuggaagaaauguacaaaagaauccaggccauuauccauggugacuuuaaaaaaacaguucagggacugaaauuuuuaguucugauaccauuugaaaaaaaaaaaaaaaaagagagagaauguuggcuucuucuuuugcaauaaugccagcuccggugcuuggguaugucagugaacaaugcucucugaccaaauggugcuaucguuaacagcucuagcuaagggggaaaguccugcuauuaaugaugacuaauaucacauacauucuacuuuguauugccuagaauacaugaaucugaaaaacaauuuuauuaauguacagaaaaaguagaaaagucguuccaaucauuuggagauauaguaagaucaacccuuugauuauuagaaacugaggaauguguguuuauucuagcacggucaucuaugaguucaguucaggugcucauugacuacuuaacacuaccacgaaccagccuuuugucaagugcuggauacacaaugaaagaaacgggccccacuugcaauaacuaugcccugucacugcauuugauaaugaccugguuuaaauauugcccuuuauagugaugaagagaaagcuugagaaaauuagccuccauucucugauccaaaagaaaaagggaaacaagcuggacaacacuacguucagacaguuagguaaucugggccaauaaaauaaugguauagugcacuugagcaugacacggugacagacugccagaggaggcuccuuggacaaugagucuuguuagaaaccacagcuaguuaggaagcaagccaugcagguuagucguuaguuagggugcucuguuugucuuccaauccuagguuucaagagucaccuacaacaucaguuaaaaggauaagagaguuaucugagcaagagaguucaauacgagacaaagcagucuuacuacucagaugagaggaauauaaauugucaacucccuacagacuuacuugaucagaaucuggaacaacuugauccuuagagaaaucauuuauaucuuaagacuuugguaagcuagugaucuuggcuauuacaagcagcugcacauaccacccauucauucuuguguuugcaucacuguuugagaauugugagaaucaaggaucaagggaaaggguugcuuuaaggggaggcucuucuagaucuuuuaaaagaaaacuuaguccaaguuaaacuaggaauaaaauacacagaaauaaggggcuacaucauuuaaacuucguuuaaauguaaaugggauccuuuaagaggucauuuagcaagagguaauaugaaauuuguagagaagacucuccaaagugcaaagagaaugaacuacauagccaagcaacauugcaagaaacacuagucaagagagugcagagaggaggcagagacgaaugggaaggacuugauucagugaaguagcagaaagcagaguaagauauggucagauguuagaagaaucaguaagacuuacuaacugguagaauuaaggaguagcaguugggaaauggggaauucaaagaaccaagcaacuucuaggccccaugguccacuuggaccugcucuaaucccauuugaaaaaugagagagucuguauaccacacaucucuuugagcugaugguuacaacguaaugccucauuccuacuucucucuuccuugccaucaaauucuuaccugcuuuucccuaauaagaaaggcaucagagccauauaacauugcuguaagaaugaaagaauguaaugcuauuuuuaaaacaaaaugaacaguagcugaaguucuaugacaaaucagaaaucccugguuuuaaaauuagaaccuugaguuuccaagcuaugucgucacagguaguaccuacaggaagggcaccaucagccuucucaacacuuaaacagcaccuaucuccugaagcaaagagaacuaaaaaacuugucccuggaagcgagcuuaagccucuagaggggccacuucuaaagaguuccucuucagcuguaaguugugcuccuccuuuugaccucggucuucauucacaggaggagaagcucuucugagcucagcaaccaccaucucuauaccugggacgaagcauccuuggacgagucaccaugccacuccagucaccuugaggacaguuucagaaaaccccucaugacagagauccauucuuuccuuucaaauaucuguuuuguucuauaucucccauggcagguaaagccaggccuuccucagcaccacuugcucccuauuuguucuggggcugaaauccaaacgugucuccuauuauagcugaacuauuuuuguguacauuuccuaccaaauucagcagaaaguugacaaagggcaagguagaauuccaggcaauauuuuuuaaauagaauuuuauuuuuaaguuccaggacagagaacagugagcugccucagaaugcauaauguuggcagcagcauuucucucuuucuauagguugcugggaacgucacuggucacguaagaaaacuaacccagucccugccuuugucuaagaaaagacuggaauuuuauucccuaaggagaauuuuauuccaaggccaauuauuuuacaaauuggauucacuguuuaccuaauaugacauaaugagacucugggaagacagaaggaaaaucccgcaauugguuuugaggaacccugcccacuuaggguauucucuggggucuuucuuucuugauuccuuuccuuccuuccuuuuaaauauuaucuaucaucuaucuaucagucaucuaucuauuaucuaucuaucuaucuaaacacccauguuuaagccuguauuaaaacaguuguuuaauaaacuccaacucugcuuccaaaugaagagagggaaggagggagggagggaaugagaaagaggaagaagggaagagggagagagggggagugagaaaucagaagaugacgguaagucgggggagagggaaaaagcaagaagcaucacuccuuugccaagagcuugucugugacauaaugaaucuccaggauugucuuaauauuugaagauuaaaguagguuucuagcucccugugucccuauuugcugguugaaaugcuuuccaauuuaguucuuugggaaguuuuguuuguucauuggguaucucuacgcagccuaagcugggcuaggaauacaggcauacagcaucaggaccagccuauuugucuuaaaaugaaacaccuuauugauauauaauuggcauauuaucaggucaggagcaugcaugauugcaagggauuuuaauauauuuagacaguuguguagccaucaccucaacugauuuuagacauuuucauuguugccuguggucuucuuugagaauuucagagugaacucuuaucuauaccucucaucaauuacaucagagucugcugcugagccacaggugccuggaacuugugaagcucccuaggugaccucaagggucaagugaguuuugggagcaaugcuaccagcacuggaugggaaagaaauagaaauaaagauauggaaauugcccaacaugaagaugcaucuauguuauaauaacccuaaggugguuucagggaaaacgcuauugaagagaaaaagaagggcauccuacagaauggugcuggugcugcgacuuguccaaucugggugaaaaugaucaaguucucauagugaccacauauucaagaauggaguacucugagcaucuaagaugugcacaggagugcuggugaggagagacuagaagaggugagaaauaaugauuccaguaguuuccaagcuuguuggugucaaaagcuccuggcugcucuuccagaggcuagugauguaugguuccuuuguggugucucuucccacugagucuuaugcacugcaguguuaguuaaugaucuguaacacucuccaccaaagcacucacuaggcaggacagccuucacagcugagcuucacucagcacagugacaacucuuugagaccagacguaacaccuacauaaaaaaaacaaaacaacaaaaacccucaaccuacuugaucaacauccuugugcuuguuuugacaaauauuuuuuggacccaaccacagugaauucacaauuacugucaaccaagaagaaagaaaagggggcacccaucccaaagagcucaggacgcuuaauggcugcuguagcuuacagacgacuggcaagcaagaccugcaauuuuucucuggaagguacauccugagcagaagcacuuugggaaguuaauaacuccagugaauaaguggcaggaccacaaacuguuauuaagaacacugaaugauguauuaccaacauagagaucaagaaaaaaaugucauccaggggagaaagauuaauuaauaucaauuaauuuucuuuuaaggaacagauuaugcagaaguccuuaggcuuuugaggagaaugugggaaauuuuuacaguaugcuggaauuugcauauacucagaguaaaaaucagaucguccaaguuauccccugggguauccucaagaugaagaacaaaggacaguggcguuucugcuaguguggaguccuggggguggaaaggaaagaaaagcaggcuuuagauggaauagagaaagcuuauggcuuggaaaaaaagacaauuauaauuacaauggagucauauaguuacacaauacacaagacuauuaaguaugcugggcugaaaggagaggguuuaaacaaaaacauacaaaaugcagaaaagaucagaaagcaaguuaccuagaaccccacauaagaccauuagagaaagaacucucuuuccuuagcauccccuucaaguacaagauaaugauauuuaacuugugacacaggcagagaguauaagagacucaccaucuagcaaacuaggauacaucaucucuuugcuuuuugcuuuucauuucuaaauuauaccaggauaacacuccccaagguugcuauggaagauuuaacagacauuacuuaaagaaagcaucccauguucaaaaagugcugggaagaaaugagaucagcugaccacguggguuucuucuuauagaacuuauggaagguuuguugcauuaaaauccacuuacaacugcagaguauaaccuguaguauuucucuaaccagaucacucucucaauagcucucucaaugucucucucucaauguuucucucucucucccccagccccugccuuguaucucugugucugucugucugucugucugugucugucugucugucgcucucaugcauguguguguuuguguggaaguauacauacauauucuugcauguggaacuuggaaguaaaccucagcuggcauuucucaggugccaacaacuuuuuuugaggcaaggucucugaccagcaagggguuugauaaguaggcuuggucagauugcuaggaauccaggucucuaccuccacaauacuaagauuuuaaauuguaugacacuacacugggcuuuuuaauguggguuuugggaguuuguaguuagguccuuaaccaaagaauuguuugggcagaggaaaucaagugauuacuuucugcugaauacucaauaugacuugcaagucucuuuuuuaguuuauagugcauagguuuuucuguuguuguuuuguuuuuuuuuaaguaaucauuuggaaucaaaagcaaaaaacaacacaaucaccacuauuaaauaggcuaacaauuuccaaaaaauauaugcaaaaaaaaucuccaauuucaaagcacucugaaguagucucuuucugcacacacacacacacacacacacacacacacauacacagagucaucuuuuuauuuuaauucucuaaacaaaaauuucaggcuagauucacuuuguauuuuauaaguaguaccuuuucucuuuauugaauauacccauugcacacuagccuguagacaugucuauaaauaacauagggacuuuauaauuauaauauauaugauaaauaaaacauagaagagaaacuugauaaguaaaauccacagucaauacuguaaaaaaaaaucacacauccacaaccuccaugcuguccugccaacagaccaugaacuucaucagcugucucuuuugucccuuguggcuucuucccuccuuuauacaccacucuugcccuuuauguccuagaacacacgccaaagccuaacaacccauggacggaaaagacaguaucuuuaaagugagauaagggacgaugcuuagcaucugucuuauccaggucaaaagucccugucauaaccuauugcagaaagagacuaaugcuggcuguuuccuaggucuguaaggaaauggguucuuggauaggcaagcacagccagguaguagcaauguucuuuaaauaccaccaugaaauugcuucuaagggggcagcaugguugauggaugcucaacuagcauuucauuucauucuuaugacaucgagacaagguagcuucuauucuccuauuugugacuauaugauguccccaaagugaaaugaauuuaucaaguuccaaauuuccugagugcgaggcucucagacucacagcagaaucuacucaaggacaagguggaaauucuucagcacccuugcccacuuuagcucacaugaggcugcacuccgggaugguaacucauuugcacagagcucuugaaugacagagaagggaggauaaagacaguuaaacuuauggggccuugagaaaagaaccuuaccuaggaugagucagaagccuuucccagcagagaagcaagaauuccagcauaauuaucuacugccuaaagaaggcucuuccacuccccagcuguaaacgugcaauuuucuaggaaccucgccagaaccugcuaaacaggagaagggcuguacuaaagcccucgugugcuacugcacuguugccuucucuagcauaagcacagauaacaaacacacuuccagagccgcccuccaaucacacucaucaagauagagagaaaagagaaaaguguuccuuaauuauuacaaaauacuuaagugugugugagugugugcaugugagugcaucccugcagcccuggaggccagaagaggacauuggauuguccggagcuagagcuacagguggucaucauuccacugaugaaagagaaggcaaguaaacucagaucuaaaagcaguacuaaaugcuccuuagcacuaagucaucucuccagccuucaagaaaagguuucgaagugaucuccucagacauaauuuugggccacaaaagugguauaugaaaauaucuuuaaugcaaucaucaacuccuucccauccuggcuaguccuaaaacucuuuuuccauguagaagcaacaaauucugauugggucugaagugaggucccuaagagacagaguaaauucuuaaggcuguuaaaggugacagugcagggcuguaccuccacuggcucaacacugauaacaaaaaacguggccacauuucacugggaaaccaccaggggaagucccaagaacaucuguggccaugccaccccgggguuuggcuuccucugcaguaguauguaugcaucguugcgguuugaauuucugcugaggagcacgugugcuuuucugucucuagagcccgaacaaagccccagcacgagcagagaaaggagaauuauaacugcaaaaaaggucugccuccaacacugcuguccaucccagcagccuccagaguggacuuuuguacuuuaggaauuagggguaccuguguuuuccaagcagaggacugauccacaggaagaggaggaagcagauacgacugguaggcagcccucugcugugagucucaggaagugagaucaaagaucagcugcaguuaaaggcuggagugaagggugggggggcggggcgaaaccgcucucgcggaggauucugaccuuucucuacagauaaaggcagaggcucacauuuccugguaauccacugugugcauauuuacguuccugagcuuuucauuauguuguucaauguccuaaguaaacaaugaugcuaugcaggaaggagcaagcugagugaggagguuaaggaucacacacacacacacacacacacacacacacacagagccucuuccugcucuucagcugucugcugaggcacuuugccucuggugugcaaaccaacaagagaaaugacuucagcaacuuaagcuuuugauugagcucagaaaucuuuagcucugccuuucccuccccuacaucucuaccacagacccaaaucaucauggccaaauugacuaaaacaagaaauguauuaaagcaagccuuuugauucauguguacaggcugccucccccuaagcagggguucaauaggucagaauuggaagugaggaagacacacauggcuuuuauagaucacagguagaggguuuccaaaauggggaauuuggcaggcaaaacaggcuagguuccaugagcagaacauacacaggacaagguagugucuccuaaaacaaagcugugggggcaacucgggcauuacaaaguggucaugccaagguagcuauaacaacccuuuugaacaaagguaguuuauaauaaacaacuucugaaacaaagauaugguugccauuccugaaacacagagaacagaaccauuuguaguuaaggguacaggucaggcacggccccaauucuugagacauaaguuuaaaucauaaacaugaauaaaccuaguuuucuuuaauauaagauggcuuuuaagacaaauauggaaacaggcugguucuucacuacucuagcuuugcccucacugauuugcagcagggcccagaaaaacuacuggggcuaaaagguuuguauggucgguuugggagaacuaaagcuuuagaaaccacuuccaaucuccaguucccagguaacacaagacagguaaacaucggcuuuggaauucacagucucacauggaaaagugacgguaucuuuguucuaaguucuuucucuagcuuuggguagagagacccgaccuuccaggcuauccuaaaggagacuagagggaucauuaccccaucagugagacacugugccuguccuuccuagaaauuguucccacugaggggacacugcugcccguguggagggagagcacauggcaucgcugggcugcuuucugacucagacaaguguaacuuacugucuuuuauuuuuguacugauacuggacaaagguuaagaauggcuucccuugcucucuggguuuuccacucucccucugaagccaccucuccuuuugccauuuagcugccugugcauuuccauuacaaugaugugcuuccaucucccugguccuuauggcugcugggguguaucucuugcaaaucuuaccuagccugcauuguucucuaaauucuaauaaaguuguucucaagcuucccuuugaguucaucucuaacuucucuuauuaauggggcuuugacugaaaagaacuucagccuccguaauaacaagcuuaagcuuguaucaucuaaaugucacacauggcaacugggcuuguuccgcugcagguugucagccauaguugaagaagaugagcuagagcauggauaagcucuaugaucuccuccuaguacccccagcaacacagacuugggaagauggcaauguaagaacugagaagagcccaggcuuggacagcaguuuaguggaccacaccaugauccucuuugaauccaggggcuucaguaaguauguggggcugcagacuuaaaccgcaacaucccaaucaugggcuuaaagcaaagcuuuacuguugauccauacgaagagugacuuugcucaguucuuuucauuccuuccaccucagacccccuccucucagguaauaccuugugucucucugcauucuuccuuccuuuucacccuguguucccguauucauguguuuugugucaacagugaguauaaaauuccugaggauagggagacuuaccugucuccuugccaucaugauagcuccaagaggaucauuugaauuaagaacaaagaaaugagaggacaaauggggggacucauucugccaagcaauuuacaucuuaguauauuagaaauggcagugagcgauagguguuagaguaagaaagcucuauaggaauugcuggagccaguaggcagcaggcuaguuuggcagugacuaugggucauguguauacacugacauagaccagcaaggagaauguucuaggcauagucaggucuagguguagcacaugcugacaucgggaaucugaggugugggcugagguccagcugccaagaucuuuuaauaacaaacagcagacucgcuuuuuugucuuuuaaccuauaaacaucagaaagaggugcccaagcaauggccacuuguuaugaugucuaggaaggcuacaggggcuggaaccaguagcaagacgacucuaugggggaauguagaauaagccuuacccaagauagaguacuuauuaauuuagucaagaaagauuuccauuugaaagaauaaaaaaaguaggaagaugacaacacaaaggaaaaguaguaucauuagagagcaacuggcuucagggaaauaacauacaucagaagggaacguguacaugguuauucuuagaugcaaagacauaccgaacugauaauuuggaaauagguuguuuaucuaucacaaaacagggucuguauuaccccucugugcucaacuauggacuacuuauggauucugcaagacgaaaaguuacugucuguaguuauauauccacugaguagccuaccauccuuuugauaguugcaaacccauagucacaugacagaucauuguuaaacucagaggauuucaaaaacaaaggggaacaaaaaggacaugagggugggacagggggcuguauagaggucagugucauagaccagaaaggaagauuagagaaggugggaaguuacaguaaucagagcacaguuuauacaugaauggaacgguuaaggaacaaauucaauaaaaguuacaaaagaaaauaauagguaaaacuaaaauuuaaacuuauauaagaaguagaagguaagguacagaaauuuucugaaggcaaagaaagaugggggguggggagggagaugggaaaugugagagaacuaugaagaagcaaugaggaagugucuccaggagggcacagugauuacuaaacuccaaggguccagugccugggagggcuccagggaaaaacauaagcaaacagggaagaaaugaaagauagcaauucuuuaggauucaauaacauguaaugaugaaacaauuccuuugccccaaguccuuggagcauaaagaaaucugggacaagcuguucuuuucccucaucgaaaaagagacuuucaaaaagucuguggccaaacagguggugacgguaaucaauuuauuuccauugugggcgaaauauaaaugaaaggucucuauuucagaaaaggccaugaaaaugcgaagacguuauuauuugcaagcugagaggcgaggugagagccucugccuggcacauuucagaaagguucaaucagcuggggcaaggggggagacuuaaaauagaaaaguaaugggaaaaggcuuucuaugaacagagaugauggcuggugaaaaccuaucccucuggagccuauucuauuaauacacauuuaccaggcagcuuggagaguuugaaaaaaaaaagccuauauaguucuuauuucccauagcuucugggacuaauuacauauuuuuauccauauacggauggauagacacacacacacacacacacacacacacacacacaguguuuuuauauagugacagagauagcugcauacccaaauuguaguuccuuaucuuaaaauagaggucuauacugucuuucaaaaguaaagaagaaaaggaaauaguaagaggaaaaauauuggcccaaagaucgacuauuuuacugauuuauucucucacucaacaauuacaaauugguuguuaccuuauuagaaacacagaguuuggcacaagguucugacuacugagccaaguuaggaaacaaacucucacaguuuaaaugcaagagauacauuuauucaggaguuuaaauucaaguauacaggcuacucagguguuuagaauacacccagguacuugucucuguaauuugcauccagacaaauuuuugccccaugcucuguugugggucaaaaauaagagaaacaauuuagaacuuaaugacugcccaauaaauaucuaacacagaaauacucagcugaaagcagcagaaguguguuuauugaaaguauaccaaauagaagggcugguaauaaaucucuuggugaaaauguagucaaugggacauuuaaugugauggcagaaucuucuuucaaauuauucaaaaauugguuuuguacaaaaacaaaaaacaaaagagagaagcauagucuaccucacucaugauauuccuaaggcauuuauuugcacacuuagaagacaccaaugcuaagagaguuccuugaauauuugauuuuguuuggcaaucuuaucaguucuuuuaauuaaaugacuauguauauauguguguauauauauguguguguguguguauacauauacauacacauacacauacacacacacacacacacacacacacacauauauauauauauauauauaauuguccagccacuccaggacauuuaugaaaacaagaugcugucuuaaugaggugagcuucagagcgacauuugacucauuagacgccucauuagcugcuaugaaaacacacuucaaucuucccuucucgcuucccaauauuggccagcaagaauucaguuacuucagugcuuccaggugagucgggcuucauagugagcucugcacagguuaaaggaucacuuuaaacucccaaagaccuaagacuacacacacuuaacucacagcacgcucuacuucagcuguaggcaccauagggaaaaagauggaaaggaaccaaccuaucugccaacuuuauuaugggaugccagcacagggagcagacauugaaacacacggaaaggcacagaggaccacuuuucuauuaaagcauuuaguugacaaguguuugcauuaucugcccuuuguuauuuagcccauaguuuaaacauggaacaacagaaaaaccuucaucuuaaaagauuuaugugggcaugugcaugugugcauauguguaaaacuuggaaggcauccccagcaaucugcuugucugggguuacaaguauguguggaccauggcuuuuuaugugaguacuguggauucaaagacaguccucauacuuguacagcaaaaacucuuucccucugugccauuugacagccucugucucuguauuuuugcuugcugggaaucaaacaauuuauuguaugaggaaaucauguuuguuugaggcagucuugcucuacaucagagacuacucaaacuccaggaucuuauaccucaguuucccaagugcuggauccuugguguuuucuaccaugucuagcuagaauacauauuuuuucaugagaugggcauuaagaacaagaaaggacaagcucaaaaauuaauauaaaguauaacagcugacaccaaaggaaagugggucuuauugauuugcaugccaauauucuaaaauaaugaaauauuguuaugcacugugacaacuaaagagagucauuagaaauuuaugugugugcaugcacuuaaaaagacaugcuucuaacuuucauuuucacuacuuggaagagcuaauuccuagggaaaauauccuaggcuucuuuuuuuuaucuugacauuauuuccuuugacaugaaacuaacuacaaguaaauauauuaaguucucaagugaaagaaaauaaucauaugauauaaaauucaauaucauaucaagauagacuaacauaguaugguaguuuaaauaaugguaguuuucuuuaaacuugucucuuauagcaaaggggggagcauauauauauauaugaaacuuccugacuaaguuaaugcccaagggaagaacugaucuuucuuggaaacaguugaagccaaugcuuacaguuugauaaagcaaaauuccugugacauagacacauacacaugcauauacauauacaucauauauacauacauacauacauacauauaaaugcacccauacauauaagcauacauauacagacuuacacauagguaaacacaaauguauucauacauauucauucauauacacaaacuuguauauguauacacacacaaaauugauaguguauuuuacauuagcuaagcuaguacuaugguuuaggauaaauuuaaagugugugaagacauucuuuuauuucucauugaaaaagaaggucuugauguaucuuucugagacaaggaagaggcaucguaauguuaaucagacacuucaccagaacacugacaucuuaaggugucuagcaaaauuaacagacuagguaggaaacacaagacauccuggcuagucacuuacucuguagguuggaucuggauccuauuccauguauuucuagcaaauuaaauggagcaugagucauuugaguaaugacucagaaaaugucuagccgccuuuuucaacaggagauacaaugccucagauaaaauuuagagguauuaggauggaguuuugauuucuucucuagguagaccauaucuuuucuaucucccccuucccagcaaacagaaguuaggccauacgcuacauugaggcuuauuucagcuuuaaaauuuaaaguuucacaggagaaccauugcaagaguauaaaaaugggaaaauauugaaaauggaaagguauguuuugauuuguuuuugguuuucagucaguuuuugcagugcuguguaguagaaucagugguuaucuaaaucacaauuuugccuccaaacaccauaaacccuuguuuauaaaagaaauugcuggccagagaagauaucucagaggguaaguguccuugcugugcauguauuagaaccugaguucaauuccauagcauccaaguaaauagucaggcuauacgaggcuguaaacacaguacugggauagagacagacaaagccagggaacauaauagcugaccagacuaacugaacuuugagugucugguaagugagagacacuguacuaagggaauaaaagccacaccagaugccauuuucuauccuucaaauauaggcacaugcaucuacauacacaugucaaccuguacauacaugugcacauaucaaacacaaacacacacacauacacacacacacacacagagagagagagagagagagagagagagagagagagagagagagagaaauuauuuuuuuaaaacuguuugaagguaaggagauaaagaugcgagcaucagcaacagaauaaaagggauagaauagagaaucucaggugcagaagauagcauagaaaacauugacacagcagucaaagaaaauguaaaauacacaaaaagcucuuaaaccaaaacacccaguaaaaccaggacacaaugagaagaccaaaccuaaggauaacaggaauagaagacagugaagauccccaagcuaaagggccaguaaauauagucaacaaaauuguagaagaaaacuuaccuaacauaaagaaagagaugcccaugaacauacaagaaaccuacagaacuccaaauagauagcaccagaaaaauaauuccuucugucacacaauaaucaaaacaccaaaugcacaaaacaaagaauaugaaaaguaguaagggcaaaaggacaaguaacauacaaaggcagaccaaucagaauuacacuagacuccucaccagagacuaugaaagccagaagauccugggcagaugucauacagacacuaagagaacacaaaugccagcccaggcuacuauacccagcaaaacucucaauuaccauagauggagaaacccagguauuccaugacaaaaugaaauuuauacaauaucuucccacaaauccagcccuucaaaggauaauaaauaaaaaccaaaauagggagggaaacugcucccuagaaauagcaagaaaauaaucuacuuuuaauaaaccaaaacgaagauagccacauaaacauaauucuacuucuaacaacaaaaauaacaggaagccacaaucacuuuucauuaauaucucuuaauagcaauggacucaauuccccaacaaaaagacauagacuaaaagacuggaugcguaaacaaaauccaccauuuugcugcauacaggaaacccaccucagugaaaaagacagacacuaccucagaguaaaagucuggaaaacaacuucucaagcaaaugguccaaaaaagcaagcaucauagguaaagucuaacaagaugaacucucaauucugaacaucuaugcuccaaaugaaagggcacccacacucauaaagaaacuuugcuaaagcuaaaagcaaacauugcaccucacauaauaauacuuggagacuuuaacaccccacucucaccauuggacagauccuggaagcagaaacacagugaaacuaacagacguuaugaaacaaauggauuuaacagauaucuacagaacauuuuauccuaaaacaaaaggauauaccuucucagcaccucacgguaccuucucuaaaauugaccauauaauuggucauaaaacaggccucaacagauacaagaagauugaaauaaucccaugcauccuaucagaucaucacagaguaagccugucuucaauaacaacaaaaaccuuagaaaguucaaauauacauggaagcuaaacaauguucuacucagugguaacuugguaaagggagaaauaaagaaagaaauuaaagccuuuuuagaauuuaauguaaauaaagucacagcauacccaaacauaugggacacaaugaaagccguguuaagaggaaaacucauagcuaugagugccuccaaaaagaaacuggagagaccuuacacuagcagcuugacagcauaccugaacacucuagaaaaaaaaagaagcaaguacacacaagaggaauagacagcaggaaauaaucaaacucaggguugaaaucaaucaaguagaaacaaaaagaacuauacaaagaaucaaccaaagcaggagcuggcucuuagugaaaagcaacuagauaaacccuuaaccaaacuaaccagaggucacagagauaguauucaaaucaacuaaaucagaaaugaaaauggaaacauaccaacagaaacugaggaaauccaaaacaacaacaacaaaaaaaaaaaaaaacaaaaaaaacaucagauccuacuacaaaaggcuauacucaacaaaacuggaaaaucugaaugaaauggacaauuuucuagacagauaccagauaccaaaguuaaaucaggaucagauaaacaaucuaaacagucccauaaccccuaaagaaauagaaacagucaccgucauuaauagucccccaaccaaaaaaaaaaaaaaaaaaaaaaaaaaaaagcccagaccagauggguuagugcagagcucuaucagaccuucauggaagaccuaauaccaacacucuucaaauagaaacagaagaaacacugcccauuuuuuucuaugaagcuacaaucacucugauaccuaaagcacacaaagacccaacaaagaaagagaacuucagaccaauuucccuuauaaaugucaaugcaaaaauacucaacaaaauucuugccaacugaauccaagaacacaucaaaaugaucauccaucaugaucaaguagguuucaucccagugaugcagggaugguucaauauacagaauccaucaacuuaauccacauauaaacaaacucaaagggaaaaaaaaaaacaacaugaucauuucauuagaugcugaaaaaguauuucacaaaauccaaaaccccuucaugguaaacaucuuggaaagaucaggaauucaaggcccauaccuaaacauagcaaaagcaauauacaguagaccaguagucaacaacaaacuaaauggagagaaacuugaagcaaucccacugaaaucagggacuaaacaagguuguccagucucucccuaagaucaagaauugacaaaugggacgucaaaaaaauugcaccuguucaauauaguacuggaaguccuuagauagcaaaaggagaucaaagggauauaaauugaaaaugaagaaaucaagauaucaguauuugcaaaugauaugauaguauacuuaagugacccacaaaaugccaccagagaacuccuauagcugaucaacaacuucagaaaaauagcugcauauaaaauuaacucaaacaaaucaguggccuucuucuacucaauggauaaacaggcuacaaaacacauuagggaaaugacacccuucauaauagucacaaauaguauaaaauaccuuguugugacucuaacuaagcaaaugaaagaucuauauauauauauaugacaagagauuccagucucugaagaaagaaaucgaagaucucaaaagaugagaagaucucucauguucaugaauuggcaggauuaauauaguaaauauagcccucuugcugaaagcagucuacagauucaauucaauccccauaaaaauuccaagucaauucuucauaaaguuagaaagagcaauuugcaauucaauuggaauaacuaaaaacccaggauaucaaaugaaaacuauucucaacaauaaaagaacuucugggggaaucacgaccccugaccucgagcuguauuacagagcaaucaugauaaaaacugccugguauugguacaaugacaggccgguagauaaauauaauauaauauaauugaagacccagaaaugaacccacaccccagaaaugaacccacaccccuaugaucacaugaucuuuuguggggcaaugggcuaugcacagacagccuggucuccaguagagcuuaggucuugaaucccagcgguaccuguugggugguaauuucuaccuacaugggacaaaaggcuuuugaccaagucuccuggaccccucgaaguuaccucccccacagcccccacaggauaggcgugugucuaucagucauguagacaaugucccacacuucugguauucuggcuagacucuuccccacaguuaccuagcaacagcaagauagccaagcucacuaaaagaggggcuguuuggcaccaccuugcucucucuaagcuuuuaccucucuuacucucuagccuuccuucucucucccucucucuucucccuuucucuccauguggccaaaggaggccucucccucucucuuucuaccuucucucuuuccccugccuuucuacaauaaagcucuaaaaccauagacuaucucugaucaugaaggcccacagugcuugaaugauggaauaggcauucuccuaacaagacucgucuaaccuccugccagaaggccuuccuaugcuccagccacagaccuaaggacuuuugccugccuugaaaccauccagugaccccucucccccugcccuuucuucccuucauccccagggccaaguaccgcccuggggccccuauucuguuuccauauccagugagggaugccggaaacugagaaccugguacccggggcugccccuuguccaccaccugccguguggggucaguggcuuagcacagccagauguccacccaauucauguggaaaacgugugcaguccucccguguccaccugcccagaggacuggaacucuggcgggacgcaguuucucucccauuccccucuuucuccuauacccacagccccacaaucuuugacaaaggagcugaaaccauccaguggauaaaagacaguauuuucaacgaauggugcugguucaacugguaguuagcauguagaaaaaugcaaauccauccauucuuauuuccuuguacaaaacucaagucuaaauggaucaaggaacuccacuuaaacaugauacacugaaacuaauagaaagaaagugggaaagcgucuggagcacaugggaacaggggaaauuuuccuaaacagaacaccaauagcauauacucuaagaucaagaauugacaaacgggaccucauaaaauugcaaagcgucuguaaguccaaggacacuaucaauaagagaaaagggcaaccaagagauugggaaaagaucuuuaccaaucucacaucugauagaggguucauauccaauauauacaaagaacucaagaaguuagacuucagagaaacaaauaacccuauuuaauaaugggguacagagcuaagcaaagaauuccgaauugaggaaacucgaaugacugagaaacuccuaaagaaauguucaaaauccuuagucaucagagaaaugcaaaucaaaauaacccuaagauuccaccucacacuagucagaaugacuaagaucaaaaucucaggugacaggagaugcuggcaaggauguggagaaagaggaacacuccuccauugcuggugggauggcaagcugguacaaccacucuggaaaucaguuuggugguuccucagaaaacugaacaaaguacuaccugaggacccaacuauuucacuacugggcauacacccagaagacgcuccaacauguaauaaggacacaugccucccauguuccuaucagccuuauuuauaauagccagaaacuggaaagaccccagcuguccauaaacagaggaauggauacagaaaaugugguacauuuacacaauggaauacuacucagcaauuaaaaaugaugaauucaugaaauucuuaggcaaauggaugaaauuagaaaauaucauccuugggagggcucagccggagcagguaagggagccucuugggccccagaucccucagagacuagucugcacagguaagaaugcggacuacagaagcaacacagcuucugggacaggcagaagcaacacagccucugggacagaccuguuucagacaucugggcaccuucuccaccagaggagaggugucaacugggagagcuuucggagaaggugagggagccaucuugggucccggaucccucagagaccaggcuacaaaggugagcucacagacugugaagggugagcgagcagacugcagaagugacacagcuucugggacaggcagaagugacacagcuucugggacagaccccauuugggguuccagacauccgggcaccuuccccgccagaggagaggugucugcccaggagggcucugaccaccagagcaggugagagagccgucuugugaccccuguaccucagagaccagucugugcaggugagcgugcagacugcagagggaacacaucuuugggacaggcccuguuucaggccuucaucuucagccaggagacaggucugaaugccagauaucuguguaccuucccugcaagaggagagcuugacugcagagaguacucugaccccugagacucaggagagagcuagauucccaggucugcugacagaggcuaacagaaucacaggaggaacugaaagacccacaacgugaggacucccccacguucugacucaggagaggcgauaccccaaaucacucucaagaaacggucuuuuugcaaacuguaagaggauuuuuauucaagagugcucucggucccagggucauacaccaugcagggguagaggaccauggugccucaaguugcuagguaaggggguauuuaaaggaagaaaccacaacucaaggaaguggggagggcauuguugaaaaauaccaaagauaccaguuaagagucacaaggaaguacaaagucacaagugucacaaggaauaccugguaauuguucagguuaucucucaagacaguuucuaagagccccuaacaauagcacauucuuugaauuaacacucuuugaacccaggaagcagguggauggaggaaugucgcuaucugauuuaugauuagcauaucuuggagcauugagucacaaaggucacauucccaagccugggucuaaaggccuagaauuuuguuuuuacauuuuacuuuuucagaacaaguucuaaccagagauaaccauaacaacuaacuccagagauuaccagauggugaaaggcaaauguaagaaucuuacgaacagaaaccaagaccacucaccaucaucagaacccagcacucccaccucagccauccuggauaaccugacacacccgaaaagcaagacucggauuuaaaaucuuaucuaaugaugcugguagaggacauuaagaagggcuuuaauaacucacuuaaagaaauacagaacacugcuaaagagguagaaguccuuaaagagcuacaggaaaagacaaccaaacaggugauggacuugaacaaaaccacccaagaccaaaaaaagggaaguagaaacaauaaagaaaacccaaaaugagacaauguuggagauagaaacccuaggaaagaaaucuggaaccauagaugugagcaucagcaacagaauacaagagauggaagagacaaucucaggugcagaagaugucauagagaacauggcacaacaauucaagaaaaugcaaaaugcaaaaagauccuaacucaaaacauccaggaaauccaggucacaaugagaagaccaaaccuacggauaauaggaauagaugagaaugaagauuuucaacuuaaagggccagcaaauaucuucaacaaaauuauacaagaaaacuucccaaaccuaaagaaagagguacccaugaacacacaagaagccuacagaacuccaaauagacuagaucagaaaagaaauuccucccgacacaaaauaaucaaaacaacaaaugaacuaaauaaagauagaauauuaaaagcaguaagggaaaagggucaaguaacaucuaaaggcaggccuauuagaauuacaccagacuucucaccagaaacuaugaaagccagaagauccuggacagauguuuugcagacccuaagagaacacaaaugccaggccagccuacuauacacagaaaaacccucaauuaccauagauggagaaaccaaaguauuccaugauaaaauucacacauuaucuuuccacaaauccagcccuucaaaagauaauaaagggaaaacaccaacacaaggauggaaacuacacccuagaaaaagcaagaaaguaauccuucaacaaaccuaaaagaagauaacagcaagaauagaaucccaacuuuaacaacaaaaauaacaggaagcaacaauuccuuuucuuuaauuucucuuaacaucaauggacucaauuccccaauaaaaagacauagacugauagacuggcuacacaaacaggauccaauauucugcuacuuaaaggaaacccaccucagggaaaaggacagacacuaccucagagugaaagguugggaaacaauuuuccaagcaaauggucugaagaaacaagcuggaguagccauucuaauaucgaauaaaauugacuuccaacccaaaguuaucaaaaaagacaaggaagggcacuucauacucaucaaagguaaaaucuuccaagaugaacucucaauucuaaauaucuaugcuccacaagcaagggcagccacauucauuaaagaaacuuuaguaaagcucaaagcacacauugcaucucacacaauaauaguaggagacuucaacaccccacucucacaaaugaacagauacuggaaacagaaacuaaacagagacacauggacauuaaccaaaguuaugaaacaaauggauuuaauagauaucuacauuuuaaccuaaaacaaaauaauauuccuucuucucaacgccacauggucccuccuccaaaauugaccauauaauuggucacaaaauaggccucugcaaauacaaaaauauugaaauuaucccaugcauccuaucugaucaacacagacuaaagcugaucuuuaauaacaacauaaauaauagagagccaacauucacguugaaacugaacaauacucuacucaaugauuccuugguaaaggaugaaauaaagaaagaaauuaaagacuuuuuagaguuuaaugaaaauguagcuacaacauacccaaacuuaugugacacaauggaggcaguccuaagaggaaaacucauagcccugagugccuccaaaaaaaaaaaaaaaaaacuagagagagcauacacuagcagccugaaagcacaccuagaagcucuagaacuaaaggaagcaaauucacccaagaggaguagacuccaggaaauaaucaaacucagggaugaaaucaaccaaguggaaacaaaaagaccuauucaaagaaucaaccaaaccaggagcugguucuuugagaaaaucaacaagauagaugaacccuuagccagacuaacuagagggcacaggaacaguaucauaauuaacaaaaucaaaaauguaaaaggagacauaacaacagaaccugaggaaauccaaaacauuaucagauccuacuacaaaaggcaauacucaacaaacuagaaaaccuggaugaaauggauaacuuccuaugcagauaccagguaccaaaguuaaaucaggauccgaguaacaagcuaaacagucccauguucccgaaagaaauagaagaagucaucaauagucucccaacuaaaaaaagcccaggaccagauggcuuuagugcagaguucuaucagaccuucaaauaagaccuaauuccaacucuucucaaacuauuucacaaaauagaaacagaagguacucuaccaaauucauucuaugaagccaaaauuacucugauaccuaaaccacacaaagauccaacaaagauagagaacuucagaccaauuucccuuaugaauaucgaugcaaaaauacucaauaaaauccucacaaaccaaauccaagaacacaucaaaacgaucauccaucaugacuaaguaggcuucaucccaggaaugcaagggugguucaauauacagaaauccaucaacguaauucacuauauaaacaaacucaaagacaaaaaccacaugaucaucucauuagaugcugagaaagcauuugaaaaauccaacaucccuucaugauaaaauucuuggaaagaucaggaaaucaaggcccauaucuaaacauaauaaaagcauuauacagcaaaccauaacccaacaucaaacuaaauggagagaaacuugaagcaaucccacuaaaaucagggacuagacaaggcugcccacuuucuccaugccuauucaauauaguacuuaaaguccuagccaaagcaauucgacaacaaaaggaaaucaaggggauacaaauuggaaaauaagaagucaaaauaucacuauuugcagaugauaagauaguauauauaagugaccccaaaaauuccaccagagaacuccgaaaacugauaaacagcuucaguguaguagcuggauauaaaauuaacucaaacaaaucaauggccuuucucuacacaaaggauaaacaggaugagaaagaaauuagggaaacaacacccuucacaauagucacaaauaauauaaaauacuuuggugugacucuaacuaaggaacuaaaagaucuguaugauaauaacuucaagucucuaaagaaagaaauugaagauuucagaagaugagaagaucccuuaugcucauggauugggaggauuaauauaguuaaaauggcuauccugccgaaagcaaucuacagguucaaugcaaucccaucaaaauuccaacucaauucuucacugagauagaaagggcaauuugcaaauucaucuggaauaauaaaaaaaccuaggauagcaaaaacuauucucaacaauaaaagaaccucugguggaaucaccauuccugacauuaagcuguacuacagaauaauuguggaaaaaaaaaaaaaccugcaugguacugguacagugacagacagguagaucaauggaauagaauugaagacccagaaaugaacccacacaccuauggucacuuguucuuugaccaggaggcuaaaaucauccaguggaaaaaagacagcauuuuuaucaaauggugcuggcccaacuggcaguuaucauguagaagaaugcaaauugauccauucuuauugcccuguacagagcucaaaucuaaguggaucaaagaccuccacauaaaaugagagauacugaaacuaauagaggagaaggugggggaaagccucaaagauaugggcacaggggacaaauuccuaaacagaacagcaauggcuuaugcuguaagaucaaguauugacaaaugggaccucauaaaauugcaaagcuucuguaaggcaaaagagacugucaauaagacaaaaaggccaccaacagauugggaaaggaucuuuaccaauccuaaaucugauaggggacuaauauccaauauauacaaagagcucaagaagcugaauuccagaaacucaaauaaccccauuaaaaaugggguacagagauaaacaaagaauucucaaaugaggaauacugaauggcugagaagcaccugaaaaaaaguucaacauccuuaucaucaggaagugcaaaucaaaacaaccuugagauuccaccucacaccagucagaauggcuaagaucaaaaauucaggugacagcagaugcuggcgaggauguggagaaagaggaacacuccuccauuauuggugggauuucaagcuuguauaaccacucugaaaaguagucuggugguuccucagaaaauuggacauaguacuaccagaggaucccucaauaccucuccugggcauauauccagaagauguuccaacugguaagaaggacacaugcuccacuauguucauagcagccuuauuuauaauagccagaagcuggaaagaaccuaguugccucucaacagaggaauggauacuccauuuacacaauggaguacuacucagcuauuaaaaagaaugaauuuaugaaauucuugggcaaauggauauaucuggaggagaucaucuuuagugaacuaacccaaucacagaagaagucauuagauaugcacucacugauaaguggauauuagcccagaaacauagaacacccaagauacaauuugcaaaaccaagaaaaucaagaagagguaagaccaauggguggauacuucauuccuccuuagaauaaggaacaaaauacccaugaaaugaguaacagagacuaaguuuggagcuaagaugaaaggauggacuauccagagacugcugcucccggggauccaucccauaaucaaccaccaaacacagacacuauugcauaugccagcaagauuuugaugaagggaccccgguauagaugucucauaugaggcuaugccagugccuggcaaauacagaaguggaugcucacagucaucucuaagauggaacacagcccccccccuccccccccccauggagaagcuagagaaagcacccgaggagcuuaaggugucugcaacucuauaggugguaaaacaauaugaacuaaccaguaccccccagagcucguuuuucuagcugcauauguagcagaagauggccuagucggccaucaguggaaagagaggccccuugauauugcaaacuuuauaugccgcaguaaaggggaaugccagggccaagaagugggaguagguggguaggagagcacggcguggggagcguagaaggaacuuucaggauagcauuugaaauuugaaauguuuauaaagaaaauaucuaauaaaaaauaucauccugagugagcuaacccaaucacaaaagagcacacaucuuauacauucacugauaaguggauauuaccccagaaguucagaauacucaagauacaauucacaaaccaccugaagcuaauaagguagaccacaguguggauaccucguaccuucuuagauggggguaucaaaauacccaugggaggaagauacagagacaaaguuuguagcagaagcugaaggaaaggucauccagagacugucccaccuggggauccauccccuauacaguuaguuacccagauacuauuguggaugccacuaagugcuugcugacaggagccucauauaucugucaccuuagaggcucugcuagugccugacaaaugcaggaguggaggcucauagccacccauuggacugaucacagaguccccaauugaggagcuagagaaaggacccaaggagcugaagggguuuuuaauccccauaggaggaacaaccauaugaaccaaccaguacccccagagcucccagggacuaaaccaccaaccaaagaauacaaaggagggacucaaggcuucagccgcauauguagcagaggauagccuuguggaacaucaaugagagaagaggcccuuggccuugugaaggcucaaugucccauuguaggggaaugccaggacagggaaguugguggguuagucagcaggggaggggaaugagagaggggguuuuugaaggggaaaugaggaaaggggauaaaauuugaaguguaaauaaagaaaauauccaguaaaaaaaaauggaaaaaaaaaccugcuugaauaaaaacuuaaaaaauuggauuucagaguuuagucaaguucauaaaagaucuuuuuuuuuuuuaaauaaagaaauguguugguccucacuggcuuauuaaaaaucauaguaccuacauuauucuaauaagaauuucuucagaccuugaauuuaaugauagugacaguuuuagcugccuacuuguguuaguuuccauuuuaauauugaaaaauaguuuguuucucugguuaguauuugucaccuuccucuugaagcaccaagcugacuauacauucaugugugcuacugaauaccauuaccauggcagggcagugugguauaaaauauucuagauugaggauuaaagagcccugaguuugaguucuauuuuggcaacauacugucugucuuucugcugcagaggccaauugcuacuuucccuuuaguaaguucaucuuuggugacaauuugagucagucaggugagguguguaauuaggacagggguggaauugaaggccuaucugacgagggaggccuguccaggauguaaggcaggaacacaggucaagcucuaauacaugguugccauuacuaacuagaagagcuuugcucaaacguccaugcuuaagccuggggucuuucuaaagugcagcuucugcuucuaugaggcuggacugagggcuccauggccacauuucuaaggaagucuucaaggggcuaaccaaaugcccaaaguagugauaaguccauuaaauacaugugaccauccccacucugggcaaaggcagcuacagauacauuuccaagugaggaaauggauguuuaaagaggcugaguaguuugccaaacauuacagagcugguaaguaguuaagaugagacauuaacccagaaggcuuggucgcagccuccuugucccuaaugucauugcaaugucaugacagcgucacauuucuuacuuacaaugucccacugcuuaucuagaaccaggcacuugguuauuuuauacuagucucucccacuguucuuaacaacacuagcagguggguaauauuaucauuuucauuuuauagauaacaaaauuaauuaaccucccuucaaaugucuccaacucacugaaacuauagcaauuccuacuucagcaaaagauuagauuaagaaaauaucuauaaugagccaaacacaaugagcaguauguuaaugagagaacgauuuaucggcaugaacauauaaaacacuauuaggaaguacacagaaaacauugccuuacaaugaacacugcccuauuuaaaggcauccuggacagguaaaaccaacuggaccuggagagcuuagccaugaggugauucuaagcagaaucucucagcagaauuuacaaugggauucuucucucagaagaaucaaaaaugcauuucuuaucaucgucgucuuuuaccuucugaaaaaucucucuuuauuaagcuaaugaaacaagauuccaccaguaaauuucccuggagaggagacugaaauauaaguagcugacaauggaugcugcccuuaaauaugcuuaagaaguccaaacaccauaguaacaggacagcaagaucuugcuuagaagguuuaaaaacaaaagucuaaggaaaucuaaggguuuccaguggggauucucaaccuuggucacaggaugcaccuugaaaguaagacuguaguaaggacuucaaagacuggugcuaagcucccacccucagacagggauaagcuggacagugggguauuuuaggcuggauacuaggguauuuuaauaacacucaaguuuucuaaugugcagccaagguggagauuuacuugauuaaaacaguaaaaucccuaugguuguuggagcugucugaauagugaagccugucaaggcagacuauagggacaaccauaggacuaggggaugcuuucuccccuggagguaaggacuuuauuagcagacauauuuuaacagaacagaauucuucacaguguguauauguauucaaugagcugguuuccuccucuuaccggaaugcuuccugcuagaaagcagccucuucuggaggagacgcgaaugggagcauucaaccuucuuuccagacacaagcuuaaaaauagcaugaguuguauuuccagaugacaccccuaagguggagugugugggaugugaaaacuucugucaagacacugucaaauuaaauguuuguuucugucuacaaaaauaaaagcauuuaaaaaggaucucucuuuguuuuucuuugguuggggauugaacccagagccucauacauaucaaccauugagcuaaacuccuugacagaaagagugaaaggcuccuaugugaaccaauucaccaucaacaaacaaaaaguagcauuuauuaugugcugcucugugggcuccugugccaacacauuaaacauccuucgugaucaucagaacaguccuggauuuggacguggagagaagacgaguaguuaaaacaaaagcauccaugaccaacaucgaauaagucuguguuccuaugcagccccuguaggaccagcaauauggguuuacagcgugauuaagaaggaucauggucucugccuggcauccaaagacaaggucugaucauccaccaggaaacuuuagaagcuuccccuguagcaaguucaaaagaaagugaacugaugugauuugagacaagcaagaaauuucuuguucacuuagugcuuuuuacauauugagaauucuuacaaaccuuuuauacuccuugcacauuuuuccugaguuuguaugugugcacuuguguaugagguauguguccauguccauguuuauggcugcuagaggucuaugcugagcaucuucuuucccucucuccccaccuuacuuuugagacagggucucucccugaacuagcucacugauuggcuagacucuggauaacaagcuccugggauucuccuguggcuaucucccuccucugcaugggauuacagcugcaccaugguggaugcuggagaucaaaauucaggucuaccugcuaacauagcaacuauuuccccaaugaaccgucuccccagaccagugaguccccuccauuucuuaugcaacuccuuuuaauuauaugaaggaugaauguuauugguuuugcucagcuuuagucauacccagaacuuugaacuaguuggucauacuuauuuugaaggcagccuuggaaaccaggguuggcaaauauucucuggacagaauggaaccaccagucuuguuagcccucagguuuccugguucaggagaaaauuccggaugacaagaugaacauggcagguaugaaugacaagcccaguaaaguagaaccuacaaccugagcuugguaucaucuucuugugucacaaauuauucuuuccauuuuaaaaaauaauuagaaaauaugaaaaaccccuaggugaggagccacacagaaauagguuguguucaguugguagguuggauuugccaacccuuguuuugaaggacaaagguuuccuguguuagcacagguugccuccuuacacaguuucuguuaaugcaaagaucucuucagauaaaggcuccauguccaaagagcaggaguaugccagcugccaggguuucucuguauagcucuggcuuuccuggaacucacuuuguagaccaggcuggccucgaacucagaaacgccugcgucugccucccaagugcugggauuaaaggugugcaccaccaugcccgguuaagcacgucuucuugagcaagaauggcaugucugggguuggaagggaacuuaaagaucaaagaagcugcuauuuacugaacacuuucuccagugccuucaagaacauuguagcgauaaguacagcuauagcuacuuucugaaaacaagcucacagaauuauaagaagccaaggaaacuccuacaggagagggcaggagcuagcucacagcugcucaugagaagaccuuauuaaaauuuucagaaucuuauaaacuacuugacaugcaucaaugaccugaaguuggucacaguggggccuucacaccacaaguacugacauacacaaguguuccaaacuagacuuuuuucuaugauuguaaauuaaauauuuuguuuguggauuucagagauggcucagugguuacuagcacuuauagccuuuacagaggaaagaaguucaaguaaucagcauccacaugaugguuuacaaacaucaauaaccuaguuccagggguuucaugaccucuucuggacuccacaugaucugucacacauguagugugggcacacacauauucacauaaaaauaauuuaaaaaaaccuuuauguugcugcuuauauuacuaaugcuaaucacauuccccaaacugcuuacacaacugucugcacauagcuuccaagaaccugcccccaguugguucagauugguaaauaaaaaugccaauaaccaauaucugggaaggacagacagagguggguuuuuggaguuucccaggcuugggaucaggaggaaaaggagggagagaggauccaguguggagaggaggagagacaucaugccuaagaaguacaggaggucacucucccggggcucuguucuaguggcuugugggagcuuagggcaucgcccagugauguacagucccuuuccacaacauuggagauuaaccugggcuucugagucugcgccugcauauuccuaugacuacuuagcauucuguggacaaugacugaggagacaaaccaugcaggaaacaaggggggaaaagcacaggacagagagacauagcugccaugagauggagccaggagagugaggcccaaaggacugcccaacugggucaagggaugccaagauaaaauauagaauuuagucaguaauaacucagaauuaucugcaggacaugauuuaaucacauggaaguuagacaguggcucagcuauugugccguuuaaggcauaucaaaauauaaaggccuguguguguguuucauucuggaauguaaaccauugagguggauaguuaacaugcugucuggauuuauuaauuaauuauuucaacauucauuuugauauuuaucaguagacuacaauugcccauaucauuacaaggcggaaagcucucuaggucuagguaaaacacaugcacacacacucauacccacucaugaaugacuuaggaaugagguaccucugaguguuguggcagaaugaaacugcugcacaccauaaacagagaucaguugcuguuuagacaccuucuauuacuguugccucuggugugccaaauguauucucuucuucuguuaacuguaaaacuaagcaauuuaaaauuuugccuagaaucaaaaauguuuuucagaaucuauuuaucucuucuaauuuuacauguuugucuaacaugaaaaacgcaaaagcuauaacaaagaccauuauuguuuuguacaacugugaucugagaacugccgguccagacggagaaaaaugaugaugggucagugacuaugcugauguccaguuggcagcaucaccauagcauggcucccacucccguggcucuccauucacauacacacacacauacacacacacaccucauucacaaauauauacacaggugaugcauauacaaacacacauggacauaaacacaccacacacacacacacacacacacacacacaccucauucacaaauauauacacaggugaugcauauacaaacacacauggacauaaacacacaccacucacaaacacacacacacacacacacacacacacauacacacacacaccucauucacaaauauauacacaggugaugcauauacaaacacacauggacauaaacacacaccacucacaaacacauacacccacacacacacuuaaaaauauaauagguccuauaaaaaaaguacuauuccauuucuggcauaugacauacaaucucuguccaguucuuugccuuuuguauucauacuacugaaugaagaucuuacaguguaauaucuagcugggccaaaauguucucagaaaauacauuugcuuuuaggcaagaggcuuuuugauuauuccuggcuucuggucucaguccacaaaacuacaugagaccauaaagcuaauucaaacaaaucacgucgaauuuauucuuucugcauuugcugcugucuucuucauuuucugucacuucaggcaucaaacccauuuugugggacccuuucccuuuaacuuuacaagauuagaaaauaacaaaggauauguauuacuaggucagcugcaauaucaaaagagggauuauauccuuauuugucaguaaaugaccugacaagagacgacaacagcucauaagagagaaagcaggcaaagcugagagcucuacaccuaauucugaagcaaauuucuuccuaggcauuaagaaagacuaucucaagauugaaagcuccugaaacuucacaguaacauauuccugcauaaucagaaauguguagacucaaauaaaucuacuucugaucuucagaaagcaauuuucugagccaguauuuuguuggauuucuauugaacgucuuuccauuacacagccugaguaguggucucugauguuauucauaaacaacuguaauuauuuauuuauagauucacggguauuguuuucaauuaguccuaaagcaaaauauuuaaaugaaaacucucagaaaguccagcacuagggccugagacagccauugauaagcugugaacacaccuacaauuaaagcaagcuugguacucagaugaagccaacacccagcucauaaaucaacuccagcuucuuuguaagacagacuuuguagcaacugacucuucuuuguuucauuuguauguaauaaaacagaaauaauugaccagaaccuuuuacucucugugagaguuuuuagccaguagguucuuuggagcaccaucaugaaaacugccacaguugucucacuggguccucuuucuaucucgcuucaguuucugugaggacuuccaggagccuuuaauaugcuaauguuccaauacuaguccuuguuuauuuggauucuguacauaaacuacauagcauuaucauuguuguuguuuuucaacagcagggaucaaacccaacagaagucagacgcaucacugucacugacccacauccucagugcauuguaaauaaagggaguuuucuuccuauugagggaguaagacuaaaaagaaugucaugucacaaaauuccacucugaagacugcuggcuuacaauccacaaagaagacugaaacaguagaacgaagucagagcauucagaaaggaaaaaaaaacaggagacaccucugacuggaacacacacuugggauggagccuggcgauguuauagagacugcucaguuccuccucagccagacccuagggaaugaugaauaaagauggccaggacugggugugggguggaagcagucuugugaaauacuuucuggaacauucuauuggauagacccuaugacuucauuuauaugacuuucuuccucaucaauauaaauaggugugguccauguuagccucaacuuccaaguuagaaaugaaaaacaaaccaaggaagcugagcaccuuuggcugaaaagcaucaacaggggacacaggaguucaugauuccuguccaggacccaaauucauccaagagaguucuuucuagccaagaucuaugcaagacaagggaucccuuggugugaauggaauagaauuuaaaagaaagacaagaaacccuuccuuuuaccccuguauagugagcacauuagaaagccaaucaguuagcugaaugcucucaucuuacacaaaagaaaacugggucccuuggacuuuauggguugagggaggacaaggaaaaugcuaacucuauccaaacacccacagcccagugagcuccgaugacuaccucaguguccaugcucugcuccuguccuaauguuacucaccacuuacuuagcuucugcuaaaugccaggcacugugccagaauguauacauacaucauuucaucuucaccucugaccaugcuguauuucacagaaugacacgggaaaagucuaucucaggaccaaccuuagccagguugccaggaauacaaucuguaccaggaggcaaaugcccaaaacuuaugcucuucugugacagucuccuuuccaucuucaauccagccacucccuuuccuuccuaucucuauuuaaaagcacucagauugaaaaaaaaaucaaaggucagcuguccauagcucuaaucuucucucuucuuuguuccuucagacaaauuggggucuucugucauuauagagcaagaaagacugggcagagaugaagcaagcugggucucaucacaaaucagauaccugaaagaggccaauccucuuuggccugcaggaagcaaagcuuagucccauuucuacuucugcuaagguuagucaggacaaaugacacagaaugcaucaaauugcucccaauuuacuccuucuuucuuugaaaaguaugaagugaggcacaugguaaaugacuucaaaaucuaguggaauguucugaagacaccacgcuaucaaacucucaaagaggaaaagacggaaaggagaaaagaaugaggagaggacgaagcauagcuagcagugagaaguaaaauucaaaucuucuacauuagaauccacuggucuuggugcucccugacucaccccagacaauuaggucugagucacaacaagguggcacucagcacucugcaugugggcaagcucuucugguaaauguaauuuauagcaaagguacacuaucugagaagugauuuguaaauguguugcuuacagaacuuagaugcuuccaaaacugaauccaggauucagcuaugaguagauauagugggagauagaauguugacucauuugggugccacagcuugcaagaacaugcaacaagagaugagaaagacauucuccucagggagacagcucuuugggucuacagagucuauuuaaagaucaacaucaacagccauaugcuacaaaccccuucaugugcuuugaauuuugaaaucauucagaaaccacagucacaugcugccuagugagguuuggucaaggauaggcuacagcuguaauagaggaucaguaaaauuccguauuacaguagcccuguagccacaucauuaugggaaaauauacucuacgaguucacaugaugggauccacacacuucucagagugcaccuugcucuuuagcaacacaugacuguauguuguaacaaccuuugcauuccauagacuaugcaagcucuggugacacacugaaacacaugcaauaacuaguuugcuuccacuccaggccaacuuggcucacagacauguuuccuucgacucagaaccacauaugcuccugugugcuucauucuguccacacaguagaaggacacacauucuaugcaucauccugccaucuuuccacauuacagcuacaucuacauuauucugccuucaagcaucacaguccuacaucucacagauggagcaugcaucauuucaucacuggcuuuugauagacauguagaauuccucuaaaccucagcugauaugaaagacauuaggaggagcacuuauucaugucuuugcucgcucaugaggauuuauaguugggauaaauuucuagaauggaaagggcaaaggauauaugcauuuuuuauuucauguacugugaaauucucucuccauagggauuccaauaauguuagugucuaccuaaaaaaccaacacccacaacaaaacaccaugguucuuauuguauuuuaauuugccaugaugacuugccccuggagugagugccaaccuggcagcauugauguaacuuggcagcucuauuuuuguggagaacagguacaaugggguggaguauaggugaacaucaagaguaagcagucgugucuucuggauuccaucuuuucuccuggauaacuccugccuaggaagcauauucaauagucucauccuggaagucuuccuaauuaccuccaggcuugacugguucuccucuguuguuccuaugauaauuggaugcuccagcuagaugcucugucuccuguuucucuuaugauucugcgucauccucuuuuuagaccguccugucuuguucuaagguaccuaaguguaaguuaauggccuugguccccuuucacucuggguaaauuuaugaaguugaguuccuaaguuuuuguauuuaaguuaauagugaagccaccagaaagccacgugucugcaguacuaugaacaacagucuuuugcuccuuaaaagaaaaauuacaacaaugacacuggaagacaacuccguggauaaagcacugcugcacguggauguagacugcaguucucauccacaggaaucauguaaaaagccaagcagguaugauggugccuuagaaucccaauauccaugacucggagcucugaguuaauggaguuaacguuaauacaaugaguuaauguuaauacaaauuccuguuuccaauucugcccacuggcugucacaacagaaaccagugccccuccucacuuguugagucuauaucucaucuucaggaaaagcagacagcaugcugcuucuuccaguaauucugagccuguuauugauuuauuguuuauuuucacugaguccaugcacuuaggaggaaagagggaauaauguauauguacuuucagaaaacugcuucaauguuguaaauaauaaucccacaccauuaaugaaccuuuccagaggugccugccuugcaacagaacauuacuuaagcacugaaaaucuaaucagcaaauauuuauuuugcaaauuucuaugugcauguuuaaaacucuuauuccauaaauaaaacaagucucucuaggaaaauacauuaauucaacacauauuuacugaguacuuacucuguggcccuaugccaccaaaauccaauagggcaaaggacccacugcuaagggaagaacauacugaaagaggcauggcugaguugacagcuaaugugaauccaggugggcaggcacaaagaaucccaugagaaggggcuuuuuacagacuuucaagggacuggagaaggcuuccagaggggcaguuuaaaaugauugccaugcuaggguucagcuaggacugauggacacaaucugagaaauaguucugccucucacagaaguugacauaaacuucagcuaagcccaacggagggagucagcauuagaacaugggagcccucaggacagaaagcaaauccuccuauacacaugaguuuucuaaaacgcugaauccaugauuagaaaugaaaggagaccaucagacuccuacaacugccacugacuuggcacuuaaaaugguacauguucuucaccaacucugucaggcugaguggacaucucauagccuucuaccucacuuucaucuuccucugauuccacccagcaggaucucuaccucagaggcccaccucaucuuuauauaaagcucauaaaaccuaguuagagauagcuauggaggaauaugauggccuuaacagauggagacauaaguuccuucccugguguuuauuuugacagcaaggagucccacaaagcagggaauggugcuaagcaaaguccuccaagaauaucagcaaggaaagacagccucugagccacccacuauacacucuuccacacacauaauaaccagcaugguacguuaugugaagugaaccccucaaaggaaaaacaauugagaauccagguacauuuucagaguugccucuuguuguggaagacugaaguuggugugcuaaaaugucaugaagcaagaugaaaacggccaacaggaauguaaaaugugccuuuugagaggcauucuugagauugcucauuacaaugcacuguggaaaagagugucucccauccagggaugauucaguucggacuucaguuagacaagcucuaacuuaugcuguuggcaagacaguugucugccucuaccucauaguaggcaguuucaaagccccugcaaauuauuuuuguuugagaaaagggacauuuuaaggaaguugaagaggagauauuuauuuaauaucaucauagcacaguuacuuaacagucugucuuuauuugugcuacuauaacaaauaauaccauuucaagugaccugaaacuaaagaaacacacauacauguacacagaacucacacacaccacacacaugcaugcacaugcacauggcacaaacauaacauacacacauucacagcacuuacacacaugugcaugagugcacagaacucacacauaauacaugugcacaugugcacauaacucucucucucucucucucucucucucucucccucucucucucucucucucucacacacacacacacacacacacacauauacacauacacacacgugagugcccacacacaagauaagaacucagugcaaaaacagucucagcuacugugacucuuuccucuagcuggauucucuaguucagcuguacucauuggcaacuuucaacuucugucacucaucacaaauaaugaacacuuuaauguuaagagaaacaauccccaguguccugcugcaacacauugacaagaaguggcuuacacuguguaaggaguaucugacacuaugcuugaugccuucuaugcccuccuaucaaccucuacaugagcaaagcaggggcauauccaagcccuccugcucugcugacaucucuggaauuaagaacucagagccagagaaggugccaacccccuucucucuccagugucccauucuuagguggguuagaaacuaaaucaaauuccacuucacaaauaaagcuaauaccuaugagguaggaggcugcauuaauauuuccaagaccaaauauucucccucaaguaauauaaauuuauagguaugacuuuuccccaugcucuaucgacuguuugugguauacgaaaguaauuaggcuuuucugaaacccagaguggcuuugagaacucuauuugaguaaacacaaaagaaaaguauucugagugguacuuuaauguuuucacaaaaguuuauaucugggaaaaaaaaguucauuuccaguuuucaguagugaauccuuuuccuuuagugacugaugguccugcuguagcuggaauagcagaacauaucuggccaagcccaugaguuguagcauguguuacauagcuugauauaucgagacagguagaugaaaggagggauucagacagagacagagaauagccauugaguuuauuagacacuagucuaguccauuagagacuaaauauggaguagauaauagccagacccacaugcuacaguaaccaguccaggggcacauaguucaaggucuauaccaauugguccuaauagucaugccuacuuaacagcuucugcuuuaguccuagcuuaguaccaaggcaagcacaagcuccccaagccaacaacagccaguucucugccuccuccuuaguaacuugcccugugccaacagucucucaucagaugaaccauaggcugccgcucuucuccuaagggaagcuuccucacaccccaucauucccaccucguuuccuaugcuuguagguggcagaggacagaagaggcauaguaauacaucugugcugucuaaaaggaaaaggagugaaacacaagagcaauggcagaaaacaaggaaggaaugugccccaaauaagcauuaaagcaaacaucagggaacaccuacaugaagaaaaacacgcaaauaaagguuuguugguuucauuuuguuccaacucuucauuccuagaaccauaaucuccuaucacugauauuuaaugacaauaguguuuaauguuguuuggaagcuuucuugaagaagcuaauaacaucugguaucuaucaugaugugcuggugauuauucaagagcugggggaguucuguguuauggauacccaccaggggcuugugcaagcucuuaaaccacucacuauaaguuuagccuuagaaaagaacagaacgagagcugaaaguuagaccuugaacacucaagaguucugauccauuuccuguccuauauuuggcuucuugaaaacaauccuauuaggaaauugauaucucuaucugacauagacaaacaaaaccuuuagaguuagacauuugauggacccucacagcuaaaaguauuuugcacacugccauuccacccaacacccugggaagcacagacaacaucacuaagaugcugacauucuaggguaguucaggcugcuucuauugcaguauagaagaagcuggaaagcucuucacaacugaccugagccucacugaacuucauuacuguuguuuaucugggaagcuucaaacaacugaacuauggagucuauaugcaaagauccuaaagaaccaucaauuguuucugauggagugcuggguaaaaagaacaacaaaaaaaagcuacauuacuauauacaugaagaaaugagcuaucucacagagauuaaaaaacaaaacaaaacaaaacaaaacaaaacaaaacaaaacaaaacaaaaagcaaaaaggggucuuugauggcuguuacacaaagaaguguagagagcuauauguagcagaaauggccaggcaagcuaugguuugaaaucauauucuuacacuuugaaaaucuaaaaagaucuuaaggcugguaccaaugugagcacccaacuucaaguuuucagggcagaauuuaaauuccaggccaauucauuacagagcauggggaacuuaacuaagaagcaaucagauguuuucugaauaaugagauagccuuuuccagauuaagggauacaguugagugaaugugugcuuuaagaagccccgaauaauugucaggaggauauguaaccaucaagaaaacucaugucuauuuucagaauaucccccuucucccagagcuauuaauaaacuugccauauuuuuaaaaaaauauucaucuaugggaaauauuaauuucccccaaacaaguaggguuauauuauuuaaaguguauuucaccaacagaaauuaauuugaauaaagcauuugaaauaauuccacugggcaacaaaagucacuuaaucuccuacccugucacaagagcaaaguggagcaacugcauuuuaaacauuuaauuagagguaaaaucaaguuuauauaaugauauaccacacugcuagcaaguaaugaagauaaacagccuugcacauuaucagcacccagaaguaccauagagucccacuuugcuuacagacugcagaaagaaagucuguagcaacaaauggcuuuuuuugaugcugaacugaguuuggugucuuucuuucuuuccuuuuuaagaacuuguaacuggaauaauugaagcauuagaguuucagucgugauauuucuuguguuugagagaaguuuuugcaauuuagacacaacugugucuguuuuagcaaacauacuguucacauuuugagcaaaacugcugauguagucacugaugcgcaugccccagcacuugaaaaucacgacagaugugcacuugccaaggaauuucuuuuuuuuuuuuuuuuuuuuuuuucaguuugggaaguuuuuuuuuuuuuuuuuuuuuuuuuuuuuuuucuuuccauuuuuuauuagguauuuagcucauuuacauuuccaaugcuauaccaaaagucccccccauacccacccacccccacuccccuacccgcccacucccccuuuuuggcccuggcguuccccuguucuggggcauauaaaguuuguguguccaaugggccucucuuuccagugauggccgacuaggucaucuuuugauacauaugcagcuagagucaagagcuccgggguacugguuauuucauaauguugauccaccuauaggguugcagaucccuuuagcuccuuggguacuuucucuagcuccuccauugggagcccugugauccguccauuagcugacugugggcauccacuucuguguuugcuaggccccggcauagucucacaagagacagcuacaucuggguccuuucgauaaaaucuugcuaguguaugcaauggugucagcguuuggaugcugauuaugggguggaucccuggauaaggcagucucuacaugguccacccuuuaaucucagcuccaaacuuugucucuguaacuccuuccaaggguguuuuguucccacuucuaaggaggggcauagugucuacacuucagucuucauuuuucuugaguuucauguguuuaggaaauuguaucuuauaucuuggguauccuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaugcugcuaugaacauaguggagcauguguccuucuuaccaguuggggcaucuucuggauauaugcccaagagagguauugcuggauccuccgguaguacuauguccaauuuucugaggaaccgccagacggauuuccagagugguuguacaagccugcaaucccaccaacaauggaggaguguuccucuuucuccacauccacgccagcaucugcugucaccugaauuuuugaucuuagacauucugacuggugugagguggaaucuuaggguuguuuugauuugcauuucccugaugauuaaggauguugaacauuuuuucaggugcuucucugccauucuguauuccucaggugagaauucuuuguucaguucugagccccauuuuuuaaugggguuguuugauuuucugaaguccaccuucuugaguucuuuauauauguuggauauuaguccccuaucugauuuaggauagguaaagauccuuucccaaucuguugguggucucuuugucuuauugacggugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguucuuugauccauuuagauuugaccuuaguacaaggagauaaguauggaucgauucgcauucuucuacaugauaacaaccaguugugccagcaccauuuguugaaaaugcugucuuucuuccacugggugguuuuagcucccuugucgaagaucaagugaccauagguguguggguucauuucugggucuucaauucuauuccauuggucuacuugucugucucuauaccaguaccaugcaguuuuuaccacaauugcucuguaguaaagcuuuagguccggcauggugauuccaccagagguucuuuuauccuugagaagaguuuuugcuauccuagguuuuuuguuauuccagaugaauuugcaaauugcuccuucuaauucauugaagaauugaguuggaauuuugauggggauugcauugaaucuguagauugcuuuuggcaagauagccauuuuuacaauauugauccugccaauccaugagcaugggagaucuuuccaucuucugagaucuucuuuaauuucuuucuucagagacuugaaguuuuuaucauacagaucuuucacuuccuuaguuagagucacgccgagauauuuuauauuauuugugacuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucugguggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccagaacuuuuaucaugaauggguguuggaucuugucaaaugcuuuuucugcauccaacgagaugaucaugugguuuuugucuuugaguuuguuuauauaguggauuacauugauggauuuucguauauuaaaccaucccugcauuccuggaauaaaaccuacuuggucaggauggaugauugcuuuaaugugaucuuggauucgguuagcgagaauuuuauugaggauuuuugcaucgauauucauaagagaaauuggucugaaguucucuaucuuuguuggaucuuucugugguuuagguaucagaguaauaguggcuucauaaaaugaguuggguagaguacuuucuacuucuaucuugugaaaaaguuugugcagaacuggaauuagaucuucuuugaaggucugauagaacucugcacuaaacccgucugguccugggcuuuuuuuggcugggagacuauuuauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucaguucugauuuuguuaauuaggauuuugucucugugcccucuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuucuucauggaggcacucagagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccacgugaguguuggcuuucuguuauuuuuuuuguuauugaagaucagccuuagugcauggugaucugauaggauacaugggacaauuucaauauuuuugaaucuguugaggccuguuuuguggccuauuauguggucaauuuuggagaagguaccaugaggugcugagaagaagguauauccuuuuguuuuaggauaaaauguucuguagauaucugucagauccauuuguuucaucacuucuguuaguuucagugugucccuguuuaguuucuguuuccaugaucuguccauuggugaaagugguguguugaagucucccacuauuauugugugaggugcaaugugugcuuugagcuuuacuaaaguuucuuuaaugaauguggcugcccuuguauuuggcgcauagauauucagaauugagaguuccucuuggaggauuuuaccuuugaugagaacaaagugccccuccuugucuuuuuugaugacuuuggguuggaagucaaucuuaucagauauuaggauggcuacuccagcuuguuucuucauaccauuugcuuggaaaauuguuuuccagccuuuuauucugagguagugucuaucuuuuucucugagaugugucuccuguaaacagcaaaauguugggucuuguuuguguagccaguuuguuagucuaugucuuuuuauuggggaguugagaccauugauguuaagagauauuaaggaaaaguaauuguugcuuccuguuauuuuuguuguuaaaguuggcauucuguucuuguggcugucuucuuuuagguuuguugagggauuaccuucuuguuuuuucuagggcauuguucccguucuuguauugguuuuuuucuguuauuacccuuugaagggcuggauucguggagagauaaugugagaauuugguuuugucguggaauacuuugguuucuccaucuaugguaauugagaguuuggcaggguauaguagccugggcuggaauuuguguucuuuuagugucuguauaacaucuguccaggcucuucuggcuuucauagucucuggugaaaaaucugguguaauucugauaggcuugccuuuguauguuacuugaccuuuuucccuuaccgcuuuuaguauucuaucuuuauuuagugcauuuguuguucugauuauuaugugucgggaggaauuucuuuucugguccagucuauuuggaguucuguaggcuucuuguauguucauagguaucucuuucuuuauauuugggaaguuuucuucaauaauuuuguugaagauguuugcuggcccuuuaaguugaaaaucuucauucucauccacuccuauuauccguagguuuggucuucucauuguguccuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguuccagauuucuuuccuaggguuucuaucuccaguguugccucacuuugaguuuucuuuauuguuucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuucuuuaagugauuuauuaaaguccuucuugauguccucuaccaucaucaugagauauacuuuuaaaucuaggucuagguuuucggguguguuggggugcccuggacugggcgaagugggaguacuggguucugaugauggugaguggucuugguuccuguuaguaggauuccuccguuuaccuuucgccaucugguaaucucuggaguuaguaguuauaguugacucuguuuagagauuguucuucuggugauucuguuaccgucucucagcagaccugggagacagauucucuccucugaguuucagugcucagagcacucucugcuggcaagcucucuuacagggaaggugugcagauaucuuguuuuuggaccuccuccuggucgaagaagaaggcccaaaacagggccucucucagaagcuguguugcuuuggcaguucccagaagcugucagcuucuguggugcagacucucaccugugcagacuaaaauccuaaguuccagggaguccuggaaccaagauggugaccgcugcuccugaggccgaggccgucucccgagccaggcggacaccuguccucugguccggaugguggccgguuaucugcggcccgcccaggcugcugccucagcggcucugugcuucugcccguuccagaagcuguccgguucucuggcacacccucuaaccuguucagacuaauuuccuaaauucugcugagucccggaaccaagauggcgaccgcugcugcugaggcugaggucgccucccaagccaggcggacaccuguccucugguccggaugguggccgguuaucugcggcccgccccggcugcugccucagcggcucugugcuuccgcccgucccagaagcuguccgguucucuggugcacccucuaaccuguucagacuaauuuccuaggucccgcggagucccggaacccagauggcgaccgcugcugcugaggcugaggucgccucccaagccaggcggacaccuguccucugguccggaugguggccgguugucugcggcccgcccaggcugcugccucagcggcucugugcuuccgcccgucccagaagcuguccgguucucuggugcacccucuaaccuguucagacuaauuuccuaggucccgcggagucccggaacccagauggcgaccgcugcugcugaggcugaggucgccucccaagccaggcggacaccuguccucugguccggaugguggccgguuaucugcggcccgcccaggcugcugccucagcggcucugugcuuccgcccgucccagaagcuguccgguucucuggugcacccucuaaccuguucagacuaauuuccuaggucccgcggagucccggaacccagauggcgaccgcugcugcugaggcugaggucgccucccaagccaggcggacaccuguccucugguccggaugguggccgguuaucugcggcccgcccaggcugcugccucagcggcucugugcuuccgcccgucccagaagcuguccgguucucuggugcacccucuaaccuguucagacuaauuuccuaggucccgcggagucccggaacccagauggcgaccgcugcugcugaggcugaggucgccucccaagccaggcggacaccuguccucugguccggaugguggccgguuaucugcggcccgcccaggcugcugccucagcggcucugugcuuccgcccgucccagaagcuguccgguucucuggugcacccucuaaccuguucagacuaauuuccuaggucccgcggagucccggaacccagauggcgaccgcugcugcugaggcugaggucgccucccaagccaggcggacaccuguccucugguccggaugguggccgguugucugcggcccgcccaggcugcugccucagcggcucugugcuucugcccgucccagaagcugucagguucucuggcgcacccucuaaccuguucagacuaauuuccuaaguucugcugagucccggaaccaagauggcgacugccaaggaauuucccuacacacauucccgauccuucuaugaguguugagaaagcucauuucaaagcuguuaaaauguacuaaugugcaauaugguauuauaucacaccguggguauacuggcaaaagacaaauuauacauacgcaggcacagaggcaucuaccccaagcucagaguucuacuuaaagcggaauccuuuauacccaguccuucuagaagggagagcuuauuucuucuuuauaaucuauagcacaugauuucacagaaaaggcucauccacccuuccacaucuauuuaaaauuagacacuuugguuaacuaaagacauuaagggauggguacauaugaucaaaaauucacagugggguuauaugcagauacucguuagauuaagaacacacacacacacacacacacacacacacacacacacacacaugacuuuagaaagauuuugaacagagaugcaauggguguguggauggugcuguucccagaagucauggguagugaaauggaaacccuggcauccagagugggacacaucucuugguauuaucacccaggaaaucccuagacuaggugauuaaagcuauauaguuaugcuuauuacucuugguugcccaccaaaaauggauagcaagaugguuuugcugaaaacuccauaugccucaauuuacuuggauacagaguaaagagaaaccuuaauggaagugaacuaaaagaaagcuuuucuugcuggauagccagccauugugcuggaaguugcuaucaggcaacuagaggcacaaaaucagcaauggucuuuccuagcuuagaaccuugcaaacuauaauaucaacuugcauuguuggaaguacuuacugguauaauaguagaccuaguguuugggaggguaaccaauugauuucucauugaaucugaggcccacccuuaagaagggaguuugugucuaguacuauggaucugcuuaaagaaccaagacuggggagaucauaggaacuaguguagagauccugugaucaggaaugaaugcugaagguccuguuccccaauugguucuugaaugauccacacagaugcuaguggccaauggcaggguggaagagauaggacuuccagguucccacagaggacucacuaugcuuuagaggcauagggagucaucagccaugugagaucucagguggaguggccauuggcugauucccaaacugugccuggguuagcaggugagagauuagaaacacaacuaagcugacgggagauuuagugauguugagcuggaaguaaagguaacugagcaaauaagcugagggaagaugaagaggugcugagcuaggggugaaaguaacagcacauuagccgugggaggcuuagauauguccagcccuugagcuaaaaagccuauuaaaaacugugugaguaagccggacgaugguggcacacgccuuuaaucccagcacuuggaagguagaggcaggcggauuucugaguuccaggacaggcugggcuacacagagaaacccugucucaaaaaaacaaaacaaaacaaagaaaaaacugugugaaugucuguauguguguguuuugucuguggacccaggguugcuccuaggcaguugcauccagggaacacaaagcaguguagcaaaaacuacaugguacacacuagaggugaaccuaauaguuuuucuucucuaaauggauauauugucaaacugccuccuaauaguuuauacaauagaauacuauaacccucaaccuucuucaaagaagcuuuucuuugcaguuaagaacagccaaugcauagagacucauaguuguucaaacuguggggaacaaauggcuauucacugcuugaguuuaaacaggguacuucaagguucaggaaacauugugauugagggaaaugagacacaccaagaaucaagugaugagaaaaacuuacacagaacuucaacucauggacaugacauggccuuagcacacaugaaacccuaagaaccagaguuuccugcaaaaacugagccugggaauagccaaccauagauaaaggugguaaucacugagccccagcaggggagcagaggucauuguuugcgguaaccaugguucaguugacagcuucacauccauggccauaugaaugucccucacuaagucaaguggaucacaaaaaagaaaccauaguaaaacaaugccagaaauugugauggagacuugguagcaggauaagguaagcaaaagugauaggaaagugacuggauugcauuacuuacaugugugacaacacacacacacacacacacacacaaacacacauaaaauuuuugagaaguuuuuguauguuacaaagguugaaacuccuugaguuucuaccuauaacuuuuauuugauaucaaaucaauguuuuuuuuuuuguuacaguuccuauggugaucauuaugcaugcauugauuuucaaaaaccccauuagaguuauaaacaaacuuaaucauuaaugggaagaauaauauggcuuuuguuaccaagcccuggggugaagcaaggguaagacauuaucaucaugacuacacuccagggaacuuaaguguucaauucuuugguuuaaaagaaaaacuguaaaagaguacuauauuaagaggaggaacagacccucuaguccguuucuagauugagaagaauuuccuguuaacugaaaaccauagcaaacaccuaccaugcuugccaucuaaacaccucucugaccacaaggaugcuuggccucagcuuuacugaccuuugacccagauaauucuuuucuguagaaauuguagaaguuugucccagguauuuuauauaagaugcuuagggucuccagaugccagaaacaauaucaauuguguuucuagauacugucagaaguguacuugguuuguuggugucaggaagagaugaugcaagcuacgaguauugcucucaagaauggcuccuuuuaacucacacaauauguacucacugauaaguggauauuagcccaaaaccuaggauacccaagauauaagauacaauuuccuaaacacaugaaacucaagaaaaauuaagacugaaguguggacacuaugccccuccuuagaagugggaacaaaacauccuuggaaggaguuacagagacaaaguuuggagcugagaugaaaggauggaccauguagagacugccauauccagggauccaccccauaaucagcauccaaacgcugacaccauugcauacacuagcaagauuuuaucgaaaggacccagauguagcugucucuugugagacuaugccggggccuagcaaacacagaaguggaugcucacagucagcuaauggauggaucacagggcucccaauggaggagcuagagaaaguacccaaggagcuaaagggaucugcaacccuauagguggaucaacauuaugaacuaaccaguaccccggagcucuugacucuagcugcauauguaucaaaagauggccuagucggccaucacuggaaagagaggcccauuggacacgcaaacuuuauaugccccagaacaggggaacgccagggccaaaaagggggaguggguggguaggggaguggggguggguggauaugggagacuuuugguauagcauuggaaauguaaaugagcuaaauaccuaauuaaaaaaaaaaaaagaauggcuccuuuugcacagaacuuaugacaguggcuaaucagugaugggucuaauuugaggcccaugccaugagagguagcccauguuuaacacugccuggaugaucaggaacaagaggcuugacaggccauagacuucuggauuugaggccagccuggucuacuaagugaauucugggacaaucaggacuacaaagugaucauaucuugaaaaucaaaacaaaacaaaaugaaaaaaaaaaaaagauuccuaaugauauucuuauauagucauagaucagugccuaggccagucaccaucagagaggcuucugaugaugugagcacauacagaaaaaucaccaccaaacauuagguggagagagaacccaaaauggagaucuccaucaggucccuuuccuuagcugaagagggccagaaaaaggguuuaagagggggaggaagaauuguuggaaccagaaggguggagaacaccagcaggagaacaccacccacagacaucaacuaacuguggcucauaggaguuugcagagacuaaaguaacagucagggagccuacaugggucugaccuagguccccugaauauauacuaugguuguuucacugcugguuuugagggauucaucaaaaagggaaugggguugucacugacucuuuugccuaaucuaaggacccuuuuccuccuauguugccucacacaggccugauaugaagauuugugacuagccuuacuguaucuuguuaugcucuguucaguggauauucuuuggagggcugcucuucuaugaaaggaaacagagcauggaucucagagagaggggaaguggggagagaggagagguuggggagggacugggauacauggggggguggagaaacugcaauuggaauguauuggaaacaaagacagaaaaagaaccauucuuagugguaaacagagugcuagggugagcuauauacaccagcgacaucaguaaauaauucauuuuugccuacaucaauuagaacaauaaagaauucauacuguauaagguuaagguuuacaaggaaacuggcuuuccuucugugucugaagcugacccugugccacagaucuccauacccaaauagcacugggagagggcuagucucccaggagugcuuacaugccugugaacauaguaaaaccaccaauuuugcucaaauuccugucccaagagggaccagcccagagucaucaggacacaggaacaaaggaacagcaaagacaggaugcuuccugauuuuguaugcaccccugagcuuucccugugucacagcucuccauacccaaauuccuccaugagagaacuggucuccaggaguacugacacacacaggccugcaggagggagaagccacagucagagacagcaaggccagcuaacaccagagauauccagauggcaagaggcaaggacaagaauauaagcaacggaaaccaagguuacuuggcaucaucagaacccaguucucccaccauagcaagcacuggaugccacaauacaacagaaaagaaagaugcugauuuagaaucacaucucaugaugaugauagggacuugaagaaggauauaauaacucacuuaaagaaauacaggagaacacaggcaaacagggagaagcccuuaaauaagaaacaccaaaauccuuuaaggaauuauaggaaaacacaaccaaauagguaaaggaauugaauaaaaccauucuggaucuaaaaauggaaguagaaacaauaaagaaaucacaaagggauaaaacccuagauguggggagccgcccucaaauucgccauugcaagauggcgcugacauccuguguucuaagugguaaaaucugugcaugugccaaggguaguucuucacuccaugugcucugccuuccccgugacgacaacucggccgaugggcugcagccaaucagggagcgacacguccuaggcggaggauaauucuccuuaaagagggaugggguuucgccauucucucucuugcucucuugcgcucuggcuccuaaagauguaagcaauagagcucuugcucucuugcucuuuugcgcucuggcuccuaaagauguaagcaauagagcucuugcuuucucuugcucucuugcucucuggcuccugaagauguaagcaauaaagcuuugccgcagaagauuccgguuuguugcgucuuuccuggccggucgcgagaacacguguaagaccuagagauggaaaaccuaggaaagagaacagagucagagaugcaagcaucaccaacagaauacaagagauagaacagagaaucuuaggugcagaagagaccagugaaaacauugacacaauagucaaagaaaaugcaaaaugcaaaaagcuccuaacccaaaacauccaggaaaaccaggacacaaugagaauacaaaauauaagguauagaagaaagugaagauucccaagcuaaagggccagcaaauaucuucaccaaaauuauagaagaaaacuucccuaauguaaagaaagagaugcccaugaacauacaagaagccuacagaacuccaaauagacuagauaagaaaacaaauuccucccaucauauaauagucauaacacaaaugcacaaaacaaagaaagaauauuaaaagcaguaagggggaaaggucaaguaacauuuaaaggcaacccuaucagaauuacaccagacuucucaccagagacuaggaaagccagaaguaccugggcagaugucauauauacccuaagagaacacaacugcuagcccaggcuacucuacccagcaaaacucucaauuaucauagauggagaaaccaagauauuucaugacaaaaaacaaauuuacacaacaucuuuccacaaaucaggccuuuaaaaaauaauagauggaaaacuccaacacaagaagggaaacuacucccuagaaaaagcaagaaaguaaucuucuuucaauaaacccaaaagaagauagccacacaaccauaauuucaccucuaacaacaaaaauaacaggaaacaacaaccacuauuucuuacuaucucuuaacaucaguggaucaguucccugaaugaaaagacauagacuaacaggcuagauaaauaaacaggacccagcauuuugcugcauacaggaaaugcaccucagugucagagacagacauuaccucagagugaagggcuagaaaacaauuuuccaaggaaauagucccaagaaacaagcuugaguagccacucuaauauugaauaaaauuggcuuucauacaaaaauuauuuaaaacuauauggaaggacacuucauacucaucaaaggaaaaaucuaccaagaagaacucucuauucugaacaucaauguuccaaaugaaagggcacccacacucaugaaagaaacugauaaagcucaaagcaaacauuguaccucacacaauaauacugggagacuucaacacuccauucucaucaaugaacagaucaugaaaacagaaacuaaacagagacacaguaaaacuaacagaaguuauggaccaaauggauuuaacagguaucuacuacagauuucauccuaaaacaaaagaauauaccuucucagcaccucguacuaccuucuccaaaacggaucauauaauuggucacaaaacagguaucauuagcuacaagaagacugagauauucccaugcaucugaucagaucaccauggacuaaggcugaucuucaauaacaacaaaaaccuuagaaagcccacguacacauggaagcugaacaaugcucuacucaaugauaauuugguaaagaaagaaacaaagaaagacauuaaagacuuucuagaauuuaauguaaaugaagccacaacauacccaaacuuaugggacauaaugaaagcagugcuaagaggaaaacucauaguucugagugccuccaaaaagaaacugaagagagcuuacacuagcaacuugacagcauaccugaacacucuagaacaaaaagaagcaaauacauccaagaggaguagaaggcaggaaauaaucaaacucaggguugaaaucaaccaaguagaaacaaaaagaacuauacaaagaaucaaccaaacaaggaucuggcucuuugugaaaaccaacuagauaaacccuuaaccaaacuaaccagaggucacagagauaguauucaaaucaacaaaauuagaaauguaaauugagacauaacaacagaaacugaggaaauccaaaaaaucaucagauccuacuacaaaagguuauacucaacaagacuagaaaaucugaaugaaauggauaauuuucuagacagacaccagauaccaaaguuaaaucaggaucagagaaacaaucuaaacaaucccuaaagaaauagaaacagucaucaauauucccccaaccaaaaaaaccaaaaccaaaaccaaaacaaaacaaacaaacaaaacaaaacaaaacaaaaaacccaggaccagaugaguuuaguacagagcucuauuagaccuucaaagaagaccuaauaccaauagucuucaaacuauuccacaaaauagaaacagaagguacucuacccaauucucucuaugaagccacaaucacucugauaccuaauccacacaaagacccaacaaagaaagagaacuucagaccaauuucccuuauaaaugucaaugcaaaaauacucaacaaaauucuugccaacugaauccaagaacacaucaaaaugaucauccaucaugaucaacuagguuucaucccagggaugcagggaugguucaauauacagaauccaucaacuuaauccacuauauaaacaaacucaaagacaaaaaccacaugaucauuucauuagaugccgagaaagcauuucacaaaauccaaaaccccaucaugguaaaagucuuggaaagaucaggaauucgagacccauuccuaaacauaguaaaagcaauauauagcaaaccaguagccaacaucauacuaaauggagagaaacuugaagcaaucccacuaaaaucaggaacuagacaaggcuguccagucugucucucucuguucaauauaguacuugaaauccuagccagagcacuuagacaacaaaaagaggucaaauuauguacucacugauaaguggauuuuaggcaaaguguguggaauacccacaauacagcucauggaacacaugaaucucaaggagaagaaagaccaaagagugaaugcuucagugugucuuaguagggggaacaaaauacucacaggaggaaauauggaaacaaauuguggagcagagacugaaggaaaggccauccagagacugcccuaccugggaauccaucccauacacaguggcuaaaacuggaccuuauugugaaugcgggaaagugcuuguugacaggagccugauauggcuaucucugaaaggcucugccagagccugacaaauacagaggcagaugcucacacccaaccauugaacugaguuuggggucccugauggagaaacuagaaaagggacugaaggagcugagggaguuuguagccccauggagagagcaacagugucaacuguccagacucucccagagcuaccagggacuggaccagcaaccaaagaauccacauagugggacccagagcucuggcugcauauguggcagaggaugaccuuguuggacaucagugggagcaguggcccuuuggccugagggguuucgagacccuaguguaggguaaugccuggauugguggggaagcacccucguagagacagguggaagggggaugggacaggggauuccagaucggagaucuggaaaggggauaauauuugaaauguaaauaaagaaaauauucaauaaaagaaauaggaaaaaaacagaagcuuccuuaaguucaauucccuuaacugccuuacucgaguugauaacacaccaaaccauuaagcaauugcugauugaaaaggagacauuuucauugugucuguaccaaagacauaaagacuuuguuauuuucuuauaaccauuaccuauucauauuguguuaaguagcaagauauaaaauauuguguacauguuuuauguauauauguuuguagacaauguauauauaaacauuuaaauaaauaaaaguaaauauauauaaauaaguauuuaccauuuaauauaacuuucacauauacagcuuauauacugucuuucuauaguuuacuguuuuauauaagauuaagcaccacagauuuacuguuugcuaggguacuaaaaauaauuccacauggauauuaaaggauagcaugacaaucaaaacaaguaagcugauagagccuugagaauuuucaguaauauccaaaaaucccuaaagaucuagacugagaagagcguguuaaggcaaaccuggacaaggcugggaaucagugugauuacugaagugucuauacagcaucuuaagaucucauuagcgggcugaagccugaaauccaagcacucaggaagugagggcuugaggacuaggaguuuagguuacccuuaggcacauagugaguucaaggucagccugagcaacacaggacucugcuauaaacaaacaaacaaacaaacaaacaagaaaacaaaacacccuuuucuauaauuccagugcauguuacagaaccauuugcauuaaaaaaaaaaugccccuucuggggagaguaaucagaaaaagcuguccuaccccuagaacuaauacaacacugccccaggcacuccuccugggagcauagcuguauaaauuacuuccuccucaauucacagagcucagguaucaucagacccucacccuuggacaauuagcauaguaggucaccaugacaaccaacagggacaaagaaagggucucugauuuccaggguuauaaucccagugagaaaaaguguuagguacagguuucuuguguaccggguuuucugcaggucacagagagagagcaggaucagguaccuggaaaaagaugccuucagacagggguagccuucucagcacaggaucccacauugucugcuacagaugcuaucaaauaugaggaagcaguagaauugccuagaaggguuaugagacacacagccuugggcuccacagccagaguuucugcuucagagagugugagaugacagccaaugauugcucugaugaaagagaugcagcucaucccaggaccacauucugaagaccacaucuuuagcagaaguagcuggaaaggagcagagcuauugcucgcaagugggaagauauaacuccagaagugacauaacuugagaaguggaggagggcuauccacugccauccauucagucaguucacagcacaguuaaacagugaacagaaaaacaaaaaacaaggcaugagaaugcaagcauacagacugcugcauugggagggagaagggagcugugcuggaaagagaaaaacaagcaaaggcagagagagaacucaguuggaagaagaugcaaccugggaacacagauuuccccaucucuguuuuacaaacaaguuacccagaauccucaacacguucucacaacugagaagauauacgugaagagaauuuuuaaaaggaaaccagagagcugagggaauacccugaaaucauuauaaauauaguucuaaaaaucuaauaaauuaaaauagaauaagaaacaagcacaacugaaaaccaaauuaacagcaugcugaaaaaacaacuuaauuacaguuugggcauccuuauucaaaaugcuugagacuaaaugugccuugaauuuuagccuguuuuauucacgccuuagaaucuuugaaugcaaucgugaucuaccuuaugaaugggacccaaguagaaacauuggauucaguuauguuuauguguuucuuuacacucuuuguauaaaaagcaagcuuuaaacaauagcgugcuuucauuuuuauuguaacuaguucugugaaucaagucgaaguuucuacuugucaaauuccauuagccaccagacuaauggaauugguuugaagaagucugaauuuuaugauuuuuaaguagagaugcauaacauguguaguuaagacccaagaaaaaugcaaagaauguguuaguacacacagaaaauggcaaaauuuucaaagacagaaaguaaacaaacaaaauuaucaguuucucuaaaauauugaaccauaaaaauuagaaggcugaguuaucauauacaguauguuccuuaagugaagaaagaaucaguucacuagauagcaguaagguauugggaugggggaaguaacagcauauuuuacuaauuaaccuuauuaaucuuuauuguuguuugaaugauaaauguucccauagucucuuguacugaaauaauuggucuccuguugcuggcacuguugagacaggcuauggaaccuuucaggagguagagccaugcuacaagauuuauagguucucuccacuuccugauugcuuccccuguuuccuacuuguggauaaagauguaauaagccaacuuccuacaccagcugccacagugucucagcccuaaugggcucuagcccucuggaagcauaugccaaaaccaacuuccuucuucaauuugcuucugguccugacauuauggcccaguaacagaaagguaacuaaugcagacaucauagaagaaaauucuguuacuacagaauucaggaagaaagcaagucaacuacucaugcuggcccccguguuccuugcaccacccaugucaagaagcaaagucucuaggagaaacaaugucuuaucacccagguucauuguuaguaugaaggcaauaggcaaguauucuuucaaaacauuaucucuagaauagagcuugccaugccucuugugggaaaaaacaaagcugagugaugaaaacugucuaaguaggagauaaguugaaauaaguaauccuggaaagggggaaccauuguaaaaacacuaaaguuguauccaaagaagaacaacacuaguccuaacaauaggagauuacauuuucaaaacaugccuucaucauugacugagauuaaugucuauauaaaacagaucccauccagugcucuaacucccacucccacaggaaaaccaucuauggaagggcauguaacccugcaugagacaucagaucucaggcuccucaguguccagagcuacaagaaauacauuucuguuucuuaaucacccugcuuuugauauuuuucuugcaguagcccaagaaaauagaaacaaaacaucacaguaaaaauaacaugaaaaaaaagaaguguuugcuuguuuguuuguuuguuuguuuguuuguuuuugggggcagugaugaagccagucugauuuuucuagccauuuuuuaacaccuaaauugauuuaguugaaaguucagaaggauuucaaaaguuaauauuucuuaacauucaaaaaggccuuuuaaggaacaaauaggcuuuaugaugaagcaucuauauaugaauuucaauuauccuuggaauuauacuuuauuuuucuguuguauugaauuaaaauuaaauuugaugcaucuauuuaugaagaaguagauauauauauauauauauauauauauauauauauauauauauauauauacccuucacauuauuucuguggugauauuaauuuuugauuaacauuaauuuuugauuaacaucaauuuguuacucuuuacauguuuuauauaugugugcuuuaagagauguuuaaauugauacuuuggauaagcuguggugguauauaccuuuaguccaggaggaagaggcaggcaagagcucuguaaguuucagaccagcuuggguuuacauacuaaguuccaagccaagaaaaguuacaugguggcacucugucucaaagcaacaauggcagcaaaagauauucugcaacuggucauaauugguguucugguucuuuuaugauuuuugagucaugguucauuacuuguccuagaaacaguccucagaaaauccuugaauuaaaaucagauccuacaguaacaagaaagcugcuaugggagcauaucagagcagcauggggcaggacagaggaaggaaaugcucuugcccuguaucauuaggcuugggggaccagaguaacaaaagcauuuaauccucaaaauagcccugggaauuacaauauacuauccucaucccacuccacagcuggcauggggggugaacugagagcauuggcaccuuguggaugggauuuugcuguaaaguuuuguagauuuaauaugggacacaggggcaacagagaugaacaaagaaaagaaaguaguguaggaaucaacgcauaaaugaagaaaugaagaacagagacuucuugugcugucuuuucuuccuaccuucuuagccauguccuggugaaagcccuucuguguggaugguugcugucugcaugguagagccuuugucugcaaagcugaaggcaguuuacaugggccauggguccuuauguaaauagcaaucugccaaggucuacuugaaauaggaucuuuaaaggucuauuuagacuucuggcucugcuugugauuuuccuaugucucaaauauucucauugguuuuaaagauauauauccugauauagucacuuuuguuaacaccuaaauuaaagauucugcacuauuguauaaauacuuucuaaagagaugugaacagguaucuacucaccccaguuaaaccaucaacaccagaaucaaaggaacaauucuaaacccaaggguagcucagugaaccaaugcucuuaauugagguuacuuauaggagcaugggcaacuuauggguaacuacacuucagaaggaagaguuuucuuucaguaacucucaacugucuauauauccuuggagauggauauggucuuuugagcaacucccuugcaugacggaaaguuaauaggcccaaacuuguguggaucuccuuugaacaaucauaacugguaagaguucaagaggguaaccaucauaucuggcacauagacaguguaccacagcagagguccaagcacagcccaccuacacagacaugcacacagagaucauucauaggccugcuacugaggccuaugaacuaaaaguucagcuauaauguacaaugguuuuauuugcuucugcucuaaggagcuggcuucacaaauuaaaggugugaucccuugaaaccacugugauaaaaguaauuugaaauuauacuguugacagugauuauggaaacaaaugucuauguaucacacauggcucagcuuuggugagaaaaaaaucaauagaauaaaacacuuuaaguuucccagagcaaagcuguaccugacagauaccaggaaauaacaauucacacuuuuaagaacccagcaugugcaaauuagaacacauuugagaagacacuaagagaagacacauacacaccucaaauuuguguagccucuacucauaaggucuuuauguuucaaucugaccauccccugcuuucauugcccauuccuuuaucuuuuugcaaccugugucauguguuaaaauuacagccaucaaauaacagguuucaguaucaaggaggucucagauuauaacaacauacauuauuuugaucaaaacgguucuguggauggauggaguuaguaagaagcaugaguacuugggagugaugcugguuucauuuuauuuuuguuuuguuuuuuuuccuguagaaauucugagguaacagaaauauauaaauacugaugcaaaggaugauacaagaggacagaaaagaaauguccaggcaucauauacaaaggaagccaacuucuugccuaguaaagucucuucacuaauguuucucauggguguucagucaacuucagaaguaaucccgcuugagaaauuucggucuuauuccuuuuuagaacagaauccugauuaccauuugggguauuuuauuuaagcagacuuaauagaaugguauggauauccuauagucugcuuuagaauuuuaccagaucucugagaaauucuguucaacuuucugcuguccucuuuuuauggucaaacaaugagaaugugacaaaagucagccugcuggaccuucccuucuaggucuugguguccugaucaaauggucaauaaggcauuccccaucaauugauucggcagugaugcuucaguauaucugaccugaucuucccuacaugaaaaucucaaccaucugcccuaucuuaauucuguucauuccaguuccaucccauguuuuuuuaaccucuaauuugucuauccuuuucacuuccaaacaucauaaauucugccugagccuuuguagaaaugggagcaucaccauaugauggguccucucucacacacugguauuugcuucaaaguuguguguuaagguaguacuagguaucaaaauuacaaugaacacauuuuagucuuucuuucuuucuuucuuucuuucuuucuuucuuucuuucuuucuuucuuucuuucuuucuuucuuuccuuccuuccuuccuuccuuccuuccuuccuuccuuucuuucuuucuuucuuucuuucuuucuuucuuucuuucuuucuuucuuucuuucuuucuuucuuguguuagucaaugcugacaaguccugcuaugcagaagggaugguguaacucaguucccaccacaggguguagaccucuacuagugcugaugguugcugugagcauggggcuuguuaguauaauaaugugcauauuuucauguuccuccuuucaggaauacucuguuaagguuaaugacucgaugacaauuagaaacagaaugagucccgggagcugagaauguguuccucagcaaaauggugaaggcagaccuuuaagacaguccuuaagacugugagaaagaacucugaaaacaugaguucgagaauguauaacuucucaacuauauaaaauagaaggauguaauaugaauuuuaugagaaguuucagggaucuaaaagaacaaagacaguugcacuaugugccagcuuggcaaacugauauuaaggaaggagauaaagggacuuagggaauggugaccucagagccagaucccauccaguuagcuuauugucuguacuuauaaaggcagauuccugacuucaagaucacccugggacaaagcaaguuuagguccaagcauggugggaaugguaaucucaggacaaaauuccacccagcaaaauuuguuugugcauacaaagauaggcagaguuuguuugcucuguuaaaaacuaauguucucuuucuaagaaucaaggggcuaaggucaugaaaugcugauucauggaauaaucaaaagggaaccuggguaaacaauugaauugauauguaaauaagagacugggcuucucuugcagagaauagcugucuagagagcuauaacaauuccuuuuuagaguuugucugguuggcuuucugacuuuggucuuaaaacccaagaauuuugucuagcagguuuucugacuuuuguuggaaaacacaagaaguuuuuuuucuagcagcaauuuugacuuugguuucaaaacccaugagcuauccagagagcuuuuagaauucuuucucugcuagagagaacuuucucaaacagaaagcugucuugagcagagaacuguacuugaacucaugauugaccuugagucuuuucuucugcugcuccuuuccucaguaucccuguaugagccaaggcaucaccaauaaccacacuauaaagaacaugacaaaccuucuccaagcuguaaaccaacauuucuuuauucuuuaugaugauauaaauauuucagaguacagaaauaggagcuuuguguuguugccauguguccugauaaucuucauguggucguaagguuacaagugucacuucccagucucugaagaagaacauacacucauguuccuugccuacaaguucuucuggacauaagaaaucuuccuuaugaaaaagaccauccuauaccuuauguauuaugaacuuaaagauuguucuacagccugccuccaauauaaaguauuguuacuguucauuccucugaaguugggauaaugggugcuuacauucagagaaauucaucaaaaugauggagauuuauuauguuuagcugaggaagcagaaauguugaauauucacuaggcgcugagugggugccagaaucacaauuuccuugugcacaugucugauaaauggguuucccacauugucaaauaauccauccacucgcugucacuuuaccaacucuuuucucagucucacauucaaacucuauguuuaugauucuguacucauuuuuguucuguagaaacagaugcaaauggagagagagagagagagaaaggagggggcaaccaugaguagagggcaggcggggagcagcaaaguagacaguuagauaguuuggggacaguguuuauccccucuugcagacuugaccaaaugaucaauaagcuuguaugccugacacaagacuucuuguccuucccccaucccuuucaugccucagugauacugaaagaggugauucuuccacaccaugagaggugggauagggggugggaaaaacaccauucagaguccucuaugcccuugggaaggaggucuagagagggcaacauccaucuuuucuguucuucuucagagagugaaacucuuaggccucugaucucuccuucucuccuucuagugcggucuuucuuacuaauaauauccucucuccuuccucaaucucuguguuuuucacuuuuucucucagccugucucccuagacuuuccucaccuucuccucucaaccucucuucuucauuuccacuggccugcgcuuuauagaugcagcucaacugagcaagccugaacugacuggcuugggcucagagaggaacaucauucaguucuccgguucuauuuccucgugugcucuaugaucacacaugucaggugugcccugcaccagccucuacuacagcacagguaggugucccuggaguggcagguaggaggugacucguaauuugggcuguaaagaaucugauguucugcuguagaccuaggcuuuggaagauaccuucaugcagucaaugguaaccacugccugcuuucaucagaggugugguccaacucauucaguauauuucaguagggaaguccaaagacagguaaagauccugacagauccaaggagaagcucagcuuuagcugucuguauggaguuuuuauucuucauguuuuccuuuucaucuaucagaaucccccugaagaaaacaggaccaaacaggaauuugaugccauaucaucacaaaaauaccacaaggucaccaucuacaccagaaccagaacucagauuuaguucuuuuuuuuuuucuuuucuacuucuucccuccauugguuaaugaauaaaggaauauaaaaaugaaaaaaaaucacaucacaaaugauccauguccuuaauuggcuuugcaaugucagagucacaugaacugauaaaccaccauguaauauugagaugucuaaagaguaaaacacuagagaaacaagauaauucucaaguaaugaaaguaagugaaauuuuaaaucacagaauuaucauuucucuucacauuuuaauguucuauaaaugagagcucuuuuucagcaaugugcauacuuaauguagagcuuuuaauuuuuccuaauaacucauuaaauuauuaguauauuuuauaauucauguuaucuugaaacuaaugaaauuugguaaauucaguacugugaccuuuggaucacagacuggaaaggcauaaauccgccuccagaagauugcacugguuuaaaacacuuuucacagauuuuuauuuuauuuccugugaaggagaauagugacccaaaugacaguaacaguaauagaauagcaguuuguggucuuguguccuauuacccccuacuuaaaaaaggaugaauucaaggacugcacagaugacucaucaguuaagaggacacaugcugcucuuccacaggaccagaauucaauuuuagcacccuuguccaguagcucacuacuccuuguaacuccaguucuagcgaacccaauaccuguggucuuugggggugccugcauucauuugugugugcccacauggacacacaaguaaaaauaaaaguaaaucuucaaaggauuauggucuccggguuccaaguguugagacagggaccuaugacccuugggaauaggcuaucugaaacaagagaagaaguagggguaggaaccauucucucuauuaaugacccccaggauuaaagggacuaaucuacccuggagcucuggccuaaagcaaauaccucuuauugccuuuaacacaauccuaugaucuggccacuccaaccacagccccagcaguuuugccaaguaaagauuuaauagcagacagccggccaccuuccuggugagagcacgggggucugcccggccugagagguuugugucacaggcgcuggcgggagccuucuuggcuccgggacuccgcggagggcaggcugcacgggagaccguguggaauacagaggccagccguuucugggacgggcgagaguugcagagcuucuggggcggcaccaucuucggcuccagacaaccggccaccuuccuggcgagagccacagagcuucugaggcggcgccaucuucggcuccagacaaccggccaccuuccuggccaaagcaacacagcuucugggaaagauccuguuuugggccuucaccuucagccaggaggagguccaaacaccagauaacuguacaccuuccgugaaagaggagagcuugccugcagagacugcucugaccacugaaacucagaggagagagcuugucucccacgccugcugauugaggguaacaaaaucaacagaggaacaaucucuuaacaaagacaacuauaacaacuaacuccagagauugccagauggcgaaagguaaacauaagaauccuacuaacagaaaccaggaccacucaccaucaucagaacccagaaagcccacuucgcccaguccaggacacccuaacacaccugaaaagguagaccuggauuuaaaagcauaucucaugaugaugguagaggacauaaagaaggaauucaauaacucacuuaaagagauacaggagaacacugcuaaagaguuacaaguccuuaaagaaaaacaggaaaacacaaccaaacagguagaaguccuuauagaaaaacaggaaaacacauccaaacaggugauggaaaugaacaaaaccauacuagaccuaaaaagggaaguagacacaauaaagaaaacccaaagugaggcaacaauggagauagaaacccuaggaaagaaaucuggaaccauagaugccagcaucagcaacagaauacaagagauggaagagagaaucucaggugcagaagacuccauagagaacaucggcacaacaaucaaagaaaauggaaaaugcaaaaagauccuaacuaaaaacauccaggaaauccaggacacaaugagaagaccaaaccuacggauaauaggaguggaugagaaugaagauuuucaacucaaaggaccagcaaacaucuucaacaaaauuauagaagaaaacuucccaaaucuaaagaaagagaugcccaugaacauacaagaagccuacagaacuccaaauagacuggaccagaaaagaaauuccucccgacacauaauaaucagaacaucaaaugcacuaaauaaagauagaauacuaaaagcaguaagggaaaaaggucaaguaacauauaaaggcaagccuaucagaauuacaccagauuuuucaccagagacuaugaaagccagaagagccuggacagauguuauacagacacuaagagaacacaaaugccagcccaggcuacuauacccagccaaacucucaauuaccauagauggagaaaccaaaguauuccacgacaaaacuaaauucacccauuaucucuccacgaauccagcccuucaaaggauaauaacagaaaaaaaccaauacaaggacgggaaccacgcccuagaaaaaacaagaagauaaucccucaacaaaccuaaaagaagacagccacaagaacagaaugccaacuuuaacaacaaaaauaacaggaagcaacaauuaccuuuccuuaauaucucuuaauaucaauggacucaauuccccgauaaaaagacauagacuaacagacuggcuacacaaacaggacccaacauucugcugcuuacaggaaacacaucgcagggaaaaagacagacacuaccucagagugaaaggcuggaaaacaauuuuccaagcaaauggucugaagaaacaggcuggaguagccauucuaauaucagauaaaaucgacuuccaacccaagguuaucaaaaacgacaaggagggacacuucauucucaucaaagguaaaauccuccaagaggaacucucaauucugaauaucuacgcuccaaaugcaagggcagccacauucauuaaagagacuuuaguaaagcucaaagcacacauugcaccucacacaauaauagugggagacuucaacacaccacuuucaucaauggacagaucuuggaaacagaaacuaaaaaauccaucaauguaauccauuauauaaacaaacucaaagacaaaaaccacaugaucaucucguuagaugcagaaaaagcauuugacaagauccaacacccauucaugauaaaaguuuuggaaagaucaggaauucaaggcccauaccuaaacauaauaaaagcaaucuacagcaaaucaguagccaauaucaaaguaaauggagcgaagcuggaagcaaucccacuaaaaucagggacuagacaaggcugcccacuuucacccuaccuuuucaacauaguacuugaaguauuagccagagcaauucgacaacaaaaggagaucaaggggauacaaauuggaaaagaggaacucaaaauaucacuuuuugcagaucauaugauaguauauauaagugacccuaaaaauuccaccagagaacuccuaaaccugauaaacagcuucggugaaguagcuggauauaaaauuaacucaaacaagucaauggccuuucucuacacaaagaauaaacaggcugagaaagaaauuagggaaacaacacccuuuucaauagugacaaauaauauaaaauaucucggcaugacucuaacuaaggaagugaaagaucaguaugauaaaaacuucaagucucugaagaaagaaauuaaagaagaucucagaagauggaaggaucucccauacucauggacuggcaggaucaacauuguaaaaauggcuaucuugccaaaagcaaucuacagauucaaugcaauccccaucaaaauuccaacacaauucuucaacgaauuagaaggagcaauuugcaaauucaucuggaauaacaaaaaaccuaggauagcaaaaacucuucucaaggauaaaagaaccucugguggaaucaccaugccugaccuaaagcuuuacuacagagcaauugugauaaaaacugcaugguacugguauagagacagacaaguagaccaauggaauagaauugaagacccagaaaugaacccacacaccuauggucacuugaucuucgacaagggagcuaaaaccauccaguggaaaaaagacagcauuuucaauaauuggugcuggcacaacugguuguuaucguguagaagaaugcgaauugauccauacuuaucuccuuguacuaaggucaaaucuaaguggaucaaggaacuucacauaaaaccagagacacugcaacuuauagaggagaaagugggggaaagccuugaagauaugggcacaggggaaaaauuccugaacagaacagcaauggcuugugcuguaagaucaagaauugacaaaugggaccuaaugaaacuccaaaguuucugcaaggcaaaagacacugucaauaagacaaaaagaccaccaacagauugggaaaggaucuuuaccuauccuaaaucagauaggggacuaauauccaccauauauaaagaacucaagaagguggacuucagaaaaucaaauaaccccauuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagucagaauggcuaagaucaaaaauucaggugacagcagaugcugguguggauguggagaaagaggaacacuccuccauuguuggugggauugcagucuuguaaccacucuggaaaucagucuggcgguuccucagaaaacuggauauaguacuaccggaggauccagcaauaccucuccugggcauauauccagaagaugccccaacugguaagaaggacacaugcuccacuauguucauagcagccuuauuuauaauagccagaagcuggaaggaacccagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagcccaaaacccaggauacccaagauauaagauccaauuuccuaaacacaugaaacucaagaaaaaugacgacugaaguguggacacuaugccccuccuuagaagugggaacaaaacacccuuggaaggagguacagagacaaaguuuggagcugagauaaaaagauggaccauguagagacugccauauccggggauccaucccauaaucagcuuccaaaugcugacaccauugcauacacuagcaagauuaugcugaaaggacccugauauagcugucucuugucagaguaugccugggccuagcaaacauagaaguggaugcucacagucggcuauuggauggaucacauggcccccaaugaaggagcuagagaaaguacccaagaagcuaaagggaucugcaacccuauagguggaacaacauuaugaacuaaccaguaccccggagcuccugacucuagcugcauauguaucaaaagauggccuaggcggccaucacuggaaagagaggcccauuggacacgcaaacuuuauaugccccaguacaggggaacgccagggccaaaaaagggguguggguggguaggggaguggggguggguggcuaugggggacuuuugguauagcauuggaaauguaaaugagcuaaauaccuaauaaaaaauggaaaaaaaugauuuaauagcugggaucccauccccuaaugacuaugaauauuauacagaguauuaaguaauacagaggugccuggcaaaaacuuauuucuauuuaauuucuggacuaaugccuuuuaugacaccagagagaaaguuuacaugugguaccuuaaucaguuaacuuugaacccccuggcuuuauaccauuggggcugcuagugucagguucaguucugugagcaggaggcacuaaacacuuugaauuaauuauuaguaucuuuucuugaaauuuucuguuuguuucccucuauucacaguagguaacaugucuucccacuuaaaauagaagcagaauugguggguuuuguuuuccaugaucccuuuccaagaaccucuuucagucagguuccacccuguaguucuggcuggccuucuacuugagauaauucuauuugagucucacaaguucugugauuauagaagugaaccaccacacucacuuugguuuagauguuaaaugucccucagaggucuguguguccaaagcugacacuucugacagauggugaacucuuuggaggugggucuuagagcuuccucacaggggcacugaggucaugccuugucaacagacucuggauucucucuccuguuuucuugcucacauagugagcccuuuagccucgauuauaucccugaccagaagcccaaaucaauggacccacccaauauuuuguuguuucuucuaaaaaccaugagcccaguuaaccuuuucuccucagaaugaaauaucuccaguauuucauuaugggaacacaaagcuaacaaauacucauaguuagaccuggcccaacucugccaacggaaaacagaugaacuuuaugccauuuggagaaacaaugcaauauuaauuauguugcuuccaaaucuccucaugaggagauagcauugcaucuagccauccauauuguggcacaaccauuuacuuguauuuauucauccuucauguuguucccagcccugggaucuucauuaaaggucuccuuuccuagaccacgagcagaguaaagcuccuccaauccugauggagucaaauccauugugcuugccauuguaacauacuuccuacucaaguguucaagaguaaaauaagcaauuuuauuuuaauaaugcacuguuugcagaaggaaaaguagacugauugaauauguuguucugugcugauuuuaauaguuguuauaaucugaucuguaucuaaccagauaauuggaauuuaaucgguuucuuuaauuuuaucacaaaacuagaauacagcuguaguaagacacuaugaguaaauaacacucauuauuguuucauuauauuuaugcacaugagcuuuaguuuaugugugccaggacuccaaucucuuccauaugauuagaacuuuguuacgguugaaccauuauugugcaauuguacagugaggacagugagagaugccuguugauugcagaguauaaguuaugcaagacauuucuggauucaccuucauuugccaaauaaucccaagacuaauuuaaggagcuacacagugcuuugaugacuuacauuguuucuguuaacuaaagaccgggguauuucauucuaaggaauacagacaugaauagagaaaacagcacauccaugguggaaaagggaaagacuuauucccaucaaaggcaaggccaucgcagagcuucaacacacacagacccuuggacuguauagaaaugugguauacgagcauuaaggaagcuugguauuucagaagaucuggucacguguucuucagguucccaagucuugcguaacuauuugaagagcuucaccucauucauguucuugaggaaaagauuauggauaaugacagaaucaacaagagaaauuguuaaggacccauacagugcuugucggaaagggcuccgauaccuagagcacauuugaaaaccccacuaauaagacuaaagcaccuuggcuauacucuuuuagauagcgaaaugguuguaaaaggucuuuuucugggaggccgcuuugggcaaucuuuucugucauuuuggcugugcaguaacaucaugaccccucccugagcuggucuagagagcuccuuccucuguaaggaggaagccuggugaacaagaugaaauguagguucacugcagagagaccauggcucucguccggcuuuuagagacaugcuguguggccucauuaccuccuccaugaaacaguucaagcggcuacucugcuguugcuuaaagaugaaaugagaugcugucagaggagcuaaccaagagagcuugaugcuccuucagcugcuaggguuucuguguucagucuuaucuuaauaauucauuauucaaccaaaccauucauauaugaauucaaguaaggucuggccaccuggaacauaaaacugaaggccaaauuugaaacacaacauccaaguuuuauuuucuuugaauuuuguaacaaaaaaagagaagagcugggguuuuauuuugguuuugcuuuguuuuguuuuaaucaaaagaugccaauuagguauuuuugaucgaccaaagcaaacagagccacagauauuguauaagaggauguuacagaaggaugugccccuuaaaauaaggugaggaaagaagcuauuguuuaauugucugucacaaagugauaucugaauuugcauaggauuuuucccauuugugaauaauugcaauaugcagaaugauaaagaugccagaacuuagcggggcgugcuggcacaugccuuuaaucccagcacuugggaggcagaggcaggcggauuucugaguucgaggccagccuggucuacagagugaguuccaggacauccagggcuacacagaaaaacccugucucaagaaaaccaaaagaaaaaaacaaaaaacaacaaaguugcccgaacuucuaggccuauacuacagcauauauaaagagcaacucaucaauuaucauugucugucucacaaagaagaaagcuagcuaaagaugccucaauggaacacacagacuaguccuuuggucuuauucuccucaacauuugagcugauugagagaaggggaauauuuuugacucuguucuuagaaaucacaugaacauacccacugccuuauuuugcaccuaaacugcaucuuuaauccugccauugucuguguugugucugguuccagagcucaugcugggauacccuguuacuuaccuaaccccccugugauccucucccacagaaaugguuuuaaacugcuaugucuuuucugccuuguugcccaaacuuagggagaacucucugccugauggcgacugggcuagcuuugccacuuaagagagaagaagccaauuucaucccagcauauaauauauguuggucaaauuuaauucuauccccucucuaacuacuuccagaucuccagucuaaccuccauacccucuguaacuaccuucauguuuucuuucuuccacuuuaugucccacuaagcccaauagaaugaaauacucuuggaagaauuuucaaaggagaaauacaaauacuuagcaugaagaccuucacccguaccuccucauuacaguagacauuacuaauccaucacaaaaaccuuccaacugcgccuguacauucuucaaaggccucucaagacugcaucuccauagcugcuggcaacauuucauacuuggcuugaaugaugaaggcaaucgaaagaagccuggcucgaguccuugcuauucuuuguacaauaaggaacugagaauaucccaggagcauuauuuauguagaauaggaaugaaaccuuauaugcagagguauggcuuuuaaaauuaguaaggucuuuuaaucccccugaaauuucauucuuaccuucucccauauagaguacaaaauagacucucuaacaucuuuagaaugaauuuuugucaacaucuguagcaucugguagucucucaugguacuagcugaaugcuauuuguaguauugucugggaaagcaaacugagacugacacagcaaaagaugggaagaauugucugcuaauaagcugaaagaaaaggaguaguggccauacaagaggagaaaaguaggugcugugguuuaaauagguguuauucaaggccucuauguucaaagugugguccccagagugugcuauuggugauauaacccuaggugggaagcuaugggaggaggccauuauguuuagcauauaaaaaagaaaacuguagcuuugcaaugcaaaggagcuuuuauguggaacacugaguaucuuuccagccugugaccacauuuucuuucucuuuccuccacucagcccuccuuccugcacccuuucuucauguccuucacccucuuccucucuuuuccuacgcuuuacucuuuucuugucuuuacuuccuucauaauucccuuccccauugccucucauucucuuuuccaaacuggaaaccacuuuucugaccagacaauuggccuuaaagaaacacucuggcaaccaugaggguuaaguggcuuguacuguccuugcuuugaggcagaucacagaaggacucgaaaggacaaagggcugguggugaggccuacacacaacacagcaaaggggagaauaggccaugagugaaggaagcagaaauccugagcucaggggaagaacaauacacacagcugugcagacaggaucagucaggccgggagugagugccaaguacacacaauagacuugaggagagggcaggaagugcucaugauuuuaaagagagaaguggggguuggggguggagugagugcugagguagguggggcuggggugaggaugggugggugguuggugguagguggaguggaaugguggguggggaaguggguggggugggaauaagguggggagcaagagagacaaagaugugaagccagcaaacuaagcaguagcauucauaacaacaagcagccacaacuggugucagauggggugggcagugggguggggaggguuggaugugaggaagcauccacacguugagauuaacaagucaaaaaugaagacagugagaugugccugccuuugaaaccccuggcaaagggaagugccagcugagcaguggcacuuugagaagaaguuagcagacaggaccugauuuugguugaaauucuuccuuaauaucacucugaaaaauggaauuauuguccugagacuuaaaaaauaucaacccaggagccccaguacagugaagugucuacucuaaucaugcaauacugugcacugacagcacagaaauucuuuguuacaccuacccuaucggaccugaaggguagccccauaacagggugccuuugggagccguucuuccuaacuaguuaucgauuuauaaaaaagaauauguguuuuauaucaaaugacuguuccugaauuguaaccuuggaucaacagagaguaaacauuggcauuuucauauggcaaucugcuauuugggaauaaucuaaucuuccuaggagaauggaaauaaagcacagaacagccauuuacgaaucacacauuauuaggcaccaguaaucugucauucaccacgguauucuuaagucacuaaagggaccauucaccauucaacuacucucagacauuucagguaggaucagugggaaguggccucccaagauugaauguaccaagcaugcaugacuguuucauuacucuagacagaaagguaauggccagugcaaaccaccaggcuacuacaguaaagaacgucagguaaaaacugaaauaaaucagauauuuaaaugggauauucauuuuggcuauagucauuagucagagcacagagaaguaaugguccacuucaccuacuuaguaauuuacauugguuauaaguauacuuuaagucauauagcucauuaauucauuaaacaaauauuuuaauauaacugacuacacacuugguacucugacagauauuguaagacacauucaaauauacauauuuaaauuuuucuaccuucuaaagacuuuauggugggaaagacaucuugaagaggucucguuuaaacaaggcaggauuacauaguaaaagacuaauaagcucuuugcauugaaaaggcaauaagaauaaccauauuuccucgcaggguuuucucgaccacaugcuccagaggaaaggcugccuccaagaggaggggagaguaguggagaaggaaaggggauggagaagcuauuguuuggggucaugcaacuuuuuuggaauggcaucuuaauuguugccuacugagucaccaggaauugaaugcucagcacagucugcugucugccuugaaacugaugugucugugguucacuaauuccuuugucacuaaagucuucuauuucccaugcuuugcuuccuuguguaggaaucagggucaauguuugcauacaccauauacuacaacuugauuggaugucauuggacuucuuugcaacaaaucccauacaaacucaucccagauguauuguugauaauuuuguuuauuauuggacuccaaaucagcaaauauaagcaaaggagauaacaaauugccccacaaaccaaaagagcuaugccuugugccagaacuuccucccacucaguaacucugguauacucaagugugcugggcuuauuuuaccaucaaucuguuucaucugcuuugauucuauccuaacaguuuaauuauacaaagagcaaauuccuguaaccaaugagcaauuguagcaagguugugauauacaacaucauuauaggcaagucaguuauuuucuggcauacuaaaaugaacaaauuaauuuugaaaugaaaaaauauuuuuaucaucuacaauaacaacaaaauuguugaaugauuuuuuauucaucuugauaauuugauauaugaacucaauacauuucuaauaagaagaaccugagagaacauucaauacauuucuaauaagaagaaccugagagaacuauuuuguaaauauuaacaaacucauucagaagacucagaucauccaaugcaauggcaaaugagaagaauacaggggcaagagcuacucuacccacuugaacauguauuaaaacuacaguaaucaagauggcgagguaguaacaaacagagaaauagaauacagagaccagaaauagaaccaaaaaaaaaaaaaaaaacauagucaaacaauuuuuaacaaaggagcaaagguaacuaaaucaugaaaggauuuuggcuguuugucuuuuguuuuuuccagacaggguuucucugacuugcccuggguguucugaaacacacuacauaaaacaaacuagccuugaacucagagauccaccugccucugacuucugaguacugggaauaaaggagugcacuaccaucaccuacaaggacugucuuuuuaaacaaauagugcuggaaauaaugauaucuauuugcauauauauauauauauauauauauauauauauauauauauauauauaucaccuagaaauaagauacagaauuauuucaguccuagaugaugaagucuagguugaccacaggcauggaaugauggcaaagacaagaccacauuaaagguacaacucaugaacgaaacaguugauaagauuauuucauaaaauaaaaaaauagggacaacacacugucaaaagagcaucauaaagucucaggacuaggaaaacauaaacaaaagacguaccacauaaagagcugcuauccaaaguguauagacaauuuaaaaauucaacaauaagaaaaauaauacccagcucaauuuaauguuaguaaaaggcuugagcaaagcuccucaucaaaguaaauaaacaauuaaaaaagcaagcauacaaaauuauauuuaguaauauauguuacuagggauuauauguuaaaacaguggcaugcugcuauguauagaauagaaagcauaaauacaaaaugauguccauauuaauuaugaucacagacauggaagaauuucaaaucccauucauggaucaguuuguacuagaaguuucuuacuaaacuaaauguacucaaucuugcauucguggcccaaguauuuaucuuaaggagcugaagacaugucuaugcaaaaaacuauacacagguguuuaaaggagauuuucaauuuucaaaacuacacaaacuuggaaguaccaaagaugucuuuggguagauaaaugaauaaauguguugugugagacacauccaaugguuacucagcugugcuaacagaaaauaugcuaugccaaccaagacagcauggaagaacucuauauacauauugcuauguguugggagccaaccuuaggaggcucuuuaguacaugauuccaagcauaucauauacugaaagggguaaaauccuggagacaauaaagagaucaguuucccgaggguucuggaaauggcugguaagagugaauggccauguggaacacaggcaauguucuaguuugcuuucuguugcugugacaaacacgaagacgaaaggcaacuugggaaggaaaggggguuuacuuuacauuuccaaguagcagagcaucauugaggaaagucagagcagaaauucagguggaaacuggagccuuugcuguggaagaacaccauccacuggcuugcucccuguccuauaugcucaacuagcuuuauuuuacaggacuggacucccagucuagaaauaguaccuuccacaguggaccccaaccuaggaacaauuucaaaggccauccaugaauaguaccuucuacaguggaugaccugacaagggauaauaccucccacaguggacccccaagaguaggaauaauagcucccacaguggacccccagacuaggaauaauagcucccacaguggacccccagacuaggaauaauaccucuacaguagacuccacagccuagggauaauaccucccacagugacucccauccuagggauagcaccuucuacaguagcccaggcccuuccacaucaauuagcaaucaagaaaauguuugauugagucgaucccccaguggaaaucccucagacaacuaacucucuuguaucaagucacugaagguaagcaagaagguaguuuggggacugugggguuauccucuguggugcugcaaucuaguuacacaucaccaagaaauuaucagaagccacaauaugaacaacauagaacaaccccccuaguguaaaccacagacguugguuaguuacaauguaucagagaugucugaucaacugaaugguguuagucggggagccaggaaaagugccuuucaguuuuucaucaaacuuaaaaucagaauaaauaaauaaauaaauaaauaaauaaauaaauaaaucuuuuaauuuuuaaaaaauacuaugaaaacauaaauguaaccaaaaugucaacccauuuaaagugaaauaguccaaacaauucuuuuucaaaggaacgcuuuuaacucuuuuaccaauuccacuuucacgccaaagguuaaaguuaugguagccuugguuccacuuguugggaacaagcaaaagaaacuuauucuaugugcuacuacucuguuuucagacuccauuuaaucuuaaggagaaacuaaauucaaggucccggcaguuccaagaggagcugggggucucccuagagcugaacagcuuguaugcuaaccagccaucugaguccgcgcuguagcugcuuguauuaggaaugcuaacuauguucccuuaaaaaccauuuucaggagaaugucugcacguagcuucuggaaaccuguugccaguggguucugauugguaaauaaagauguuaccagccaagaguugggcagggcagauagaggcggggacuuugggauucccuggcuugggacagggaggagaagagggagauccuccgugcccagagaguguggaggggaggagagaugccaugccugagaagagugcaggacagggaggcauagcuaccaugugaaggagcugggggggauggcccagagggcugcccaauggaguccagggcagccaagauaggacacagaauucagaaagcaauaacucugaauuaucugugggagguauggagguuuggcaauggcccagcuauugugcuguuuaaagcauuuuaaaauagaaaggcugugugugugugugugugugugugugugugugugugucugcacguguuucauucaggaacauaaaccauuggggcagauaguagaacucacuuccagaauuaauuuauauuuaauucaacagacaucccagggacaccuuguaaagagacaguugucuaaguccagccaucucacagacaacuucuucaucuugcugguaggaucaaauagguucauauuuccaagccuaggaacaaacaccuaucccacuucuccaaguguuuucuuuauuguuuguuagcuggaaaagaauauaaaaauuguguuuauuuaagucaaguguauucguuauagaaauacauaaauaauugccuauugugcccuagguaacacgcagcuuguccuguuguucugccgccuuaucacucugaacuccaaaccuaaugucuaggagaaugaguuaagggccuugaagccaggugcucuggaucuggcccagucuccauuggguacucccuugcuuaaccuaaugucagaauauaguuggguaccacugcagcucccucuguucccuccucacuucguguucccaucauuuacaaaugcuaugcaaucucguuuccagggacaugguucagaucccaaacuguccuccuuccuguguacucagaaaguuaagcuuucaguuuuaagcuucuguaucugaaaggaguuucuucagcuuccauccugaacccacuacacucugcuucuuaaugcaguuauuuuuuauuaaauuuccucuaacuuacaugaguuuguaaccauucugggaaagaaaaaaguuuucuuuugccuuuuaaaaacaggaguucauuuuguagucccaugugaugauguauuccaggcugaccuuaaacuaagcaauacuccugcuucugccuccuaaacgcuaggauuagagauugagccauccacuugucuuacucaaaaacguuaauaguucuuuaguacacaaacuagugacugcaagugacuauucaguaaagaaaacagaggaaugacuuucuuaugguuggggaguuacuguagauaaggaagagaacagccagagcuacguggaagagaaagaagcuggcuggccacggacacggcuaucucucgggagcagacaaaauaguagacgguaaaucuuggagggagaagcaagagaagcaagaaaagcaagaagaggaggggaugaugggagaggaagggguagagccuggcugguucuacugaaagugggaagggagugugcuucaaucaggaccagccuggagcuagcauauuuaagggggaaggauuaccaggaugcucggaagugcauaagagauaauaaguguuuguuaaaguggaaauguuacaaaggaguuccuagcuagcuuggacuuggauaugcuaacaggcacuauagguauaugucaauagagagcuauaugucccuuuugccagaggcuagcgaagauaauggaaauggcuccguuucacagguuccuggagaauucugcucagaagcguuuaugacuuagccagcagucuguaguccagcuugagcugagcuaagacuuugggguuauucacugcuugaguuuucuuuggaccuggcagcgaccacacugaguguugaguggaaaaaagcccagggaauacauuuucacaugggcacuauauaguccaaaacucuuggucuuucuaagaauaauaaagaagggggugaggcuuagugggcaguaugcgugcuuaggguacacaaagcccugaauccggagcacuguauagaacuauauguggugucacaagccuguauccuaacacuucagagguggaaacaggaggauuggaaguuaaauucaucuuugacugcaggguauguuuaaggccagucuuggcuacaugagauaccauaaacaaacaaacaacacguuagccagugggcaguggagucaagacugaacaccuugugaagcuucagggugccacaaaagucccuuuuccugacaggaaguaccuaauuagcccuaucgucaugaucuuaaaccugcuaaacuggccaagaaaagaauuacagugacaauguucuuuauucugucucuaccugucccuguccuuaaaggacaucauauuuuuuucccauggaguuuuguuuguaaagaaaucuaaagcagguuuaauucaagcugagaaaacuucaguacuggaugagaaggacagauacacuacgaaguaagauaaagaugcuugauaagcaguuaauucagaaucggcaugaauuuuaucuauaaggaaaacaacagaaucaucacacaacaaaaaggacaucuuugaaugagucguggaauaagcuauugaguuaugcaaaacaauuuaguuugcacuagacuggcugaagacugauuuugaaaaguauuaaguuucaaacuagggacaaaaggaugagaugucuguuuaacauaucaaaauggaccuggccuccagguucuccuaacagcccucaggccccaccuguuaaggguuagguucgcauacccccgcccugcccucuacccugaacucugcagcccuggggagcugcccuucccccagaggcucuacccuauauaaaccagacauuuuucauacuuuuggccuccuggcuacugcacucaguuccccuuucuucuuucuuccuuccccuccccccucuacccacagggcccugcucaggauccuguucacuguggacuuuuccaguugucucugccucuagcuguguucucacuuuuaucuauaauacaccuuuucuucaccauaccuaggagcagucuuuauuauuauaucuaaguacacuguagcugccuucagacucaccagaagagggcgucagaccuuccaguucaauggaauguuuguuguugcuccugguaggagcacuccccccucuggaaccaaaacuucuaggccugcagagccuagaguuauggggacaggaagcaaaaauuuuccuagagggucacuaggagugauagugaguggagcuauucccuuuuccacaucugcgggcugaagagauggcucagcaguuaagagcacugacugcucuuccaaaguucugaaguucaaaucccagcaaccacaugguggcucacagccaucuguaaugagaucugacgccuucuucuggugagucugaagauagcuacaguguacuuggauauaauaauaaauuccuuuacuauauagagagacuauccauaaguucugugacucuagagaacccugaccaauacaaugugugaauacuacaugaguuccagguacuggcagaagucagaagauacagaugguugugagcuaccacguggguacuggaaaucaagccuggguccucuacaagagcauuacauuuauuugauauuuucuucauuuacauuucaaaugcuaucccaaaaguccccuauacccuccccgcacccugcuccucuacccacucacucccacuucuuggcccuggcuuuccccuguacugggucauauaaaguuugcuagaccaaggggccucucuucccaaugauggccaacuaggcuaucaucugcuacauaugcagcuagagacacgaguccugaggguacuaauuaguucauauuguuguuccaccuauaggguugcagaccccuucagcuguuggguacuuucucuagcuccuacacugggggcccuguguuccauccuauagaugacugagcauccacuucuguauuugccaggcacuggcaaagccucacaggagacaguuauaguguccuuucagcaaaaucuugcuggcauaugcaauagugucugcguuuggugguugauuaugggauggaccccugggugggcagucucuggauaguccauacuuucaucuuaguuccaaauuuugucucugcaacuccuuccauggauauuuuauucccuauucuagggaggaaugaaguauccacgaguuggucuuccuucuugauuuucuuguguuuuggaaguuguaucuuggguauuauagguuucugggcuaauuccacuuacgagugagugcauuucaagugacuucuuuugugauuggguuaccucucucaggaugaugcccuccagguccauccauuugcccaagaauuucauaaauucguuauuuuuaauagccgaguaguacuccauuguguaaaugcaucacauuuucuguauccauuccucuguugagggacaucuggguucuuuccagcuucuggcuauuauaaauaaggcugcuaugaacauaguggagcauguguucuuauuacuuguuggaauuucuucugguuauaugcccaggagagguauugcuggaucuaccgguauuacuauguccaguuuucugaggaaccaccagacugauuuccagagggguuguacaagcuugcaaucccaccaacaauagaggaguguuccucuuucuccacauccuugccagcaucuguugucaccugaauuuuugauccuagccauucugacuggugugaaguggaaucucaggguuguuuugauuugcauuucccugaugauuaagaauguugaacauuuuuucaagugauucuuagcccuuuggcauuccucaguugaaaauucuuuguuuaguucugcaccccauuuuuaaugggguuauuugauuuucuggaguccaccuucuugggcucuuuauauauauuggauauuaguccccuaucugauuuaggaucaguaaagauccuuucccaaucuguugguggccuuuuuaucuuauugacagucucuuuuacccuacagaagcuuuacaguuuuaugaggucccauuuguugauucuugaucuuacagcacaggccauugcuguucuguuuaggaauuuuuccccuguacccauaucuucgagaauuuucuccacuuucuccucuauaaauuucagugucucuggucuuaugcggaguucuuugauccgcuuagacuugagguuuguacaaggagauaagaauggaucaauucucauucuucuacaugauagcugccaguugugacaacaccauuuguugaaagugcugucuuuuuuccucuggaugguuuuagcucccuugucaaagaucaggugaccauagguguguggguucauuucugggucuucaauuuuauuccauugaucuaccgggcuuuugcuguaccaguaucaugcagguuuuuuuguuuguuuguuuguuuuguuuuuuguuuuuguuuuuguuuuuuuuaaucacaauugcucuguaguacagcuugaggucaggcauggugauucccccagaggauguuuuauuguugggaauaguuucgcuauccuagguuuuuuguuauuccagaugaauuuguaaauugcccuuucuaacucagugaagaauugauuuagaauuuugauggggauugcauugaaucuguagauugcuuucggcaguauagccauuuuuacuauauuaauccugccaauccaugagcaugggagaucuuuccaucuucugagaucuucuucaauuucuuuguucagagacuugaaguucuugucauucaaaucuuucacuuacuuacuuagagucaugccaagguauuuuauauuauuugugacuauugagaaggguggaguuucccuaauuucuuucucaguccguuuauccuguguguagagaaaggccacugaauuuuuugaguuaauuuuauauccagcuacugcacugaagcuguuuaucaggauuaggaguucucuggaggaauuuuuaaggucacuuauauauacuaucauaucaacugcaaauagugauauuuugacuucuuccuuuugaauuuguauccccugaucuccuuuuguugucaaauuguucuggcuaggacuucaaguacuauauuaaauagguauagagaaaaugggcagccuugucuagucccugauuuuagugggauuccuucuagcuucuuuccauuuacuuugauauuggcuccugguuugcuguagguugcuuuuacuauguuuagguaugggucuugaauuccugaucuuuccaugacuuuuaucaugcagggguguuggauuuugucaaaugcuuucucagcauauaaugagaugaucaugugauuuuugucuuugaguuugucuauauaguggauuacguugauggauuucuguauauuaaaccauccaugcaucccugggaugaagccuacuuggucaugauggaugaucauuuugauguguucuuggauuucguuugcaagaauuuuauugaguauuuuugcaucgauauucauaagggaacuuggucugaaguucucuuucuuuguuggaucuuugugugguuuagguaucagaguaauuguggcuucauagaauuaauuggguagaguaccuucuagcaucacaugcucuuaaccacugagcuaacucaauaaccuaaaacuguuauuuuggguuuuguuguugcuacuguuggguuuuuuuuuuuuuuuuacuguuauuuuguauuaguuacaugccuaucaaaauucuuuuuaagccuguaucccuugcacuucacguaggagacaauaucuggaaaauuuugaguuugagcccauccugggcuauauagugugaauugucucaaaagcacaagagcagagauauagccuguaguagagcaaugguucuugaccuguaggucauguccccuugugauuugaagaauccuuucaauggugucagguaucagauauccuguauaucagaucuuuauguuaugguugauaacaguagcgaaauuauaacuaugaaguagcaaugaaaugauguuauguuugggaauuaccacaacaggaggaacuauauuaaagggucacagaauuaggaagguugagaaccaauuaucugaacaaugaugggcauacauuuggagaacuugggcugagaaaugacagguuggauauaaaguguaguuaauuccccacaguugcugugaaaucauacagaguuaaacagaagucuauaaauccagguucuggagcuaccuugaaaucccaccaaaguacagaaauccuaacaacagcagggugacaggaagggagagaaggaauaauuugucagugaugcacaaaguaaaaguaucuggggagacugagaacugugucuuccaaggagaaaacaaagaagacacaggaagucacaauaagaucacacaucaaggagaaaacaaaacagacacaauaaggucacacacugcaggucacugagagcauccuccaccaauauuaaucaugucaaauaauccagguacagacauuauuaguaucuccaucauccaagcguuucaugaccggccauuccaguuaacccuguguuuucagguucuucagcuuguauuaacauuguuuguuuuuauugccuauuaauaguuggaauaagaggacacauuuuuuuuuacucuuucaugauuugguggauauuuagguuguuuucacuuuaauaggaaugaauauuuucacagggaauacucaaguaauguuuuuguuuggauauguguuuccauuccucuugaggauguaucuaucagugguaccauaugguaaauauauauucacucuuuugagaaaacacuagauugguuuugcaaaguagcugcagcauuucauguccccaucagcaguacaugaguguccaagugccuguacaauuucccugucauuucagaugcccugugaugugucauuucauuguccuuucuauuugcauucaucugaggaugacugguaguaggcaucuuuucauaggucuauugcucauuuuauacuucuauaaauaaauauauaaauauucagaucacuugcccaucuuaauucugccaauugaauuuucacuauugcauuauaaaguuccauguacauuuuagauacaggucucuuauuagauuaaaugacuugcaaguauuuucucuuaauacuuuauguugugccccacagcucaaugguacccaguguagcauaaaaauauugccaucuuuuuccuccccuuauuuuuacauuugguccuaugucuaauaugccaauaaaucaucucaggucacuaauuacgguuaugcuuccuuccaugaacuuuauguuuagcuuuuaaguuuuagguccuuuauccauuuugugaugccuuuuguauaggagucauauaggcacccaacuuuaucuuuuucuaaaguggauacucaguucaaccauuuguucaaaagauuguucuuuccuaugugucuaauuuggcaucacugaaaaaaauuagcugacagaaaaugugagaauuuauuuccagaacuucaguuuuauagcauagaucucuguguuuguuuaucauauaugaguaccauacucuugaugacuguggagguuucguuuguaaaccauauaaccuuccaacucuguguucuauuugcaaaauuaauuugauuauuuucugugucacuugaauugucaaacauccuaaaguuaucuagugauuagugacaggaaguaagcugaguuaaugaaaagcauugcauuucgucugcaugucacuuuacaauaucagcauauagugagccucacagucugugaccuguauagugagccucgcaauccauggacauguguggugagcuugacaauauucugaauccuuucuaucuguuaucuuaaaacacgugucaaccauaguuaucccacccugcuacaaauacaucaucuaauugcacaccuguauuuaggaacucuauguaugucuuuaaugcaucuuucuugcccaguuacccugguuacaacuauuagaagaguugggaacagaaguuaggagggcaucuauccuuguuucauucuuugucuuaggggaaacucauuuuuaauuauuaaucagagaguuagcuauggaguuuuuuuuuccauuuuuuauuagguauuuaacucauuuacauuuccaaugcuauaccaaaagucccccauauccacccaccccaacuccccugcccacccacucccccuuuuuggcccugguguuccccuguacuggggcauauaaaguuugcaaguccaaugggccucucuuuccagugauggccgacuaggccaucuuuugauacauaugcagcuagagucaagagcuccgggguacugguuaguucauaauguuguuccaccuauaggguugcagaucccuuuagcuccuuggcuacuuucucuagcuccuccauugggagcccuaugauccauccauuagcugacugugagcauccacuucuguguuugcuaggccccggcauagucucacaagagacagcuacaucuggguccuuucaauaaaaucuugcuaguguaugcaauggugucaguguuuggaugcugauuaugggguggaucccuggauauggcagucucuacaugguccauccuuucaucucagcuccaaacuuugucucuguaacuccuuccauggguguuuuguucccaaaucuaaggaggggcauaguguccacacuucagucuucauucuucuugaguuucauguguuuagcaauggaguuuuaauaaugcuuuauuguuuagaaaagcucuacuaccccacucuaaggguuccuuuuaucaugaagagguacuaaguuucuuuuuaaauuuuccaaugaauuuacugagauuagcaaguggcuuucgguauuuacugucuugauauguugcauuauauuggcuuucagauguuaagcaaaucuuugcuucuaauaaaugccaguugaacacuaccugguucauuuuauucauuacuagaaaguauuuucuagacaucuuguacagauuuuuaugucuguauucauaggaaauguugauccacaguuuauugggagauucugguuauguuuuggcaucucauccuauuuaucucuucguauguguuugguauucuuggaacaacauccaaagaauuacuauuuacuuguuucauagaauccaccaguacagccaucuggacuuacaguguuauuagauugugguuuuuuuauuauauaaauuguguuuucaauauccuuauuuuaaagaaacuauuccgcuagauauaaaccaugcuaacacacacacacacacacacacacacacacacagaaggccagaaccuucugcuugugaagucaggacccucucccacugaucuguccacucucucaugucacauccaggcuugcccugaagguggcuuuccaggaaucuguuuacuucucuuuauuuaguuaguuucucugaauauguuuccuguuccacuauaauuccuucuuucuauggaguagaagcugcuuaauucacccuuccucuuguaucucugaauuuacgcuuuuccugcuuccaugauuucagguuggucaguuuaggcaaaguuguauaaauuuuaucaaucuuuccagagaaccguugauucucuugauuauacugauucccuccauagcuuucuuuggucuacuuuugcauuaauuucugcacuaguguuugugguuuucuuuucccuuaggcuuauuuuauuuauuuacuuuuugaccuuucuuagggugaguggauagauugaauugagacauucucuuuaagcaaaggcaacugggccuauaagcuuucuccuauguacuauuuguuauauauugcuuccauguguuuucuaggacauauuuuauuuuaguucauagugcuuuucauuuuccugauuuuuuucuuugauucucugacuauuuaaaaaauggaucauguaauuagcauuuacagucagccuucaucacacaguauccguggguagguggucucaggacucuuuaggucugugaggcuuaaagguggcugcuuaucaaugcaauggaguccagguuagcaugaguaaagcuguguuuaauaguauaguaggagugaagcaaauucaaagagaagcauacuuuuauguuuaauuauuaguguuaguggagucugcagucacaaaugaguccucuguaucaugcccucuccccaaagugcagcaacgaauccagaagagaggaaaggaaagaccauaagagcuagaggucaagaagagccccaaugcaacaguaucuucuagacaugacagaaugcuguacucaugaacauaccaggccccacaaaauaaagccagucaacauuuuggcaaggauugggaagggauucaugaguccccacuccugucugaggagccauggacaguugaugacuuuaggggagggagagccaguuuuugaugagagugugccugcugguauuagaguguccuccaguggaucgccccugcacuuaaggaguguggaaacagcucaguuuggaguugauaggucacuaaaagaauaaggagaacaugaaguugggaaaugguggccugagguacauauaggaagauuagggagaagaguuggagugacuauaaccuaucauuuuuuaaaacuuauucuuaguuuuuaaguuaauuaacaaaguagaagauuuuccuuuggauuugcauacauauuuauuucauuugguugauucugcagccuccuacccuuccuacccucucccuauccauuccuauggugccauuuuggcccaguguaccucccuccacuuuguuguacugacuuccacacagcccucuuguguccucccuguuacaggagucucuuuccaguuuccugaccuuuacucauucacacucauguagauacacaggagcuagaauccacuucauauaauguuuucauguucuauccaccgcuuuacaaauuuuaacauuucauuuuuuuuuuuuugcaaauggauaaaauuccauuuuauacauaucccacacuuuucuuaucuauuccccaguugauagagaacuaugcuaauucuguuuccuggcuaucauuaaaugagcagcaaugaauaugcauacuucuuuguaguaggauagagagucccuuggacauauguccaggagugguauaggugguuccaaauuuucugaggagccuaugcauuuauuucuagugucuauacuaaauuauuuuccaaccaacagugguucauuuuuccucuuuccacauauucucauuagcauuugcugucaguguuuucuuggugguaacuauacugacuggagugagauagaaucucaaaguugaucuacuuugcauuucauccaugacuagauucccugagauaacagaaacccagucacggaccaucacaguaagcaucucuggggacugaggacuggacauaagagacacuuaucccugagcaucucucucucucuuuuuuuuuuuuuuugaaaaaaauauuuuauuagauauuuucuuuauuuacauuucaaaugcuaucccaaaagugcccuauagccuccaccugcccugcucuccuacccacccacucccacuacuuggcccuggcauuccccuguacuggggcauauaaaguuuucaagagcaaggggccucucuucccagugauggccgacuaggccaucuucugcuacauaugcagcuagagacaggagcucugggaauacugguuaggucauauuguuguucuaccuauaggguugcagaccccuucagcuccuuggguacuuucucaagcuccuccauugggggcccuguguuccauucuauagaugacugugagcauccacuucuguauuugccaggcacuggcauauccucacaagagacagcuauaucagggucccuucaacaaaaucuuguuggcauaugcaauagugucuggguuugguggcugauuaugggaugaauaccggggugggguagucucuggaugguccauccuuucguccuagcuccaaacucugucucuguagcuccuuucauggguauuuaccugggucccaacagagacgucuaucuacuuacucagcugggaaccagugcugucuacagacucugcuccucacccucccaccuaguuagaaccugguggccuuccuugccugggagccccagauugucacaacucucacuuuccucucagaugagacuaacccaccuccuccucggagcggcuucauucuauauuauagaggcauucuaugacaucacacauuuagucucaugucuucucagagucauuuuaaagcaaaagagaaggaaagaagaggguagugaagcagggagcuuuccuugugugugugugugugugugugugugugugugugugugugugugcuuguuguuuuguuuuguuuuugacucaugauaucugcuuugagacaccuggccaaguauaaccugugcuagguuucaaauaaaagccagauaacuuugaagauuuuuauuucucaggggacaaaagaugaaagucugugucaaguagucauuagcugcucauggccguucuuggaggggugagggggcacccuccucuucuauggguaucuaguagaugggucuccggguuuuaauuugagaagggauuuacagccugaaaagauuuaauauaauuuugauuuggguugcacugggcugggcagccagauuccauuuguaugaaacuguauuaggagauaugaccaaaaccaccaaaaucaaauaaaaagaacauuccccagagagccuaaaaauaggggccugguuccccaaagcuuguccagugcuuugcugucacucggauuuacaucugcaggaucuaagcagaaacacagagaaaggcagccagcaugcuuccgcuuucgggucagcagccugucacuaaacugauccagcauauucccucaauggagaaagaaaacaauuaacccuuaaagaagcaggaagugugugugugugucugugugugugugugugugugugugugugugugugugucugugugugucugugugugucugugucugucugucugucugucucagggugacuugaaaaauauucuguuuucauuuccuggggcuacuguugaauucugagucuaugagaaauucaucaaauugucugcaaagauuccaggacccaaucacccaccaccaccacaugcuacugcauacauguaucucacaguauaccccagguaaugaagggaagauaaugacuuaagaggagagugcagcauuuuccccaaacaauucuaaugcuguuuuaaagcucaacuuccuuccugugcacaacaaacaguaagucaccuuggguacugaaaaucacaauuucuccugagaugaagcacagaaaagaauuagcuuuugcuuguaaucauuuuucccaaacagcuaccaagugcugggcagauuaucagcaucuuccagugggacuuagagaugggaccccaugggcugaaaucuuaaaauuaaaauuauuuugaugacagucucuaauaucaaauggaauggguucuuuuuguguggagaaagcaagacugcuuccugucagagaguuauaaagauggccaccaacaacuucaagguuagucauuucuuaaauggucaguuccuuucaaagguuuguuugccuguguguauaugggugaacugcaugugggcccacggccuucagagacuggaagagagcuucagaucuccuggaacuggaguuauagaucgugaacugcaaagugcaugcugggaacauaaccuggauccucuacgagagcagccagugcucuuaacugcaaagaccucucuccagcccuggucaauucccucuagagugguugcuagccaaaaggaggaacugucugugagaaugaucuuucuaauuucugaaaggacaucucacuucacaguuaccacaggagguaaggaagaaaaggaccagaguuucuacaggagucacuuuuucucagaaacaccaacuaaagcaacuaccuucacuugacaguuugccugggccagugagcaaaguuuucauuccuuguuucuguaguaagaggugacccaugaggccugcguaugguagagguacguccagcuuaaagauaugguuugcacagaaccacaaagaagaagcaaaguuacagaguacagggacuucuucagaauaaaacaaaugugguaguuuaaaugacauggcccccauaggcuuauagauuugaaugguuaguuaccacacaguggcacuauuugaaaggguuagaaugauuaggaggcguggccuuguuggguuagaguaaucacggccuuguugaggcaagugugucacuagaagugaaauuugagguuuuaaaagucuaugcuaggaacggucucucuuucucugcauauggaucaagaugcaacuggcagcuacuacuccaguaucuaccuacguucugucaugcucccugccauggugauauuggacuauacuucugaacauguaaacaaguaccuaauuaaauacuuuuauucauaagaauuacauuuguuaugguaucuuuuuacaguacuagaacagugacuaaaacaguaaauuauauacaaaugaguucaaaucucugcaccugcacaaaagaucuucuuuguuuguuuguuuguuuguuuguuuaagaaaggauuucucuguguaguguuaagauagccauuaagaguuuccauucuuuauuaaaucuggcaucuuuaaguucugacugcuuacaacgucaucugcaaugcuuuuuguuuuuauuuuuuagauuuauuuauuuuuacuuuauguguauaauuguuuuugccugaaaguauauagggguacugcauuaauaccugucgucauauaggccagaggcaggaauuggauccccuggaaccaggauuaugcacaguugugaguuucuauaugagugcuaggaguugaacuucggaacucuggaagagcacccagugcacuuaacuaccuagccaucucucuaacaccauuugaauugugucacaauaauuaauuaauuuuaaugauuguuuauuguacaaaauaguggacuguauuguauuuacuuggugguuggauagguauuuggacuauauuuaucagcaguauuuuuaccuagcucacuguauuuuauuuugugcagauuuuguaaauauuuucuacaagauuauuagucagauacaguucaaucucacauagcaaggugcauaauccuuccagcuagaguuuaagaaaggucaucuagauaacucuuaucuguuaaaauucuguuuauuuacuaaaaaauauaugggacauucauaucccuuugacucugucuucccauuggauuucugcuuguuuucuugaagugucauuguauaucacgcuucuauagucccaggauucuauaaacagucagaacuacaaguuuuaauuaauaauauacuguaggagcauuguucaucauuuauaaugcaacaugacaucaugauuaacagacggaaauaguucucuacuggagucaccugggaaaauccuaacaagggaguaaauaaauuacugauguaugacuucuaccucagacacagugacuuaauuggcuuggaacuugaccuuaauccugggauuuuuagaaguuccuuggguguuucuacuauuugguaaaacauaggagucccuggugcaaugucugguuuccucacauugaguuguaucacaauugcuacauacauucagguguugucaggcuaaugccuucuguaucaaguuccccaggaaauuccagccaaauguugauagucacagauaguagagccuauucauauuauuuuauaaauacuuauaaaauggcuacuuuuuaauuucaucauucuucccguguguauugcaagggagcaauucucucagauacaguuuauuugagauguuguaggggcaaaaaagguagguaaaauacuauuucccacaaucuuuauaucauaugaacaacaaguggcuauccuagugaguucugaaggugacccacaauguuuuaaggaauacuauggagaauuccuaguucugugucuuggcucaguuucacuccaucaugucugcuguucuuuuugauguugaaacggaguggucuguggccacagagggccccuuucauguuggugccaagucuuuuacauaauuuuagaaggguuugacaguuggccaugcaaacuguguaggcucauggugccauugacuggcacagcucuagaaauaguucauuucauccaugauucucaaauucucucauugaaccaagacacaggggauggagggagggaagagcaaacaaaacagguaugacaccaaaauagacaaguauaauucaguucucaacucucaaccuauuucuccuuugccgaagaguaaaaaacaccauuuucuucuuuaccacauauuccuuguugguuucuguguccagaauucuccuguguaacaugagaaugauaaucuaaauaacccagacaaaugucaacccucuuuaugcuuuaauagagaaucaauggaggaauaauauguccauggucaguagcccuuguaaaccaauggcaguauucacuggguagcagcccauucagcagacaguaauuacgguucucagcccuggucauagguggucgucagacaugacgauugaaagcauugcaguuauuuguuuacucaauaaauaaucaugaugugcauccucugggaaaggcuccaugcugagguccgggaugccaugguaaucaagauggacagaaagacagaaaauaagcaaauauaaauuauuucaauggaucuagaaucauucaaacaggaucucucugggcucuaugaaaaucuccaguagcuucauuccacccuugaaacgagugcuuccuaagcuucuugucagagcagccccuagaacauccuaacugcucuguucauucugcuaaggcaccucgucagcuuccaagcagccuuccucucauagagaaugaauuauaaucaugagacuccuuggcaacaguuccagaaguuggauuagggcaucucuuccuucuucccagcaugaccgaaauggaagagcagacaggugccuugaaagaggaguuucugcugaaaccaaaggcaggaagccauucaguaccucuauguuacugcagaaugaaaaacagguuugagauagcauuuucuaugaauuucuggggaaaaaagaccaagaagaaaaccugcuuccccuuuacaguuugaugucuccugguguuauggaggacucauuuugggggcucuuugucuaacagacagucucagcugggcugcagagcagcaggguagaaggaugaaagccacucuccuugagucucaccuucccuguggagagagccucuggcauggacacaagguugcacgggcuuuucaauuuguggccuccauccuguuccguguuuuccucauugaauggaaacuccucaaguuucugacccccauuggaccucaccaguagccauugacuugauccaaccucuuuaccagaaagucaguuucauuggcagaagguaccauaacauggcauuuacuugugaacacuuaccaugcagucuaaagaacugagguaaaauguguauauuccgaaauucuucauugauucuacaugagccguuauaccgagagauaaaguuaaaaaaugccaccuucccaaaucacuauuguugucuugggcaaauauauacaacucuugugguuagugauucuaugaccuauuauaugacacugugggcaaaauauacuuaucuguauuuaaaguauucccuuuuaaaguaucacuuauuauuagcaugcaugguagugguggugguggugguaguggugggguguauguguguguuuauguguguaugugaauuuguuuaggauucauguguggguauacauaugucacagaauguauguggaggucagaggauaacuuuuugaucaauuuucuccuaccuuucuuuaccuuuacauggguucuauagaucaaacucaggcuucucagcagguucuuuacccauugagucaccucaucuguccauaaaauuauuguuuuaaaacauuccaugaguaucucacuagugguaauggaugccagucauguaucagaaguuccagggaauaaaccagaaucauuucguagcagcuauaugauggucaggcaggugccaauaaacacugguuucaauaacaaagacuaggaacuuuggaaagcagaacaaaaggcagaagagaguacagagccuguuccagaagggucaucccuacuugggcuguacucucaaaguugagggagaacaacugcuuaaagcugggcuuaaaccaaaaaagagagccuugacaauuuaugagcuacucucaguaacagaaaauguacaaaggggaaaaagaggagagggagaggagggagggggagaugagaauuacuacucuagaaggaggugcagagggaaagauaaagcaggaucagaaagcuugcccuauacuggacauaucaauauucagaacucaguccguucagacagaaauagaugcugagagaaaagcuuuucuaacaggaguaguaugaaaagccauguuaagaagacccuugcugggucuguggcuauaggugcucugaagacagaggugccucugcaauacuacacuggaaacccagggcaaguacuagggucuauuuccugaaaaccuaagcagaauaauaucuuuagggauauuauucugagaggcagaaccaugcagugcuccauggaagggaaucuggucugagccauagacuggagugagaugaacccccaccauggaggaugacaaaugccugaagcagcuacagucuaaggcauaccaauggaaagcuaccaagagcccuuuccagugcuuagaaacugaaggguaguucucgcuaugauacucacuggucagauggcuuaugagccacaccuuuauuuguagagaaaacaauucaaagauugacacaggaaauccaauacuacaaagauucugcucucaucagaagaugucaauccaaaaccagaaaagauaaacaagaguuccauguaagcaguugaagggaaggggacaccacaccugcauuuaauggaccuacccaucugcugugguuguuuugcauuaauauucuauagccagaguaaugcuagagaauaugucuggagccccaagcauaagggcuuaggauuugccacugccugaauacucccagucuaauggagacaaacagcacugcaacccuacuacaaccuagucaccaugaaauacuacaaauaauuuuaaaacaaaccuaaucucugguguguaagucaaugcagaacacaagaaaugggaaaagaaaaagucagcauaauuccucaaauaauucucaauucuauagaaugaauuccagugagcaaaaauuagaugcaccugcagaugaagaauucaaaagaauauuuauuaaacugcucagccaagucaaagaggaugcaaauaaacuccugaacaaaguaagaaaaggauguaaaaaaaucaauauagccauacacgggaaaaaucaaucaaauugaaaucacagagaagagacucucaacaguucaauuccaaaucugagugaagagccuuaccuacagaauggaucaaguagaaggcagaaaaggcagagaugaaucagaauguucacauuacauauaauuagcaagaacaaacaguacauggaacgucuaaggaacaugaaucuuugauuccuggauacaguucuucauacauagauaaagcucuccucucucucucucucucucucucuuucuuucucucucucucucugugugugaaauaaugucuuuaugaaaccucacgcuuuguaaaauaauauguaccuacuuuagaacugcauguggcuguauguagcucacaaaacuagaaauacuugcccuuuuccacuuuaugaaagguucgccagcccuacccuggauauuuaaauuuaaauuuaaauuuaaauugaggcuucuuuuccacagcuauauagguuagcauugggaagccuagauuuuuaauccuagcucauccauuuacacuuaggcaagugguccgacucuucuuaauuuuugucucaguauuuguccaaaggacauauggacucaggcagcaaccaguuuuaaaugguaccagaagcuuucaggcuugugggugggaagggucagauaacaacauaaacaugaagagucgagauauuuuaaaaucgcaauaaccaucaaaaagguguauggaaaccauaguaguuacaggacauggaaguuagguugagggaguuguguacaggaaaauggcuuaugaaaggggagucaaauggucaagcugaaagugccuaagagagacuaaaauuguuugguggcuuugacaaguguaccagccaacuuucauagggauuugcuaugaguuacccuuggccuuuaaauguuucuagugaagugggggaaacgaggucaucucaagcuuuaaaaaccuggagcgaucuugcuuuuagaaaaugaauuccaucacuacauugaauuuuuuaaaagauguauauaaauauccaucuggcuccagaaacuguauagcucuaccuacugcccauugguuugcauuucugugcucuuacauaguacugccacacugauaaggucuugugguguucccuagaaacagaguucagcugaaacccuuuacauagaagaacccauaagucgccagguuaaagugaguuccacugacuuuuaaaugcaccacaaagccaauguuuccgugcagcauuuacacuaaucagaauagaaugcauugcggguuucugacaugaaaaagucuucugaauucccugagcuccuuccccauuugucacagagaaucuuccuugcacugcucauccacaacuggccacauaacccugcugcaccaucaucuuaggaugaggggaaaaaggcugacaccuauugauuccccuccuuggacagggggacgcuuucacacucuguaaugaacguuugucugugugagaggggcggccagcaucagcuguuauuguccuuugaugugccccagaaacagaacagaaguuauuagagaauaaauugaaggcugauggcuagaccccaacagccuccugcuuggccuguuacuguaggagggaguugcuucuucuccuggguaauaguaguagcuccuggaaccaaaauguucucaauguaugaacagugcgggaacauagaaguaaccacuucaguacaggagugcagccagggaaguuggcuucgguccauuuuagagauaagguaggugaggcucacagaggucaggguugguuaaggucacgugccaagugggugcucagguggcaucaggcaacugguuccuauuauucaaaaaugacucuuuuccauucugugccaucgcuucugcauccacagagagagaagguuaaaauuguuuaaaaccuggaaacugaugaaauaugaagaaaucauaugcugugagcccgugcacuccccagcucuccacugaacuggaaauugucagggcaccccugugggucugaaaccaucccuagcagcugggcuuggugucugcaaagucgagcugugacuccugguuaagucaugcagauaggaagcaggaacugcugggcuguggacucaugccuucuccuugcuugcccaaaugaagcugccuaaugcuguuccuggggaggcuggagggucguccagggucagcaagcauuuccuaacaguucucucgagcaaagcgagcaugcccuuccuuuucuccagugacacugccacugcugaguggccugaacgagcuuucuaaauuuggauugcuuuguuugcugcuuaaauuaauccaaaggagagcacacacacaaugccauuguuucuacaacuugguuuuuaccuuucuuuuauagaugauaaaucuauaaauuauacaauguaaucuucacacauaauucccaagugugugaagauuacauuguauaauuuaaaaacugaucuccauuuguuuuguuguuuuuguuuuguuuuguuuuuccaagacaagguaucacuauuuagcccuagguggccuggaacucacaagagaaucacccuccuuugccuuggaguaaugaaauuaagggcucugcgcagcaugccuggcugcguuauauucuuaauacuaaugcuuaugugugcuggccaagggugauagacuacaucugugaaccagguaugcaugccucaacuuuauugggcuaugacagggagccuuuuucugugauucuuaggcaucugaggaggcugaagcucagggaauuaaaaugauuuucugaagauuuccccacuagguaagggugcaagauguggaaugaggagguguacuucugaccuccaccuccacuccucuccaccauaccauagugccuccugguucagccuuguaaguuccuaaguauaaaaugauucuuuuggcugugaauucaauuguuucagaggccuuaucuuccccuugauuugaggcugacuuccuucaggcuugacuuaaucuacacuugcauucccaagggcaggaaucccaccuggaagguguagugguuugaauaugcuugggucagggaguggcacuaucaggagguguggccuuauuggaauagguguggccuugugggaggaaguguaucacuguggguuuggacaauuagacccuccuucuaaacacaugggagccaguauucugcuagcagccuucagaugaagauguaaacucagagcuccuccuacacuaugccuaccuggacgcuacuaugcuuccaccuugaugauaauggacugaaugucugaaccugcaagccagccccaauuaaauguuguccuuauaagaauugccuuggagaugauaugagaguauauauaagugacccuaaaaauuucaccagagaacuccuaagacugauaaacagcuucaaugaaguagcuggauauaaaauuaacuaaaacaagucaauagccuuucuguacacaaaggauaaacagcugagaaagaaauugcacccuucucaauagucacaaauaauauaaaauaccuuggcaugacucuaacuaaggaagugaaagaucuguaugauaagaacuucaagucuccgaagaaagaaauuaaagagaucucagaagauggaaagaucucccaugcucauggauuggcaggaucaauauaguaaaaauggcuaucuugccaaaagcaaucuacagauucaaugcaauccccaucaaaacuccaacucaauucuucaacgaauuagaaagggcaaucugcagauucaucuggaauaacaaaaaaccuaggauagcaaaaacucuucucaaggauaaaagaaccucugguggaaucaccaucccugaccuaaagcuuuacuacagagcaauugugauaaaaacugcaugguacagguauagugacagacaaguagauuaauggaacagaauugaagacccagagaugagcccacacaccuauggucacuugaucuucgacaagggagcuaaaaccaaccaguggaaaaaaagacagcauuuucaacaaauggugcuggcacagcuggcgguuaucauguagaagaaugcaaaucgauccauuucuaucuccuuguacuaaggucaaaucuaaguggaucaaggaacuucacauaaaaccagagacacugaaacuuauagaggagaaaguggggaaaagccucgaagauauggguacagggggaaaauuccugaguagaacagcaauggcuugugcuguaagaucaagaaucgauaaaugggaccucauaaaguugcaaagcuucugcaaggcaaaagacaccgucaauaagacaaaaagaccaccaacagauugggaaaggaucuuuacauaucugaaauuggauaggggacuaauauccaauauauauaaagaacucaggaagguggacucuagaaaaucaaauaaccccaucaaaaaauggggcucagaacugaauaaagaauucucaccugaggaauaccgaauggcagagaagcaccugaaaaaauguucaacauccuuaaucaucagggaaaugcaaaucaaaacaacccugagauuccaccucacaccagucagaauggcuaagaucaaaaauucaggugacagcagaugcuggcaaggauguggagaaagaggaacacuccuccauuguuggugagauuacaagcuuguacaaccacucuggaaaucagucuggcgguuccuuagaaaauuggacauaguacuaccggaggauccugcaauaccucuccugggcauauauccagaagaugucccaaccgguaagaaggacacaugcuccacuauguucauagcagccuuauuuaucauagccagaagcuggaaagaacccagaugccccucaacagaggaauggauacagaaaaugugguacaucuacacaauggaguacuacucagcuauuaaaaagaaugaauuuaugaaauuccuagccaaauagauggaccuggagggcaccauccugagugaggaaauacauucacaaaggaacucacacaauauguacucacugauaaguggauauuagcccaaaaccuaggauacccaagauauaagauacaauuuccuaaacacaugaaacucaagaaaaaugaagacugaaguguggacacuaugccccuccuuagaagugggaacaaaacacccuuggaaggaguuacagagacaaaguuuggagcugagaugaaaggauggaccauguagagacugccauauccagggauccaccccauaaucagcauccaaacgcugacaccauugcauacacuagcaagauuuuaucgaaaggacccagauguagcugucucuugugagacuaugccggggccuagcaaacacagaaguggaugcucacagucagcuauuggauggaucacagggcucccaauggaggagcuagagaaaguacacaaggagcuaaagggaucugcaacccuauaggcggaacaacauaaugaacuaaccaguaucccggagcucuugacucuagcugcauauguaucaaaagauggccuagucggccaucacuggaaagagaggcccauuggacacgcaaacuuuauaugccccaguacaggggaacgccagggccaaaaagggggagugggugguuaggggagugggaguggguggguaugggggacuuuugguauagcauuggaaauguaaaugagcuaaauaccuaauaaaaaauuaaaaaaaaaaagaacccagaugccccucaacagaagaauggauacagaaaaugugguacauuuacacaauggaguacuacacagcuauuaaaaagaaugaauuuaugaaauuucuaggcaaauggauggaccuggagggcaucauccugagugagguaacccaaucacaaaggaacucacacaauauguacucacugauaaguggauauuagcccaaaacuuaggauacccaagauauaagauacaauuugacaaacgcaugaaacucuagaagaaugaagaccaaaguguggacacugugccccuucuuagaauugggaacaaaacacccauggaaggaguuacagagacaaaguuuggagcugugacaaaaggauggaccaucuagagacugccauaucuggagauccaccccauaaucuagcuuccaaacucugacaccauugcauacacuagcaagauuuugcugaaaggacccagauauagcugacucuugagagacuaugccggggccuagcaaacacagaaguggaugcucacagucagcuauuggauggagcacagggcccccaguggaggagcuagagaaaguacccaaggagcuaaagggaucugcaacccuauagauggaacaauguuaugaacuaaccaguacccuggagcucuugacucuagcuagucggccaucacuggaaagagaggcccaucggacacacaaacuuuauaugccccaguacaggggaaugccagggccaaaaaaaugagaauggguggguugggaaguggggggaagguaugggggacuuucgggauagcauuggaaauguaauugaggaaaauacguaauaaaaaaaaaaagaauggaaacucuuucuuuuagucauaagcagauuuuuuucugcuugguuuauaugcauuagugauuacuuugauguaccaauaaugcauuaggucucauuaaggaaagagaaaaaaguauuucccuucagaguccuuuaacgaaaagggagccuccuuuugaauucucuauuucaugcucucuguaucuucccugucugucuguucuaugaguuugaaucugugcccaccugaaggacaucuugugacucugucccggcccaugugcccaugugccucugugugugugugugagugugucucugacaaagggcuucacuuucucuuuaaugaacagcauagaacagaucacauggagaagggauaagcaauaaauuacagacaucuuucagaguuuuacaagugcuaaaucacugucuccaacugaucccaacugacccagacaacaaauaucacuguuuaucaacuagcguccauaaaggguucauuucgaucuuuauaguaggcuuaaggacauuuguugauuucagaaacugauacgcauuuucagugucaggggcauggaagaguacaugagauuacagguaugcauuaccuuagguuguaaaauuugauuacaugggaaugccaagacaaguaagguugauuguuacauuuuucucuuaaaggcagguuaaagaaagaguuugaguacacaguaggcuagcagucuuaagugaccucaaggugcguuauuaacucugauuuugaaauccagaaaaaaaucauuucucuucgaauguaaaagauauuuucaaauuguuacauauccacacugcucuuguuguuuaacuuuuaugcccugacaccacacacacacacacacacacacacacacacaacuauagcaaauuuugcaguuggauuuucuacauuuggaaaaauugcaggggucagcauaccaggaauacaauagaugaacguugccucgggaaagccaccuuugugaucaucguaggccaagacccuuagcagguaaauauuuucagcaacuguuuaauguuaaagacauucccuaauuuucauugucaaaguagacuaacuauuaggaggcagaaagcaacagcugggacuugaaguaguuugggaacuggagagaggaaucuugaugguaagggguaccccagcagucggcaggacuccagagacuuuaaaucaaacaaaaaugagcugaacaucucaacaaauuguccccaugagaacuuguaaaauuuccacacuacaaaugugucuguaaaguccaagaaacuauacaaaaaguugcuuagagacuaaagcaauuuugugauuagacuuugggaaaccaagagaagaauuuaagaucaacugguagggaaggaccccaauaaccacauuagagucuuagcugagaacacauaaagcuugaauuuuuaggacaggauggaaaaaaaagaauaagccugcuuccaaaagccuuauucugcuuguguuguaucuguuuuccagaauauuccagccucuguaaaagaagauaccaaauucagguuaaagaaaagauuuaaaaagaauguuagguuguuacuuuuuggggggagggacauugggagaacugucacagaagccuuuaaucuagauagaaagucgucaaagagaacucuuaaaaugugugauaaggaugccaaagugcagcucuccacaacagauggcuauggggaggcuaugguugaucaggaagacucacuuuucuuuaagggguugacuaccaggaauuugaccaugcuccagugagcaaugggcaacacaaagugcacuuuuuuuuuuuagucuuuuuuuucuuuuucuguuuuugcagggaagccuguaaggggagaaccuugacggacugggaaguaagggggggggggugagguacacuaugugaauuucccaaauaaucaauaaaaaucauuuuuaaaaaucuaaaaccaaaaagaaaaagaaauaacagggcuauguugaaaaaagaaaaauuucuaagaugaggaauagaaugcaugguagaauaaaaauugcaaaguaacauagacaguuaaaacccaaauacagaucuaagaaacaggucugguggguaaagacuuguauuucagcccaguacccagaggaaagacgacaagcacuguaaggggauuuacuaugcauucuucaucagacaaugucaggcuagaauagugaaagaaagcuagaguuacacauuaaauaaaggccagaaauaaauaaagcuaccuuuguuuauagcugacauaaucauguacguaaaaaauuuaaaagcugaaaggaggacuaguaaauuaauuuaucaggguuaaaugucaggguaauauauaaaaucaguacugcuucccagaaagaacauugaaaaagaaaacuaaagguauaacuccauuuauuauacuguccaaaaugugaaauauauguaagacuuuugugcuaugaacuguaaaauagcagaaaaaaauaaagagaacuaaauaaauaaaaagacagaacauucauggauuagaagauucaguauuguuaaaaauggcauuucucucaaaaucaauccacagauucaauauaauccaaucagaaacccagcaggacuucguauagcaauugacaaacugauuuuaaaauaugcauggaaugcaaauuaccaaaaauacagccaaggcaauuuuaauaagaaacaaauccuuauacgacuugauuuccagacuaacaauaaagacccacuaaucaagacaguguguuaacauugaaagaacagacaggggaauuaaaagaagcagauguaaacucacaaauagacucagacuuuuaccaauugaucuuuuaaugaagauuccaaaaaggccaaaaggggccagaagucuuuuaaacaaauagugucagaacgccuacauauccagaccauaagggauaauuaguaguagucuuuacuuuaaauaaucuucagacaguaucuuacagaccacaaaccuagcaguauaaaacuuaaaucuauauugcuucuagauuagauuacagggaguaaaguugcaagcuucaaguagagcaaguucucucagaaacacacaaaaaacuauacaccaaaaacuuuaguuucuuuaguuuaaguuucuuacaagccauaguccauaaauaaauaaauaaauaaauaaauaaaguuugucuuuuacaugucagacaaaguauuuguguucagaaugcagaaaguccuauaaaaaggaauggaauaaggguugaagauaugaacaaaaaccagaagaugaaauacagauuccaaauaaauacacuguaaggugcucaauaucaauauucauugguaauuacuaauuaacaaggccagagauguuggaucuucuguagauggaguuauaaacaguuauaagucacucauuguggguaccaggauucaagccugggccaucuacaagagaaauaagugcucuaaaccauguaucucuguagccugagcaguucuaagcuaaaugacugucauacaauacaauuaaaauaugugaacuuuucuauauuuuugucauuauucacuaaaaauauuucaagguagauauuuguuaugaaucaaaaggaaauuaagagguauagcaacuaaugaaauaugugguuggugaaugguucaugaucugaagacucuaacuugaaguuuuuugaggaacuggaggaaaaucaaauauagacuauauauuauacaagaaggaaucauugcuuauggaauugcauguguuaucuugcugcuuuuaaugucuuaaccuauaagagaaauucacugaaguacauauaggugaaauaacagagcuaggauuuguuguuucagcaaaaagaaagaagauggccaucauggaagcaaacaguggucuccuauuaauuggucccuagacuauuguauaaauuauuuuuuaaaauuaaaauuaaaaucucuaaguuaaggcagguuuuagaauugaguagcuuacaaauacuucugugauacauaugucccaaauucauuccuauuuacucugaagaucaauauacccacagcaucaaaaugcuugaguaaaaauguccugcuucaaaacacacgugguaacaaauuccucagggauccagaagcaugacaagaaguaaaacaaaauuuaagagaguccaacuagguccugaaugacagccuggcagguauaucaugaaaaacaguacccuuauuuucccuagagacugauuuguuuugagcccaaugugaggaacacacauuuguauaauccagggaauuucagauuuauuuuucuggucccugguuaucucagucugaugccuucccaguuuuagaaugaagaggauaaaauguuuaguaaaaaaaaaaaaaaaaaaaaaaaacacacacacacauucugaaaccaugaguuauaauccuagcaggaaagagaagucacaaucaccuguacaucugagcugaaucaaguguaggaacaauuuuugaaacuacaaacaggguuauaaguaaaggacucuguagacacugcagcaggaugucuuugcuaccaaaaauggaugcugaggcucugcuguagcaggaugucuuuggugcucauaaagaaugcugaagccacugcaguuggaugccuuuaguacccaaaauagauguugaagccacugcaguaggaugccuuuaguauccugguccucuaaagguaaagggagaagauaacgcuaccaaagucucguaagaugaaggcugcugucuccacaagcuggagacacuaaagagcccugcaagaaacaugaugagaacggcagaccauggugaacuaaauaccaacaccccuuuccuucugcugaccacacaauuuuagucuaggauuucugcaugaagcaaucaaugauggaagcaauuuccaugggaacccaggucugcagaggcaaucucuugggucaacugaggccacugaucagacuugggaggguagcagaaagaaauacagucugaagcaggggugaguggugagauuugaaggggaagcaugagauauaaaagcaagggcugggagauauuagcacauggaugaguuuauuguuuucucaauuggaagugcauuuguaacuagaagucucagaauucuauguuagcugugaaaacaaacuuauggcuuucuagaacuuuguccauggccgcagaaaauuuggucacucaaugaaucuuugaagcucaguagaaaagaaguuguguguguguguguguguguguguguguguguguguguguguguguguguaugcuagcuuugcugucuugggucugguagauacacagaaccaauguuuccuuggggaguuuucacagaaagugccaagauuuugcaagucauccuugagauagcucacuaucuuucaaugaucgugaccccuuucauuaguagcugucagaagccuccaaccagggcuccaguccuaccauguggcaaccagccuugggccuuauaugcuaaaaaguccaugggccaucucagguaccauacugcacuagauccuaaagcauuccaugaugguuauccucuagacaucguucagaccuggucucccgaaaacacucauuggcucugugccuugggaaagguuaggagauacaagcuucagcuucagcguugucuaccccaucaccaagcuggucgcuauguccucuacaucuugccuccagauuaucuacuguaguauucucuuaccuauucccccauagaaaacauauuuauacauggcauguugcaugcauuugccguagcacaauguaaaggaaacauaagagccacaguaugcuccaccucaaaacagcucccaggucucauugauuaaugcugaucccauugguaaugauuguuauaaacaaucuauaaaucuauaaucaaaagcuuaccuugagagguuuccaacccauaugcucuccaauuagaauaaacaaaaccuacuugaaaugugugugcuuaaaauagucuucuaacauacuccucacacauuaaauuagucccaaauuacuagcuauuggugacaugccugagagugcccaagauuuuucaacuuuugcaagaacccagauggucaaaaagaacauuaccaaauuuggauacuuguuuuuaauggaacaauuuuaaauauucuuuuaacacuagguguaaaguugcauuuaaagaaagcuacuugguuguauuuacaacuaagaaaauagacaauuacuagaaucaaccagcaucccuccaaagcuuguaaucugaauugaguagcacuauguauuaagauuucaaaaaaaaaauguaaaaacccuaaagugcacacauaccaugcaaacauauuuaauugcaccaggacacaaggagaauggcauucccucugguugccuuuacuuacgccuaucugagaaagaagccagacccccccaccaaaaaaaaaaugccuaaauuaaagguaaagauuucuaauaguuaagucagcuguccaaucauuacccuuuauugaagaaugucaaaaauaaaacauuuuagaucuauucacaauaaaauaaaggcucuuucacauucuguuccaugcuagaucuuuuuaccuauuauauugaaggguguagaauaauacuaaucagccaaaaaagacacuugaaagucucuuugaaugggacuucauaaaaauaagaauucugauuccuuuuggggaauauuuuuuaauauaaagagaguugguaaaaaugaaaccaagagaaauauuuuuaaaagaaaagcaccuuaccaauggacuugaaaggcagcugagaaauggcacugcacacugucauuaaaguuauaggggagaggucuuuaaaaggccccaagcugagcuguccagugcagguauuauuuuacucuauuaaugugcucuuaauucaaauuggagaaugugcuucucuacauuaguucaauuuacuagaaaugggaaagagaaauuaugaauucuuuaagugaggcaaagcacauguagccaaagcugcacuguuaucuuccagcaauuuugaugcuucaguguaccaugaaaauagcucagaagggcaugugcucaauccagggccccacauaugacuucagcucucccuuuaacauaaaccccauuucucuuacccacuccccucuccuacaucaucuuucuuucauuaccuacaucucuucacagaaauagcccuuuagcagugaacgccaggaacacacaugcuuaugaaaaggcaggaagagagucuaccgucuuuacuuucuuuaaagcagguuguagaauuucuuucacgguagcuaucccaagaccucauugcuuuuaauacucugaagcugaggauuuguuuguuucugaaauauaggcagugaagggaacacaaagauaaauugucaagguuggagauuaguaauuguuuucaauauaaacuucuuaaauuuggaaggaucacagagaagagaaagucauguuuuacaaguguggagagggccacagagggcuggcaggagcaugcuaggacuggcacaagagucugggguucucuuucauugcuccguguuucuuaucuucucuagaccaucgaucacgaugacaaagucucacguaggaucaccccuuacucaaaagaacaugggauuuccaacaaaagaaaagaauucaaaauauagauuccaauuauuugucucucuuucaggaucugucccuaagguucccacaacugccucugguccuuuuuguuuauuucuuucuuuccaacccucacucccaaaauaauuuuauauaccuuacagacauacagggaauacaagcagcuaaaaauaaauugacugagggaaguaaaaaggaaaaucauuccaaagaaaaaauaagaaggaaaaacuuggcauacuaaaggugagcauaguaggacuucaauaauccaaaggaagcucuuagaugaacuaucacaugccaggaauaugccuucucuauaugacauauccacagagcacaugcuauccacagccaaauaauaauggccuacagaaguuggccauuacugagaggaaaugucaaugagagcucgaaggaaggauguugcaauacaaagggcugggauuucgaaaguaaauagucccuaagucauucaagccuggaaaagaagagggaaaagaaaaagaggagagaaagguccaggguagagaugagagcaugaguguggagugggccagcagauguuaacccagauaucacuuauuaaagaacugaaaucauuuauugcauaauuggaagcucaaagucauacaucaccuggacucaauugcacuuuugugaugcuauaaugcaauauuguauaaaucaguuggcucagaauucaaaauuagagcuaaauuaccugugugagagaaucauaaaucuaacuuguauuuuucuaacaggguuaacaacucaucauaccagcuucaacucagcaaagaucaaucucugggcucgagagcaauugugcuugcuauucuaucacccuggucuagcgagccaggggcaaagucuagagcuggugggguggaaugcuuaggaacaggaaaagccuaaagcaaaacaaacaaacauagaauauugaauguaguugagauaccagcuacaucccagguaaaucagaauggagacauaacaggaaacagggacuuggaccccagacaccuguuauuuggucauaucucagaggaugaaagguaaaagauuuuuuuuccuguuuucuuauucagaaggaauucucuaaagguaaagaagugagagaaaaugguaaaauggaagacaguuugaaggcccacucacagaccacccaaaccgggucuuccuggaugaggucacaccaaacagaccacacagacuugcuuccugagugcaguaugcugaauuucucuuugauggggcccauuugaaggcuuagucaguaauuaagggguucacagaagaagaaauuuguggaaacaguaugaggauuauugguaaaauggcaguuuacuauugccuaugaguuugacuauguacacacacacacacacacacacacacacacacacacauauauauauauauauacuuaugaaaaaucuauuucuguaaacuuuuucuuaauaaauaauugaagaaguacacaaaauauacaaaguugguucuugcuguauuguuuccaaaaacacagagggaagcaaauuauaaguccauuaaauaaaacaauuucaccaaacuacauuucauccauauaaaacaauaucacugaaauguaaaaauuguggcuuaaaucucauagacauggcacagugcuguagaaaauaauaaaacauuauugggcaugccaaucuguagucugugagggagagaaaggaacaaagaaagaaggaaccuguuacugacaaaguagggauuuuuagggacacauucuaagccuucugcuguguugaacguuuuguuuuaacuugccaaaaaagguugagugguuuguuaauaaucugaaaaauauagaacaauuucuauuugugugcuuuugaaaggaugggagggagucacaaugggguacuucccacacaaaagcacaagcucuaguuccaucauggcuguguguguagaaacacaagcugagauauguugucaaguaggggagucagauacgcugaaaucaaucaucuguccacccuaucuuuaugaccucuaggccauaaaaucauaaugaugucuuucucugacagcaaagaauauucuuucuacacuuaacaauaugucuagaaaacuuuggaacucuaucuucuaccuuugguuuauugaugcuuggauagucccacuguccaaauggacccauaaaacuaucauucagcuaguucauguucgcccugugggguguguguguauguguguguaugugaaggcuagagcacuauguguuguuucucaggcacuauuuacauugucucuucagacaggaccugucacuugccuuaacuguucagguggcugggcuggcuggacagaguccaaggcucuccuugucuccaccuuuccuguuugggauuacaaacaugugccuccaugucugacuuguuuggaauguagauucggaggcccagauguacauuuuuacguuugcaagagugcuuuaccuacugagcuaucugcccugcacccaggguccuuucuuccaagcauagaauuaccagagacgcacaguucucugugaacuaggucucugucagucucaucugggccaggcuaggggaagacauucaugaggacagacuaugagaccaagaaggaccuucaugcacacucuucucaaugcauucuuuuuuuuuuuucuuaacaagagaaacuggaaggcugacuccagccuacucuaucaacugugguuuuuuguauagaaauggcacccccauagacucaaagauuugcacgccuggacaucagggaguggcacuauuaaaaggcacugccuuguuuggaguagguguggaauuguuggaggaagugugggaguuggcuuucagguuucaaauaugcaaguuagaugcaacucaugcauucucucucucccugccccuccccucccccucucccucccucuccccuucccucucauucucccucucucagcuacucaucaguuacucaccaacaccaugucugucugucugucagucugucacuaugauuuagucaguaauggcaauggacuaaaucacugaacuguaagccagcccaaauuaagugcuuuuuaaaaugagaguugccauggccauggugucucuucauagcaauagaaacccuaacuaaagcaccaauaaaccuuuaauuccauccaaagauacaaguuaggggaccuguuuuuauagaaucuggguauuuaaguaaugcugacauauaucaaacuuuuggcauugccagagacauagggagaaaaaccuaauacagcccaggcaggagggauuuuacaaaugcacugaggagauguuuagguaauggagauuacauccugagaugcuaaggguccacucugauucugcuaacaguacaggaauaugugugggagguuaacagggaagccacaugggccauuuggugacauuuuaaaaagguuuaaugucagaagcacauauuuuaaagugcauuuccuuuugguaguuccuauuaaaucuaaacauauaaacuguaaaacaucugggaucacagcaaaguaacagagaaaucucacaaaauuuaacugagagacaauaaaguuaaaaguuuggacuagauugauugauugauugauugauugauugauuuauuauguuuugaaauguugauauauauuaaccauuuuaaucuuuaaaaauaaaccaaaauuaucagcaagccuuuuauuuuuccuuauaucagcuuacuaaaagacauguguaaggacugaagguacucucaaagacaaagcaaucaccuaaccuguguaaggcccuauuguguaauaucaucugagggaauugugugaacaaugucacaucguguacacauuuauaauuauauuucccuuuauacaugccauuuggaucuuuucuaucauaaauaauguauacacaaugcaauaaauaucauuuuauaaaaugaacuucgauuuuaauuucugauauuuuccuuaucuuuacuuccgacaauaaggagucugagauuacauucuaugcacauuuuauuauuacuagaaagucuguaacagauuuuccuauucuuaccaauagcagacaaaaguauccaucuuaugugauuuaaguaacaaaguccucauuguauuuugucugcuuacucuugguaucugggugguuagaacacaugugcuucgaagaucugaggacaacucuaaggaucccguuuucuccuccucccaccugacuccuaggagcugaacucaggcugucagguuuugcagccagcaccuuuaccacuuagcugucuuuccagaacaaugauagauaauuuuaaaucuugguuaauauagaugucaaagauaccuauuugaaucuuuaucauuaaacaguuucacagguuuacuggucacuauaguacauuuucuuugacaacucuacucuugaagacuuuaucuacuugcaaagugggaaaaaagugaagcaaguccgaagacaucuaggcaucguuuucuucaauaaguaaagaaaaauaaaacuuauaacaaauuaauaaccauuacuaaaaccacuaaagguuaagaaaaaaacugggggggcuggagagauggcucaguaguuaagagcacugaaugcucuuccagagguccugaguucaauucccagcaaccacaugguggcucacaaucaucuguaguggaaugugacacccuguucugguaugucuggagacagcuacagugucuucauauaaauaaaauaaauagaucuuaaaacaaaacaaaacauaauagugucuggccuugggaccuccccuugagcuggaucccacuuugggccuguugcuggaccuucuuuuccucaggcuccucuccaucuuuauccauauaauucauucagaccaaaacauuuaugggucagagaugugacugugggauagcaaccccaucccucacuugauguccugucuuccugcuggaagugggaucuauaaguucccacucccuacuguugggaauuuccuuuaaggucccucccuuugauuccugggagucucugaccucccaggucucuggugcauucugggggaggugucuccccaaccuccuauuuacugaggcugccuguauguauucuuucugcuagcccucagggcuucaguccuuuuuccucacccaauaccaaaccagguuccccuguccaacccauucccuacccuaccccaccccacccacuuucccuuucaggucuuuccucccucccuacuugugauugcuuucuucucucuaacaaguaggacugaagcauccucacuugggcacuucagcuuuuuaagcuuuuugaguuuuguggacucuaucuugaauauucuguauguuuuuuuuuuuuguuuuguuuguuuguuugguuuuuuugcuaauaccuacuuauuagugaguacauaccuugcauguccuuuugggucugaguuaccucacucaggaugauacuuucuagcuccaucaauuugccugcaaaacuuaggauguccuuauucuuaauagcugaguaguacuccauuguguaaaugaaccacauuuucuguauccauucuucuguggugggacaucuagguuguuuccaguuucuggcuaucacauuuaaggcugcuaugaacauaguggaacaugugccccugucgcaugguggggcaucuuuuggguguauuuccaagaguaguauaggaggucccaaggccugacacuauuacggaggcuaugaagugcucacaaaaaugaaucuaucaugacugaccuccagaagacccaacaagcagcugaaagagaugcagauauuugcacccaaccaauggacagaagcagcugacccguguuguugaauuagggaaggaugaaagaaucugaggagaagggugauccugcaggagggccagcaaucucaauuaaaugggaccccugagaucucugacaauggaucaacaaacagaaggcauacaccagcugauauaaggcugccaacacauguacaguacaggacuuccgggucugugaucauucagagauguugcaccuaacccucaagagacuggaggccucagggaguuuagaggucagguagguugggaaguuggggcauccacguggagacaggguggggugggaaggaggugugggauguggaacagaaggaggguacaugggcagagcaggaaauggaauguagaauguaaaaaauaaauuaaaaauuaaaaaaaaaaaacugauccaguuaaaugaaguagaaaaaaagcaaaagcccacauagaugcuccacguguaacguacauaggguucauugaauuaguguuauguucaugaaaaaaaauauguccugauuccaaguauuagauuaacaaacugaugaaugaauaaauaaagugauacaugguacuucuuugcuauaaggcauauaaaaucucaaucuacccuuuuucagaagaaaguguuuuaggugugguauaaauaaauagggaaagguugggggccccaucccuaacacugccagaaauugaaauaaauuaauaacucaagagauuauauucuacuuuguaacaaggagugagcaaaccucuuuaccacuuuucccaccagaaguauuuuauaaauaaugccaaaggaaggugcaagucuaaaccugaaaucacuaagggccagggagaggaucaauuagaagguaaaggauuucaauaagucuguugacccuugaacugcagcacaagacaucagaaccugggagggggcgacaggcaagaaggucaaaccugccugcaucccugagcugcaggccuccgagagaagaggugaggcagugugaggaaccggcugguggggccacggggaacuguggacagguuagcagagaguaguuuccccucauuuucuuuguaggccagccugaagcaaacaccagcaucaaaacaauaagaaguagcuaacuuggacagauaccauagguguaaaaaucuuacugcagcaugcuggcauuuccccauucccaugcaaacaucuuacacugaacguuucaagccuagaauguauaagacccaguggcuuaaaaagaacuggcaaagugaccuuucacacuggcuaccugcauguaaucagacaucuaauacgccaagaaaaaggaaugaauaaauaaaacuggagaaagcugagugcugcagaaacagacgaucuagaacaacaacaacaaaauaacaacaaauuuuaaaaaagaaaacccuuuuauguuaucaaaagagaauggaggagauuuggaagcugcaagaagaaaacaauaucacacaaaaagggaggaaucaaacagggaagauuucuuaagaauuauaugaucccuuaacuaaaaacaauucaauagaaagugugauuucagucagagaaagccccuggacuacaaagacagauacagaaguuugggggggggggcgggguuggggauauaggauaugaagaaaaucaaucuaggaggucuaaggaugggcuaacacaauuuucaggaugagaagggagaaacgaguaaaaaaauauuauagaagauauuguauuagauuauuuucuggaauuaaagggaaacacgaauccucaagacaaauaauggauucugaaguguuagaaaaugaagagaaauucuuuuuuuuuuuuuuuuuuuuuuugguuuucugagacaggguuguagcccuggcuguccuggaacucauucuguagaccaggcuggccugggccucaaacucagaaauccaccugccucugccucugccucugccucugccucccgagugcugggauuaaaggugugcaucagcacacuggcagagaaauucuuaauagcuuccucaugagacaaaaagaaaucuccccaaaaggaaggauuugaguagcaucagacuuagcacugcggauagauaauaaaaauucagaaacacuaugguagacacaaaagcuuauaucaaacuaccagucauguuuugagaacaaaccaaggaacuacaaacacauaagggcugagauaguugaccuaccauucaccuuucccuacuuagagaaaagaaaacugacaaguaaagucaaaccaaaacaaagcucauuggauacccuaugaccccagaccuggauugcucugggggagucuugggaugcugggcuaggagcaaaugcacaaaggagagaagaggcugggggacaaagagaaccaagagaagagagugacagacuuuuucucucccauggugaugaagacuacaucagaccagauuaaaagcagauaaaggcauguuuaauuaggagacagcucucggguggguucauggaucucacagguagucaguaaagucacacauccaggcuaaagcaagggaauuuuauaggucuugggcguggggugaugacuugugagcuaggagcugggauuguuucuguccauggucagaacugagccccugggcaggcacacuuggguagguugucagaaacacagagaugaggugugauaaucgccuggaguuuucacuaagcaggcaagggaguuuucucugugcauucagggagguguguguguguguguguguguguguguguguguguguguaugcgugugugugugcaugcucgaagaugguguuuuccagauugugcaggggaugagcugagguuccaauguaacacagagcacacaauugaauuugcaaaaagaaaaagaaaaaaaaaaagaaaggaaggaaagaaggaacagaaaaagaaaaaagaaggagaaggaaaaggaaaaagauauggaaaacgaaaagaaaaaaagaaaaagaaaaagagaaagaaagagaaagagaaugagaaaaagaaaaaaaagaaaaagaaagagaaagagaaagagaaaaagaggaaaaagaaaaaggaaaagaaaaagaaaaagaaaaagaaaaagaaaaagaaaaagaaaaagaaaagaaagaaaaagaaaaagagaggaaauauauccuggaaaggccaagaggacaucagauauccaagcaaaaccaaacagaaacaauuucauaagaaagaucugacaugacacauacagcacaaaaaugaaauaauagaaggauuuuaaccaagugcuguaaagaagcaccuaaacccuagcucaucacacaggaccauggcugugacacugggacuccagagaucacacaggaucccacuaacagucuggccaagucauauuuguguaaauguucucauuuuaaacuucagauaaauggcaaaaauggauuacucuagugucagagcaaagguacccugaacucagcugugcuuacagcaacuugucugagccaauggaagagggagacgcuacugugcuaauauaagccagggagucaauggaccagccaggaagagaccaagauguggaaaguagggacugagaaugcuguuguuauaacagaacaucccaucuucagaagaauuuaagcagccaguguuguuuccuuuuagaacuaaauaacuauuaacuggcaaugugggagguaccaagugugagcuucaacaggaguucuuuaccaagugcacacaaugcagacaacguuccagacgcugcgacugggaccugcuccugcucugaguguuucuaagcuauuugggguuuaacuagguguugauuuuuuuuuaaauuguaaacauggugguacaccuugacaaguucguuuacuaaagccaaaaauaaauaauugagccuggaugcugucuugggagccucgggacagugcuggaggagcagugaauauagucuaacuggauuuauuucuaaugaggagagagcgagggcagcauacggaaaugagacacaucacuuuaccccaacagaacaauuaagauuucauuagggcuuaaugacaggaugacagucugcauuaaggguaaguuagaggguaaauacaucccuccguuaucaaaucaaggauuaccaguagcaagaggaacacugcuauccucaauucucccugccccuaaaccacaucaggaccccaaagauaaaaaaacaaaaacuugccugcugcuuguuaauugugcuuuuauuucucuccccccccauugcagcuuccugugcauuucguaggaguggcuccaaaagcaaacaaaacaacaacaaaaccaaaaccgaacaacggugacacaaucagaaauagaaagccaugauuacaauuguagggcugugaagguuuuccuggccgugcugguuuggaugcagcaguugcagggagguuuggugaugguccagugacuccaucuucuugucacuaucccugucuuucucacagguccagcauccacauuauuuagaacagcccccgugaagguauuacuacaccugucuucacagagaaggugguucugaguucaauuacaaucccuagcaguuuaaacgauagcugcugugcuauaaucuaaaauaaauugcuuuucucaagaagccauguaagcuuugcacugcaacuuagcagagcuguuggcuuaucucaucugaaauucaagcagaauacaaaagcugggccucuaaccucuacuucuccucacccccacuuuccugcaaacuggcauuugucuguacuucugagguucucuguucacccaaaauuuucauccuggaaugacagcuaucagaaagcaacauacaguuuccuuuuuaaaaaaaaugcaagccaucauuuuauuuuccauuucugagcuacacauugugcucuuuccaaagaauucuauuccuagggccaggcauauccccaguuccuacggcuccagcacacauggugagaccaacauccugaagaacucagaucaucagcaaacuccugucagaacccucacuuggcucuaaggaggacacgaggcuaaagaagcacaugcaaugugaaagggacaguugccacaugcaucucuguuuaaguaguucccaaugugccaggccaccagccaaagcaaggaaaagcguuuuccuuggaguacacauccagagccuggugucuuucaaggaaaugcuuccucagugccgcucugaggaugugguuucucaugccagcgauuccuccucuccagaggaaguaaaaaaccuuuccaaugcuaacuagauuuuuuucaaggcaauguaauugauguuugguuuucuuccagucaacaacaaugacaaaaauauccuuccaaggcauuuuuuacauuuacagaaauaaucuaucaauuuuuuucuuuuucaaaucuucuauugagauugaaggaggcuugguggaugcuaugugguaugugcucugaagaagucuugaaaaggagguauuacugaagaacaacaggcccccacacacuuacccacauucacugcacaucaacuguaaaugaaacuuggagcccccaugacaacaaggaaauccuguuucauguacgugcagcaaugagggaagauagguguaguucuugaaucaaucgaagacccccaguucucuugaaucuauaauaauagaugggaaggaagauccugguucucaagucaagcucuuaaaggcauuaggaaauggagaaggggcuucuuaaggucucauuuguuggggaucaauaauagcaguuggggaaugcuguaaacaucaccaaaaguucuccagcauguugucucuagaggacaauaaaccauccugcccaaaaugccaacuguugagaccuaggaaacaguggccuuggucagagacagucaauauuuuaauaagacaaacaaagcucucugucuuggguccuuccuugucuuaguuugcaaacaaaguaaucacuuugugauguuagaaugcaaaguauuauggggcauuuuuggauccugcuagugguucaauaauaaagacagagacaucuauaugguuuaaagcuguuggccuuaugcuggggcagucucuucgcuagcuacuaacuuaacccaacuucccagcccgcgucucuaauacauggcuagcacuuuaccucccugcucuacaccagucucccuuuauaucuucucugucuccuuugauucuccugccucaguuagugucauuccuguuucuuucugcccagaaguccugccccuuacuuccuguccuagcuaaugguucucagaucuuuaucauaaugaaucagcaauaagucaaggccuggucacucucuuuggcuguguaaggcaucaagggcugucaaacacaaggaaucacacaguauuugucuuuuuugcuccuuuacuuugcacaauguuaucaauguucacccauggacaaauuucccacuuugaaaggcugauuuauaggaaggggcuuacuucuuucuuacuuugcuauuaacuuucaguauuuccuauagcuuuucugucugucaacuccaaugcuguguucuaugucuuuguuauugauguaucauugcuauugcuagggaagaguuaagaauuugaccauuuccucuuguguauucuauagcaugauuuuguaauuaaccguggugauuaaaucuaacaucccaaagauauguacucuaauuuggauuucuuucaguuuuacuuuuaaaauguaaacaccuuuucuuuccuacucuguccccacucagacaucuuuauuuagaaugugucaaagauaucaacuaacauuuccuaauguguuaucuuuuacaucaagcagaacauuuauauguagcuacaaaacaaaguuacagcaauguugaaccuggaccaaucaucaacucuugaaaaauagagucaucuuaacgucauuuaagagaauguccaaguacaaaucacuguuagaagagcaugagcuuuugucauugucaugcuugcuucagcuucuggcuaagugucauuucauuuuuaccuggagaauuucauauuuaccuauuuuggagcuccuuaggaguacuagauucuuuuaggcuuuauugaccuggaaagccuuaauccuuccaucacauuugaagaucuuuugccaguuauagaguucuugguugagacuuuucuuccagcauuuugagugcaucagcccauuacugucuagacuccaaacuuugggugauaaaucuaauuacuaacuucacuguugauuucaugauuguucuuugggacugcugaaauggcucaaagaauuaaugguaucuguugccaagccugaggaccugagguugaucccaggacccacagaguagaaggaaagaaccaacuuuggcaaguuguccucugaccuucauggccaccaaccccaucuacucagacuguuugaauucauaggugaugaaaaaauuucauacuuaauuccauuccaagauuuuguucacuauuauaggaugcugguugaauaggaauuacaacauagauugauguguuuaaaugcuuggccaacagggagugugauuuuuuaggaaguauggccuuguuagggugugcuugcaugccaucaugcucccugucaugacaauaguggacuaaucuuuuaaaacuguaagcuaacuauaguuaaauguuuucuuuucgaagaguugcuuggcuacagugccucuucucagcaauaaaaaucccugacuaagagagaaauugauacaagugacugggauauugcugagauaggucugaccaugcuuuuguuuggaagaauguggacuuuggaauagaaaagcaguugaacacuuuaaguggaacuuaauggccucuucuaguaggaacauggaggacaguggugaugaggaugaucugaacuguuggagccuggcucaagagguuucagagaaaaaugcugauauguggcuuagagacuguucuuguuuuaucuuggcaaagaaugugacuuuuuguuauuguccaaaaaguuuuaguuuuggaauaauucucuuggcagaggaaauuuccaaacagcguaguauugcugcuaucauuuguuuaucaguguucacucguguggagaucuagaacggaaaggaacaagaugagcaaggaaaacuacaaaauuuacagauugagcagaaaagagguaccaagaagagcaaugagcuaaauccugugcucaaggagauaaaaaagauuaagaaauggaauaaagggagugguaaccuuaggcaagauuucacccagcuaagcuuccaauuugugaaacagaauuaaagaacaguuuagguccaggccuuuaauccuagcacucaaaaggcagaggaugguggaucucagaguucuuggccagacuggucuacagaucaaguuucaggacaacaaagcuuaggcagugaaggaaacgcuaaaaaacggaaagcugguggguaaagauguaacagaacaagggagccauguucccaccccaggaagcagcagaacuuggcagcuuuggccacaugguucuggcuuuagagucaaggauggaaaaaaaagggaugauggagucucccugcucgacuaaggaaagccacuguggccaggugcuuggcucgugugucccuuuguggaggguccagagcggccauugugugaaauugugaaggugaaaccugcauugccuugcagauuucaagauguuggagaugccagagcuguaggauaccugccaaggacaguggcuaauggaguagaacccgcccaagagagagaaaaguguugcagucaacaaaaaagaaaggaguuaaagguuugaaggccacuuuggcaucagacagagagguucagauguuggauuuugcccagcuauuuuucaguauugcuuaggucuaguauuuccucauuaaguucuuuucucuaccuuuuggaacaguaaugucuauccugugcuauuguauguuggaaguauguaugcuuuuucacuuggauuuuacagaggauuacaguuaaaagauugcaugacucucagaaaagacuuugaaguugaacuuuuaaacaggauugagacuauuauggacuauggaggccuuugaaguuggacugaaugcauuuaugguuauguucuaguuauaaaccuauggggccaagggcgugaaauguggugguuuaaauaggaacagucccauagaaucauguauuugaacucuugguucacaggaagugccauuacaaggaggugugaccuugauggaggaagugugucauggacggugggccuuugaagucauguaugcucaagcuaugcccaauauggcuuugucuccuuuuguugccuacaaaucaagacauagaacuccuagcuccuucuccacaccaugucuaccugugugccaccauguuuucugccaugauaauggaccaaaccucugaaacuguaagucagucccaauuaaauauuuuccuuuauaagaguugcugugguuauggugucucuuugcaguaauugaaacccuaacuaauacauauaaguucucugcauuuccaaauaauuuagacuaaguuugaugaaauuguauuuggaacuaaauaaagucagaaacugaccuaaaauaacaaaaaacaaaaaacagguagcuuccuuuacuccuaaauacaggauaucuccuggcaucuacuugucacugcccuggacccacauccuacaauuucugauauguugucuuacuuuuauucaguuuuaugcauuauuaaacuuucagauucuaaguucaugaccuauuuccuaugcuguguguguguguauacaugggugcauacacauguguguauacauguguguguucucuguguuuauacauuugugguuccuugcaaccucuuccagaagaacuagccaggcacucaauguaagagaaauuucuaguuuaucucugaaggucaguuugcuugacacacuguuuuagaggugacauuucuuuuguugguacugugacacuccuuccugucucccuuguguaacugaaaacagacacugucacugacccuuucauuccucuucagagucucuccacucuuaagaugucuguugacauuuugauuuuaaaaaguuugauugggaugcaucuugcauggguuucuuuaagguugucauguuuggaggucauucaguuucuuagaucuggaaguuugugcucucuucuuagacuuggagaguuuucagccauuauguccauggcuaguuuuagcccuguuaucuuuauguauuacuacuaucgugaugauuucuaaucacaccauuuccucccauuuccuuucuuuccuacaaugccuagacagaccuccaguaacaucaauauuguguuuucuaucacaguccccuagacuccuaagauugcacuccucuuggcauauaauuuuuucucuuuuaaugugcagaauuuauuguucugauucuauauuuaauaaucccaccuccaucauaccuauuccacuguaagacuaccuuacaaagugcuuauuucuguuauuuuauuuuuuucagucccauacuuucuauuuaggccuguguuauaacauucuauuuucugucuaaggucuucuuuuuaacuuuucucaaaaacugugauuugugacgagucauguggaggacagauguuuagaauucuuugaaaauuagcuccaacauuggauuuuuuugauguuaguguuaccagauugaaucuuuuucuuugauguuugguuuuucuuuuucccacuaugacgacuguguuuucuuuuuaauugcauucugaacuuugucugugugacaggaaugugggucuuucuuaaauccuuaugaggagaacagcaggcuuaucaaacggcugcucuaugagcuuccuuuccaauguauuuuacuuuccuuggcaacuugaucuaucuggugaccucgggucccacuaguuccugccccuucuuuccagccuauguaacuggaaaggggugccccaguucggugccuucugcuuucucuccaugggaacagugcacgguaguguuauccagcugccucaggagacacuaugguggaaaggaucauucuaggccugugggaacaaagggauuccuuagcuaggccucguuugugguuguauucuuguucuuauucuucuguugucaccaaugacucuggauagaagggugaaucucaggccucaguaaugaagagcuuuccaagacaccacuaauuuuugcaaguggcucucucuugauugcuccaucugccauaguccuuucuuuaugagauaguaauuauaaggcuucaugaaaaaagugaacuugucaauuacuauugaggaaguuucuaguuaagaccccuuuuugguggugcuggacuugucugauacuaaauacaaucaaggaaauaccaaccuccuucuuuuugcaaacuugcaaccaggaaauagguggucuuggugaccuucuguugggucagguuucugggccuuuccuugaccuaggcuaucaaaccagcucaugcuuuguuuucucaauuugaggucuuauauaucuaucuauguagcauuaucagaaauuauagcuguauauguagcagagagauacaugagaaaauaggucuguucugucugucugucugucugucugucugucugucugucuguuucucucucugucucucugucucucugucucugucucugucuaucucugucugucucucugucucucugucucucugucucucugucucucugucucucugucucucugucucugucucucucucucucucucucucucucucucucuguguguguguguguguguacuugcauuuugcugccauguaugucugugcaucauuugaauggcugguacccauggaggucagagaagaguguuggauuugaugcaacuaaauguaugaacuguuuuugagcuuccaaauagauguauguacugcuugaguuuccauguggguacuaggaauugaaccuggaucuucugcaagaauaagcaguggucuuaaccuuugauccuuuuuuuaguucauauuuacauauaauuuuugagacaggcuaucucuauguagccuuggcugucuuagaauucacuguguagauuauauuggccuuaauucacuggaucugccugcuucugaccccaggacuggaauuaaaagcauguaacaccauaccuaguuuauuuacuauauuuuaacuguguuuucuauaacaccuaaccauuuuugaccuuauacaaaugcaaaauuuagaaugcugugagaauuucuccuugggugccuugcaggccuugaacagaucacacucucccugcacagcucuuauguuaguguuuaugaauagucucugaggccguauaauggcacaugccacaucuaugaagaaagguugcuggcagaauguuaucaugauucaugguauucacuccuguacccagaugcaugaggaacacugagaaccucacucaauaugauuugcuagaguuuggaacaugugcucacucagccauuauuuccucucaucuucacaaucaucuuucuccuuucaucagacugaaaaauauaauccugggaugugcuuuacuaugaguacuuccagcuccauuacacuugccuauauccuuaaauggaccucaccaugccaugccaaaccauguguaaaacuaacucugucugugucugugucugugucugugucugugucugugucugugucugugucugugucugugucugugucugugucugugucugugucugugucuguguuuuucuuuguuucuccaagaauuucuuuucagagaaggcagagugccagaaauguguuagauuucuucuucucuaagugaaaccacugcagcuucaacaaggaugaguagaaagcacugaugcccaguaacaaauaacaaauuacugggauaacucaauuuauugaugccccacaggaacaucauauaaagauaacacauaauagcuggagggccucaagcagacaaugcuauagaaugugagaucaggucauuugggugcccugugggaucacaggcuauugccagcuuucuugguccuuuaagauccaaagccacugguccucauaauuguugcaaauagucacuuccauuuaucaucaucaucaucauuaucaucaccaucagagucauuaguauuuugacaaaaaggagcuuugcuuuuaauaaaaucaaaucuauuacuuuuuuccucucaugaucuuuuugccucugugcuaacaaaacucucuuauucuaguugagauaaacacccauuucuauucuggguuucuaaugauugauuuuauacauuuauuuauugcuuuaauccagcaggaauuaauuuuagcauauggugugagagacaauguaauuuuuccaauguuaauggauuuuugaucagcagaaacaacauuucucagaguagaaaacucagccuagcucaugcugcucaguguuguaagguaggaagaguguguggcggguacuuuucucauaaacaugacaaccucaucugauuuuuuuuuuuuaagacuugagaugaucuccuuuauuucucagugucugcucuuuucuguauuguagggucacaaaucucauccacuguguccccaaggguacgguaauugcuuaagcccaucaggcccucugagcaccuucugcacagaggauuuuuccauuacugauuaccuggcagacacagggcuccccuggagaauaugaccagagaaaaucgaacuucaaaaacaugaaaugagcugcggguuuucccauuugguagaaauaguccucaaaaaaaagagagccccacuauuuagaacaaguauguguaaccucccaggugcuaaaguucucaucaaacuuuguguuuaaucuaaaagcaagcaagaugucaguauugguauuucugaguucuagauaucagauagagaaagcuggaauaaggagagaaauauguagucuuguuccaauuaguaaaaggccucgagggauucuagaagcaaaacagccucauuaauagguugauaacuaacuuagcuaagagacagaggaaaucuguauuucuugugucuuauucccacaagaguacccaaaaacccagaguuaucuucagaauaaagaugugcuaacccucagucaucaauuaggcauacugacuauucacugugggccagacuuaaggggaauuaaaacuguuggauuguagguagcugugcuuacuaaacccaugaacacuggguacauaccauuauugccacaaaaaaaaaaccauguaaucuaguguguagauaguaaaaugguagaguaagcaugugcuguauucacaagcccuuaagcuaaagcuuuaccacuuuuuuuuuaccuucuuugucuucaggaaugcaaguuuacuacaugaaggaccacaguagacaaaagcauacauuuucacaagugggaaauaaaugaucuuagagcauguacccuuaauacacacagacacacauacacagacaaacacacacagacauacaaacacauagacacacagacacagacacauauagagaaacagagagacagagacaccuacacaccuacacacagacacucacagacacagagacaaacagacacacauagacacauauacacacaauuaacacauggacacacagacacacaaagacagagagagacagcgauaccuuacacaucuacacauagacacacacagacacagaagcagacagacacacacacacacauacacauaggaacacacacacacagaaacagagacauauauacacacaaacauacauggacucauagacagacacacacacagauaggcauacagacacacacacacacauacacagagacauauauacacacaaacacgcauggacacauagacacagacacacacagagagacagaaacauguauauacaucaacacacagauacacuccaccccaccccacauacuuucccuguucucugucuacaaaaucacugagauauaauguacuggagaauacuguauaacaaaguccggaggcuaauugagauuucaacagcccaccucaccagcuuccagcacuaucaucuggauuaggcauuuccuugcaucugaacagucacauauacuuuuacaauaccaaaguugccuguuacagagucugaacuguucaucaagagcauccucagccuggcuaugcuuaguaaugacacuggccuucaaggacaucucauuuacaauaaacuaucugccuauauuuuaaacuucugaguauuuuagcaaagugaacuuacaggaaaccgaaaucccagaaaucccaaagaagcaaagauuaagcaguguucccucucagaacuuggagacagugcauuuaggaaugcucagugauucuuucucuuuaaagcuucaauuuauuauuauuauuauuuuaaucuuaaaaccaagauacaguaccuaacuagaacuuuuacaugccagcaaucuaagcugguguagcuuuagaacaucauucuuuaaaaaucaccccagaaaagagaaaaugaaucccgagaacucagaaaugaaagcugucucuugugagacuaggccggggucuagcaaacacagaaguggaugcucacagucagcuauuggauggaucacagggcucccaauggaggagcuagagaaaguacccaaggaguuaaagggaucugcaacccuauagguggaucaacauuaugaacuaaccaguaccccggagcucuugacucuagcugcauauguaucaaaagauggccuagucggccaucaguggaaagagaggcccauuggucuugcaaacuuuauaugccucaguauaggggaaugccagggccaagaagugggaguggguggaugggggagugugugggggacuuuugggauagcauuggaaauguaaaugaaauaaauaccuaauuuaaaaaaaaagagaagaaaaaacaaacaaaaaaagaaagcgagauggaaaaaaaaagaaauauacuuaaaagaaacgaauaugggaguaggggagaggugggugcaggagauggcucugucucuaaaauacuucaaagagugcuggaguucacugucuaggcagcagagcgauccuacaggugcagguucaggaaaaaauucuucucucaaaagauaagguagagagcaucugaggaaggcacaugacucccaccuugggucuguacacuugaacacacccauguacagacagaaacauguauauacagagauaccacacacacacucacacuuaauaaguuaaacauuuuaaaaagaaacaaauaugaauagccacuaauggugcacagaagagaauuuagauucauuuguuguucucuaaguuacugagauguuuccacauuugucuauguuaucuauuugaucaaagaaauguuuuuuuuuucuuagcuuuauccuucccguuuauaugaaggaugaagacuuucacaucaauuucaucuuuaccauggguaaaucuaccaaaggugcugagcuuagaucaucacguuuuaaaacaagaaaacaaaggcuggcauaucuacuauagaaagaagugacuuggacaggugccuuggugaguggaugaacggguggggacaaccaccauugugauuuuccuuuaguuuaucugcucaauaugcaacaugcacacaugacacaggcuacaaacacaaggggacaaccaaaagacaagcuuucucauuuugacugguaaagucucaaaacagugagaaaggaggacucaaggaugcagaggacagcucaggagaaguccuucuuacuauguagcuuguagucuaaguugauggggaagagggcucaaggcaaagauacuuaauagcaacuuuaaccaaagcaguugaccagcaacuuaauguggcugaccucuccagugaugagcccuuuagguaagaugagaaaaggccuaccaucucucacggaggagcugugaagaccaauauuguuuguucauuaucauuucccccaaauuccuaucucuaaccucgaacacaagacagaaaggaagaggaaauaccaccuacagcaauccuccaugcacacagacacauguaccuagagaugugcuuugguuuguuuucuguuuaaauuauuuuuuccuuaguucuuuaaagcccuaaaucagaaagaaauuuaccauauuucccuucuaaggcauuuaucaugaaugccacaaauauacauuuuuggcauguaaaaccauaguugcugaaucuuuugucuauuuuggaauaugauucuauuuccaucuagaaacugcaauauguugggcaauuaaguaagaaaaacagaacacuuauugcagaagccaauguauauuauauaucaccauucuauaaaaugcaaaauuagcauguguccccuuaacuuugauuggcaaaauaaagacagauuuuucugcaagaaguucuccagaccacuauaaaaauuaauaauauucagagucuuuuauuuuuuuuuuuuuuuuuacuuuaugaguuguauacagcauauauggugucaucuaccuaggagaagacaggaaggucaguuugaaacagaucagcagcaguucccacccaccagauaggaaaguagagugcucacaguuugaaagguuuucacgugggccugaguuuuccccgcauggauaaccagcugauggaugaggacuaccuauaaaggaugcaagagccccuuucuuuaaaaacaagauuuaccauuugcuggcuucugaucucccucuaaacuccucucucagacauaucaguuauacaguaaacacuccaucuuuacuaaguguauaucgcaggcaacaacaugacucauuguuggugaugcaaaaacaaacaaacaaacaaacaaacaaacagucugaugugcaaacuuuaaucugugacaaaccauuaacacaauagcagcagcagcagcugauguucaugugggacucccacuucuugaugucccaguaacugauuucaugugugaagcugcccuacuacuucaaacauacagagaagguggcagcccagcaggaaacaagcaaggcaaaagaauuggugcaguuguggaagaaaagccucaccuccuggaagaaggccuauuuuuuuuugggugagacuaaugaagcuguuuguaauaaguaugaacgaaaugcauucuugguccacacaaacugagaaggauagcaaagaauucuuucaaguugaauauuaaucuauccuucauagauaacagugauaauguuuugauaucucucagucucauugagaagugccccuucauuuugucuguugauugcuuaacuuaaauuuagaacauuuugagugauuauugguugaaaauuauauuguauuuucucaugucauuaaauacaauuuuaaagauuuuuaaaugcuaccuuauauacuaaaaguuaacaauuguccaacucgcugacagacuauuuagaauguuuaauuauauuuaaguucuguaauacauaauuauaauuuugucuacaucucucuuugcguggaaagauuucuagaaaugagauugcuaaaccaagucaaaacuuaugacagauucuuguuuucugucuuuacuauuaauucuuuuguaacucuacacauagguauguauguauacacacacauauauguauguguaauguugccugaccauuucucucuccauuacccucucuuaucccuucccaguacugcuauaucccuguucccucccuacaaaucucuuucccacuuccauauuauuuauuuuugaggguggagggauugggcagugagccacugcauuuaauuccaguugcuuucaaugacaaggguggggguuacaugcaucagggaaacuccccaguggcuucaccacuaaggacaauaacuccuccaccuauagccugaauguccucagacaugggugaaaaugcacuagacucucccaauucgugguggagugucaauagaccagucuuuugcaggucugugccagcuucuuuuuccuaaaaggcauuugcccuauaugauucuccauauuggagucuuuaaccucaagcucaagguaauaggcucauuauagguaauaauugccagccaguugaaaauaacauuuucgcauauuucaaauuuguauauaguagcaguauauuuaauaccuuguaaaucaucuugaaaucauugcuacuaaacauauuuuugagauguaucucuguuaaguguuguucugucagauaguccgucucuuuuccaaacaaacacuuguaggaaugcuacaugaccuuuuuuuuuccauguacugguagauauuugggaucucuagaauuuugagaaaaucuugugaagugugcucagguuguuucuugagcagggugagccaugagaauucgaagccuuaaguuucugggccaucccacuugguccuguggauuagaauuuccauugcccuacaaccucaccaacaucugauuucaaugauauacaggaaaaucuuccugacauuuaggaaauauauucuguaaaaugucuuugggaaagcaaacugaguuugacaccaggaagacagauuauaggcauggcuaacagggcccugagcaucagugugaaccacagccuaacccugagugcuuggauacauuuccacaguucuuuuguguugagauuuccacuaccauagaguccucaaaaauauguagaaggaaauugugaggauaaagcaaaacaagugagaaaacauacuacauauacagcaagcauuuacaauaaccaagcgauuagauaauauggcuuaaaauuauucuaaauucuaaaauaaugguuuauugcucaacugugaacaugcuagguucuuuaucuuuuaugaaauuauuguggauggguccuacaguaacauaaugcaagaucauuuucccacuuaggauaaugggaaauuuucuccugaaaaucacuuuuggauaaaguguuggaugaauaggaauaaauuaugaacauaagucagggagggaaaucauccauaucuaucagaauccuuuucauuucuuuauuucucauuuuuuacauuuuuguguauuuuuuaaaagucacuacuagcaaccuugccauagauaacuauugugaccauguuucacagaggaugaagccauggagauucaggggacucaggaugguugccugugacugcagugacacaguaacauacacuugaugucuuaaagcaauagaaauauguucuucugcuacucuguguccugaaguaaaaugccaagauguuggcagagaccauaucccuccagggucuccaggacacacuucuuccuugcuucuuccagaucccggugccugguggcauuauugguuaucuccauggucacacugacauuucccuucccacguguccugcuucagcccuccuucucuuaaacauacaagguuauuuucacaaaucccagaaaucggaugcagacaguuguggccaauuuucagccuagcacucuaggucaacauaacauaaaacaaguugagauguaugauguagacuccaaacacuacagucuucccauuguaugugcuauuucugucaggccagguuguccuccgucucugucccuccucacagcucagcaaucgcugagccuugagguuaaccacacaaaccccaguccuuccugaagagcacaggcaaagcuuaagcugccauuaacaaaugccauugcgcacucuuggauuucuuccugauaccgagucagccucuuaacucugcuacacaaaagcagcugagaaggaauauuuaucuuugcucaguaauuuguuaucucagaaguucccaucagucucuaauauagcagaggaaaucacgacaaauguggauggaauucauaaaacgaguccccgagauaggccauuuuggcacacuuauuauucugaguuaaaaacauuugaguuaaaaauagaagacuaaagaaaaauacucuaauguuucuaccuuuucuaaagagagagagagagagauuaaacugcucugugaaagaggccauccuuaagcagaaagcaagaagcauucugaugauaaagguugugugaaaggacacacguacugcaagcucuggcuaagccagcccuuccuugucuccaaucacacucuagccaagucccuugcuuccucucagcauucccuaacauuucuccagcuaauaaguggucaauucuaacugcaucuguguucugaacgcuguucuucaacacauucuaaaguguuucugcuguucacaugucuuacauugagugaugucaacccucuuccucaaaacucuaagagcuaacuuuuugccuccucagcagcuucauucauuuugcucuuauuuauuuuuccagaauuuauuuuuuuuaaaaaaaaauuuguuugccuuaguacauuugugugaguucuaugcuuuuauauguauguguauguauauauauguauguaugugcacugcaugcaugacuggggcuuuggacuucaggaaaggauguuugcuucccuacaaagagaauugcaggcaacugugagaugucaguacugggaacugagcacaguccucuacaugagcaguaagaccuuucaaccgcugagccaucucuccagccacuucucagacuuucuaucuguuguuacuuaagaauuaaaaaaugaaugggaaagagaaaccacccuacaucuucuggccugccuuggguucacccuugaaggauaaucaaaccaggucgcuugggucagguguggcaaaugauaggagagauggcuagauagacauagaaaaugaaugacaaucugcaacugauaggggugaggaggugguggcuucuccaggacaagacagagaccuaggauaaggagaugcugaccuuagcugugacucacuacacuggggauauggaaccuaaagaagccgcaccaccgccaccuguagucggacaggaaucacaguggaccaauagagacaccaaccuauccacaaaacuuucaaaauguauccugucuacaagaaaugcaggcaagggggauggagcagagacugagggauaaccaguaaucagcccaacaugagacccgucccauggguaagcaccaauuccuaacacuaugaaugauacucuguuaugcuuucacacaggaguauguuguccuuuggaaagcuccagccaucagcugacucagacagauauugacacucagagccuaacaguguauggagcuuggggacucuuauggaagaaaaggaggaaggauugcaggcccagcaggauauaagaacuccaaggaaaaccaacagagucaacuaaccuggacucuagggacucucagucugacccaucaaccaaagaacauacagggcuggaccuaggccucccuguacauauguugcagauguguagcuugaccuucaugugaaucccgaacaacuggagugugggcuaucccaaaagcuguugccuguacuuaggauauguuauaauagcugugguucuuuguuuggccccagugggagaggaaacgccuagcuuuguagagacuuuaagucccauggucagauggauccccuuggaggccucuacccacucagagaaugggaggggaaauggggaaaggauugugggaagggguaacugggggggggggggcagugagugggauguaaagugaauaaguaaaaaaauuaaauuaaaaaauuagacuaaagcaaggcauugggcuuaaaguccauacagaagacagaagacacugagguuucuaccuauuugcugugccaaaucugcaaggcucugcguguguaagucacaucacugcaagcagcaaugcucccagauacauacaugcagauuuccugaaguuccaccucaccuuucuuuuuuagagccuacuaaagcuuauuauuucauauaaaauggagaauaucccaugauuauguaggcucguccacaagcucucuuuucauugaagucauuguuugccauuacuuuuagacuuacugcaaauuccacaggauggacuaauuuuuauguaacuaucuuuauuuuuuuaaucaaucagaaaaaaauaaccugggcuuauauacuuacuuugugcuuaugauuucucccucauucuuauuuucuuguguguguguacauguguguauguaugaauaagucugugugggugugcaugcacaugcaugugaauggucucucacuauccugaaauucacuggauggguuaggcuggcugacaguaacauccugaaauuugccugugucggcuuccccagugcugggauaagauguguguuacacuacccuccuugguuuuuacauggacuccgugaguaaaagcaagucuucaugcuugcagagcaaguacuuuucugaccuagcuaucugcccaguucuuucauacauuuacucacaucuuguaagacuuucuguacuccuuauugugauagaguuuggccuguagguaaaauuucucacuuuuucuuugcaugcuagcaacuuuauuuugacuccauucuugaaguuauaguuucacuggaucuguaaauaguuuccuuuugccuguuuguagccauuucuucuucgugugacaaauauguggccuuuauagauuaguacagcugugguuaccuacaggagacccugaccuauacucaugucaucaaucaaacagggauagaugacagauaccaggucuaugguagcaaggcaguuacuauuucugcuugaagagagagacagacagagacagagacagagagacagagucagagagagagagagacagagagagacagagagagacagagacagagauagaaacagagagacagagacagagauacagagacagacagacaggagagagacagagauagagaggaccacagagagagacagacagagacagagugacaaaucacaagacccucccaccugcuccagauacaggcagucuaagaaauguugagagguuaaaugauugaugaaauguugcagucuuauccuccccugggccacccauuguccucagugacuacauaagcgcaucacuuugucaagugggacuugaccaccuaucugcucugugucuauuuggggcgaauagacuucucuugugucucccucaggggaguuaacaaccucacuaaagauacugucccacuguguucugcauuuagagguucugaggcaggccagcaguagccaucucugacaacccauguuuuccucuggcuucuagcaaacuguccuuuacuuagauucuaaguaauuugauugugacaugcaucagcuuugugaugaugggaauuaccuuuugcaaaacugggcaauuuuagaucauauuucugcaaugcaaacaacuuacagguuugggauauuaaucccuguagguuccuccuuacugcuagccaaugaaugaaagugauuugcuccacagaaaugguagcccuguauuuacaaacucaccaauuccauuguuuacacauuuuguaguguugcugaaguuguugacaaccacaggccucaugguauuuauuuaauagcuuugaccauuuaaauuuuagccacagaguucuguucuuccaacaguguaguaaucgauuuucuauuugaaccugaggcuguuugagcuaaggucuuugcugcuauuguugcggcaacugcuguucuucaacuuguugaguuuugaauuuaagcucuuauaauuaauuucugguuucauuucauuguagacagagaauucagccuguuaacauuuuauauuucauaauuuuacauugcgucuuuguaguacaauacaugaucaauuuucuaaauguuuuauaucuccuuaagaagaaaguauguugcuuauuucuagaaaccaaaacucaauaaauauuuauuaaaucaccucuauuugguuauuaagacacucauguauucuguguuuguuugauccaagaaagaucaaugaaaauguauugauguuucacacaauucaacuaccaauuuuuccuuauauuuuuaaugucucugcuucaaguacuuugaagcuauuaccacaucaauaauaaucccaaagagccagucuucacuaugaagucccucugaaagcuaaaguucugucacauuuuauauuucuagugucuuugauuugauuuugucuaaauauuacccauauuacauuuugcuuuauuuuacuuucgcuguuaagcuguaccaccuccuuucuucaucucaagaagccacuguauuucagguacaugacaucuugggaguguaagguuaauugugccuuuuagcugaaacagagagccauuguaacuaaaugcuuaugucaugaacuuccaaugggugagccagccucacaauauaccuggaugaaccacugagccaccguccagcccugauauuugauuucucucuuauuugaaccaguauuuucuaauccagacuguaagaauugucuagaagggauuuuuccacacauaucaccuuugggugauguugguaaaauuuuaagcucaaaggagcuuuuuauuaaucuuugauuuuuauucuauucugaugguuuucuucccuaaaguguacauuaauucuuagauugguucuagguguuuaagucugugauuuacacuuucucuguuuuaaggucacaguguuuauuuuaaugauacuuuucuauuuuugaaugauuguucacuauacauuucaauuuugcugacauuuuucuucacagccucuaacggccguuucuauacuuccaggccaguuaagguucucugcccauccuggcuucuuaaccaugcguucuugagcggcucaccaguauuccaaacaaucaauccuacucuucuauaaucuaaaccaacucucucacuuuuccuuuggcuugauacugcaacugaggcugccaaacugcuaaaaauccuuuuguaguucugaacaaacccccuggaaagccaacauuuacucaagggcuucagaauacuuuuuuguccuuuaucauuuauaaaauuuuaaaacuuuugcuuauucuuuccugcaugaaauuauuuuaaaauuuaaaaauuuuaauuaaaacauaaauaauuaaaaauuuuagaaugacuuugaaaguagaaaacauuuucucuaaaagcaaaaugcuuuuauuuauucuuaaagagcuuauccuucccagggaagaguuauauauuguuguuguuuccuaugggucccugaaagcuugcugcuguacaggauguaugcuccaauuccuaaucccuaacugcuucuucuaguauguggaauuccuuggcuugguauaggaucuucauuacuaucugauuuaaccugauuaggaaacaaaaauaccccagaacucagcacagguauaguguauuaaccauaacagauccugaaaaauauccuuccaaagucuuguauaauguaucccacucgggaagaagaauggccuugcugaaauaucugcauucugaucccuaggaucugaacauacauuagguugcaugccaaaggagaauucagauagcaaaacgaauagagauugcuaauuacaaaauuuuauaauaaaaagguugucacguggcuuguuaaacacagagagaagggaacagagaagaugaugagauguggacauguuuaucuaaagaugaaugaaacgaugccuuugaaggggaucauggauuccagaucgaaaacaggaaacauucuccuaacaccaaaaaggaauucagcucagcugacauucugaucuuagcccaauauuagauccauuucagacuuaugaugcccuagaacuacaaaguaauauaucuggguuguuuugaaccaauagucaugggaaaguacuaaccaccauuuacauuaucccagcagauacagaaaagcaaaggccuucuacauuaauugugaugcuucauacaaagcacuugcagcuagcuuauaagguaaauaacucuucuucauagugucugcacauuucuuuuuuuuguuuauuuaaauuuuuaaauuaauuucguuuguuuuaauuaauuaauauuccuuauucucuuuacaucuugcucacugcuccacuccuggcaaccccuuccacuauccuuagcccccauccucuccccuucuccucugagugguugggggcccccuggguaucccgccucccuggcacaucaaggcacauccucccccacugaagccagagaaggcaccccagauagaagauuauaucccacauacaggcaacaacuuuugggcuaguccccacugcaguuguucaggacccauauaaagaccaagcugcacaucugcuauacauaugcagggaggccuucauccagcccuuuauguucuucgguaagugguucagacccugagagcuccaagguccauguuaguugacucuguuggccuuccugaggaguuacuauccccucuggggccuucaaucuuuuucucuacuccuucauaagaguccccaaguuccauccacuguuugacugugggugucauggcuauacauucugaaccaggagaaggacaguagccaacacauuagagaucuuuccucugcgcagagaaagcccaauagaguuaucaguugaaauguuuaguucuggguacauguaacuuucuauuacuagaauucaauaaagaaaucaaaaguugacugagaguaagaacuaagcuuuugugacagugacucuuugauauaucuuauuuuuauaagaaauuggaaaaguuauaguagaggccauugcucagacaucaguuuagcuucauagauucuucagucccuucucuaauaagguacuguuccccaaacacccuuccuauagguaaacacaaaaucacaaaaaggacauauauuccaaacugaagaaauuuuuucuuacaagaagaaggaggaggagggagagggagaggaggaggaggaagacaaggaggagaagcagcauggacuauuuuaauuuaaucuaguaguaauuugccuucaagaaagaauagaagaugauccuuuuaaauauuucucucugcuguuggauugauggcuuuuucagaaaaaugcuugucuaguaaacaugaagaucuacauuuuaucccccaggacccauagaaaauagcugaguauggagaauccuaguguuaggguggggggaagugacagauggaucccugugguuuauuggccagccagacuagccaacuuggagaaccccgggccaaugggacacccuguuucauaaaacaagauagacaguuaaggauccucuacauguguauacauacauaugcacauaugucuacacaccuguacacuagcagagacacauacuauauacauacacaaaaauauuuuucucaaaaacacagaagaaaugaaauuuccauacauuagauaugaccaauuagguauuuuucucaauccacuugucucugaaaacuacuguauuuacauaaaauuuaacucagaggcuaaaguuaugaguaaauauuaugaacaaauugauaaagggauauuaaaucuaaggaauagacuauacucuuaagaaaacauuccaguugccauagaagaccuccaucauuuggucaucuucaugggauccugaccugaaugauuucaacaagcaugaaugcacaauauaguccaguaaauagcacagacuccugcaucuuccaccaucaaggcucucaacagcucccacuauuacaagcaugugcugcuuugacauugcacacaacuugugcagacaucauugcuauauugggcuaaggcugaagacuagacagucucuuucauugucuacuauuaaugacuacacaguccagcauuucuaccauccagucaccuaacuagacaaggacucuucaguccucaucaagauuaaggccaagugcagaggacaagcaauaggucuuauucaagaaggacaucacuuuaggauguggcuuaguagagcuaucagaauccugagggaauuuugugaggcgaauuugaauaccagaaagcaagcuagggacaugggcaaggagcauggucguguucaguuuccagcugucucugggcaugguccugcugggcagagguaccuaccaucuggcuguccagagcacauacauuuucuuggcuuugucggccagugagaacaugacaugacagaaaauuaaggucaucaugauuccuucgaaauguaaaauggcccacuuuuaggaaaacauauaaaauauaguuacaugcguggaaagcagcaagggcccaagugucagucuugguccucacaaaugaugcaauuguguaggccucauugucuguaucugcuaggcgucaaagggucucuccacaugcugccuugaggaucugaggaacggaggaacugggacuuaugcaaguuccuagcacgcuacuuaauucuaguaagaguucagaaccacagccgcugcuagggaaauguaguaaggcauuccagaacaagcauccgggaacuauguuguccaggcuauaucacugacaugcugacugauagaaauguauucaaacccucuguaccucaguuucuccaucuguuagaugggaacaacagcaggcaccaccaggauaguuguuuugaaaauuaagaguuaauauuugucuagaguuuagaacaaugucugguaaaaguguauuugauaaauaauuuagcucuacgcaaauggauuuaacacuaucaucauggaaacucaggagccucagagaguuagucuggguguuuacagaaagauacagauauaaagagcauuugauacaacucuucucccccauuaaauuuaaauauuaccuauuuaacuuauaguuucuuugauucaagaguccccacccucccucccucuuccuugcuuccuugcuuucuugcuuucuuccuugguuugauuuuguuuuuguuuuguuuuguuuuguuuuguuuuguuuuguuuuguuuuguuuuguuuuuugagacagaguuuccuauguagcauuggcuguccuggaaguaacuuuauaaaccaggcuguccccaaacucagcaaucugcuugccucucccuccuaagugcuaggauuacagacugcccugugaauccugcugcuuuacuggaaaggcaauaggaggaagcaggacugagcuguagauaugauauguccccacauaaaaugcaucaguucaguuuuguaaggcauugacuauauuauaauauacuauauguaguuauaguauauuauaauauaguauauuauauacacccuauagcugaguuaaacugaugauuuugaaauucccauauagaaaguucuccauaccuggagaagugaauuuuaguauauucaaauuuaaagauacacuuugauuaagguaagaaauaaaaucucaaaauucccaaucgauaaaaaaagaaaugacuauucaucccagccaaauggaaaacaaauagccccuggguucaagugcuuauuauguaaaauugucuauuuaacaaaccaugcagaaaucugguuguaaaucacuuguuguucuugauccggggacugcggcuuuucaaagccgucuggaaacuauaaauggucagcauuuaggaggugaggagagaggaaggaaggaucauagaggccaguaugaauaugaaagacagcauccauggaucagagggcuaggcucuggaagacauuuuaaaaaugucacuagauuauauuuacaacauaaaaaggaaccuuccuuacacacucugaguauuguuaucuacaugaauaauaaaucaaaacgcucuuuauccauuuaccucugaacacuaugaccuuaggcuagagaugugauuuauuugugcuguuaccaaucucauagaaacccacaaagacuaucacuucauugagcccaaauucugaagaauacaugaggcuugggaagaacaaauauucugaagggagauacuaaaccacaaauacuguggcaccacuaacaugagugacucacaagagauuuuauuuaaggaauuacucuucauccuuauccaaaccucaaguguauccaagccucaggggcuugcccauuucaugauuugccugcuaauauaucagcaguauuugcugccagccuggauuuaauuauaaauauauucacuuuaaaagauguguacaguaugauuccauuuguauaacauccaaaauauggcaaaaugcuugcuugcugcacauccgaagcugaugauaaagggucaagauaugggacauuaugaugaucucacagaacaggagagcaacucccccauacuguggucagagccacuucagcucuccugaagccauugaacagccacugucuuaaccuggguaaacagguauuuauuuguuuaaacuacauaucaaccacagacacuuccccugugcaaacaucauuucacaaaugcauauuauagucugagaagacuaaugagacuuuuuguuuaaaaaauuccuauucauugguuuucagaaauucacauuucuuaggcguuucaauuuuuuuuuccuuaagacagucuuauuguguuuccauggcuguucaggaacucacuaugcagagcaugcuaggcucaaacucccagacaucuaccuaucucugccuugcaagugcuuggaucaaaggcauucuaauuuucuuucugguccauaucacauaagauuccaaauacuuaaaaaccagcaaacaaauaaaaacuugaaaauaagccauggagauaauaucuucuuuaaaguguuacccauuuuugucauauauucuauucuauuauauauauaguuucaaggcuuggaagcacuccccccacccaugaugcuugugccuacagauaaccacauaaauauccuacauagacacaaauaguaauuugcuuauaggaaggcaaagaagcugaccuuuuuaacagagccaugcccaagaugagcagcaagucaaacagagcuccaagaaaaaaauuaauuugcuucuuuuuguuagaguaacgauuuauguuuuauaacauacauuuguuugcacaggaaaaaaacaaucaaguagacagaaugggugugauacgguucccuuauauacaugaagauucacacaucugucuaacaaugcuaacugcucugaaagauaauuauggaucaaugcuuuaaaaaaauauccugaauugccugcagaaauggcaaggagaauucaauuaaguuauuuguaaaagccagaaucuuucuuccuauccaucugcuacuugaaauggguugaccuuucaaacagcacuugccauucucaaugcaaacucuaaauaaagaaaugggggaugagccccaccccaucuuuucaucagagauauggcuuuuguacugacauacuacacugcucagaagaaugcagauuggcuucuagaacauaaaagaagcauuuuaagacgagccaucaggccucugccuuaugccuucaguccugacguuugccuucuaucagaaaguggugcugcuucugagauaagugcuugggaacaagguacacauaacagagugauuuacugccugagcaaagcuccaagcacaccaguggagagcccuuugugaagacuguacaaguaaagcuaauuuggaaagaucggguauuuaaguaacaauagauacaaaacaaacuucucaacaggccucugggaugcauuaugaacuacuaacauaucugcuaggagauaguaauagcacuuucuucucucagucuggauauucuuccugccuguguauuauuccuccuacccuucuugagucuuaacauuuuguuuccuauuugaccuccugugccuuuaaacauuuuuugguuguuuuuguuugguuguuugguguuuguuuugauuugauuuguucuuuugaauguuguuuugggguaauuuuguguguguguguguguguguguguguguguguguguguguguguuugaguguguguauguaucugugauaaaaguucauuacacacauugcaagaaguuuaggaacuacccagcauacaaaacaauaguucauuauaccauccagagcuacucacugcugacagaguaugugcucuggaagccauauuugcacacaucuaaauacaaaaaauaaucacaaaauuguaucuuacuaaaagguaauuaguugaaucuuccuugacuaccuaucaacugcauggagaguaacugguguagaugaaaaccugagcuauaacaaguaacuucagcaugauguaugugucuguauguccacaguucuaauaugaaaauauaauaaucagcugauugugaacauugagguuuauagcuauccuaucugacugaguaaaguugaaaugaacauuuaugcagaaacccuuacagguauuuccuuaguguuauuucccagaaguggugagccuaaauugcauggaauggaacauacuagaguuuuuuacugagucuuaacaaacuacuccagcaaguuuaccagauaagauaugcauaucucccuaugcucuguauaaugaugggaaguggcgauuuuuugaacccuugccagucugagcaaaaacucuuuauugcuuuaaugaucguugcuuucauagcuagcaagguugaauuuuauauugguguuuuaucuccuguuaauguaccuaauaguaauuuaugaaacauuuuuaauuuuggcucauuuuaucugaagcagaagaauuauuuuaaaauauaacaccauguagauuuaagauuaaacucacuuugaaaaaaaauuaaauacaacagagaucaauuauuuuaaucuuuaaaauaauauaugcuuagcauaaaaaguuuaaaacacucacaugaguacauauaauauaaacauguaguuuuucaaaaucaaaacaaaaaguagacaucauuuacccucugacaccauucucuggcuucaacggaggucauaucauacauagaauuauucuuuucuuuaucucagugcauuccugcugucccaagaaaucaauggccauaucuuaucaaaucacagaugugauaggaagcacauaagcacauacuugucuuuaguuauuuuccuauuucacauuccauaacacuguaguauaacauucaauaauucucucuauucuugaguugucauuuugauaaaguuaucguuugauuuguuuuuucuauacaacuauaaacaguauagaaaccaucuuugaauacauaguucaucauguauaugguucccaagggcagggauguagucagagaucaggcaucucacuaauuucgacugacagguacuucuggauuuaucaauacaugaaaaguuccacuucccugcaucuuuacuaagcacggauguaccuaucaauauuuuagcucuucugucuauaugaacaggaaacaaaccguguuucacugugaucugaaaucauauuucugugaguauuaaaggugaucagguggucaugucucugucauuguguuuucucuccauaccauugacagugaacgccuuucaucuuuaugugugccuauuuuuaacccaucugaauuuuugugguaagauuuaaaguccaauugguaacaaguggguuuuaagcaucauuuauuaccuaaauguauaguccuuuagugauugggaagagcuuuuauuuaauauuucaucaugacuauauauuuggaucuguuucuaacucuuucuguucaguugcacauggccaagaauacagcauuugugucaacaguaacuuuagauuaagguuuaauguguauuaaaguaaaaacaaaaacuccuugccauucugaugaaucacauuaacaugcauauacuauuucaggaaggauugacauuuuacauuaggaaauagcaaggaauauguuaugacuguuuugacagauaauauuugucauaaugcaauuuuuccuuuuuauguaauagucauuuauuuuucuuguuaaauuuauuacaaucgauuuuauucauuucuguauaacugauuauuguaaaggaaaagcuuugauuuucuucuuuuaaaauauauuuacccauggccauugaguuuucuugucuuuaacaauagugugcaucaguuuugcauuuuaaaagauuauagucauauuaucgcauguaauaaaaaugacuauccuacuuuuucuaauguuuuuauugccuauuuuuuuuuuauauauaauaguacaggcagaagccacaacccagugcuaaauaauagugcugacauaaaacacccuucuguaucuuucauaguacaguacaaacggguuuuauauuccuaauggcauauuuuuuucuguucaacaugggcuauuaauuuaaauucuuaguaauuccauaauuuaaauuucguccuuaacuuccuugugaacaacuuuuguaggcuacuauuagauauuuccagugaauuuuaugaaauuuuaugaaaauuuuugguggcauauauuuugcguugaguagaauaccuuucggccgaacuuaggaaauuagucugaacaggugagagggugcgccagagaaccugacagcuucuggaacaggcagaagcacagaggcgcugaggcagcacccuuugugggccggggacagccagccaccguccggaccggaggacaggugcccgcccggcuggggaggcgaccuaagccacagcagcagcggucgccaucuugguccgagacccgccgaacuuaggaauuuagucugaacaggugagagggugcgccagagaaccugacagcuucuggaacaggcagaagcacagaggcgcugaggcagcacccugugugggccggggacagccggccaccuuccggaccggaggacaggugcccacccggcuggggaggcggccuaagccacagcagcagcggucgccaucuuggucccgggacuccaaggaacuugggaauuuagucugcuuaggugagagucuguaccaccugggaacugccaaagcaacacagugucugagaaagguccuguuuugggccuucuucuucggccaggaggagguccaaaugcaagauaucggcgcaccuucccuguaagagagcuugccagcagagagugcucugagcacugaaacucagaggagagaaucugucucccaggucugcugauagacgguaacagaaucaccagaagaacaaucucuaaacagagucaacuauaacuacuaacuccagagauuaccagauggcgaaagguaaacggaggaaucuuacuaacaggaaccaagaccacucaccaucaccagaacccagcacacccacuucgcccaguccagggaaccccaacacaccugagaaccuagaccuagauuuaaaagcauaucucaugaugaugguagaggacaucaagaaggacuuuaauaaaucacuuaaagaaauacaggagaacacugcuaaagaguuacaaguccuuaaagaaaaacaggaaaacacaaucaaacagguagaaguccuuacagaaaaagaggaaaaaacauacaaacaggugauggaaaugaacaaaaccauacuagaccuaaaaagggaaguagacacaauaaagaaaacucaaagcgaggcaacacuagagauagaaacccuaggaaagaaaucuggaaccauagauuugagcaucagcaacagaauacaagagauggaagagagaaucucaggugcagaagauuccauagagaacaucggcacaacaaucaaagaaaauggaaaaugcaaaaagauccuaacucaaaauauccaggaaauccaggacacaauaagaagaccaaacguacggauaauaggaguggaugagaaugaagauuuucaacucaaagguccagcaaacaucuucaacaaaauuauugaagaaaacuucccaaaucuaaagaaugagaugcauaugaacauacaagaagccuacagaacuccaaauagacuggaccagaaaagaaauuccucccgacacauaauaaucagaacaucaaaugcacuaaauaaagauagaauacuaaaagcaguaagggaaaaaggucaaguaacauauaaaggcaagccuaucagaauuacaccagauuuuucaccagagacuaugaaagccagaagagccuggacagauguuauacagacacuaagagaacacaaacugcagcccaggcuacuauacccagccaaacucucaauuaucauagagggagaaaccaaaguauuccacgacaaaaccaaauucacgcauuaucucuccacgaauccagcccuucaaaggauaauaacagaaaaaaaccaauacaagaacgggaacaacgcccuagaaaaaacaagaagguaaucccucaacaaaccuaaaagaagacagccacaagaacagaaugccaccuuuaacaacuaaaauaacaggaagcaacaauuacuuuuccuuaauaucucuuaacaucaauggucucaacucgccaauaaaaagacauagacuaacaaacuggcuacacaaacaagacccaacauuuugcugcuuacaggaaacucaucucagagaaaaagauagacacuaccucagaaugaaaggcuggaaaacaauuuuccaagcaaaugguaugaagaaacaagcaggaguagccauccuaauaucugauaagauugacuuccaacccaaagucaucaaaaaagacaaggagggacacuucauucucaucaaagguaaaauccuccaagaggaacucucaauucugaauaucuaugcuccaaauacaagagcagccacauucacuaaagaaacuuuaguaaagcucaaagcacacauugcgccucacacaauaauagugggagacuucaacacaccacuuucaccaauggacagaucauggaaacagaaacuaaacagggacacacugaaacuaacagaagugaugaaacaaauggaucugacagauaucuacagaacauuuuauccuaaaacaaaaggauauaccuucuucucagcaccucaugguaccuucuccaaaauugaccacauaauaggucacaaaucaggccucaacagauucaaaaauauugaaauugucccauguauccuaucagaucaccaugcacuaaggcugaucuucaauaacaaaauaaauaacagaaagccaacauucacauggaaacugaacaacacucuucucaaugauaccuuggucaaggaaggaauaaagaaagaaauuaaagacuuuuuagaguuuaaugaaaaugaagccacaacguacccaaaccuuugggacacaaugaaagcauuucuaagagggaaacucauagcuaugagugccuucaagaaaaaacgggagagagcacauacuagcagcuugacaacacaucuaaaagcucuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguugaccaucuaaacagucccauauccccuaaagaaauagaagcaguuauuaauagucucccaaccaaaaaaagcccaggaccagacggguuuagugcagaguucuaucagaccuucaaagaagaucuaacuccaguucugcacaaacuuuuucacaagauagaaguagaagguauucuacccaacucauuuuaugaagccacuauuacucugauaccuaaaccacagaaagauccaacaaagauagagaacuucagaccaauuucucuuaugaacaucgaugcaaaaauccuuaauaaaauucucgcuaaccgaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucauuagaugcagaaaaagcauuugacaagauccaacacccauucaugauaaaaguucuggaaagaucaggaauucaaggccaauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauuccaacagagaacuccuaaaccugauaaacagcuucggugaaguagcuggauauaaaauuaacucaaacaagucaauggccuuucucuacacaaagaauaaacaggcugagaaagaaauuagggaaacaacacccuucucaauagccacaaauaauauaaaauaucucggcgugacucuaacgaaggaagugaaagaucuguaugauaaaaacuucaagucccugaagaaagaaauuaaagaagaucucagaagauggaaagaucucccaugcucauggauuggcaggaccaacauuguaaaaauggcuaucuugccaaaagcaaucuacagauucaaugcaauccccauuaaaauuccaacucaauucuucaacgaauuagaaggagcaauuugcaaauucaucuggaauaacaaaaaaccgaggauagcaaaaacucuucucaaggauaaaagaaccucugguggaaucaccaugccugaccuaaagcuuuacuacagagcaauugugacaaaaacugcaugguacugguauagagacagacaaguggaccaauggaauagaauugaagacccagaaaugaacccacacaccuauggucacuugaucuucgacaagggagccaaaaccauccaguggaagaaagacagcauuuucaacaauuggugcuggcacaacugguuguuaucauguagaaaaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacacugucuauaagacaaaaagaccaccaacagacugggaaaggaucuuuaccuauccuaaaucagauaggggacuaauauccaacauauauaaagaacucaagaagguggaccucagaaaaucaaauaacccccuuaaaaaauggagcucagaacugaacaaagaauucucaccugaggaauaccgaauggcagagaagcaccugaaaaaauguucaacauccuuaaucaucagggaaaugcaaaucaaaacaacccugagauuccaccucacaccagugagaauggcuaagaucaaaaauucaggugacaacagaugcuggcgaggauguggagaaagaggaacacuccuccauuguuggugggauugcaggcuuguacaaccacucuggaaaucagucuggcgguuccucagaaaauuggacauaguacuaccggaggauccagcaauaccucuccugggcauauauccagaagaagccccaacugguaagaaggacacaugcuccacuauguucauagcagccuuauuuauaauagccagaaacuggaaagaacccagaugccccucaacagaggaauggauacagaaaaugugguacaucuacacaauggaguacuacucagcuauuaaaaagaaugaauuuaugaaauuccuagccaaauggauggaccuggagagcaucauccugagugagguaacacaaucacaaaggaacucacacaauauguacucacugauaaguggauacuagcccaaaaccuaggauacccacgauauaagauacaauuuccuaaacacaugaaacucaagaaaaaugaagacugaaguguggacacuaugccccuccuuagaagugggaacaaaacacccauggaaggaguuacagaaacaaaguauggagcugagaugaaaggauggaccauguagagacugccauauccagggauccaccccauaaucagcuuccaaaugcugacaccauugcauacacuagcaagauuuuacugaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaauaccuaauaaaaaauggaaaaaaaaaaaaagaaaaaaaaaaaaaaaaagaauaccuuucaaccucccaccuauccuccaauagauauuaaaauggccuuauuuucaaaucauugcagauacaauugacuaacaaucauaauuaguaacaacagaccauauuggaccugagugaucccucaaacaaugacuaguguccucgcaagaaaagcaaacacaaauccugacagagaaggaaaaugaucugggagcaggcacagugccuaguguuccuggccugcauuccaaggugagccugcacaccuggcaaccacaaauuggcaggaaaugccucggaagggucaucaucaaggaccuugagagagagcacaucuuguggcaucuuuauuuuggaaguauagguccauagcuaauacagaauaaauguguacuguuuugugcuaucuacugcggaccauccuccacagaaccuacuuguccuguggucaauggugcaaaugcguuucuaaggcuaaaccuauuucuaauuuuggaaacaaacucuuucaaacguuuuacugcuuuuucauaaauuggcaaaccuagacugcuggagauuauguuauaccugaauagucuuaugcaacugccaugaaacaucucuguagaauggucuacaucagguuuugauaugaggacguucuacauuuauagaaucucuucgggcuuauccacuuuuucuacauauucuuaacuuuucuagaaaccaaaggacagauugugcugagauaugagagcgucuugaccccaugcucuuuucuguggaauaucuuuaauaguccgcuuccuucuaggaggaucaaaagauuuuacucuuuaugugguuauugauauacauauauucauucucugaaaaaguuuuaaugccuucuauauuuuaaggaauauggcuccuguuuuuuucagguagcuauagcagugaugccuggcagaguggacagaaagcucaaauggcaugucuaccccucugcacuugcucugaaauguggcuggcaugcuguguauccuucuggacacgcuccagugugugaauggaaggaaaggagagaguccuccacgaaggagacagucacucugcccuugaagcaugugggagaaagcauggcugcugggccuguguagaagugcuaagcaaacaccugggcuagguuggaccuggauccucaggacucucacaauaaaaaauagaagcugacuuguuaagagaccugauacucuucugucguuggggcaagacuuuacagagcaaaucuuacaguuucuuuccaucgagauccaauaaagcuuucaguuuuggaaugaccugaauuuuucuuuuucuuuuacuucuucuucuucuucuucuuuuuuuuuaaagaacuauuucuccucacacuuguacccauuuucaaauagcuucaaauuuucgaagaaacacauuucucuacaacuuugccagauuucaucuuuauauuguuuuauuccaagcagauggaggaaauuagagcagcauauuugcuucaacucauuagugcugcaucagcacuuccaaucuccacagcuuuccaugagguuauuguuacauggagcaggauugugcuccaggcagaaagaaagaguuuuaaaagucuuaaaaauuaaccuucuuuuacaauuagcuuuugcauauuaauuucuucaauagcacacauuaauggcauaacagaauggccuaacucagucacagggcagacugcucgugggucagucuuuaauaaaccaugauggcugcuguuuuaaaauaaugauggggaagacauacuauccacugcuugguuagcucgaggacugagcaauccaccugcccucuugccucaugaaacgcuuugaaguaaacucuacuuggcaccugucuuuggcacagagauggacaucccuagcuaaagaacaaaugaauucaugugugcuuuuuaaguuacacuguacuauuaaguacaguguggaguuaaccucauaggaaaauguuaucuucuauuacccaugggagcaaccacagagaaccauacaguacagcaagggcuccauuugccacuucugcacagcauuacaauccuugagauauuuucauggagguuuuuuuuuuucuuucuaaucucuauaguaaaucuauaauggauacaggaucaaagaagaaaagacauaaacauaggcuucaaacaugaaaguggcacugagcacaucaauaaccuucuuuauagauaaagaaauggagaccaaagaacuacagaccuucccccugauucaugacuaaguaucagagguuggugaagggagggcaggucaccacaugaguuacagauguaagcucagaaaauuaggcaaggggaaggugacagaaacaauggagacaagcucugacuuaauguccuuacacaaagcaaucccauuggguuagcauuugaaauucaauguuagucucuaaggaccacuuagcuauggcagccaagugccauuauuagauccuauagggaaaaauacaauuuugagacucucacuuccacuacagaugugggagccauugacgaacaccuucaugcaggaguaaaucaugucucacauacacagacagaaguguacaauucaucaagagaaauuggaaaaagaauauagacacucuguacuggcuaguuuugugucaacuugacacagcuggaguuaucacagagaaaggagcuucaguugaggaaaugccucuaugagauacaacuguaaggcauuuucucaauuagugaucaagggggaaaggccccuugugggugggaccaucucuggacuggucgucuugguucuauaagagagcaggcugagcaagccaggggaagcaagccaguaaagaacaucccuccauggccucugcaucagcuccugcuuuccgaccugcuugaguuccaguccugacuuccuuggugaugaacagcaguauggaaguguaagcugaauaaacccuuuccuccccaacuuguuucuuggucaugauguuuguguaggaauagaaacccugacuaagacacacucuauaccucaauuuaaaaauuaaaaguauuuccuacccaucagcucucuaccugucuccuacuugucacaccagcaaguccucauggcugauccuaaaacugugauuuaccuggcauauauuaaaaauaaucuuuccuuuacgugagaauauacuaggacuauauauuuucuauuacauuaugugugucuugaacaaugcacaggcuaccuuccaagcauuuuuuauuuuauuuuuuucccauuuuuauuagguauuuagcgcauuuacauuuccaaugcuauaccaaaagucccccauacccacccacccccacuccccuacccacccacucccccuuuuuggcccuggcauuccccuauacuggggcauauaaaauuuguguguccaaugggccucucuuuccagugauggccgacuaggccaucuuuugauacauaugcagcuagagucaagagcuccgggguacugguuaguucauaauguuguuccaccuauaggguugcagaucccuuuagcuccuuggguucuuucucuagcuccuccauugggagcccugugauccauccauuagcugacugugagcauccacuucuguguuugcuaggccucggcauagucucacaagagacagcuacaucuggguccuuucgauaaaaucuugcuaguguaugcaauggugucagcguuuggaugcugauuauggguuggaucccuggauauggcagucucuacaugguccauccuuucaucucagcuccaaacuuugucucuguaacuccuuccauggguguuuuguucccacuucuaaggaggggcauaguguccacacuucagucuucauuuuucuugaguuucauguguuuagcaaauuguaucuuauaucuuggguauccuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucugaguucuuuccagcuucuggcuauuauaaauaaggcugcuaugaacauaguggagcauguguucuucuuacccauuggggcaucuucuggauauaugcccaggagagguauugcgggauccuccaguaguacuauguccaauuuucugaggaaccgccagacggauuuccagagugguuguacaagccugcaaucccaccaacaauggaggaguguuccucuuucuccacauccacgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccagucuguugguggucuuuuugucuuauugacggugucuuuugccuugcaggaacuuuagaguuucauuaggucccauuugucaauucuugaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaauccaagcauuuuuuaauucaccauaggcuaucaucucaaaagguuuuacucaauacauagcagcugucucccauaacucaguguaggacagucuuuaaaacuugcagcugggauauaauuuuaauaaaugauggcacuacagaaagaugucagaaaaagcagugagggcauuauuauuauuacuauuuguuauuaguauuacuauuuagaaaaggagaaauucauaucaagguuaaaggccaaucucaguuaagguagacucugaauuucuugucagaaugcacagaaacccucucuacauuuaaaaacuucauuuugccaccuuuaaacaucugggaauugaagacauaaaaacaccacaucugacagacauugaaaaguugcauaguuauccuuaaaauggaagaacaaacaucuuuauuucuauuuuggagcuauacaauauuuacuggcuucccauucacucuuauucauuuacauuuugugaauucuaguuuucuuccuuccuuccucccucccucccucccucccucccuucuuccuuuccuuuccuuuccuuuccuuuccuuuccuuuccuuuccuuuccuuuccuuuccuuuccuuuccuuuccuuuccuuuccuuuccucccuuccucccucccuucuuccucccuuccuuccuucccuccuuccucucucucucucucuuucucucucucuuucuuucucuuuuuguugucuauuuucaucaucccaagggcauuuuuuuuucuaaagaaagaaaaaaauucaauaaccaaaaauucuaagaggacacuuccaguugaaaugacaaagaaaauaagauaugauuggugaagcaacagucuagucacagagcugcgguggccaaaaucucuucucauaugucugagcacuaauugcauagcugaauuuagacagagcuucaacuauucaguacagacgagagcccaagcuggaagcaaaagucuuugaaugacaacccugccuuuugauucuuuccacaugccuaugcuuucugacauuuuccugaguguucuacccaguugcagugugaccaugacaaaagauuucugugggcauaguggcacaucuuuggggaaugacagggaagagauaggcaaugagagccuuuaguagcaucagacaagcccauagguauucuacaaugcuuuugcacgaugcucucagaaaugcauguuaagaaauggaaccacgguggcaguuuuaaucacucaacagacaguucugugaucugcugucacucuacaaugugaagccucuggaacauaggagacugagcagagguauucucuccgugccucucagacuccaaauggcuacuuacaugcaaauagagaccuuaacacacaacauauuuaaucaaacuaauggaagaauuauaaucacuaaauuuaacaggauggaauuuucuugaugaguuuuacuuuucagaccuuggauucuagaccauuuaccugcaguuuacuaguuauuagaaacuaguuaaccuagauguagauagugaaggcaaaaguucagccuacauggugguaaugaguucgguuucuucugaagggcuaccaacgcugucugucuucuccacugaaugauucuuucauauagaaaugacauaccacuucuaaccugacaucccagaaacuugguugaaacaucauuuacaguuuuuaaggaaguagagaaaguacucucaaagauguugguggcaauguaagcaggaucagucuuuuugaaaaccaauccgacaauauaugacaugcuauuuuuaucuuacaggaauuaaggaacagagucccaaaaguuugaauaccuucaaaagccaggcaucuccaauacuguguuguauuccaguuauguaaauauguaggcuuagauuuuuuucaaaaccuauuuagguuucuucaauccuucaaccucucuucuagcccaccaagcagacauaggggaaaaagaagguuaauaggaaaaggguguuguggaccuuuuagacaauuccacucaaugcuguaagcauaccagcaaacaccaaacccaaaucaguagcuauaaggcucugccaaauaggcacaagucagcugaaggagcuagaauccgccagaauaccaugagagauacuuuggcauguuucucucuaugaagugaagaccaaugaaguacugcaaggcagagcaaugcaagaacaccccuuacuuuugugggguuccauuuauauuauuucuaaacauuacacacccucugaaguguuuguuuucagcaaaauauuacaugcccucucauaauacagcuuccugaagaacaucacaugacagaacugaguugguaaagaaaccagaaauuuccacuucaugaauauucuaugguuuucuauuguuuccacauuugugaaugcuucaguuguuuucaguuugggguauuauaaauaauccuccagagaacagcuccauaaauacauuuuaauucacauuuugcuugucccuaaggaaagauuugagcuagauuuuguuauaauuuuauccugaaaauuaaagaauuguuuccagcaaaucaauuccuaaacuaaaauguaauacaucaucuauuaagauauguaucuuaauuaagauaacacauacacuacuaguaguggguaauuaauuuuccugcagaaauuaaguggcauuuaugauuagguuauugacugagaaaaaaaguuguguccuauucaaaggccagucauugggagucaacacagcagugagccaaguuguccuuagguccacugaugagaaccauaaggaaauauuuugccaucuuuacaugaauuucuuuauuuguuaagaacugauaacaaacuauucaaccuuauaaaacuguaaagccagacaguagggauaacauguucucuagucacuaaaguuucauuugccuggagauggaaguuauuauauggaagauauucauaaagaaaguaugauuggcccccaaaguaaaacaaagguaccaugagcuaauaacaaaugauguacacucauuaguuuaucauuugggaaauauuuuuacuacaauaaugcugaguguuagcacaggaagauugucuaaaacuuuuccaaugaaaaaaauauuuucacagugaagagaauuuacuaaagaaagagacauaaggaaauuucaaggugaaugauuaauguguuagcacacuguuugcuccauaaaaggauacaacugggaacauuucuaaauuaauuuacccauaagucuucuugcuuugugcugccuuugguuucugaccacucuauuggguuuguagauuaucucaggggagagcaaucuuggaauguccuuuaggaaauguuucucuaggccagugauucucaaacacuguagucucaagacacauuuagauuguuucaagaauugccaaagaccccaaagagcauuugguacauagguuacaagcacaaguaccuacugugcuggaaauugaaacacaaaacuugugaaacaccauuaacucuuaaacagauaauuaaacagagaccaggauuguugcucacuaguagaguaugugcuuggaaugcgcaaaacccuuuaguucauucucaaguauggaaauauaauaaucauaaacaauuacauggaaagaugaugcauaguugacaaaaggaaaagaaacugguaacacaguaauucuauuucacaguacugaaauucauucuuaauaauuggcuaaacaaaguucagauggauuuuucugugauguuuaagauuugcuacuuuuauuuuauguagaugagugcuuugccugcauguaggcaugugcauuauaugugagccuguaaggggcagaaguggagcaggagucaacugcaauuguaagucagcauguaggugcugggaacuaagccuggguccucugcaaggguaacaagcacacguagccacuaagcaaucccuacagcccuccuuugcauucuuuugugauacacuaacaacugauaauugaaguauaugaaaggaaaacuugagguacuauuguuaaggauauauuuuuauuauuuuaauaguguguauguuugucagcggauauuugcccacgugugcagcugucugugacugguggcaucagaucucucugcaguuggaguuacaggcaauuguaaccauacgguauggguguuaggcaccaaacucaaauccucugcaagaacagacacacugcuaaccacugaaccaucucuucaaucccuucccugucugaucugacuauuuuuaauaguuauuuggaaagcaauagcuaaggauauuuuccauaaugccaauuuaaaacuccuuauuguuguuauuugcagggcagaauuugaaacuguaucaagacacauuccauacucugcugugugaaaaucuauggucucuguggcauuuugaauggauccuuccaccauacaaaauuuuccaacagugugcauuguuccggucgaaaauauuggcucagugaauuaugcagaucuuucaaauggugacacauuucaucauaugauauaaaaaagaauuacuuuuguuaaugucaucauugaucucaucagaaaauucuuuaagcauuggaaaacugucaugcacgugguggcagaugcaauuugccccaaaucuaaaauucugcuugagaguuccaacucuugcuucaguggugcauacuuucaaugguuuacuuaaagggauagacucacugucaguggguauuuguugagaagaacugucaaaccugguggugguuguggugguguugcaugccuuuaauccuaguacucagaugucagaggcaagcagaucucugugagcucaaggccagcccgaucuauagagugcucuccaggauugccaguauaguuacacaggagaaacccugucccaaggagaaggaagagaaggaggagaagauggaggaggaggagaaaggaaagaaagagaaaaggaaggaaggaaagaaagagggauaaagagaaagagaaaaagaaggaaagaaagaaagaaagagagagagagaaagaaagagagagagaaagaaagagagagagaaagagaaaggaaggaagaaaggaaggaaggaaggaaggaaggaaggaaggaaggaaggaaggaaggaaggaagggaaaaaggaauaucugucaaauauccuagucugcauagccauauugcauaugucaagaguucuuuccuggaaaaccuggauuucucaaaaugcauaguuuaguuuacaaguugggggucaugaacagacuuccaggagacauaaggaaaauauucuugagcaguuuuguuaacacacaguucuauucaagagauauguacucaauaauccaauuugacauuaguaaauuuugcucuguguugcuaaaacuucuucccaaagggagaugugcacaguauuuaccccuccuccuaaggucccagugaaccaaagaacaauuccaucagaguucacucuggagaaccaaggaauuuauugggcuuccuuauagaacauaagcauggaguuacuuaauggagaguauguguuucccucaaaggcugcacuggaaaguccuuacccaacagagaugauggcuuucaaguagccacacagauggaguccccugcuccuagucuucccugaacuauauacuccagcccuuccccaaagccacaugcaauuaaggcagaguugcacauacaaccucuucugccagucacugauacagaaaauccauuugaccugcucauagcaaaaaaaaaaaaaaaaaaugucaaucccuugucaaacucaaaucugguauauucuugagaaauucuaugauuaucuauaacaaagauacauaaaacaugguuggaaacaugucuguaacaugagcauguucaacucuagaugaccaccacaugugauaucucuggugugcauaccacagucaacccaagucaaacucccugaggcuagagaguaauggaauguaaagaaccucauuuggcaggauaucugaagaaccuaccuguugcauuuucauucagauuucuggaauaaucuauaucuaaaaauaugauucuugagucaccugcaucaacaucauaugagauacuuguuuaaaauguacagucucagcacaguaauaaauuaugacuuccauacacacauacacacacacacacacacacacacacacacacacacacacacacacgcaagaguagggacagaugugaagaggauaauaaaucaagaaacaaaauucccaagaaugaagggcagggccuugugacuucuaccugacucugaagaauugauaccuuaaacuuucuuuuccagggaagugaagaaggaaugcuuaaaaauacauuuuaugaaauuguuauugucuggauuccaaguuagucaaagauaucagaaaaccauaggugaauaugucugauaauaacacaugcaaaaauccucaacaaaauagagaacugaauucaaagcauaaauauguuuugaauccaugaucagguuagaccuuuuucaacuuacaauauauugucaaaaguucagauuuuuuugugugcauuuaugaguguuuuacauauauguauguauguauguguaccuaugugugccuugugcguguugccuguugaguuaaggggguucugagccaccauguaggugauagguaucaaaccugaguccucugcaagaacaaguguucuucacuacugagccaccucuguagcccaggauuuugaaaguuuaauguuaaauuccauaacaggacaacaggaaaaaucauagcacuaucuacauagaugcuaaugcuuucacagcacuuuaugauuuaaaaaauauugcaacagauuaagcccagaaggaaugaaccucaauauaauaaaaaucauuuaugacaagcucacagcaaacaucaaauucaguggugaaaacuaaaagguuuccugacugcuauuaggaacaagcaaaggauuucacuugcuccaugcaaaauaguacaaaugcuggaagacuaaaagcuuagaguugcaaucugggggugguuaagcaguuauguauguuuuuguucaaguaucugaaaaacugugaaaucuggacuguuucuuguccuaaacauuucagauaagguacacucaaucuguacuugauuuuaaaauacacuacaaugcuauggcaacuaaacacaauacagcaugaaacaggcccaaauggccucaggaacagaauaagagcuaagaaauaaaccaacaugcuucuaggcaaguaagaagaacacggagaaagcauagugaagaaggccagucucucuagcaaacagggcugugaaacuggauauccauaagcagaaaagcaaagugugcccuggucucccagccuauacaagaaacaacuuaaaagagacuauaguccuaaacauaacaaaugaauugauaaaacuacaagaagaaaacacauuagucuuggcaagaaaaauuuaaagaaaauaugucaucaaagucacuagaagcaggauucaaaaagugauauuacuaacuguuugcaucugggcagcagagaucaacaauuaaagagaaaaucuguggaaucugaaaaacuacuugcaagggguuaacacauaaaauauauaaggggacuauagagaaccugccugcucuuuuggaggacugaaguuugguagccagacucauauugaggggauaacaauggccuugcaccuccaucuacaaggggucaagugccuuuuucuagccuccguggguaccugcacacaagugcacauaugcaugaauaaaucuuuaaaacaaaauacauccagaacguaaauaacucaaggcucagggaauaaauugauuacaaauaagcaaaugaccugaguaaauaacguucaagagaagugagguaaaugacuaacacauacaaaaguucugcaucaggacccacuagggaagugcaauugagaaccacaaugagacaucaucugacacuggacagaauaucuaucaucaaaacacaauggcuaacaaguguuggcaaggguaagaaagggaaacucuuagacacuguugguaugaauuaaauuaauauaaguauugugagaaacaauaugguggcucucaaauuuucaaaaguagaagaaugaucuggcuuaguguauguaucuagaggaaauuaaguaaauaucuugaagagauaaauaugugugcucucgcguucauuguagccuuguccgcaaaagccaauccacuggacaauggauggaaaaagaaagagcaauguaaacaauagacugcaacucauuuauuucagauggucaaaauucuaccaucugugacaucaguggaucuagaagucaucaugugacauaaagcaaaccugguacagagagacaaucacugcacagaagcaccuaguuggagaacuuagauuacugaggucacugaagcagacggugguauugguaggaaaauggggagaugcuuguuacaggguucaaaauuuuguuuauacaagaugaguaaauuuuggaaaucuguugcacuauauuguaacuauggcugacaaugauuuugcagagauuagaacuuggauugcacagagaauaccgugugggcucaacaucccacaacauaaugauaugugugucagugugaauaguaacuaacuugauuuaaucuuguaauauaugcacauaccaaauagcacauugagcucuuuaaguguauacaauuuuaauuugucaguuaugcucugagaaaucuggggguaauguauauuucugaacuuuacuccauggauacuaaaacaaaauaucuggagcaaagcacugauacuugaaaugaagugugguuugugcccuguugcauagaauggaauuugaaucugaauaauuaucugucuaaacaauccugaguuuauuaaaauuuuaaagaaucuuucugauaagcucugcguuagaauuacuaggguagccaagggguuaggggaguagcagagaaggcagguucccagaggcagcuuaaaacuuuuaaacacuaacaauucggcaaggaaauccucaaaacacuugucacuguuuggcuuaaaaugagccagaaucaguucaauacaucuacuggauccccagauuuccacccaggcccacccagaacuucaggagugugagccagcugguagaguaucccagaaccuguccauagcuccuuuauaccccaaggcucaggaacaguuguaaucuugcaaucagccaggagaguugcauugauccucucucacaccagaccuucaugcccaggcucagacaggagcuggaauaacauauuccaccaguaaguaagcucccaguccccugcccaacacagccuuacugcacucagaugcagcccagagccucaucuguacacuuuugauuuccacugaguuggagucaacucagugucuucaaucaaaacucgaugccaaauaucugaaggacuggccuacaaacucuucgucgcugaaaucaaccaagguugggcaacagcaaaaucucccacucaacagaaacagucgagaaucuuuuaauagacacacaacaaaugaaauguugacauucucaggacacauagaaaacaagcaacauaaaaggccacaauaaacugacaccccuccccacuaaaauaguccuauagaaauguucugcaacaagaacuuccucggugagcauagggacacagaauuugaaccaacaguaaauuaugaacaugaucaaagaagugaaggacauuacaaagguuaugaacaaauacaucaaugagcguaaagaggacacgaacugcccuacaacacaaauauaugguucaaugaaaugacaaagacaaauucaaugaagaaaaauacuaaagaagacccaaacugaaaugaauuuggaauugaaaauaucaauagccaaauuaagaaauucaaaagaaagcaauagaauggaucauauagaauaucaugaacuccucacucaaaaaaaaaauacaauaaaauuuuaaaaaacacacacaaggaauauucagcagaugugaaacaccaugaaaugacaagaagcagaccugaacaaugaggacauuagucaauucaacauggcaacauuugaagguccaucugcagacagagauguaggcaaucaacagcugagaggguggaagcaguuuucuccaaggaaguagaguggaggaagagagaagggggacugagagaggcaagggggagugagaggccagagagagaauacacuuacuugagaagaagagaggagccauaugggaggaguuggagucuggaggagagggagugggugaaaaugauguaaaugcauguauaaaauucuaaaaccaaaauaaauuaaaauguaauaaacacacagacucuucucuugaguuuaauccgcauguagaaaaaaagguaaauagacucaauacuuacauaauaaacacaauuacagaugcaugccuacuacagaagagaaaaggagccagaaggagagcuuauguguuuguacgugaaauaugaaugccaugggcaugcugugcccgugaaagucagaagagggcaucagauccacaggaacugccguuagaggugucagucggcugccuaaagugggugcugggagacccacucugguucucagcaaaagcaacaagugcucuuaagcucugagccaucccuauaaccgcuccagguaaauaaauauuuuuaaaaauaaagguugaaaguuuuugaguaaaguucacauaugaaccuaugugcaugcauuccuacacuacaaguacauauacacaaauauacaacacacagagauacacacuccaaaaagaauuagaaacauauuuuuaagugcggaacuagguuuaucugaucaagaucacucgagcagagaccuaagcauuuuuaaggaccaucaugguuacuucugggccugccaaaaagaugaaaggcaucucucuagcccucaaaugcuauagcuaucuacaagaaaucaacuguaaaaauauugaagacagugcauauccugacuguuuaggaaacucagccaccauuuagucacugucuauuccccagcuauaaauucaucuuguaaaauuaccagugacuuuuagaaaaacucagcuccccgcccuuuccuguuagcgugcuuguuuucacucugucaggauaaaauuggcucucaacuuuggaugcuauuccacccacaucuugaaauguauuuaggcagaauuuucugguuuuauaugaaugcuaguuaaccagacauaggucuuauuuuuuccaucuuauacaaaauccuucaagagaaaagacaaacuaaguucauguucaaaucaccaaauugacucagaucuuugaaugccauucaaaguuucauguuauauacuuaacuuaaaaaaaugacucaguguaaaugucaugucugguuagaauccuauuccugggaucuugcuuucacuugaaauguaguggaaaggaagauucuauggcugccaaaauauaauugaucaucuggaaacaacaacaaaaaaaguagcaucgcuuuucuuucuagaaaauaggaaagcaugcaaauaaaucaguaauuucccuucuagcaaagcccugaaguagggggguauauuuugcugauugaaggggaugggacaaaacaaucauuaggcuacccuuuugucccaaaugacaacaugucaucuuccagucauuccugaaaagcacugagcuuuaagcaagugauccuaguacacacaaagacgguaggaugucugaacgguaggaugucugaacacaagccagcacaucaugaagcucaccaacagaaaaauuagucaaaggaauggagaauagggaaggaaaagagaaauguuacuucagggucaggugaggucgggacacuauggguuacacagaguuacuucagggucaggugagguugggacacguugggucacacacagcugagugaguucucuuacaggauuucucagauuaagcucuccucuaguaaugcaggccuugcuuugcaugcaggggaaaugccagccuugagcacauucaaggaaaugcuggugugcacaggucaggugguuaauggaaacgcucaagcauguccccaaacucugacaaagcagaaagcacaugcccagcagggagcucccgccucugcccccugcaucaagucccucagcuucucuccauggaccucacuggcuuuaaaagaaagaugaugcuuauuagugaagugccuugggaugguugggcaggaaacacuaaauaagagccaauuauugccuucauuacaaagcagaugaucaaauaaagcaucucaauuaacugacggaguuuggaugcuucuuuucuucuugcuuuuucuauaaucuagcuuucccuaguccagucuaaaaagaacaaacugaagacuucuaaggaaauacauacuguagugacauucuugaggauucuggaauuuugguuucuuuuaaaaacacagcaauauuauaagaacauguuuucauuuuagucccagguguaggauguggggcugcgucagacugucuaccgcagcuggacaugauuugccuccugcucuagaagaagcauaguuuugccagcugcagaugauuucuucgauugcuugauguuuggaauuaugggaaaauuucaaagaguauaucagugugagggccccaagagguaaugugugggugguuguugguuguuuagggaguuaguuaugguuugacaauaauuguggucaaagaagaaacaaaaggaaagaaauuagauugagggauuuucuaauuuuucucaccccucuuuucuauccuuguuucucuccugucuacugcuaggaggugaaacugaggggauggaaauaaaggguagguaaagaagagcccacaacauagcaaagacuggcuauaagaagccauggagaauuucuuuuuccuuuuuucuucauuuugauucuuuauuuuugcauggcuggaaaugggacucaagaccuuguacaugcaggcuauucucacucuguccugagauaucccagcaaaacaaucuaagcuuucugaucagauuccucucugcagauuuccagugagagucaacugcaaaaaaauccaaauuucucagccuuguguacaaccuuuauaggcuuuagcuuucaaguuuguaggcugauaaaaguuuaggugcagguuccauuuuagggcaucuuaaguuauuucucuucccugaucccuuaacucucaaguguucuugucacugaaagggucagagacugccuuugcaggccuaagaagcagguuaggccacuguucucaauaaucucauuaaaaaugcauauuaauaguaacaucagagaauggggaucgauucaaugugaccacaugaccaagagggacaaagauucagugaccucccagcuccaaauccuucuuggggcccuagcaggaaggugaaauuuaaauauaacacgaacaguaugccuaacuaaacagucccagucaagaugugacccugccacauugaccagucagugucuaugcuuuccugcuacguagucuaacaaauuguaacucuuucuccuggagauauguuccucuggcugacccagucuuuccuucaucuaucauaagauuccuuggggaacugcagucuuugggauccaugguuucaauggucugauacccaggggaagggacgcugugucuuuauugggacacuugugucuucuuuagaauauccuugcugacucaaagcaagucacaggcuguggacaggcaacagcagcauccacugaggcuuauucaaaauguggauuuuaaggcaucuuugcaaaucuacucaaacagaaucucuaucucagcaaggucuaaggagaucccuuauugugagagguauaugagcuauaugagcugaguagcucauuugcaaauaauuggagaagcacaauaguaaaauauuaaaacuagaaauaagaucauuugcucucuugcuccacugaauccauauuugauuccucaggacuucagugugugauggugcuccuuucuuccuuucagcuuacacuaguccgagcucuucuucacuucucuccagaccuacuacaaagacuagccaguucauuacaaugcguacccuccagcagcuucccuuuacugacacugcacuacugcaagagaguuauuuuaaguuuucgguccaccugcugugagugugcacaugugugcguguguaugagagagagagagagagagagagagagagagagagagagagagagagagagagagagagagagagaaugcccaugguugccagaaguaacuacugaggaaucuuaugaucagagaauuauucaucucauuuuauaacaaaggccagaagccuauaacuucugcuagagguuuccaacuucugccuugguuguccuucuuucccccuuuaccuugcuuucagcaccuuuccgguuuucuuuguucugugaacuuccccuuugcaauacagugcaacuggaaaagcagucuucccuaccuguuguccuccccucuaucuuggccuaguggacuccucuucaucuuucauaucaggucaaguaauaucacuacuugauauuacugaagguaacccuggacuuucuccccaagaaucaauacccugucagccuuaugccuaaacccauagaaauuucugaacaaauaaauugugaaugaaugaauguccauucauauuguuauuaugacaaccaaacauacuacacgguguaaagcuuuuggcacaagcuuggugcuagaccaguuguuacauguugggaauauuaguucuguaagaaaccagacaccaagcagugcucaacaugggcucacaauucaaauuaucuggaaaacuuccagcccauuaauguccaagucaauuauauuagagucucugggugugcaaucuaggcccauaaguguuuucaaaccuccauccgugacuccagcaugcagucaggcuggagaauaacuacuucagcucuuucacacuguguuccccuagcauuuuggaagcaaguaaguugugugacaagacauauccucauuauucauaguauaaguucauggccuugacucuucccccagaaagggaaaauaauaugaacccaaguaagaaaaauccagcaauucauuucccgagccucuugacagcagcagaugguggguacuuuccuugaauggccugaaccagauugaaaccuucuagaggaaugccaaaucacuugaacuaugauuaggaaaggaaacaguaacacugaaagauggcugugguccugaggguuaacuuuacacaacucaucagauuugcauuauaaaccacucacaauuguuucuaagaagcuguugccucgcgagagcaauuaauuucaacugauucuuuuuuuaaguuagaucuuagaaguggucaaucaggcaauaagaaaggugagagcgggugggggugggggcugaagcggggagcuccuuacucuacucuugacucuacuacuuuaagaauuugggcacuaaaagaucacacuagauggacuauaucuagcuuaucucagaguuugcaaaugcaugcauaagauugcaguguaauuccuacccauuucaacuauuucaaaaugugauauaacaaugagaaauaucgaaaaauauuuaacauuucaguuuuaagugcuuaagacagacacacacacacacacacacacacagagagagagagagagagagagagagagagagagagagagagagaaaaugaaagagagugagagagagcaaaauguccccucuaaaauuaacaacauccagauacccuucuuucugaauaccauuuacaauuaauacccaccaaaucuaagcuaauaccaaaccaacacuaaggccgugggauuguuauaaaaugcacaggacaucuuuauggaaauaauaucuuggugagauaaauuuuccucuuuuuccaauuccccauaugggcaaauugcaaaaauaaauaaauaaauaaauaaauaaauaaagauagcaugauucaugaauauaaauuuuucuuggcuguuaaaaucacauacuggcauaguccucucugagccucagccaaaugagaauacacagauaaugacaauuuuucaauaagugguuccaggaugcaggcuuugcaagaucugaaaaugaaaggcacuauuaaaaaggaauaguauuauuauuguuauaauuauuauuauuauuucauacacccagagaaaccacaaucaaugauuagccauaacaauuaagcuaaucguaauacaucuagaauaaauuccacggcaacauguacuucaugcuuaauaguucaaauuaauuuaaucugaugguguuagauguaccaguuaggagcuggagagcaccaaaauucacauuagcuuccacuuugaaagauauuaugaaaagagaaggaagaaaaugaagcuauaaacagcagugguaaguaggggaggcucagagauguuauagacgagaauaacucucagcuauuagaacuuuaacaaugauaacaugaaggcuuguauuucuaaccucacacaucucuucagauccagucauugaacaacccauuuaaggcaaaagagccauaaaagucauagaaggggguauguccugccucccucuagcauccuuucucucccacuucuccuaccaaggcagaauacauggugugcaauuucuccuguagcacaugucaaacuguaaggcagagggaugugagguagggcuaacacccaaguugggggaguuaaggacuggugagccaucuucuguauaagugucuaagcucugcuuuucuggugcucuuccugugugaggugcuguuacucaguccuggcacuguugacagguuuaucaaggcuagugguucucaaccugugggucccaaccccuuugacaaaccucuaccuccaaaaauauuacauugcaguuacaauuuguaacagaaaaauuacaguccuugaaguaacaacaaaaauaauguugugguugggggucaccacacaugaggaacuguauuaaaggguuguaacaucaggaagguugagaaccacucugacuaggcaauuuucuguugcaaagggccacccuguacacuuuaguguguucauaccaucugugaccucuacucaauaagguuacuaacaaacaccaucaucugcuauggcaagaaaaugucuccaaacacaggcaaaaauguucucugucugacuuuucaucccuucggcucuguagagugaugugcagagcaucucuguuccaagguucccaggaucucucucggagacuuuugguggauuugcagaaaaauugagaguuuuuccuguuuuugcagaaaagaccagaguagaacuaaacuaucacauaccaaaauuauuguacaugagguuacagcuggaagcugagcuagaaaacagucuccaacacugauaaaacaacaauugugccuaaggucacugucacuaaccuauaaaauccuuuggaauagaaccuagacaugcauaggcagaguagccuccaauagagaccaggggcccagagucuuacaggaucuuccacaguagaaagccgguucccacacaucauagcuauggcuugcagagguuaggauauccuaacuuauucucccuggaguaaaaauccuagggcucaccucugucuccuccagacucacaccucuucccuuuaccacauuuucuuuguagcuuuucuccauagaacacaauauauugggagaacaaauucuguucccaauagccucucagagaauuucagaaucacacacacacacacacacacacacacacacacacacacacacccacucaccccaagcauuauauugugggcuacuaguuccagauauggugaaacucugaguacuagagaacuugggugcuaguagcuagagaaagaauuaaguaugguagcuuauuucaaccuucuuccaaaaagcacuuacucuuuggcaugaauuuuuacaaugacuuauuuucaaauacaauucauauaucauauaauuaacucuucuagauguuuuuaguauauucaaccuaugcacccuagugauguguccuuuucauaacuguagacuuaccuccucugaguaguuugaugaauuuccggaaucccauaguccagaguuugucacuuagcacaguuuuagaguucaucaugauacaaucuguauuaguccuauacguuuuuucaauguaugcaccaucuuuguugucccacccccaauguuagggaauugugcugauuucacugugggcuaccaugaauacuacuauaaaauuuuacaaaguucugggugcacacaugaccaaccacuucuuuuggguggacauguaggaauacagucacuggguuaaauuucuguuugacuuuuuuuucuucuuaaaaauuuauuuauuuuuauucuuuuuauuaaaauaauaaaauguauuuuaagauauacaacucaguauugacauuuuaagucaucaaaauaauuuauacuaaauaaaugccucuuaaauauacaugauaucuucugaagcuaaaaguaaaacucaaacaguuuuuaauaucuauuugaaacaugaaacaugauagaaguagaaaaaucucuuaugaguccucuaugaauggaaauuuugacaaguuucugauuagacagaaacuguuccaucuccaagggagaauacacagugcaacuggagcuucauagaaugaagugaguagugcuccuucuguuucuauuuuguggaauaguuugaagaguauugguauuaggucuucuuuggaggucugauagaauucuacauuaaacccaucuuguucugggcuuuuuuaaguugaaggauuuuaaugacugcuucuauuacuuuagggguuguuggacuguuaagaugguuuaccugguccugauuuaaauuugguauuugguaucugucuaaaaauuuguccauuucauccagauuuuccaguuuuguugaauauagauguuuguaguaggauuugaugauuuuuuaaaauuuccucaguuuccauuguuauaucucccuuuucacuucuaauuuuguuaaguuugauucugucucugugcccucugguuagucuggcuaaggguuuaucuaucuuguugauguucuccaagaacaaaccccugguuuuguugauucuuuguauaguucuuuugguuuccacuugguugaggucaucccugaguuugauuuccugccaucuacuccucuuggguguauuugcuucuuuuuguucuagagucuucagaugugcugucaagcugcuaauuuaugcucccucaguuucuuuuaggaggcaucagagcugaguuuuccucuuagcacugcuuucauugugucccauaaguuuggguauguugugccuucauuuuuauugaauucuaaaaaguguuuaauuucuuuuuuuauuucuucuuugaccaagcuaucauugacuaggguacuguucagcuuccauguguaugucaacuuucuguugucuuuuugcuauugaagacaagucuuaguccauggugaucugauagaaugcaugggauaauuucaauauuuuuguaucuguugaggccuguuuugugacugauuauauggucaauuguggagaagguaccaugagaugaugaggagaaaauauauucuuugguuuuaggauaaaauggucuauagauaccuguuaaaaccauuugguucgugccgggcgugguggugcacaccuuuaacccaguacucaggaggcagaggcagacagauaucugaguucgaggccagccuggucuacagaguaaguuccaggacagccagggcuccacagagaaacccugucuugaaaaaccaaaaagaaaaaaggaaaacaacaacaacaacaacaacaacaacaacaacaaaaaccauuugauucauaacuucuguuaguuucacugugccucuguuuccauggucugucuacugaugacaguaggguguugaagucuccuacuacuauugugugaggugcaaugugugcuuugaguuuuaguaaaguuucuuuugugaaugugaguucccuuucauuuggagcauagauguucauaauugagaauucuucuuggcagauauuuccuuuucuuugauaacuuuugguugaaaguuuauuuuauucaauauuagaauggcuacuuuagcuuguuucuugggacuuugcuuggaaaauuguuuuccagcccuucacgcugagguagugucuguuuuugacacuaaggaguguuuccuguaugcagcacaaugcuugguccuauuuacauauccaguuuguuagucuaugucuuuuuauuggaaaauugagugcauugauguuaagaaauauugaacaauagugaguguuacuucuuguuauuuuuuauguuauuuuauguuuguguggcuaucuucuuuuggguuuguugaaaguuuacuuucuugcuuuuucuagagaguaguuucccuccuuuuguuggcauuuuccaucuauuauccuuuggagagcuggauuuguucaaagauauuguguaaauuuguuuuugacauggaauaucuugguuucuccaucuauaguaauugagaguuuugcuggguauaguagccugggcuggcauuuguguucucuuuuggucuguaugacuuuugcccaggaucuucuagcuuucauugucucuggcaaaaagucugguguaauucugauuuuguccuuuuauguuacuuggccuuuuucccuuacugcuuuuaauauucuuucuuuguuuugugcauuugauauuuuaacuauuaugugaugggaagaauuucuuuuuugguccaaucuauuuggaguucuguaggcuucuugaauguuuaugggcaucucuuucuuuaggucuguuugacuuucuaaggaagacuuuguuucuuauaacugauuuguuaucuuccaucucuagaggguagaacuccaauucuuccauauucuugcuaaugauuuuggcucugauuucuuuuauagauaucuuaaaagguaugauggagcuuauuuugguuuugucgucacuuccgugagggcuaaugauaauaaacauauaaugugagcuuacuggcaauuauaaaccuuccuuggauaaugucuauucagagaucaucuaucuauuugaaaagaauuauuugucuuuuuuaaagaucugaauacaaaucccuucuuaaacauauuauuuuuaaaacuaaaccucccaucauguauguuuuuucucagugauauacuuuaaaucacaaaaaauuuaaucuuuaugaugucucauuuuacuuuuucauuggaauacuuugaucugggcaucauaacugugaaagcauuacaugacacagcuugaagcagauuacaucauagcuaugaaaccauuauuuccuuuuuaccuuuuauacaaccacccauuuugauuugauuuuugucuaugaugucauguuuggguccaacuccauucuuuuguguaugauaucguccagaucuuuugaguuaauucuugaaacaguuucauauauuuuuggacuauacaaguuaauaaguaccaauacauagaugugugacuaaaagcacauuuuuaaaagcucuuuacauguuuuuguuuuauauguuuauucucgcuauuuuugaauauauuuaguauucuauaucaagaagcaaugccaugauugguaugcagcagccauuuaauacuucauaagugccuuuguuccacauguauucacuacaagcacuucauacacuuuaauuauauaauauucuuuuugugauaguggguugguagaaucaauauguccacauuagcaaauaaugaugcugagaguaauuuuccuuaaaauaacgucauggauggagaaacaguaauagcaaaugcgagaaggucagcacuggagagaugagcacugugacuuaaggacuuuuguuuguggagugggguacauguccacacaucugugaaguaugugucacuguuuaugcagaaccugaagaaagaaagacaucuacucuccugcucuauugcuuuuuaaccuauucccuugauacaucauguuccuguucccucauugaaacuagaacuuggcuugugaacagcaaguccagugaucuccaucucugcucaccauagucuuggaguuacacaugcaugcacacgacacuuagguuuugacaugaguuuugaagauuugaacuugagucuuuuuuuauuacauauuuuccucaauuacauuuccaaugcuaucccaaaagucccccauacccucccccccccaacuucccuacccacucauucccccccuuuuuuuuuuuggcccuggcguuccccuguacuggggcauauacaguuugcguguccaaugggccucucuuuccagugauggccgacuaggccaucuuuugauacauaugcagcuagagucaagagcuccgggguacugguuaguucauaauguuguuccaccuauaggguugcagaucccuuuagcuccuuggguacuuucucuagcuccuccauugggagcccugugauccauccaauagcugacugugagcauccacuucuguguuugcuaggccccggcauagucucacaagagacagcuacaucuggguccuuucaauaaaaucuugcuaguguaugcaauggugucagcauuuggaagcugauuaugggguggaucucuggauauggcaaucucuacaugguccauccuuucgucugagcuccaaacuuugucucuguaacuccuuccauggguguuuugaacuugagucuuuauacuuucccugugcacguucugauccacugugcuagugcugucuguauaacaauuucuuaugaagcauacauacaaacuauacaaaaacacacaaucucaaauccaguaccaguagauggcauucccaguuuuggacaagcugcugacaauggaguuggucuuccucuaauuuacuaaaugguuuaaaaucuaaucacaagagauaucaagauugaucugaugacucaaaagcuuuugccacacuccugaaauuacauuaaugacuaggugagugaaggacuaagucaauuagaaccagaugggaagccaaugacugagaauuagggaaucaugaacuaauaauauaaugaaaagucaucaauuuucaaaacugcccuuucucuaacuauaagccagaaauggcuuuguaaaggcugaaauuauaaauauauuugaucuugggaacauuuucccacauauacgagaacugcacuuucccugacucagacuuagauaucuggaacacaagucugguuaauuuucaggagaaaaaaaaaaugucguugcaacagccaguugacucuugcaaguucaagcauguuuaugguagaaagucagugcugguagcuucaagucuaauucccaccaucuuuacugaguccugaaaugauuccauaauaaccaacauucacugucauauuacauggccuucauucuaagugcccacacauaagucuuaugaagugaguacucuuacuucccccauauaugccaggauauaaauugacuuucuaagggcuguggugugaaucugaacccugcccuccuguauaaauaauaccucucuaugguuuuagaacagcagcaaccacacacacagguuaaacacaggaagcccaacuucaaguugagugguuuuuccuuuuuuuuuuuuacacuaggcaaagcugucuucaauauacucauaauaacuuuauacaccaaauaacauucuaagguuuauuuccacacaacacagaaacaucccugugcuuccccugggaucuucagcauugucugcuguggaccuggucugggcuuagcaagcauugcuuuaucauucuuaaauaaaaaccguuacagagaaugcagaaaacaauuucccuuuuagucuccccacuccuguccauauugagagagauggauucuaaagcgcugaaggaaagcucacaauauaauaaaaacucagcaucagaaaugugcugggucccucuacucucuuccuauauuuaggaaguaaaauuuaauauagggcuuggcccucuggagaacccuguaugggaauguuaauacacuuuuauauguauuuuaacugagauaaacaagaagcagauagagaagccagggcagugacagugaagacacaauuaugauaagacuaaucagccaacagcaauggaggcagauaguggcacuacuauggugcugcuguauagcuuguaugguuagaaaacuauauucauagaaaauacggaggaggcaggagcuuuguuauaggaaagcaaagauaacuuaccacgugacuccagaaaauaaagccuauccaggagacugaggagcauuuguucuauuauuaaaaugccauccaaauguauuuuauaaauggaacccugcaucaaaucaguugaucaagggaagaguaauaaaaagguggacacugucuguaaggaaagagagggaaaucucaauucuguuuucuauaacugagccaaugucuuagaguaaacuugcagauaacuucaaaauccugcugccagaacuaagcucaugcaugugcuaccaacugugcugcacuugucaguccugaacacaggaacauccugaaauguuaaggauguaaggacagguaaggacaccucaugggccaaaccacuuggccauaugcaaagggaaaaugguaggucagagcaagcaagaaagcagcuacuuauuguaugaccacuguucccaagcagcagaugcacauguggggaaguaguuucaagaugucaggagacaaacagcaugcuuucucugcagggccaggauagacacucauugaucccagaauccuuuuuugcugggggugaaugcaaguuuagaaccuucuugcugcagaaucuuuggugguucuuuucuguuuugucuaugucgauuaagacacagagucagcaugcgaagguacacauaaggaaagaacgcagcacagaacccacagcauccacugccucccuaccuuucugugauuuacauacugagugacuuaagcugggagaguugaaucucuagagcugaauagucaacaacuuucuaaaccagggggaaaugucuccacuuuaaugacuauagcaaguuuaccuugcuauuaaauuuuaaucauguaagauuuacugcaugaugagacugguuuuccugcccuuguaaaauauacugaaauacauaaacaguaaaugacuucacugagccugcugaaauaauaaaaacaaacaaacaaacaaacaaacaaacaaaggcuacaggaacauucagggagcugucugaugucucagaacacagcaauuugcaauggcucacacacaaaaugaccagaacuaagaauuaugaaaaaaagccaauuaucuuuaaguacaugucugcuuacuaguacucacuauaauaaacgaucuuaccacacuagagaaaacaaguauagauguaaguacagaaggcagaauaaucuuuuacuaguaagagccuuuucccuugaauaugagcccaaaggucaagaaauggcacauguaaggaccuguucacaagggugcugccugguaagugaugccugaaaaaucagaagccagcaaaugaugagaaagacugaggggugcaguggguaucugagccuugauagucuaauaugugucccucuuuaguggaagccagaacuaaccucaucucuauguacacuaugcacaucucacagucuacaugcuguaaauacagcgagcucccaccaauaagaaggagcaaguggugcuugcuuuuaaucacaggaacaaaucaugcuggcagucacucuacuccaguauguagcccaggagaagaauaaccuaagugcacacauauaaacaaaacugcacacaaauguucaucacaacauuauuuagacuaaucaaaaugcaagaagaaaaccuuuucaacaacugaagaauggaaagaauacacacacacacacacacacacacacacacacacacacugggauauuagguuuuaaaagcuauaaaacaugcaugguacaacuugcuauuaccuugaaaacauuauucuaagugaaaggagccagacgauuuauaaaaugauucuguugcuaccgaauauacagauacacauagccuaccagccagggcucaguggcuaguaacagagucugcagcaguggcugggaauguguuaggguuccuuuugaagaugaugagaauauuguggaauuagaaacugaugacagccacacagcucugugaagauuaaaaaaaaaaaaaaucccacaggacuguccuguuucuucagauaaccaauucaccuagacccaaguguucuaguaaauaaaggagaaggcauauucaaaugcugaugaucaucauugugaucgugauggcuugacugcuagaaugcucuuggaaaagucauugguucuggaaaaccagaaagcaaaaaucugcugagguauauaaggcuuuuuaaacacucagcaggcauuagaaugggaaaauuaccaaaaugaugaucuugguucucuugcuuucuuuauuuuuagggguguucagcagcacacauuaaagaggucuagagaccucuugagguuaccaggaccccagccuggucaggaguguaauucaggcaacccucucgcuguucuauccauuccccauuaggcauucagagccuccuuguuaauauacuacauugugaacuggaugcauugucuggauaaacugcauugucccaaacacugccccauuauuacagaaaaugcagaauauaauuagcauuccuuuuugcauaagccacagcucccaacaacacugccauauuauaaaagccuuaauuaauaaacaagaguugggccaugaccaguuacacuuauuugaauuuuguauuguggagaaaggccacuguucaaauuccauuuacaaauaucuaaauucuggcuagccuacaugaagacaaucuucuguggugcuaauagcauuguguugguacaccaacaauagcaaacgauuaacugcugggacguaaaccauccugagaaaugcucggagcagggugaugauaacauuguauucuggcuguauuauaugguacaauucuucuauuuguucacauguguuuuguauuuaauagauagaggagccaggguggcuuuucauaucacuguggagccuuaaauguaacaaaagaacaaaaaaaguggagcaaaaguaaaagugcagugugugguagugccggcugggaggggauuacaucauggcacaguggaaugcccacagcgccuuccugcauuucagcuggguuuauugauuuuuuucuuucuccuaaccugcaagccagaagcacugaacuaauauuuuggacucuaacaucgagaagcccaguuauugagcaccaaccuaaggagaauuuucauuaaauugcaccaaccuaccugauuaaaaccuaucaacucuaccauucucacaacugcacaauacuuguuagauaugcucugaagugagcauucugcaucuugaggaaaauaaugaccagagggcaucuaagaauaagacuucaagcaguauggcagagagaaaacgagcugugccuuggaaggcaagucacacaaauaaagaccaccagggcucaaaucugaacagaauacuaaauucauugugaacacugggcuguguaaacaugguaauucuuucagcaaagucuguaauaaguuuuacggccuugugacagcagaguggcucuggaaguguuaccguucagggaagggugaauggaccagcaacaaaauguagcauuauaggaagcuugggggaaugcccccccaucucccagugauccaggaguauaagcccagagaccuuaguagccuaaacaagcugucuucaauugaugcccauuucaucaguuccaggcacugagcacaggucccaugggucucaggaggaccuguuucagcauggccaaaacaacaacauuugaaucaagaacaaccuagaagaaucuacccaggaagagcuuuccccaaggggcuguugaaguuggagauucacacauccuacagcugugugagcuuggacaagcaguucagcucuacauccuaacuggcagcugaucaaggguggagcaacugacuagcuuagaagaggauuugaauucaaucucuugcauuuccaaaaguacaaaacccuacuuacuuuuaauaaaaaaaaaaaaaugaaaguuuauuuuugacugggaaaagcuccuagaaacuguucuuucucuuagcagaaacugacaguacccucagucaagucccaggacacuugcaacaguggcguugauucaaagaaaaauauuaguacugugauuuucagguuccuuagcggucuccucugcucccuaagcuccucuguuuggguuuugaaggacauuuuugcuauuggugcuguugucauuguuguuuguugggcucuguggugguuuugaaugaaaauggugcccauaugcuuaugcguuugaauacuuggucucuuccugggaaaacuguuuaggaaggauuaggaggucuggacuuguuggaggaauugugucacugguaguggccuguaagguuucaaaagucucucucugucucucucugucugucucucucucccuuucucucucucucucucucucucucucucucucucucucucucucucucucucucccucucccucucucucucucucucucucucucucucucucucucucucucucucucucucucucugugugugugugugugugugugugugugugugucucugucucaugcuuguagaucauguaaacuccagcaccacaucagccugucugcccugauggucaugaauccucugaaagugcccccacccccaguuaaacauuuucuuuuuuagauugccuugguaauggugucucuuuacagaaauguaagaguaacuaagacagagucucauauagccaagccuugugguccugaccuucuacuccuacaccucaauccuaccugcugggauugcagguaugcacuaccccaucaaucuuagaucccucagaacuucuuaaguacaaaaauuucccuccccaccccugagccucuucagagcuucccugagcugggugguaucuccagcaucauacuccaccacccucagucacuaaccgccaagagaguccucagacauuaccaaaugucuccuggggacaaaauuacuaucuguugugaaucuuuacuuuaaugucucucuucaaauuaagauaccagaaucuggaugaauauaccauuuuuuauucauaaugccuaaucauuagucaugaaugaagauacguucagaaaaucauuuugagggaacuuuauugaguguuuacucucugucagguaaaaugaaugcagauauacuguccugcccugaaggaugucacaguuugagugcaaaauagcuuuguacaauuuauuucuaagggugaaaagccaggauguuaggauugaacaggaagccuggaggucagauugacagacacuucaacauugcauaaagauuauuguaagcuaacauggugugcacaacuguaaccuuaccuacucagaaggcugaggcuggagaauagaaaguuucaggcuagucugggcaaccuuacuauugaugcagccauuuuaaggcuaagagaaauagcaaugcuagacuggauacacugaguaaaaccuaauccucaacaaugggaaggcccauaagacagagccuuaacuaauccuauaagacacaaaauaccaagaggagugcuaucacaucuggagagucuuguuggugcuccuugccuugugccacaccuuaagguuggagauaaugauguucaguuagaugaauuaaaugccaucggcuuuauugggcccaaauguagcaagaaggauugaggaggucaugugauuaauggaguuuuggcugaaucauaguagaucuagugguucccugaucucauucucugguuauuugcccaauuccagaauguauaauucagauaaauagacugaaaaguugucagaguucucauauugguucccugaccuauagaguaagggcuauuaugguuggaaaggcaaaugggagucuuuagaacugccucugccaaggaaaauagugagucaacaacuuuacugcaagacuggaggaauuacagaaauuaguacaaccagugagaacuucaaagaugcagaggugguagcucccugugcaucucccuuuaagucuccuaucugguugugcagaaaacagauuuugaagaauaaguuugacuauuaaaaaacucaaucaacuagugacuucaacugcaguuuuugugcaagaugugcuguccuuacuuaagcagauuaacacauauccuuguccgugguauacagcuauugaucuagcaaaugccauuuucucaguaccuguccucaaggaccaccagaagcaauuugcuuuuaguuggcaaugcuaguaauauacuuuuaccucaaagauauauuaucuuuccagcccuguaucauaacuuaguuagaaggaaucuugauuauauuucuuauagaaaauaucuaucuuauagaaaauacucgugcccuauauugauggcuuuaugcugaacagaccaagugggcagccacuguggacucauugguaacacauccuuaucagaggagaaaaaauaaauccaaucaaaauucaagggauauuugccccagugacuuguuuaggugcccaaugguguggggcaugcagagauauuccucuuaaggaggcauaacuuguguggaucuuugucucgaauacauuauuguacuuagccacucccaccaccaagaaagaaacacaauguuuagugggccuauuuagguucuagagagggcacacauaucaaguaauuuaaaaaguuacuaguuuugaguggggagaggacuaggagaagacucucuuugccugcuugcuugcuggcaaguccauucuucagcggcauuagagcuuauuuauuugggauuccaggguauacugaggacaagcugagucaccacugaauaacuacuggauucuuugcccuucuauugguagauagacaucauuggacugguuggaccacuagcuggucuagccuguaaaccagucuaaacauuuccuuuaucuauaaucucuuucagcacuguuucucuagagaaccaugaccaguauaucaacuuagagaggaucugucugaaaaugaagugaugauguauuuagugguagaucacauaccuuuauguaucagguccugcauacaugcucuaguaucuucagccaccccguaaaaauuauauaguuggucugaugugauauauauauagucuacagaguugaugucauaugauuagaucaauuuugauuuguuuuaguggcuugcuagagagauaggugggagagucuaaaaccaaaaaggagaggaggguugacauaagaucagaagcuaaaauagagauggaugaggcugucuggccuuaaauauaaauucugcuacauucuguuuaugugguugugguuuaaauaugcuuggcccagggaguggcacuauuuuggagguauggccuuguuggugugugggauugugaaaggcagccuguuuucugguugagcuagguuuaacgugacccagaaggagagauuauacugcaaaggacagcaggaguuuuccacaugcucuuagauaccaggguccugacaggaggccgaggccgaagcucuccacuccauaggucuguggccaucagucagauagggcaacaccccaagccccuccacaaguagagcgcuugacuacagaucacauagccucaagacagaucucuauuuuaaugaugcaccuaaaggccuguaggucuuagccaauuaaacucuccuucccauacaguccucccugcaaaagguacuuuuuucccacauuauuuauuagauauuuucuucauuuacauuucaaaugcuaucccaaaaacccccuauacccaccccugcccuguuccccuacccacucacuaccacuucuaggcccuggaguuccccuguacuggggcauauaaaguuugcaagaccaaggaaccucucuucccaaugauggccaacuaggccaucuucugcuacauaugcagcuagagacacgagcucugggggaacugauuagauuauauuguuguuccaccuauacgucaggcccgaucugaacaagugguguaugguuguacucagcacaacucuccaccaugacaauaaacgucuuaaaaccauggauuaucucuuuccauccagaccugccauggggaacaacagaucaggucuuccucuaaagagcagugucuaaucucccacaugaggccucccugcgcucucagccuccguuuccaccaagccaaugcaucugagcaagccaaggacacuauuguccccuugagaaccugcacuuuucccuuuggccuugggccagagccagcuccaugggcgccuacucuguucucagcucuugcccaacauccagcagcaugcagccuggggacucacaagucugcucccagcaguuccccagguaccucagacugugccuucccaccccuggagcaggguccugcugcuucucacagucaaacuucccucgucuggccuugcccaguggcccaauuuuaacccacauuggaguauauguggccuuuuuggaggaaguguauuacuaugggugugggcuuuaagacccaccucuuagcugcuugaaagccagucuucuccuaacggccuucagaugaagguguagaacucucaacuucugcaccaugccugccuggacacugccaugcucucaccaugaugauaauggacugaaucucugaaucuguaagccaggcccaauuaaauguugucuuuauaagaguuccuuuggucaugguaccuguucacagcagcaaaacacaaacuaagacagugguucuugaaaaauccucagcccuugaaguaagcucauuuuucucuaugcaaaagagucauucauugcacucaccucaugguucuguugaguacucaguguaggaauccuguaaagcacauggcacaccugccacgaagcucacaccaaaagugcugguuaucagcauuguacugcucuucuguuccucuguuaaauagcagcccaacuucucaguguggcagauaugcauaagcugaccuuuucagcaaaugguucaagaguguuaaggaagucacauuuuacaccaucgucaccaucaauuuuaauaaacauuaaaaucuuuauuuuucccacacagaaacucuucaucccacucuauacacaacagaauugagcuuuuaagccauucuugucuaggaagauagccucugagaacugcagaugggccuuuuuauuugaaacuaagguugguuaaaaacccaaguaccauggaaacuaaaugcaaugcucaaaaauggccauguaugguuaggcuauuaucuaccuagcaccaugcgggugauccacugcuuuuuguuauuguuugccaaauggguucuggccaugggcucuggccauuggaguuauuucuaucauggaagcuuccacagcacucccucuuucagugaagaaggaagcaccuaaguaauguuauucuggaagaucuggaaggccuacaucauccccaauuucuacuccucugccuguaucaucuccagcucauacugcuaugccuucaugacccucagcuucugcuccucuguguguauuacuucccacuuucgcugcuuaccagucacacugugccagcauauuuccagucugcugucauuucugauuguggauguaucccaucacaguagaacugaagguguuuguagagaggaaccccaucucaacuauugguaaccugucuucuuaucuuacuggugggugguuggguuaaaguagcaacuaagaaugcuggaagcaaacauacugugggagaaauagccaggcaaguaacaggcucaauucuacacugaagcccauucuucuauacuguuggagaggugucccaagauauuguccucucugacucaacuaaucaugaacuugguagcucucuccuauguguccaggcauaacaagcucauaacaacccacaggaaccugagucuacauucagcucugauuaugcuguggucuccaugccuucaaggcuugguccuuccccuucauccuucuucagucacuacugccuacaaaaaucuuacuuccuuuaaggacccucuucuacagagguggagagggcuguggggagacacuggaagacagugagaucuccuaacuguauguauauuuugauugacuucagaagauaucuuuaaaguguggcaguguuuucuacuuccaguacuucagggaagucuuuacaccucccugaguuuauuuucuuuucugaaaacuugaggauaugggggacagccauuuuacaaggucuuuggaaagaccaaauggggggacgaauguaaaaugcuucaguggugcgugcuccaguuaguggaguuggggugcagauuacuaagaaucuuuagaaacaccccuuuccacuuugcaaaccaauaucugcuuucaaaacuuuccuuuaucagggaacaauuuagucaaagaaaaagugggcuuaaaaccagggugguagcuugggacaugaaaagagacccugagaaguuguacccacagcaagaagggcaagagcauacaggucaguuuuguccguguuccuauuguccgagucugauuaaaaacaucccccuaguaguugaaaaaaauuaauauacaugagucaaucacauugcaucuauuguacagauacaucccacuugguaaaaaauagguaggcuuuuauaucugucaaagaauaauucuuaacacuucaauaccuguaauaaaguauuugagcuacaagaaaagacugcguuucgaagucaugacuuucauuguauacuaagcuggcagugaguggugacuuugccuuuagcugaggaagcccgauaaggacucugugaacucagcucagaaugcagaguacuagaaaaagcccuaaauauagaccacauauagugucacauaaggauaucaaacaauagucuauugugacaaucacaaguccccuucagaauacuccucaaagacguggaaaagggaaacucgaaugguuuugacugcugugcagaaguaaaagcagauggccugccugccugguucaccccuuuauaugucuuuuggggagauuuaagguaaaggagcgacaauuggcccagcuuggcaucuccuuucuggaagagcuaauuaacucuugugaugcccaaucuguccucuggccggagaucauagcgugguagagacucuguagcacugggauuacaaacuaccauugaaagcaugggguuccccucuccccacuacccuuucauucuggauuucauucuuauuaggaaaaugucagcaauagaaauaaugcaaguaccuaaggucauguuagacaucagauucuaucuaacacacuacuguauacucucuagaaagucauaggugcuaacaugaauuuuaacaaacaugaucaagcugugugaugucacacugaaguccagauuucuggcugcuuuuccuugaaaacauccaaaauacugggcagaacagacacucuucaccacaugucaaaggauuuuaagucccaaacacagcacccaccuuuguccucaguaugacccacuggcauuaauuaaggcaaacucccucuggcuauacguggugaggacccaagagaauugggagcaaagagggcugaggacccagcuccagaacaccagagcuagggaagaggagaaaaaacuaaugcucauuccuucauacaggcuauguuugucucagcuccccucacuuuguuuggcuggacacagaaaggccuggaggggaauucugauuccagcuugcucuuugcacagcuaauuauuuggggcucccagaagguuggcaagaacaaugacuuccccagcaguggcaguuggacuagcucaguucccgguuuuuggcccuggggucagaacucaaggaaggggagcuauuuguuuuggccuuaaacuaaaucugccuagagacacagacacaaguucugaccugagugcaggaaggcuacuauuucaaugccgaguuaaguuccccucccugggcuucccuagcaggcuacacaccagaaacauguauuucccucuucgaacuguuugcuuaggaaaaagaaauugcuagauauuccagacuugcagcagcugcccagguaagguauuuaacaagacaagggcuaauugggauggaacaguagaaguucauuuguacaaaauacacuaaugaaugcauacaacuucacucugauagaggacucacaacaauuuucuucaaagaccugguagggugggaucaggggaaaauaauaauacuccauguuuuuuaguuaacccacuaaccagauaggacaaacucuagcagucccagagauacuguuaccacaagauauucucacacauuccucaaaucaccauuaucauauccaaucugucagacccacuuaggaaacgagaugaggcagguuugcuauagcaagcugggcacugccuuccugcaucugaacacauuucauuuuuuugcuaauuccaguaggaauuaucuggauucuuagcuagauaaaacccugaaugacaaggaaaugcucucugucucucugaccacugcugaauuguauuuuuauauccaauugugucauacauacauaguugcaaggcaccuccaugauaacaguauugugaauaucaggugagacaggugccggaacagaacccagcagggagacagguguuaaucaaaagaucucaccaauaucaaacaaguccuuugaaagguacacaaggagaaauaucugaaaacaggaagaucuauaacaaaaugguagccuagcuggagguaaagacuagggauuggaaggcaaagaauuuacucuagaaguaacagauuuauagcuauagguaaaguaucacagauggggcagggguauugaaugggcaaaggcuuauaguaagaguuuguggagaguacagggccauaguuugaaguccagacuguagaggaauuugcaaagaugguagugaagaggggauacagguacagccuagagaagacauuuacuagcuucaagaauuuugagcaacaggaaaccacucagggacuuucuuuucggcaugguacaguaauaguagaagauacaaucagauuuaugguuugaaaggagccaggcuggcaggagcuaauagaugcagauagaugcaggaggaccaagcugucuagaucaucaacauuccauacuuaggggugggaugcuaguuaaacuuggauuguaugcuccuauaggugcuggaggaaaggugacauauuugaaagcuuuugccauggagucaaccuaauacccuggugucauccuaaaagcaaaagccugguccuagcugagggacgcagaagugccugggaguguuagaaaaggaaggggcggggcuugcaagaugggaccuccugugaacagggaaacaguuucuguuuuaguuuugacggaaagacaucaauguaaaauacaucaauguaaaauauaucaaugcaaaaauauggcaguagauacaagcagaaaggauguugguguauuaaucaauucagccuggauuagcuacacugcucacuuccauagcuucuaagaagaaaccugguuauuuugaggcuuuuccauugugccaaauucagcuuccucagugugacaccccaagaccaaagcauguauguccacucuuuucagugucuagaagcccacuacuaaaccguccaggacugaaaauccucccaugauccgguauuggcuuaccucccugguuuuaccuccuuccagcucuccaucaaaacuaagauugcaaucauucuauucuuggaagucacaagagaugaaguucugccugggcuguccauaugaaacuauugcugacuacacugaaacacccuugcucugacacccugauagcuaccccuuccucucugcacugcccaaucccacuucucuggcugucaccugagauggucuagccuuggguugcuauccucaaacuggagcuguguuaaguauuccuuccaggcuuuuagcagagcuccugauagcaggugcuuauaauuagacaguguauauacuuuuuaaagacaggaacuuaaucucuauuguccuuauauuaccaaacacaauccaacuauaaaauacaaagugccaugauaugaaauaaaugcaggaugagaaacacugugggcagagaaggcaaaggucaccuuugguugagacagucagagcaagagcagcauggcccuugauagcauuuaugacucaugaacuauuuaguuauuguauaaugagucauacagcaugauuauuuccauuaacaaacaaggaaccagguguuuagagaauaaauaaguaauccccaggagaggcaggauuugaauuauaggccuaccauuuccagaaacggagcacagucuuuccaucuacuccauugguuugcucuccacucucaacuuaaaaguagccauuauccguuuaguuauuaguauccuaugugauaaugaaagccacaaugagauuuauggcagcuucauuuccaaaaccuaauagagguuuccuucuguaagagggauccuaagugucuucagcuuaaaguaacucaagguucugagauggucugugcguuuucagacaggagccuggcauccacugucuuacuccacaccacugaccuuugggaaugaaauggaaagugauccaaaccagaccgugagacaggacaucaaauaauccuggacagcugagcuacucugggucagaaagggaagaaaacugaaggugacauaauaucuugcuuuacucagcuucccauuguuaacaaaguaaggcaacuaaaauagagguuuaguuucaaucaguguuuggagguuguaguccauggucaguuaggcaguccaucacaaugggaucaccacaaaaacagggauggaagagggaacgguuucaucaagagcuuguccaguagccgggcgugguggagcacgccuacccagcacucgggaggcaggcagaggcaggcagauuucugaguucaaggucagccuggucuacaaagugaguuccaggacagccagggcuacacagagaaaccccaucucaaaaauccaaaaaaaaaaaaaaaaaaaaaaaaaagaaagaaagaaagaaagaaagaaaaaagagcuugcccaguguaugugggacugugaaaggcagccuguuuucugguugagcuagguuuaaacccuggaaacacagcagguguuccugcaagggacugaaggcccauuugccaugcugccagacaaaaggcuucugacaaaggccccagcuccauaauucuguggccaucagucacguaagacaaugccccaagucccuggucuucuguuuggacucuacucccacaguuacuuggcaauagccauguaggcccagcccacuauaaaaggggcuguuugccccccccccuuacuccuguuuccugcuuguuucucucuugaccucuuguuccccgccucucugcacucccuuccucccucucucuacauggccauggccagccucuacuucucuacucucucccucucuuucuuucucugccucuacuccaugaaaauaaaugccuuaaaaccaugagaucugcugugcuagagcaguggagcuggucuuccucuaaagaccucucugcguucucagccauggucaccaccaagccaagcaacucgcagaccaaccugagaacucuccucccgcugccagaaccagguggagcacaguccucccugccccuuucccuccuacccauugccagaggcagccugcaggcccacacuccguucuucgcucuuccucaacauccuguggugucugcggugucuaauaaugagaaccugccuuccuuguccucccuacaagcccagggaccccagaacugacucuuccguagcacccagagcugucucugguuccugagaguccgaaugaacuccugcagguccacagggaccacaggcugugcuuccccaccccuggagcaggguccugcaucuucuccuacucagugguguggggcguguguaguguguagucaaacuucccauguccagccuugcugagcggccgagccgugagcugacacagggccccauuuuaacccacgaauguccugaagaccuccaccagaguccaacucuuaaagaguccaccaccucccaaugacucuaugauggggucuaacuuucagcaucugugcuuucacagacacugaagaucaaacuagaacaaguauuacaucaacauaacagaaggacucucaaaaccauuaacacuaacaaagacccaccuacaagaaaguaggauguggagagaaaaguuuuagaaauguagagaacacuagagaaucaguaagaaacuguuagacuaugagauuagagagccagcuccaucaaucuauucaagaaaugcagcaugggagauguuccaaagaugcagauugaaaacaugggaaagguacuuaaccuucagagaugaaagagggaaaagagagugggccgcaugcagcaagcuuaaacucacaauagaaagauaaaacccaaaugugaaaaagaguuuuuaagucccuaaagugaccaaggcaugaugcccagaagcuuuggucauuucccccaugaaacagacacuaucuuuuccuccuaggaaccaaugcuggugacgugggagaaggcucagugaguaaagagcaaggugaggaacucagugcagaucugcagcacccaugggaaagccggugccauggcauccugucagagcacaguccaggaauggaguccugugaggggaaucugagcacuuuuugaggaaaaaaaaaaaagaaaaaaaggcuacagucaugucaccucaguuccuuuaaaccacagaauugaucuuggaauguguuauuucugcuccucccagguguagaggguaggagugaguuuacuucagcugcugucauucauaugccucuguggaaaaacauguuuuugccaugugugguuuguccuugugauuguauacugcuugaacucaugagagcguuuaucagguggccuuucuuaauccucaguguuaaauuaacugucugaugcucugaauaauguuggcuauuguaugaggguuuaguagaaagccauccagaaucuccuuguagccucuacauaugcacacacugaugaucaaaaguucauggacacacaccacacacacacacauacacauacacacagguaaggaauagaguaagagacuauauuuugcucaaaguuauguacuuaguaccuagagaagucagcuaauaucuuauuugucucacuccagaggcagggggcacugaccaaugccauacagucauucuggguagagauguagcuugaggccaggagagaguuuucaggacucaacaggaugaacucagucaagggcacaguagacugagaaaggggcaggccauuugaggaucugccuuuugguagaagacaugccccuuugguaucuggagaagauuaagggaaccucaaguagcucaggcacaaaugcccucaucaucaugaagcaggcacagcuggugauuuccccacuguguuggguuuugaguuucuucuccauaguauuaccucagugugucagcuauaucccccuacaguaacaagugucacccugcugugugagaauuauaaagccuucuugguucaucccuugaucauucgcucuguuccuaaauacagcuuccaugaggccuugcacagcauauaguauccuccucuuccuuaagcuauacaugugacaaacucuuguuauucucuccucucugucauguuuccagcuaucucugaaacgaaaggacaggaauugugccucccucccacaucagguggacagaacaauaucagauaacagagugucuacugugaacauuacaugagugaagugccuaucuuagaaauuacuggcuuuauuauagcuggaaaauaauaagcuauacuuuucuaauuucauauuagaaauugaaagucagagagggcaaauggccacuugagguaagacagaaguagccucucuuuccaauuaagugauguauucuuuaaaaauaaauuaguauuuuuauagugugugugugugugugugugugugugugugagagggagagagagagagagagagagagagacccaugaagcuguaguuacagguaauugugaauugacaaacaugggucugagaacagaacucauguccucugcaagagcacuuaaccauugagccaccucuucagccccuaaaagcagcuaguuauauaccacaagccuugcuaugcuacauugaaauuucauaucugagcuccucaauaucuuaaucaugccucuagugaccagaaucuagucuuaaagcuaucaacauacuuaagcaaucuacaucaacaucccaggucucuaaggauuccaaacucauuugccaacacuaguguugcugaccccaggguucuucauauuagaacaaauucaggcacagacucuggggcaguucuugaauauccuaugaaaaugaauugcagauagucaagcaacccaacauccuuuuuaaagccuuuuuuaugaggcaggucugaagcuggaaaagcucuccuuuaccacaaaggagaucuaggccaaaaaggaaaaauaagaacuuuaugaacuauuaaaaaaauaaugccauggaguuagagaguuauggauuaaguuccgacccauuaauucuuuuagucccugaguuggagucggcugaagacaugggguccucuggugaagacggaaacagucagguccagaacaaucaaaaaggagagaguggcugucaaugcgaagggcagacucacuccucagcaugauaauucagaaagggaccuggaauuccaugaucucaccuccacuagguaagggaauaaacgguuggcuccuguuucuucugggaguucaguuacauuaagcaauauccugcuaaggccgacuugcuauauuucccuugaaggaaauugauuucuugauucuuccagcaaauauaaucccaacucagugcuuuagguuuccucggggcaccacuagcugaaaucuagucuaaaguacuucuagggagcucaugagcuagagacaggaauggaaggcaaggcacaggaagcaugugggcuaggcacagucaugcuuugaacuucuccaaugagaacuacuaaggauuauuggagggggguagucuucgcugaguggguauguuugacaauuuccaugggaaauuuguuuuuaaguauguaaggccucugaaaggauaaauaaaagauuauaugaggaagaaaccaugguuucugauuguuuaaaaggcaccuuuuccagcacaaggaaaaggcugggaucaauaaagggucuuuccuuuagagggagaucgguuuccacuuuaacacagauaaauccuaugguaggucuuugaaagaucaagggaacaucaaaguaugcagagcauccugucuugucaggaaaauaaaacuuguccauuuacaauuccccaacaguaccagaagcacagccaccugcagcccuccucagcccucugcaugccuguugcucaaaggcuaacaugaagcaucaaaagaagcccucaacaggaagaaguuaugagucauaaacaauuauguucuaaaagugcccauuuagaaauaugagguuuuaauguuuuuauuaucauguuguuuacagauaaugauggauuucacaaugacauguuucagauaugugcacaguguguuuaguauaucuagacccuggcacccuaccuugcuccucucccagucccauucaucccauucauuccccuuccucagucgugucuuuucuuguuugcuguuguuauuuucucgguguguacaugaaccaaugaauuucauugguggcuuacaaaagcauggugaagcacuacuuacagcagcuugggugcagugucagugucuacaccacucaagaaaaugggcccucaucaucugaagagcaagguucacaaaagaaaaccccaggaauaggcagaggccuggcaggaauccugcagggcaccaagucucugauaucagaggugggcuuaagccaaaggagcuguguuggaagaucuccugguacaacuuacuaccaccaccuacccuuuucaugugcccaguugauguuauaaaguacccccugaacuacuguaaagacuagaaagucucacuaccuuuggcaguucuuacaacaaugaccuuuucauccaucuuacauucuuugacagaucugaaucuucauugcaauggugguuguccaaauacuuagacacccuacacaaagacauucucaccuguaaccaauuucaaagggaaucaagaaaggaacucaaggaggguagaaaccuggagucagaagcugaugcagaggccauggagagaugcuguuuauugguuugcucccccugccuugcuccaggacuacuauagaacccaggacuaccagcccagguauggcaccucccacagugggcugagcccuucaccacugaucacugauugagaaaaugccuuacagcuggaucucauggaggcauuuccucaauugagacuuccuucguucuuucuggucagucuaacaugucaaguuggcauaaaacgagccaguacagguguggcacucucucccagaacauggagaguuuaccagugguuacaucauucucucuuaacaacuaucaaccacccauccucccugcauaucaggagggggcagggccccaugagucccucccccccccaucaaugacuagauguugagggacccagucuuaugcaggccccacacaagcaaccauaauugcuucaaguuaauggguacaguaaccauggcaugcucagaaaacagcauuucacagccuccccccccccccgcccccugccccaucauucuacuuaggaacuauucaauuucuuuaaaagcuuuuacauuuacuguguguuuguguuuuaagacaaggucucacacagcccaagcugacuucaaaguugcuuuuugacaacccuggacauaaacucaucuuccuguucuguuucucuaaacagaugagaguccucacauauucugccugccuaggacgucuguguuguuuuguaaggaccuacuaauuuccuuauguuuuccuaugaaacuggucgccuuacugaucugagauaccucuccucuuaccagugcaugauagaacauuaagaaucuuaaguuuaguagggaacagaagcugaaaauuagugggcuugcuuuaacccuuuaaauucaguauuuaaaaaugugacauuugccagaaaauacagucagcaauggguauggguggggccgaacuugcugguacaugcauuuaaagggcacucagucuauagucaccauauccccacauucaaucuugauuagcuggaaauuagcuggcauucuacaaauaaucuggugccugggaggcaccugaguuugagagcuagggaggaacccagagacgggauacugaaggauuucccuaguuuggaggggaugagccuugagaccuugggaggauuuauacauuggaaaaggugcucugagaaggucauuucaggagaauaacuuugaugcugaauuccaccaggauucucuuuuaauaauauuuacauugcuuaaggaggcagaugauuugcugcuuucuuuaaaaggaaagccgacuuacgggugagaaucucacucccugacaccuugccaucgcauaggccuccuggagaggaaggagcgacaguaagagaggaauuggguccaaaugagcuccuggccguggcuagcuguuaugcuuauggauuuauuggugauagguggacaugcacaauaaauaaacccuuucuuccccacccuguguuuuggucauguuucauugcagcaauaaaaauccuaagacaaccucaugcucaugaagauggccuauaacauacaguccuacacggagcagaagguaaaacauuauaaaaagacaugaacaugggagggacacuugcugggaggaguagugcuuuggcaggagcagaaggagcaugguggggugagaaugaccagaauguacuauauaaaaucaucaaagaauaaauuuuaaaaagauuaaacgcauaagaccaaaugaauuuccacacucccauccagauauucuauuuuuucaucaaaucuuagcaaaaguuacgugauccuaaauauuucuucucuguaaaccucauaauucuaauuuguauaaaaggaaaaggaaagaccuagccuggcauagagcauguguucucaaacaugucguuuauuaaacugaacugaaagaaaagcaaaagaugaaaggagaacuaaccuugucucccaagagcgacaacauucauggacuaauucuucuuccaugaaugccaucaaacucuagacagcuucuccuggagacugggucuaacuucauagagggaaguucaaacauuagcgcguugcagcaagacucccaguaagcagacacaagcccugaugcaaaacccagugcagcggacaagggcaagggaaccagugaacagcagcuaaugcgccucgagggaggcuuugaacacacuuugaagggaaugcaaugaacacuaagaacagaaucaguuccuguguggacaccagcuguuguaaccauguggcauuauccuuuuauucacagacgugaaaaauccgagucugaaaagcugaaucauuuguccacagacuuacucaguuggugcuccaguggaguuuggccaaguccuucuagucugaaaacucaagacuagucaucaccaaaaucacugucaacuaugucacccagaaagucagcuucauauaacagcuaguguaacgcucaacgaugucacccagaaagucagcuucauauaacagcuaguguaacgcucaacgaugucacccagaaagucagcuucauauaacagcuaguguaaagcugaacugggcaucggcucaguucucggcuuaauuuuugugaaagucauacauaauaggucaacugaggaaaacaaccuaccaaagacauggaaaaucacccuuguuauuaguagcauauucaaauacauauuuagcuuucauuaauaugcuugagauccccaaauacaagaagggugaacuuccaacuguuuuuaagauaucuuuuuggcaaguuuauuuuaauuauuuaaguuacugcacaagggacaaaacaccuuuguuuaaaagaaggugcauucauucaagucaccaaauauugaggcuccaccugggccagaaauucuucuggacucugaaccuaagagaaggaaccaggcagggaaacccaagucuagaagaaacugauuuugguuugcuuaaagccaaacuaagcauuaaccaaagagggagagggaaguuacggcaaguguuuccugguagagaauauggaauaaauggaaacuuccucuagaccaggaagauaggcaaggugaagugcagaugauuggaguuaccacuagagaaacaaaagggcagagaaagagaucaagagcauauauccugcagagaagggcaggagucucugaaggccacugauucaaugaaccaugcaccuucugggaaguaacagcugcuggaagugggcauugcaagcuaaggauaggaaggaucaacuuagcagcaggcacaagcuagccagaccuggaggauggaagucaccucagcacagaucuggauuuuauuccaaauguagcagagccgcacaaacuggccguugguuuuaauuuugaccacuguaugcauaaaggacaagaagaaaauuaguguagaagcaggggacaccuauggaagcacggaagaaugcguuuggcuauuguguggcacaccugcaacuugcccuucagccccagagacuagcuggcacuccuucaucccagagcuccuugccuuuaguccuguuugcacuauaagagauccaaaucagaagucagaaggaaggacacucauuccaucccguaacaagauauuuguguacuuagcacccaauuauugaaguucucauagcaaggaugcuaguccugccagguggcucccaucacauggucucccccagaaggccaccccacagcuucccccaggauuccaggaaccuucuuucccugcucccaucaggccuuggauaaucucauaaaagguugcagccaaccuccagguacuguguuuugccuugugguuugaaaacaauaccuuuauuaaacuccaguuaaauuauucaauuuguguacaccaucuguuuccugugguacagaaagaaagaagaagaguuuaauauugaagaguucauggacucugauccuuaacuaauauucucuuccuuggaggcuuccugcucaugacuugagggccauaaacucaaaagaguucacacuccuguauaauuuggggaaagacaacaguauaaauugaucaaggcuguaaaaagccgaaugcugugcugaagacucagaaaacaagaguucacugccaaauguaguauugcgacuauagccuaugaagaaagagccacugcuuaaauacugagacauguuuaucaaucauucauuuauucaaacaaugagcacugagugcccacuacuuguaagguauguuuuaugaaauugcucuagaaaagagccuaccacacaaaugucuagaaacuugcuuucuaaaagagugagagacuaacucaacagcaccuuacauauuuaucuaaacagaugaaaguuuuaugaaaaagaauacucugccuaugauguaggcugggaacagaguaaugggagggggcaggcaaaacaagaugacauccagaaagacaaggucuuuggauaaguuagaaaacaggaucuuucaaacuucugaaugcuaacaaaaggccucugcugcuggagcaaacccugagguaguggucacucaauguucauugauugaauaaugaauagcaaaguauuuaagauagauaucuaaguauuuaagcaguagcucucauuucuacggcuacagucacauacugcgaauggcagugaauacugguuuucugagucuucaacacagccuuuaacccugagaguggggaaucacagugggguaguuuucaggcaggagaaagcugggaggagaccaacaacuucugcaggacuucagauucuguuuugagacaagaaacccuaggagguuugagcgaguaguaaccuggauuguuuuaguucuaagaggguuauucagguggccaauauguuugcuauaguuuggauuguaaaugcccccuaaauacucaaucuguuaacugcuuaguccccagcccaugaucuuauugggagaguccagagauguuaagauacagaacuagugagagguacuggaucacuggaugauccucagaggggauugugggacuccagccccuucuccucuccuuucucuuucacaucuuagcugagaugacugcucagcucuaagauguguucccuucugccaugaugucacaggcccccaugccauggaauuaauaaaccucaaaaaaccauagaaacuauaaaccaaaacaaccaccuuuuaaaacuugauucucucagguauuuuguuacaguagcagagaauuuaacaacaaugaaguaaaaacaaugguaagauuaaaaaaaagagagagagaaaaaaucuuacuugguaaaaacacagugugguuugggccagaaugguagcuuucuauuugcuaagacauugacaucuccagugagugcugaguaggucugggauauauaagucaaacucagaagcugagagaugagguuugaucuggaggggagguuugaaaagcaucaguguucagcucugagagauggauguggauguuuggggagugaggacagaguacucuccugaccagaucagaaucuggaaaccugagacauggaagcaggcacauuggcaagcagaccugaaaagcuuaguauggcaggaagaaacauagagaggugggaugcucaaagccaguagaaacugcagaggaagaaaaucagccaucaguagugaugcuagguccugggagaucagaaccuggagaaacacagacuggguaagauagggucacaggcccagguggacaucaauggcuagaaagcaaguaguuuaaaaaaaaaccucuuccccccuugucucucugucucugucuuucugucucucuaucucucagucuuucuugguaauccagcauuuuaguaagcuaccauaauugcaucauagaaaagaucucagcagguucaugaacaguaaaaagcaaaggggauggggccaaggaaacacaaagguuagggacccauagaucucugucacaaagcacagguucuagucacagguagucuugggagagguggccuacaaaggaaucccccugccuacuuguccccuguaaauccaaaaauuaagucauucaugcaguaaaaaacagggagucacuauugaaugucugagugggaagagaguggcaaaucauucaggaggauggaggagaguagggaucaucauguaggauggaggagagugggggucaucauggaggauggaggagaguuggggucaucauggaggacggaggagagugggggucaucauggaggacagaggagagugggggucaucauggaggacggaggagaaugggggucaucauggaggacagaggagaguaggggucaucauggaggacggaggagaaugggggucaucauuagcaugaaggguggaggaaaguggggaucaucauggagcauggggagaguggggaugauuaauguggaagaccagacuacuaggcagcauuguauaccuauguuguggaaaauauuaaaaacugaaccuuccagagaagcuccugcuucucucaacugccaacucuucggcggggccggacugugcuccugugcuccugccacugccaacucucuccagcuagcacuagcagugucuggcuugcuugucucuggagcuacuaguucccucucugccauuggcggucccauauuccuguaaccaaguaaagcaaaacucuugaacuuuauaaucaaccuaucauauuuauguaucaauaaaaucacaauuaugagaugccacaauaauuucugaaccaauugguaaugauaaaagcuuuaucccaauuauucuaaccuuaugauaucauagcuaccuguggcugauuaaagccaugcugguucaugucugccuccauuucaccuuccccuucuccccucugauguucccucuuccucuuagcuccaccucccuuuucccuguccaaucacaggccuccugcugcccuaauguaauuggauagggagcauccugcaacagaccuagauuggcuuugguggaaacucaaaaggauaguaauauuuacaaugauuguaacuuuaauccaaugugacagaaggaaaguauagacugcauggugacuugcagaggguggaggggcagccuauagaucacccuggguaguguucacugccaauuaucacagaagguauuuguuccaacgguaguacagagaugguagugccuaugauugcaggcaaagcaagcucaaggaaaugugacugucccugcuguccccagacagagggagagaaacaacacaaaaacauucaaauauauggaaauuaucuugguuuuagauucuuucucauuuggcauuugaggcucagagaauguaaaaaauaaaucuaaagccccauuuuaaaaaggcucuuuuguagauuauuucugggauauaaaagcccagcucccagguagaacuggguggggguggacuaaugaccccugacauuaaaauuuaaaauaucccauaugcaaauccaucuucccuccauccuuuuguaaugcaacaaccagugagaauuagaauugcaaaaaaugcuaaaagagcuacacaggaaauuauacaacaaaguuguuucacagugauauuggggcaggaauaugaaauaaguauaggggaacacagagacacauccugaugcaagagacuuagacggacauguuuguauguguauaugagucugaggaagcccccugauaaaacguuauuuucuuucuuugcuucuuccugagcaaaacuuuaaaaaaugacacucuuagcucugguuacaauucaauaauacuguaaugguaacauaguucuuagucuacuuauaaauaacuuucauugaauagcuuuuaaaauauuuacuuauaacuguaaagagcuuccaaaugccugauaguuaaaaaccaacccugauaaucauuucuccaguguuuauuucuuuaguuacucaacacuacagaauuccaguaugguccucucuucucuucucucuucuuuccacuccuccuuuccccuccccaucccuuccucucuuuuccuuccucucuccucccuucuucuuuucccuuccucuguuuuccccuccucuacuccccuuuuuuucucuuuccuucccuccccaccuccucucuuucuagguuucauggaacacuuaaacucuuauuaugaucagguagagaaauguuuugaaauggacauauaucagcuacauaaacaucuaguaaugucugcaccugcuugcuccguacaccuuguuuggugcuucgaaugaaauggccccauaggcucauacaagugcaugcuucauccucaguugaugaacauuuuagagagaaauaggagguguggucuuuuuggaggaggugugucacugcagguggguuuugagguuucaaaagccuguuccugguccagucucucacuuucuaucucugccugcagaucugaauauaaagaccucagcugcugcuccaacaccaugccugucugauccccacagugaugauaaugucugaaaauguaagcaaguccccaacuacaagccuuccuuuuuuuagaguggccuuggucagguguauguucccagcaguggagcguaggaucuaagauaccuugucuaugcguugccccuugccucccuucuuucauccuucucuccuucuuucccuuccccucugcccuccuuccccauuuucuuucucuccacauuucuaucagcacagaaugaagaaauaaauaucuuuccuuugacugagacagagaagaaagggugcugucugcuagauuucaccuuaucuuucuacugguuuccaucaaguuaaggguaauuuuauucauuuauucacguguuaauuaauuaauuaauuuuagucccggggaucaacccuggggcuugguauaugacagacaaaagcucuacuucugaccuacauauacacccaaaaccaaccuaaaguaguuuuuuuuuuuuuaaauuaauccuagaggcuaaugucaaaggugauuacuauaaaagaaagucccugugagggcagacacccuccauguauaccuggugagcauuuuguugugaugggcaucaguuuuuguucuuucugguagucuucccccaucccuuucuuuuggagugaccuugaaaaacauacucagcuuuugagacuuccuugcaucuaugcaugaucaaaaagauaacugagcaagaagaccaaaaagaaacugcuagaugaggcuuccaaaauaacuuuuguggaaaaggaaagauucagacaacauggcauuguuagcuuugcccuuugccagucaucucggcaaucucgggagggaggcuagggauggugaugcuucuccuuguaacuccuagcacaggaggcuggacaaggcauaaagcagcagugauggaaggugcuggcccugagagagauuugcauuuguuaaaauaucuugagaacaguaaacucuuccuuugaauuuguggcgguuaaugcugcacucagugugccuaggugaucuaugauggcugacuaugaacauacguaggcuaugguauuaggauaauucaucauucuugucugggugguacuguuaaaguucuuguuuuguuuuaaaaaugaaaccugcuguuaaauguggaggccaaauaaagauaauuacaucuccauguuaggggaccuuaaaagacugaccucugcaaacacaagggaacucuccaagucgauagccaccuuaguuuuccaagaucuccaugcugcugcccuguucuauaaauguuggccuugcaagccucugcagucacacaguuaauuucuuaagccaucuuccuccauccugcucacuuuccccaagauguuggguuucucuggagaaccugacaguauuauauggcuuuguucagugcggcugaauaugauucucagaggcauaugcaaaaucuucuacgcuauuugcugaacaacuggcugugccuuugugaaucagucuucagaucuguaaaauggguucaugaguaauacugacuccacagccuaucaaaaaagcuguaugaggcuacugauguaaggcaacucaauugucaugagaggucacaacgccacuauagaauaagggcgcaauggcuuugcuauaauucuucaaugauaauuauucuucagucaggguugcauuuguugaagauaaugauuuccauuaaaguugaccacugaaagucauuacugcgcacucagaaaagcacaagaaaacucagcugccuagaucucaagcugcugcuguuugcuggcaacucauuuuuauugagguauuguguacuaggcagaccagaaaccaaguuuuguuuccuuaaaugggauaucacuauauaaacccgacuuacauuccugagcucugggucuuccuaacucagcuccccaagugcugauuguauaggccacaagaccuuagcacaacugaugccaugacgggaguaccacucagaccuugcaacccagucagcagggagcaacaaaaugagagcagagaccuaauucgucgaaguuggcaguuaugggaaagucucuaaauguacuaauuauucuuuauagccucuguaguucugcuucuggcaaacuuuucuugaugacugaggagugucaaccaagaaugugguggguuuugugcuuaaaaacucaccuuuuuugaaagaaagucccaggacuauacucaggucccaaauaccuaaugugguugcuagccagcuaaugaaaauuuucuauuagccugaacucaugaccaaguuaucuuccuucucuccuggauacugcacaacacugggauuacaugugugucguccaugcugagcugugcgguccagugcauugauuaucucuaccucauggguauucaugcuacucugaugccuguauuuguuacuuauuguuaugacaagauauuaaacauaaacaacuuuaaagaaaugaaauguuuauucugaugcagacuuuagaggaaacaguccaucaugaugagaaagcgacacuggaaucggucagucuguaauagaagguacuugaggcaggggaucaagaggcagagaccacaaccagaauuaaguccaggccaaauggaaucaccacccccuaagcuccaauuuucuaaauagucugaagucucacaaaacaaugccaccugauuggaaccacagguuuaaacacaggagccuguaggggacauuugacauccaaucaaucuuuacuuguuugcaugucauagcugacacaaucauauacuagagcaugugaauacguggcccugaagcacacagugacacagucacagugaugcagucagggauaaaggcuggaucugaauuacugcaaagcccgugcaucuauccaccagcacagcaggugauagguaugccuucaucagugcuaacggagaagucaugggugaagcagcacauguacacugcucagcauagaaaccagagcagauucccuuguccaguacagaauuugaaguggaagccugccccauauuagcuacuccugcuaacacugcccuucaccucagaacgagaaaucccccugguagucaccccaaaauaacacugguuuauccgcuugaaacugugguuuggaaaccacggucagguuuucucucuguguagcccuuugaguuaagaagugcagguaccauuaacuccauuucacaggugaaggaacugagcucugcagagguuaaauaaguuguccaaggucacacagcaaguuagcauacgcaggagaugggaaagcccaucuccugacuucccgcccagugccuucccacucucccucaugcugagcuccgucacuuaucauucccaucacugcugaggggcagcaguugaugaguuaugcuaucagucccucagcaggaaacuguccuaucuggguaagaaaaugggcaugcaaauacaugcacgaacacacaguccacuguaacugcacaugucaaaacaauccaguaaagggugagaaaaacucccagguuauuuuuuagaaauggagccuagaggaucaauuucaucaugaaauggaguuguggguaugcuaguggacugcauuaacgguggaaugguaagugggccauaggguugaagcucuuacuguccauugcuguuaaauagugcuaauacaaaacacaguggccuagaagaaaagaccagacacaaaagguccaccucugcccuuauacaacuauuucuauguuucuggauauggacuacauuuuaugagacucaaaaagaaaugcauauuuaacuaacuugauaugauguugauaagaagcaaagagaaggguguuacagauaaugaagaucaugaauauucaaauagcaauaauuuaaucuuguaaaaaaaaaaaacaaaacagcuaacaacaucuagaagcaagauacugcacuacaaauucagcagugaagccaggauuugaauagagacauuugucuuuaaugaguuagucgauuuggcaguuuucuaccacaauggcacugguggcagcacagugaaaaguuacuucuuugaggugguuggauggagggaggaaaaggugcaagaucugaauccuagaggcagaggacuggcugucagcagacauucccaggaaugauuucagaacagggauugguggccucucuccaaacaaggauggcacuaaccaguagucuccugcaaacaaggauggcacuaaccacuagucuccugaaacucaagaggaagcaccaagucaguuuccucagcaacauuagcaaaaggaaguuuaggaaauaagaacacugggagacuggccaccuucucaagaaggagcuugccacacauuacagagauucaagauguagagaaaguaucuugcuaaaugaaagagagaaucaguauuuacgacagaaaggcaaaucucaucuaaaauaacugggaucugucugcucuagcuaugaugagagaaugcuauaaaagguucaagagaaagcaaagagagaauuuuaaacaaauaugcuuuucgguagaaauuugcccugucacacggagugcaaauaguccaggacucagaauguuuucugcauucuaacuuagaggcacaaaaauaugagagaacuugaaaggaaagacuuaguucucaguguaaauaaaacaucacgaaaugacccucaucucacagcugccuucuugaacauucuugacauggcugacagcugguggacaaagacacuccuggaccuggcucugguucuggcccuggcccuggcccaagcccucuacugccagaucugggaggccugucucucucguucucuucaguuuucaacucucuauuauaaacuucagcccagccucuuuauucuuugcugcccuuccugcuuuauuaggauuugaaggggcauagaaauguaaccaagaagcacaaagagugggaaaaugugaaagaucaugcauauucaaagaacaauaauuuaaucaugcaguguauuagcagaaauccccccuuaaauuuuuauugucuuaaauaaauguagacacugacuuugagcauggcaccuuguagauggcagagcagggauucaaaggcaagggcggugcuagaaaucaugcucuucccacagcaucgauaugaugaaugaaguagauuagaaaaagaaucuuucaccucucguugagacuauguucacagugugcugccuggcuuuaggucaaguggacacaaguuacagucauuugagaggagggaaguucaauugagaaagugccuccauaggcugagcuucaggcaaaucuguaaagcauucuauuauuuagugauuacuguaagagggcucaacucauuauggguggagcuacacuaaugacgguccaggauucucuaagaaagcagugugaacaagccauggggagcaugccaguaagcagcaccccuccaugaccucugcaucagcuccugcauccaaguuccuacccuguuuucauuccugucuggacuuccuucagugacaugaaauguaagccaaauaaaccauuccugacacuuggguuuggucauggaguuucaucucagcaaugguuaacccaguuaggacaaccugguccugagccaaguaguagacaggcagagcuuauugacauacucucauaguucucacagaggcacauuugaugcaguuucucaaacuguucuuugguacacaaggggguuccauuaaaacuucccauagucugaauacuguuugaaaugucuuauguucaauauucuuucagauguuucucauguucaucagacuccucaaauacauuucuucucugugcuuuuagcgcuucccaacuuaucugacucucuugccuagcaaaaaacguaccuuggagugaguuuauaaguauaaacauauagauauucugucuucaccuuggcuuuuuuaagauuaaagggggcugauacacauauguacucauagacugugacaguacacauaaacccuacacagguuuuaaacaaaguuccagcauggugaaguagauaucccuaaccaagaaacuauuuguaauugagaccugcuuaagaaggaaaauaagcuuucuccaauggcaugucaccggauaaaucaaugacaaucucaugcaggccuugugauuaggaauauuggugaacacaaaagaagcucuaguuagucuguaugcuauuuguucuggcuugauuugguauuuucugucuuuuuuuggguuuuaauuuuaauuuaauucucuuuuaagcuagagaggcaucgaaagaacaugaagaugagagugggagggaaucagggaagaguggagggagggaaagaauaugacuagaauauauuauguggaauuauuuuaauaauaugaagagaaaacaaauaauuucaaaaagaaagaagguuugaagagacauaaugggaguguuuuggcguaagguaagcaguauuucauccaaaaggagcugaaugugcaagcuaccccagugaaggacacguuugccuccuuuacaauuuauaaaagcagaaagauggcacagugaagaccgcauucugacagguuugucucuaucaggcagccucuggucuuauucacaauauguauuuaauuaugacaauaauuacauaagaugggcuauuguucuucuuuaggucuuaaugcccaccaaaggccugcuagcuaauggacuguuggccagaaagccuauggugccaccagaaggcagagaagcuuuuaggauguggcagcuaguggaaggaggucagguccuuagggaccuucaaaggggauaugaggaccccacaggccacugugugagcacuucucacuuacccucccacaggagccugcaggcuagaggcacaaagauaaugguaauuaguguuccuaugaugucugagagcucacaauuuauaaaccaaaagaaaucccagucauucuguccuagugaaggaaauugaguaaaaggaccuucuaugucagaguccuuuauugagggaucgaggucucuugccaugcacucaguaaaccaaaucuaaaguaggcucugugauugaaagcuuaguggccucaguccuauuuaucuagccaagagacauuguuuuguguacaggaagcggaggaggcauacaagauguuagucgguggagaagcagaugauuaauaaaagcuggcacaugugcaugcuccaugaugaggggugacugcguugucuggcagaaugaaaagaagaaggaagcugcacaaagauguagaugagaaucacagugaggcuaugucaaggggaggggaggaaggaaggaagggagggagggaugaagggagggagggagggagggagggagggagggagggaagggagggagggagggagggagggagggagggagggagggagggaggggaaggaggaaggcaggcaggcaggcaggcaggcauaggcuucuguuugguauggauuucuucugguuuugcccugacccuccuauggagcagcgauguuuuauucagcuuaauggcccccacagaggugaugcuguuuucucaccaggacaguuagcauugugguugugggcauuguucccagaagcauagccucaggccuacuucucagggacuacccaggauuccuugaaaugccuuauagccuuuaauaaaauuauuugcucuuuugacaagccagaaccuauucuauuguuugagacuaauaccccuggccacaucuucuugcuccucuuuccaauauccagguaaaccacucacagucuaaccauucucuccagaaaacucuaauccagaaauaauuuuucugugaauucuccaaacgagaauuuccccaagccaugaaaaaagaaugaaaugcggucuugcucuggaaucccaccaucguuccuuuccaacucaaucuccuuccuuagccuaaggcuggccuauuaauuggauaaaauacaguucacugucugugaacauggcaacaucuuugggugagucaaaagccacacucuucaucuagcuuuccagagagaaacacgucccaggacagcagggcuuggucugcaacaugugugugugucucccauucuccagcaaucauuuuuacucuccuacuuuccccuuuccuccuccuccuccuccuccuccuccuccuccuccuccuccuccuccuccuccuucuuuuucuucucucuccucucucucucucucucucucuuccccccccccacaggauaguacuguggccuuuuuugcaaacuccucaaauaugcugagaaacuugccagcaucaucaaacccagacugagaacagaaagcauuuuauuuccauauacaaaguuggcuaauagauacaaaacucaagcaagaguuguccagggcaugucuccccagaagaaggucucaaugucgguggccagcaacacaaaguaagcuaggccacuacugggaaagcacuagaagagggcugaagagacacagcugcucaguggguagagcuugggaacuccagcacccguguaaaggccaggaacuaccacacaugcuugaaagcucagcaguuugagggagacagaagagguagcagagguucugggcacucuauugccugaaaacacagugugcucuggauuaggcaagagaucugucacaaaggagaugagggcaugugagagagaaggauagugucuuccucuggacugcgcaugcaugugcacaugugugugcauuuauacacacacacacagacacagacacacacagacacacacacacacacacacacacacacacacacacggaacaacuagagaaaacuguuucaauagucaucuuauagaagaacaucagcauguuucuugaugcaguaaucaacaaaagacucagauccaauguucagauucccaguccugcuucaccccacaucuacccaaagcaaggauaguguuacaucagcugcagcuuccaguguaccuuaacaggaaggaucucugucuuaugcaaaacugucccuuucaccagauuggaauauuuuguuuuugcuugaaaucaucuuuccuucccauuuugcauuagacuaaagugucacaaaguugaaucuauaguggaaucuuggccccacuccugcaggaaacucagaggucugcccaauguagccaauaacagacuagaugugacucuaugguacaggcuuaccuguguuucgaagggaaaccacacaaauggcauuacacaauuacaaagauuucuguuccagcccaugugaaaccauuaaguauccaggcuauccugucugugggccuggaaacuaguauuucaguggugcucauaguggcgggccucuauguguacacaaacccuugguuaauaauacaauaccaagaucuaugcagacaccacugaaguagcaaauaaguacccagacuguauuccucuaaucuuuaauauucaccauaaaacauaaucaaaaagagaauggcuaagcugguaaggcacuuccuugaaagcaugaaggagauaugaguuugauccacaaacccaaauauaacuuccaggugugguucuguaugcuugagauccaaggaugggaaagugagagucagcaaucuuucugggguugcuggcugggcagucuagucuaaccuggugagcuccggucaaauaacagacgauguuucaagguagguagauagcauugcugaggauggccccacaccgaagcuugugguccaagcuccacaacaugcacacacauguugaccugaacacacacaaaaacauacaggugcauauacacacacaugcauugaaaagaaaagagaaaaguaaguuagauacaaaguuuguugagaaaacucagggucaaaggccugagcuucauucacuacuucaagggacagaagggaagaguuuuaaucugcauggagauggucaaaaucaaagacaaaucaaaacucagucauuaacccaaggucaaagccaagaauaucuauuuauuagugcccucucuagcucuguguccaauuaagucucagcauuucccaagccauuuuccuccuggucauaugaguguuuaauaccugucaaugcaauuuucuugauugcuaaugaggcacgccuuguucauuccauuagucucuaucaucgcuauauuaagucuuucucccugguguuuucucccuggcauucacuaugagccaggaaagcaucgcuguuuucccuggguuuuaucucuuagaucccagcgaccauuuagcacuuucuuuuucucaugaaucaaaccaauccaacaucuuguaaacaaccaggcaagugcuuuaaggcuugaguugagccugaccgucuuaucgagccauccaauuaagcccugauaccgucacuccuccaguuuacaagauaaucaucugauuccuuuuuguuaaaguauucacccuuuggcuuucuggucuauucucuugggaacuagauuguaguagccuggacuaaagcuacaaaggagcaguugggucuuguuacaagcuuaauuaguaucccacaaugccaguccaacugcaggcuucaugcuaucugcugccacaaagcuacucugucauguugccuucaguaaauuucuugauugguaauuucccugaagguucuaaaaacucuuccuacuauacaauaaacaugaacaugggauguggcuaagccaucauaacaaacaguaaacuuuucagucuguauuuauguuuccauguuugaugaaagggccuaagggagaugugaaaauggcaaaauuaccuucauggugacaucauaauacaucaagguccacaguguagaaucucgcccaccuuacuuaauuucaucuuuaagggaacacagaggacuguacagaaaauaucuugucauuggaagcacaccauguucuccaaacuguaucaguaaagaccaugcccauguaacuguuucagucaacucaaaccuuuucauauuguuuugcccugcaaagcaccaugaagucagaucaccauuugagcugagcauaagcuauagguuggaaagcaucuuuucuaaaagggacaagcacaguggacaauauugaaaagucagggagaccacuucaggcuccuagggacugaguggcuucaaaucugcucucaauccccaggagagaaaaagccaaagcacugagaaaugcacacaagagcucauucucuucaguuuaaaacuugaaaagucgucacaaguggggccuuagccaagcacuuaguccuguucuccuucuccaggaagcuuaccaugugucaaacagaguaugaugccaggcaaacaaaggcgugaagaaguuacagacccagaaaaaucacugaaaauauagaacaacuaccuaucaagucagcauguggguucuuaagugucgcguccgcucucgaccagcaagaaugacacgaccacuaguccuucuaacagcaguuuauucaguccugauucuucuuguuuauaucucccccgaacccugggccucucacuccuuuuauacucucauccacgcacagcaggccaugcugccucaccaggcacgaagcuucagcuaaucagggcagcaggggcauaucuccaucaaacuggauucaccgguauccuggugcaccugcgcagcucucaagauguuuguggccuauaugaggaagucaggugcaagucauacaacuuagcuacagucccuggcgccuuugggacugccgccacacccgcuccuaacacuuaagaauguuacauaaugccugagguuuccgaagcuggggcuuugggugaaccuucugaaaaccauaugcuauuccuacagagaacccaggguggguucccaccacacucucuauaauuucacucuucaugucuucugaccuccuugagcacaagguaugcacugguccacacacauacauguacgaagacacauucauacacaaaaaauuuuaaaaaaacuuuaaaaauuauaagccaauuucucagcagguaugagaauuguaagacagccaagaaaugaugguaggcuguccucacuuaugggggcugagcucuucugugaaaauaggagcccuuccgcucgacucgagccccgggcuaccuugccagcagagucuugcccaacacccgcaagggcccacaugggacuccccacgggauccuaagaccucuggugaguggaacauagcgccugcccaauccaaucgcgcggaaccugagacugcuguacauagggaagcaggcuacccgggcuugaucuggggcacaaaccccuuccgcuccacucaagccccgggcuaccuugccagcggagucgccugacacccgcaagggcccacacaggauuccacaggagauccuaagaccucuagugaguggaacacaacuucugccaggagucugguucgaacaccagauaucuggguaccugcccugcaagaagagagcuugccugcagagaauacucugcccacugaaacuaaggagagugcuacccuccaggucugcuuauagaggcuaacagagucaccugaagaacaagcucuuaacagugacaacuaaaacagcuagcuucagagauuaccagauggcgaaaggcaaacguaagaauccuacuaacaaaaaucaagaccacucaccaucaucagaacgcagcacucccaccccaccuaguccugggcaccccaacacaaccgaaaaucuagacccagauuuaaaaacauuucucaugaugaugauagaggacaucaagaaggacuuucauaagucacuuaaagaauuacaggagagcacugcuaaagaguuacaggcccuuaaagaaaagcaggaaaacacagccaaacagguagaaaucauuaaagaaaaacaggaaaacacauccaaacaggugauggaaaugaacaaaaccauacuagaacuaaaaggggaaguagacacaauaaagaaaacgcaaagugaggcaacgcuggagauagaaacccuaggaaagagaucuggaaccauagaugcgagcaucagcaacagaauaaaagaaauggaagagagaaucucaggugcagaagauuccauagagaacaucgacacaacagucaaagaaaauacaaaaugcaaaaggauccuaacucaaaacauccagguaauccaggacacaaugagaagaccaaaccuacggauaauaggaauugaugagaaugaagauuuucaacuuaaagggccagcuaauaucuucaacaaaauaauagaagaaaacuucccaaacauaaaaaaagagaugcccaugaucauacaagaagccuacagaacuccaaauagacuggaccagaaaagaaauuccucccgacacauaauaaucagaacaacaaaugcacuaaauaaagauagaauauuaaaagcaguaagggagaaaggucaaguaacauauaaaggaaggccuaucagaauuacaccagacuuuucaccagagacuaugaaagccagaagagccuggacagauguuauacagacacuaagagaacacaaaugccagcccaggcuacuauacccggccaaacucucaauuaccauagauggagaaaccaaaguauuccacgacaaaaacaaauucacacaauaucuuuccacgaauccagcccuucaaaggauaauaacagaaaagaagcaauacaaggacggaaaucacgcccuagaacaaccaagaaaguaaucauucgacaaaccaaaaagaagacagccacaagaacagaaugccaacucuaacaacaaaaauaaaaggaagcaacaauuacuuuuccuuaauaucucuuaauaucaauggacucaauuccccaauaaaaagacauagacuaacagacuggcuacacaaacaggacccaacauucugcugcuuacaggaaacccaucucagggaaaaagacagacacuaccucagagugaaaggcuggaaaacaauuuuccaagcaaauggacugaagaaacaagcuggaguagccauucuaauaucggauaaaaucgacuuccaacccaaaguuaucaaaaaagacaaggagggacacuucauacucaucaaagguaaaauccuccaagaggaacucucaauucugaauaucuacgcaccaaaugcaagggcagccacauucauuagagacacuuuaguaaagcucaaagcauacauugcaccucacacaauaauagugggagacuucaacacaccacuuucuucaaaggacagaucguggaaacagaaacuaaacagggacacagugaaacuaacagaaguuaugaaacaaauggaccugacagauaucuacagaacauuuuauccuaaaacaaaaggauauaccuucuucucagcaccucacgggaccuucuccaaaauugaccauauaauuggucacaaaacaggccucaauagauacaaaaauauugaaauugucccauguauccuaucagaccaccauggccuaagacugaucuucaauaacaacauaaauaauggaaagccaacauucacguggaaacugaauaacacucuucucaaugauaccuuggucaaggaaggaauaaagaaagaaauuaaagacuuuuuagaguuuaaugaaaaugaagccacaacguacccaaaccuaugggacacaaugaaagcauuucuaagagggaaacucauagcucugagugccuccaagaagaaacgggagagagcacauauuagcagcuugacaacacaucuaaaagcccuagaaaaaaaggaagcaaauucacccaagaggaguagacggcaggaaauaaucaaacucaggggugaaaucaaccaaguggaaacaagaagaacuauucaaagaauuaaccaaacggggaguugguucuuugagaaaaucaacaagauagauaaacccuuagcuagacucacuaaagggcacagggacaaaauccuaauuaacaaaauuagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguugaccaucuaaacagucccauaucaccuacagaaauagaagcaguuauuaauagucucccaaccaaaaaaaagcccaggaccagauggguuuagugcagaguucuaucagaccuucaaagaagaucuaauuccaguucugcacaaacuauuucacaaaauagaaguagaagguacucuacccaacucauuuuaugaagccacuauuacucugauaccuaaaccacagaaagacccaacaaagauagagaacuucagaccaauuucucuuaugaauaucgaugcaaaaauccucaauaaaauucucgcuaaccgaauccaagaacacauuaaagcaaucauccauccuuaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguguuggaaagaucaggaauucaaggcccauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauucuaccagagaacuccuaaaccugauaaacagcuucggugaaguagcuggauauaaaagaaacucaaacaagucaauggccuuucucuauacaaagaauaaacaggcugagaaagaaauuagggaaacaacacccuucucaauagucacaaauaauauaaaauaucuuggcgugacucuaacuaaggaagugaaagaucuguaugauaaaaacuucaaaucucugaagaaagaaauuaaggaagaucucagaagauggaaagaucucccaugcucauggauuggcaggaucaacauuguaaaaauggcuaucuugccaaaagcaaucuacagauucaaugcaauccccaucaaaauuccaacucaauucuucaacgaauuggaaggagcaauuugcaaauuugucuggaauaacaaaaaaccuaggauagcaaaaagucuucucaaggauaaaagaacuuuugguggaaucaccaugccagaccuaaagcuuuacuacagagcaauugugauaaaaacugcaugguacugguauagagacagacaaguagaccaauggaauagaauugaagacccagaaaugaacccacacaccuauggucacuugaucuucgacaagggagcuaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacguauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacaccgucaauaagacaaaaggaccaccaacagauugggaaaggaucuuuaccuauccuaaaucagauaggggacuaauauccaacauauauaaagaacucaagaagguggacuucagaaaaaucaaauaaccccauuaaaaaguggggcucagaacugaacaaagaauucucaccugaggaauaccgaauggcagagaaacaccugaaaaaauguucaacauccuuaaucaucagggaaaugcaaaucaaaacaacccugagauuccaccucacaccagucagaauggguaagaucaaaaauucaggugacagcagaugcuggcguggauguggagaaagaggaacacuccuccauuguuggugggagugcaggcuuguacaaccacucuggaaaucagucuggcgguuccucagaaaauuggacauaguacuaccggaggauccagcaauaccucuccugggcauauauccagaagaugccccaacugguaagaaggacacaugcuccacuauguucauagcagucuuauuuauaauagccagaagcuggaaagaaccuagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaagaaacucacacaauauguacucacugauaaguggauauuagccccaaaccuaggauacccaagauauaagauauaauuugcuaaacacaugaaacucaagaagaaugaagacugaaguguggacacuaugccccuccuuagaauugggaacaaaacacccauggaaggaguuacagagacaaaguuuggagcugagaugaaaggauggaccauguagagacugccauauccagggauccaccccaaaaucagcauccaaacgcugacaccauugcauacacuagcaagauuuuaucgaaaggacccagauguagcugucucuugugagacuaugccagggccuagcaaacacagaaguggaugcccacagucagcuaauggauggaucacagggcucccaauggaggagcuagagaaaguagccaaggagcuaaagggaucugcaacccuauagguggaacaacauuaugaacuaaccaguaccccggagcucuugacucuagcugcauauauaucaaaagauggccuagucggccaucacugcaaagagaggcccauuggacuugcaaacuuuauaugccccaguacaggggaacaccagggccaaaaagggggagugggugggcaggggaguggggguggguggauaugagggacuuuugguauagcauuggaaauguaaaugagcuaaauaccuaauaaaaaauggaaaaaaauggaaaaaaaaaaaaagaaaauaggaguuggagugggcuguccuguacuggaacccaggaaccacagaagcccaugagcauauuucuugugcuacaggcagacagcacagcaccaagcuucacagagagaagagccucccugauugauugugccauugucaguguccugauacaagaugggcaccauacaagaguuauucccugaugccacuuggcucuugcugugucugaaaacugaucucuguguccuuucaacucuaccccugagaaaagcacagugucuggguaauuucuucagcccaaugcuucagucauaucugagcuaugauugacaugaaguggugucuuuuuuuaaaaaguaugcuuugacauacucacauagugaaaugauuaccacagacaagcaaacuggucuaccugucaccucacaaagucacucucuauauguauguaguaagauuacccagugucuauucucuuaaggaaaaauaguauuacaacuauuuguguuugugcauguucauguguguggauccaccuguguaugugguggccagagagucaaccuucggccuuuucaccugaggagcuacccgccuuauuuucugaggcaaggucugagaaccagguagccacagacaccagcugccaccccuaucucugucuccuuggugggaauacaaaugccuaccaccauaucuggcuguguacacagguaccaaggauugaauucagguccuuagcauugugcagcaaguauuucauuuacuaccugcuccacucucuaccuauaacaucuauucuuuaaccaaacuuccagcauguaguacucuuagucauucuaaaagccacuuuuuagauucauuauccuauaugaccacaacuuugcacuuucugacccauauuccaugauuuccccccuuucacaccauggccugcuagauguagcugacucuuacuuuuuagagcuucuauuucuauuuuuaugaucagcuuauuuaauguccucuaggcuugcucaccuuguugcuguguaguauuugcuuaucuaucacaauuucuuuuuucugacaauggauacuuagguuguugacauacccuggauauuaagaauaaugccacaaagagcaugugugacacugacuucauucuguuguugugauuugaaugugauugacccucauaggcccaaaggcaguaacacaauuaggaggugugaccuuguuggaguggguguggccuugcuggacgaaguauguuauuguggaggugaacuuugaggucucauaugcucaaagcuaugcacaauguggcacauagucucuuucagcugccuguguaucaaaauuuagaacucucagcuuucuccagcacaaugcccaccugcaugccaauaugucccaccaugacaauaauggacuaaacuucugaaacuauaagggagccccaauuaaauauuuucuuucauaggaguuacuguggucaugguaucucuucacagcaauagaaacacuaucuaagauaugcauauacccagaaauaggacugaugguucuggguuuauuuuuauuuuuuucagaaauuucuauacuauuuguauuugauauuuccaaagaaggcucauauauuugaauaucuggugccaauuaauggcccuauuuggagaagauguuaaauuuuuggaggugggguugcuuggcagaacuggguccuuacaauggucccuggggcuugaguguguuucuggagcuggccucugccuccugaauagaaaaggucagacagcacuuugacaagucuucucugccaucacagauggaaauuacugaagccaacauccaaaaacuauccuauccccucuugugauaccucggccagacauuuuaccacagugguccaacaaguauuaagcauguuucuuugaccagagcaguauccccugacuucacagaaauggcacucagagaaccuuuucccucuacauuccucccagcuguccuauuuauuugugaugacaagacacgcccacagugugagguguggccucucuugugauuuuccugguggcugauguugacaccucccagguuuuagagauguuuguuccacauccauuucucaugaaaucaccuaccuuuagggcuuaguugcagaagcuaccuucuuauuuuguugauuauuuccuuuuuuuaaaaguugcaacauagcauuguuuuugcuauugucacuaagacugggauguaauguucccaaaucacuuccaagaccaaggucuaugugccuauuugaccuguguggcacccaagucuugcacagaauaucccaauguaggaauucaauauguaacuguggaaugagcaaugaaugaaugagcugacuucccuacuccaucaagagcccuuccuauaaauaacuacacuggcccaaggaacagcagcaacagcuuuuaaaaaccauauucauuuuuuauuuuuauuaauguauaugcaugucacauguaugugaguaaaauugggaauagaagugggugccagaugcccuggagcuaccugaugugggugcuuggaacccaacuuggguacucugagagaucaguaaguacucuuaaccauguagccaucucucaaagaugaaaacaucaagugaugaaauucaacacaguuaaguugaaacuaguguauuucaccagcuuuucuggguuuauccuccaguaguagaagacuccagaguguuacagcuuagaaugcuaucugguuauucagcuuccuauuuuucagguaggcugccaucuccuuuauaaccccagguagagccagaaaaauaucuuuucuccaugagauccugacaaucaucauugaagaagccaauagaaaacaagggagaaaugaaaauuaaagaggcaggaggcagacaauacagaaggaaaaggacaguuugaagaugagaggggacuggauccuggaaauacaccaggaccucacugugcauaaauggguuugucagcaucuccaguuaaaauucugaccaaaugacagagagcuggauuuucuuuuuuuuuuuuuuaacuuuuuauagauucuuugugaguuucaaaucauguaccccagucucacucaucuccuuguuccuucagauccacccucugcccuguuaacugucccucaaaauaaaauaaauaaaugaauaaagaaauaaaugaaccaaaacuaagcauagaaaacaucucaucauggagacuguagugugacauauaugucauaguguguuccacaguauauccuucuguccacacaucuuuacuuguaaauguucauugcaaugagucauuggucugguuugagaucucuagcuucugguuugguuugagaucucuggcuucugcaaaaccaucaauacuggaucuucaccaggacugcucucagauacccuguuguugcccugugugauggagagucugcagcuuuggaucugcaggagcagcccacucacaugcucuagaagccuguggaugggguagauuuuaguaagggcaacucaaagcccuggauuuaggccuggugauagcuagugacucuuauagguaaaagcuuaucacagguauaaagaaaaaugcuuucauaaaaugaaaaauacauuuucuuuuuuuuccauuuuuuauuagguauuuaguucauuuacauuuccaaugcuauaccaaaagucccccauacccacccaccccccacuccccuacccacccacucccccuuuuuggcccuggcauuccccuguacuggggcauauaaaguuugcaaguccaaugggccucucuuugcagugauggcagacuaggccaucuuuugauacauaugcagcuagagacaagagcuccgggguacugcuuaguucauauuguuguuccaccuauagguugcagaucccuuuaguuccuugggugcuuucucuaguuccuccauugggggcccugugguccauucaauagcugacugugagcauccacuucuguguuugcuaggcccuggcauagucucacaagagacagcuauaucugggucuuuucagcaaaaucuugcuaguguaugcaauggugucagcauuuggaagcugaucaugggauggaucucuaccacugacuaaaagagaaaacacauaaaauaugaaggaaucuaauagguauucccaguuuuuauuguugcuguucugugauuuuuguuuuguuuuugucuuuuguucuguuugcuuuauuuuguuuuguuuuguuuuguuuuguuuuagugaagacaauauuucccaaccuacuacucagagaaguucaucuggaccucagccagagcagaggacuuuguuacaggcuucacuagaaaguuccauugucauaaguagucaacucuugggucaacuguuuguaccuguaugugaaaauuuaauguggguggagucucaucaggcucuggcaucaaccuuacucauauaagcuuugugugaagagacaaacaaauacacgugcaugguugaucuucauuauuuauagauucuauauucagaaaauuuccaauucaagaauuugugaucuauuuguaaccccagaaucaauacccuuaauacuuuugcagggguuugcugacauuccuagagaugaaguugucaugggacaccauguguuccaaagaaggaagaacaacucagacaggucccuagacuccucuucagccucguccuaugaacaagcguccauuuuuggucuucccggugcuaccuuuucaucuauuucugcguuugaugacugcgcuauuucaaaugcccccuaugugcauuacugaagugacaaccagugaccucacugccagaagccugugauugacagcuacauucagucuugaguucaacaccauugguauuaaugaaacaagcauagguuaaauaaguugucuucaaacaaaaauacauaugaaacaaguuuauuuauugaucaguuaacaaaaauguuuggccaaaagcucaugggaacccaagucuguaucguuuaugaaagcugugacucacuauucacuaacuuaguggcugugacaacuuuauggacuauaauuaccaagaaaaaugagaauuggcuauguacauguuuuguuauauaguugguaauuuucugggcuggggauauggcucaguggugggaugcuagcugcaccaauagaggcucugaguucaaucccuagcacuaaaacaaacaaacaaaugucucuuugagaaugacaucggugcuaaacagagggagauauguggaucacaggaccguagcucuccagggucagggcagaagagggacauauuauguucuaaaugaauacucccucugaagaguggcauuuaauguggagcaauuuauacaaauucacaauacauauuuacauuauguuucugggcaucaauggccuccuauccaucaccuuagguuaguagucuuacagaagccugggugugaugaccuaugccuuucauccccauaauuaggaggagaggcaaauggaucucugaguucccagcgagccugaucuauaagaguuucaggccagcuaggacuacagaguaagucucuguuuguaaacauguaaguaaauccaagaucuaacagauauuucuguuucaaaggagaagguuggaagggaagcacaaauguaguguagcacauguuugugugugcguuguguguguguuuguucacacacauguauguguacauacacagucaucuuaauuugcuucaaauguuccagauacagcaagcuuucaauucuuugcaucauccccaugaugacaagaacuagacagacaauuccaguguucauguauucccagaugaaagagaacuuaugaaucacgaguuacagugguucccuaaaguuaaugaaacaaagagagcagagagcuaagugaauuauauguacaccugacuguggauguuaaucagcccaucuaucaucuugagauccugugcauucuaugccagguauagaagagaguaauauaagcuaagacuucucucauaucaacguucuucagagaaagucaccaagaaccauuguuucugcucagauaacacauccuauuucuuaaagaaguuuccaguaagguuacuggguaaagauauagcuagagugauacuaugaggaacagaaauccugccuucgaauggccccaugcacacuagucaaguacacaaaacaauuaccuuguuaauaauucaguauugccugagaaguguacgauugugaaugauuuauggagacucaagcugaugcauguuguaccacagguagauggugggucacugagaaacugcuucacaguuuucccacaagaauaagggcaaaaaggucacuugcagugaaagaucuuuuggauuagucuucuaaaucaaugugugaauuaaagacaauuuacauauaaauaggcuaauauucuggcuuugaaauuaaauggauuuuuaaaagauguaaguaacugcagaaaaggucaguuaagcaguaaguacacauaaugugauuuuugaaaacugcuugucuuguugguuuauuaauauuucguauucaugucagugucguucuaaaauugcgugcauaauuagugaugcgccaaagucaaagacaggccaccaaagugagaaacacacaucucacaaagcugggaaggaaagacaaguggagcgucucaacacagaaauagucaaaauuaaccuuugcccacauauuaauacacauuagauucaaauauaucacaacaacuuccaaauacgcauagaugacuccaauaaaauguaccuugacauuuagccuugcuaaucaauuuauaguucuucccaaacagaaaagcugcaggugaucggcugcagccacgugacagccccucuucauaaccugcaggccucaucccuguagugucuuccuagaaacugugcugauggugaugaagagaagggugggauuucucaagugccuaccuuaccaccugccacugugcauuaguggacccuaaaaagagcuggcccauagcauaaaagcaaggaacacagcgacuugcggggguccacugcaggcacucaugcauggaugcugacagacaucuaggucuacacuucauucacugagucagggucuugacugaaccuggagcuugucuaugacuagccuaucuagccagccuagucuaggggucccauaugacugccuucuaagcauaggaauuauagguggguggcuacacacuggcauuuacauaggugcaaagaaucugaccccuaguccucaugaauucauggugagcacuuauccuagcugauuuacugccucuugguuuggagguguuugggguaacagaacagggaagaugaggaguaacaaaagggagguuugcuauugaagggaucccuccuuguuuucucccucugcuuugaacacagcaacucccccuuucaccccugagcucacagcuucccaaaggaaagcccauuaggcaggaauccucagcuaaagaaauaucaaagaaaaagcagacagaucacagccuaggaagguaacuugcaaauaaucccaugugguaauuucaagaauuacuggacaacaaagaaauguuagcccaaacucccugucuuacuguuucuacagcccagccuggcguuaggcuacauaggugcuuaucaagucuggaaaaagagcaacuaggaaggcaagugcuaagaaacaaccaccaagccucaugaaucaccucgccacaccccaguaaaacacacaaugggcuuugaacaccgugugaaaaguucaauaccucaagaaucuuagaaacuuucaggacacgagaaaccaaugaucacgucaaaaugugaaagcaaugugucuaaaucaccacgaacacaaccugacccaaaaaaguagauguaagguuugucuaauauuaauagauugccaacauuaaauaaugugaaggcugcugcuaagaagaauauuccaaucccagugauucauuucuaaaaggcugaaugaaucuggacaaguaguacaugccuuuaaucccagcagauaagagaccggggcagggggauuucugugaguucaaggccagacuggucuacaaauugaguuccaggaaagccagggccauuacccagagaaacccugucuugaaaauaccaaggaaggaaggaaggaaggaaggaaggaaggaaggaaggaaggaaggaagauagacagacugaugaugcccgacaaucagcuacaccuuguaaacaagaguugcuuuccaaaaccugagagcccuggacuuacuaaccgcuaaacagggagggacuugcgucuugcugagggagaaauguugguuuuaugucaaugaauuugggcugguagaacaagauguacaaauccucaaagaacccagggggaaucucuagacaugcuauacucccaauaccccuaccccuugguagaauggguucuuccucuccuuggcuccauacuggccauuggagccuugcuugucuuggcacccugucucauucaguuucuaaagcagcagauggauagcauugaaaaaucacuaccaaucaggucuugguucaguaucaaacuguucccgacauagaagacaguuauucuggugacaccucucccuuauaaaaagaaagagaaagagaaagagaaagagaaagagaaagagaaagagaaagagaaagagaaagagaaagagaaagagaaagagaaggagaaggagaaagagaaagagaaagagaaagagaaagagaaagagaaagagaaagagaaagagaaagagaaagagaaggagaaagagagaggaagaggaagaggaagaggaagaggaagaggaaaaggaaaagaaaagggggacauguggggcaacgggcuaugcacagccugguuuccagucgaggcuagaucuugaaccccgggaccugguagugauaauucacuuacaugggauggaaggaguucucacaugucuccuggacccuggcuccugucugaguuacaacccccacaggagaggcguggcuaucagccacuuaggaacagcaccaagccuucccacaugcaaguaauauuuuccccaaacucucagucccagccaaugagagaugccugcugucaaacccugaauaacccccagaacuguauauaaacccaugcagggaauuaaagguaugagagaacuauuccuuugucugacccuuuuguuccaagagcuguauguaacucuugggaaaagaucuugucucuggaagagccacccaaggucccgucgcacuccucacuggauugucugugcuucgucugacccaacuaaguucagagaggcuuggaguuaccgagagaccuggaacgccuggcagagacuucaucucucugccugcacucacuucccuucgcuggaaccuucccaccuggccuggacagagaucuccguggaaaaccucugguaccccggcccacacaagugcaccauaaaacauucuauguuguccuauaucccuccucucucagcagcuguuccauucuuagguugauuugcugauuggcuuacuagugcuuacugugcaaacaugagaccuggcucuauccuacagaauccacacauaauguuggcauaguggugagcauauguaauuccaguacuggggagcaagacauaggcugcucuccgggguuuguaggucauccagcucagccuaauccaugacgauucccagaccagugagagauccucucucaaacaccagguccaggcuggagagaugucucagugguuagaucacuugcugcucuuucugagcaacuggguucagcucucagcaccuguguggugguuaaccaucguaacucuaguuucagggaauccaaugcucuguuccagcagcccuguauguuggacauauguguggugcacaucuguaagugaggcaaaacacucaaaaggcaagcaaaggggaaaucuccaguggggugguucccuagaaacaacgcugagcucaccucuagcuuccgcgggcagucagcaaguacauacacgcagucuccuugaucuacauacauacaaacaaaauugaugcucaucaagauccaccaaguaguucauuuccaagaccuugcauaugucaaguugcucccaaaccuggcuaaauccagugacuuuucuaugguuugcuggaaaucacucuuuggugguuugagugagagccacccacaggcuccaguauuugaacacuuggauccaugugagugaaguuauuuggggaggcugugugaccugucuagaggggugagcuuugagagaucacagccgggccucuuccccagcucacucucuguguuuuuauggcuaucagcuucuugcucugaccaccugcuuccuuccauuucugccauuaucacucaccccugugcccuggucuggaaugcuaagcaaaaagcaagaagcauccuucucuguauaaaucacauccgacugugauuuauuauuuuauugcuguguuauugcagcaacagaaaaguaagguauacacacccugauggcagaaucacuaggcuccgggcaggauugaccccacaccaagcacuacaggacagagaaaucacuuuucuuuuuauuccugagguaggacaguuuucuuuuuaagucuguaagugugcugugcuauaaauuacccuguuugugggggugagaauaaacaucuauguauguaagugugcaugcacaugcauucucuuacauacaauacguuacaguuaaaacugugcuucaagagccacuccaaccuagaaacccaugacucuaaauguagccacacaucuagguuagacaguaggauuauaaaugcuucgacuauuaugagaacaaacagacuacccagggagcauaaacauuuacaaaagagccaugcucauucgcacuggugacccacagaccuguugcagaugagggacugagauaguaaacaggauuuaaaaaugcaaagaaacuacugcuaaaugacaggcuguauuugacaaugaacucuggacucagaggcaccacugcaaucuacaagcaaggugcuuuuggguaauucgcuuguccacagagaacccucugcugaggaguuccucuuaaagcgggcuggauucuuuccagucauuagugauucagucuugagauucccuaaaaaaauaaauaaacaaaacuaacacacucucucucccucucucucucucucucucucucucucucucucucucucucucucucucucaauugauaaucugugcuuuaccaagaugagcuuuagaaguuguuaagaacuugcagaauacauuagcuaugaguagcugaauaaugaacuccaaguauguacaggaaaaugaacgacuggcagcaacugcuagccugcaguccuuuuacugaaauuagaaagcagggaauacaguuggucauuuaaaaaggaagaggacuuuuaaugacuguaagacguaggaauggccaguguuccuccucccaaugccacauucugacauuguuucacugggcucuuuucccaaagcccgcacucauauauacugagacauugcuuuuuaggggacgagaauauagcucaguguagagucuuacuguaguguaaaugaggcucuggguucugucuaacaagauaauacaauaauaugaauauauauauauauauauauauauauauauauauauauacauacauauaaaaauguuucaaguauccauacauucagaguagaauacaaaugucucaucucagaauacauagaagaugaguagugagugacuuauuagagacuccaagagaaacugcucaggaaguggugagaagcaggcaagugguucaugauggaauugaguucucagcaagcaggggacaaugcuuucauccauaucugccaccaaacaugugcuugaugcuccucuaugugucuaugaccuccucuaugcuccucuaugucuguggauggcaucauuccaggcugguggaaagagaaggagcuuacuaguccugggucaggaugaggguaggggaauauguuguacuaaguaagauauaacaugagcacugacaccucagcugcagccaaacucccaauggccuaugucuccugcuaccuuaaaauaacugugugggugaauaaggaaggaggauucaagugacacaguaagaugaaaaacaaaagccucucuucucucaaaaccaccuccauagguaucuacaguuacuucuucaaaaauucaaaugggacccucauagaguuuucuuguaagaaauacacauguauacacacacacacacacacacacacacacacacacacacugaauuuauuuaaacauugacucaugccuauaauaucagcauuugggaugaggggguagaggaagaacagucaggaguucaagacuugccucuguucaaaagaaaguucaaggcuagccugggcuacauaagacucuguguuaauaaaagaaaaacaauuuggaauauaacacaagcuauuuuaguuuuugagcuuuuauuuucacuuaaaauuacuuaccuucguauuuaaauauaguguguauaaaaguauaucccaaggaguuaagacagacagacagacagacagacagacagaaagguaaagaaaggaugaaagggaagggagaaacaguagcugagaggauggcggcuggagcaguggagcauguaauuuacugaucuuaagacaguucuuugcauuugaaaauauugauuucuuuuuucacauuauuuguacgaguauuuugccuguauguguguauguaugccacauguaggccugguaucgagagaggcaagaagagggcaccacauccccuggaacugggguuacagauguuugugauggcuuucucugugcugggagaugaacagggucuccugcaagagcagcaguggcucuuaacugcugaucccaguucuugccauuuuaauauuucucaaaucaaggugaccuaugagugacaaugguuuagauuuacugaguagaagucuaacugcuccugcagaggacaggcaggugguccagacacugcucuguuagcugagugcaugggcacugagcaggaggaagugugaguccaagcucuuuucgcacuuuggaaagagcaguguuugcauagggcugacauucucuucaguagcugcacaugcucauagguccacuagcuuuuaacuuaaauuauugugucuauagugacagcgagucacaguucuccacuuuguguuuugguaccgccacaauggcugcaugaaagcacauccacacuucucugucuuuaucugcuaugggcaguuuuauuccuuuuuaaauauaauuuuugauuauuuaaugcaugcacgcaguauugaauucaagaggauguauauacauagacacacauacauauacauuaccauggaucugccucugaucugucucagccugucuagucucuuaccuagagccaaccacgguuucaguggcuuuguauuccuuacagauaugacagcugcaagcauuugacccacacauacacugaaaugguagugcaaaggacauagugguuuguguuuuccuuuuaaaagucuuggagacuuuucccuaguacagaacauauucuaccagauguuuauauuauuuuuuauuaagaagaugugaaacuaaguuuaccuaguaccauguaaaauaauaucaucuucaaacucacuugcuauugaauguucuaugaccuugcaccucugauucuccccgagguugcuuucguugcuccugcucucucuccuaggauaaguuuagguuccuuacugucuuaaaguuuuacugcugugaacagacaccaggaccaaggaaacuuuuauaaggggcaacauuuaauuggagcuggcuuauagguucagagguucaguccauuaucaucauggcagcauccaaacaagcauggugcaggcugagcagagaauucuacaucuuaaacugaaggcugcuuggagaagacuggcuuccaagcagcuaggaggagggucuuaaagccuaugcccacaaugccacacugaccccaacaaggccacagcuauuccaacaaggccacaccaccuaauagugccacucccuaggccaagaauauacaaaccaucauacuuaucuaccacagaucucacugugggaggaaucucaguuaccugcaggucauuuucccaagguuuucuguuucuuuaggggagacccuucuuuccacagccuugucuaguuuugcuuggcugcauuuuugguuaugccaguuggcagacuuucuccuuaguucacuuuacuuccuagaagaaacccuuugugacaggaggagagcaucgaaacuguucagugcauacaggcgcuuacugcacggacauuauggccugaauucaauuccugcaaccaacucuacaaaacuauccuuugacccucacaggcacucuggggcacacauaccucccugccacacacacacacacacacacacacacacacacacacgcacacacacgcacacacaaauuguaagacuaugaagacaucugcauuuaugacacuagguuuauuuuuaaaucagaaaccuuauuuuugguuuugccuuuguucuugaugcacucccugugaauguagcuguucuuaccucacgugcuuaacuguguuguuaaugcuuguauguuuguuuuuauguguuauucagugucucacacuauagauuuucuucuaagcagagcucugguugaagcccacaauuuuaaaugcuauugcuauuaccaacguuuuguggauuuuuauuuaaguuugauuuuuaagguugauuugaguucacaguuguuuauaaagaaaguuucaauauucauauuguuccaguuucugauuuacugcauugugcucugaagauggggcccuugcuacucaaacuucucaaacuucucugugauuauuuauuuuuaauucauuuuuguagccuguuauagucaugugguacaaaauuuccaaaggucauaacaauauaccuucucauugucagguccuaaaguuagcucuguauuauguagccagcauuuacugguuauguucuggauuauuggucuacucauucgaacuuugggauuaagugcucuauucuuuccauuuauacuuccuugcuuaucugaauuucacacauggaguguauagcucuguauacauccugaaccccauacuuuagagaaaacuucccaucagaaacacauuccuaccccaaauaaugagaaagcacauuuacagcccaggaacuugggucugaugcuuccaucagcuagacagagccgcaaacuccuacuauugcaacaagugaggaacauucuagcaagcauuuuucagcgcucaugccccauuucacugaagaagaggcagcuggccuugagggucaggcagggcuguggaauguaaguaguauagacagugggaagccacugguuuggggggcauaugagacugagcuucauaaaggguuaggcaggggguggggguaaucuauuaucucccucucagauaccaagaguacaguggauucacacaugaagaaaucucagacucagucaugaaaaguacuggguuucucuauggggaccugcuaacuccauuccauacuuccagaggcugcucacucuugggcaggacucacaacuucaguccccaguagcuaaugcacauucugagacuaagaaauuaacuuuuccuuccuuaugacuacauguagguuacaauauucaugggagaaaucugauccugaaauuucacauugacaccuagauggaaugauuaaaaaaagcagaaauucuucuaauuuuauagaaaaauauuaagauuuaaugaaagugucaaaauauauauaaaugcauuuggcuuaaacaguuuaauaauggucagcauauuuggcauuuugcacacuuacaagaaaugugacuuuacugaaaauaaaugaaauauuuuuaaauuuucuaauuuuaaguuugaugaacauauauuuaaauuguccacauguugaguagaaauugaguguaauuuuuaauucuuuagauagaaaucagcaggcuucucuguaaagaacuaguuaggacauauuuggggcucauggacucucaucacagcccugugucacacaggaaaucacagacgaugcauuaaguuaauggaguggcuauauuuggacccaggguucuaauguaggauuccuauauuagaucauaacugucaauagucuugaaguaugucuaaaaauggaagacauuaaauuauaacaauuaaaaugagaugaagguaagaaacuaauuuauuugaguauaucauaauuuaaaacuccaucuuucuuuuuaagguccuuauacaaauaucauuauucaaacaacagcccaugauguaauaacaccacauauuguguuuuguuuucuuuuguuuuguuuuguuuucuuuuguuuucgagacaggguuucucuguguagcccuggcuguccuggaacucacuuuguagaccagguuggccuguuuuccccuuuccugguuuccccuccaaaaccccccuauucccuucccacucccccugcucaccaacccacccacuaccgcuucuugguccuggcauucccugacacugaggcauagagccugcacaggaccaagggcuucuccucccauugauggcugacuaggccauccucugcuacauaugcagcuggagccauggguccuuccauguguuuucuuugguuggugguuuagucccagggagcucugggguuacugguuaguucauauuguuguuccuccuguggggcuacaaacuccuucagcucauuguucacuggggacccugugcucaguuaaauggauggcuuugagcauccacuucuguauuuguccacacaauuuuuaaugauauaaaaggcauagcuuuaccuuuccuuacauuuuguccuuaaaaauauuuuuacaguaacagcuuacaauuuacaguuuugaaacauucagaaacaugguuuauaccugguuuccauuuauaauuuugugauaggaaaaaccuuaguaacugcccagauucaacauuugccaagugcuaaguucuggagucuaguaggccucauucauguucaccuucucuagccaugagauuaucaaaccucuuuauugucuucucuacaacuagucuugcucuucccaauuaauuucuauacaacagaggacuauuuuuaaaaaauacauuguaaacuaucaucuuuguucuaaaaacucuuuuacugucuuugauauucaugacacaaauucaucuagagcauagagugcuuucugaaacucugugcuugccaaccuuuacaaucuugugcacucccauuccugccugucccugcccccacccccauccccagcacuaucuguuccuuguguacucacaguagccuuuggcagacaucuaccccacucacuauaucuuucuuccaggccuugucuuaaauauggcuuccccagguguagacccacccugggauguauauucuauuaguuacugguaacagacuuccacaagaugggcaagaaaaagaaagacaacccaccagccaucagaaaagccaagaauuugggguuucacuugaacuucagccuuguucaucacacuagugauucuguggguaugaacagaccauaguugccccuuuuguuaaucuuagccaggcacuagucagacagagcucucagguauuucuauggaagguagcauccaucaguagagaauuaauucuuugagaugacuaggcagcugagacauaaguacagagcuccagcaaaggccuuauuggugaaggauaucauuguuuccuacacuacaaacaugcucucagaauucauuuucaaaaugagcaacuagggugaacugugguagaaccuacugaaacauuucuagaaaacguaugggcuuuggacgugugugucuaugaauaauuguauaauguguuugagaaaugcuuuacgucagacauaggaauggagaaacccagucccuguccccuggccaaggauuagcucacggguuaccaaugcuuuucuuccagggagcaguccaccucuuuuccccauccaaucugucggaggagccuuagacaagaaacugaagcucaaacaagguguaguuuugugucacaucuuacuuaagguggcuuuuuuuuuuuaauuuuauauuuuauuuuuugguuuuugagacaggguuucucuguguaaccuuggcugucuuggaacucacuuuguagaacaggcuugccucgaacucagaaaucugccugccucugccuaccaaacaacuugguauuucuaggaaacacuaucucauagaaaauuuccuguuccuuugagucuuccaaucuuccuuccaagguuucugaaaagagccauaaguacaggaguucuguuguauuguugauguaucauuugauacugaguuccagaguuauguuguagauauaccauuaggucugggcuucacaaguguacauuuuuaucaguuuagauuuucuuuuuucuuuuuuuuuuuuaauuagguauuuuccucguuuacauuuucaaugcuaucccaaaggucccccuuacccacccccccaauccccuacccacccacucccccuuuuuggcccuggcuuuccccuauacuggggcauacaaaguuugcaaguccaacaagccucucuuugcagugauggcugacuaggccaucuuuugauacauaugcagcuaaagacaagagcucuuaagguggcuucuaaaaccauguucaaagaaacaaaagacacaagauaaaauaggacuggccauaaaaagguuucugggaauucucuaguuucuucagaucacugcagaacauauccaggcugagaccuucccauccagaagcccugccagaacugcaggggaugggguagggggaguucucacuggccugcauuuuauaucuuggacugucugccugauuggcauuuucaguuacauagcucacauacauggccuuacauaucuagauugggcaaaaagaaaaguaaauuaaagcaugaucuuggguguugugcauuuuuucuaagucacagcuauggauagcauuuuauuugugcugaauauuucauuaaaaugcagacauugucuaucaugagugugugacaugccugagcuuuuuauucgaugauaaugauuauacuaaaaagcagucucugaauuccaugaguagaggcaugccgagauuccauuccccacuaaauuaaaacaugaugagaguguuuccucaugcugaggaaaaaggacaagcaguguguucccuggaccucaccccaugauauggugaugcugcucacaaggggucacaaacauguacuaccaaaccuuccuguuuaacggagcccagcaaggacucaacugcucaguccauuacugucauuaugagagaaauccugccaacaaguuccagucagguuaguaucauucaaucaugcugcuaauaggaauaauuuuaugguaauugguguauucaagauccgaaaacgacacaaaugccugagaaauucuuaaugauuugugcugacuuucauggugaaaaugacagcguauuaguuuaccagaugccgggucaagccgucggccauuaacaggggaguguucucggaacacuuucagaacaaauaccagcugguuuacuuuccauuuacagacauaaucacaggcaucccaaguaagaucccaacaacgcuguaggagacaucauaaauuaaagccuuggugcgcucauuacuggcuuuucuucauaaaagcgacacauuguccuggagagauccaaaauauuaaauaagcaucuaaauaaacugcagaaaggaucgccuugcaagcuaaacaccccacuuaagaccacugacaguauucaaguauucuaaguguccuucuauaauguccccagugcuaauuccugucuugucagggacacauucugguuaggauucucaggacuugucagcuuauuaguagauuuaauugacugccuucagaggaagagacgggcugaauuaaauaagcagaugaaaucaaagcaaaaaagaaaagagaaaacagaccgcgaauuuaauguaaagcccauuuguauccaggacaacucagauaucucagcaaacuacugaagagauaaauucauaggagaaaacagaaacaaaacaaaacaacagcuaaucccgagcagcccaaccuucagaagagaugugaaguuuauuuccauuuccuuccugucucccuaggugcagggcuccuccccagaauacacaaugauccuauuuggagacaaagagauguuggcaaaagaaaacagaaauaaauaaguaaauaagcaaggccccauuuucaaggucugaucauuaccugaaaaaauauuuuauuaaaaaggccacucccauuaaaucuuucugggggaagaugcugaacuaaaagagucaaaagaugauggggugacugugcuuucucgauaggaaaugguggugccuuguuacaguuaccagggccugagcuuaugacaccaacuccauucuacauccuugaguugugcucugugcaugugacagaaccccuuguaaugaucgcauauauaugugucuauauguauacacacacacacacacacacacacacaguaacaguuaaugaggacauuccauuucuaacuagcuaccucaaaaacagaauggcauucuuaaauggugauuagggguuuugugagcaucuugggcuuggagggggcaguuccucacugaggacucuuccgccccauucacuuucauucagcucuuugggggaaguuaaaagcugcagugauaaucccuuaagcaaggccuagauaaaaggcacaguguauaagcaauuggaugagggagccuuuuauguguaacucacugaauggguggccucugggccaugugaguugggaaaagcagacucacuguccuuucccaaggugggguuaguaagaccccaggcgagucaauuggcugccauuaccagcacugcugccccuucguucaccuugcugcuucugcccacucagcuccuggggccauuuugcucccaaagauggagggaggggcaaugugaucuuugguaaggacccaacuucucucuaaaugccaagucggccagcuggcacagaacaggacuacccuucuucggaaggagauagugaaacccaaauuagcaugcuccauuuuaaaaccuugcuuguauuuaaagacuaauucaugacaaacaguggcucccgcacuaaggucuggcgcaccaggggcuggcaucccaccaaacacaugcaacuaauugcuacccucagaugacacgcaacuaacaaacuccauuuugcuuuagcagauucacuaaggacgcaagcccggaaggcagcagaggcagaaaagguccuuucauaacauuguccuagcugcccagggcagcuaagcgccugaaaaaaaaaaaaaaaacacccaccuuuguuucccugcaccaacaauuuaucuccacagagggcucaaagugcugcaaguugcaggaagacuguuggaacacugcaaagccccaacacugguugucaaguguggggaucucccuuccuccuggcccaaggaacggggugaacuuguccauuugacaagacaccucuugccucacuuggaaaucugccaauccugguacucuccgugcuucagugagauucucagggcucccuuacccaagccuuuauaaaaaaaaaucugugggccaaacccauguauuauggauuagaagguaauuuaacuuagcuaugucuagguuuccucauaguaguaucuacggugugcagaugugaguauauacagucaacuugauaugcaucggauuguaaacauugagucugacugugaacaaaaguuucccuguguggauagcccuggggcuaauuauauuugauguuaauuccguucucccucgagggguuccgaacaaggaaugagucagcagucaggugauuuccuguaaaccugcuucccaccuuaauuugcaaaauaaaggagagcugaugauugagcagauaaaggggagguggagcagaagguggagaaagagaagagggagaaaauggaagagggagaggacacagaagaagcugggcagaagcaauaucccagagaaacugcaaguucuaaggggucucacagcuguggaagaugguaguguagagguagaucugcccaaucuaggagcacagcauuuauucauauuaacugaguuguguuuucauuaccggggcauauuuggguuggagauuuacugcaacauuucccuguguagacuacauauuuacggaaaaguuuacacuuaacucgaaacuacccaggaauucaaccucuaggcuucugcuugcaaccccuucaacugcccucucucauuuucuagcucuccauggucacauuuugucugcuucaaagcccuccuuugaugcuggcuucaccacagucucuccuugaccuaucagcugcagucagucacuuuaguuuggguauuuuaacaagugagugacaguguuuauguaccugcuuuauuuccucaucuagaguacagaccuuuuauccucauccaugauaacuggcucauccauaggcaacuguuaaaaaaguagacagucaauggacaaaauuauacucuaaucuugcuggguauuauauaacaaggcagacagggaaaugaugucuacuaguuuugguucaaauuaagaguucugucuaagucagugugaacugaggcucauaaaucaaacccaacaguagaauuuaucaauaacuaucuuagcuuggacuuucacaacaaaaagcacaguugaaguauuagaagucauauuuguggguuuggggaaggagcuaacuuuagaaugauguacauuacuaugagagagaccccauucacagaggccuugcccaggccuuuauguuggaagguagcaauaaaggaucauagcagaaauaacauggugaagacuuagagagcuagagagcauagacaacugauggauggccuguagugagagauacccuucaaacaauccucugaaugaaggagauguuccagcuuuuauaagacuuugaagggugacaggaaguugcauaccaugaaaucuaaugcaacauagccuaccuauacaaagggacaacuauagcaaaguugaagacacccucccaggaaguaaacaagaacagagcuuagugucagacccaaaauaaucacaguggaaugucccacagcacagugaagacagugcccacauuaauaucuggucaucccaccauuuuuaauucagaguaucuagccaguggacccaaaaucuuccuacaccuucucaugacuuaccaauucaucugaaauaauaaaggagaaaauaagaagcuauuagcccuuuuuauauucucuagccaaucagccaauuaucacuuucaauuauuauccaaaugaaguauugccaagaugucuuuaggucucuuuccaaaggauacacauuuucaaguaaacaauuaaccauuuuauucaucucagaguaguacaacuucuagacaaugcgagucuuaucguauuuucaucuuuugaugcaguggcacacuuaacaaaaucugucuggauaaacauugaccugacuucuaucccaucaguuacuaccuaaccccuuggaguucuagaugccugugguuaaaagagauucaccaauauauuuccugacuaacucagccucagcauuguguccugucccugaugccauaccugacugcucagugaggggagcagaacaacuauugcuaucaguccauaaggaauaauccucacaguggauuccugaagaaacagccaccaaaucugcuuucaggaagcuuaauucuaagacaggccaucaugaagaaaggugaaaguccuugauccacuuggacuugagcuuuguacaggagauaagaauggaucaauuugcauucuucuacaugcuaaccaccaguugaaccagcaccauuuguugaaaaugcugucuuuuuuuccauuggaugguuuuagcucccuugucaaagaucaagugaccauauguguguagguucauuucugggcccucaauucuauuccauugaucuaccugccugccacuguaccaguaccauggaguuuuuaucacgauugcucuguaauacaguuugaggucagggauggugacuccaccagaaguucuuuuauuguugauaauaguuuuugcuauccuggaauuuuuguuauucgagaugaauuugcaaauuguucuuucuaacucuaugaaaaauugagugaaacuaauagaaagaaaguggggaagagccuugagcacaugggcacaggggaaaauuuccgggacagaacaccaauagcuugugcucuaagaucaagaauugacaaaugggaccucauaaaauugcaaugcuucuguaaggcaaaggacacucucaauaggacaaaaaggcaaccaacagaccaggaaaauaucuuuaccaauccuauaucugaugaaggguuaauauccaauauauacaaagaacucaagaaguuagacccaagagaaccaaauaacccuaucaaaaaauggggaacagagcuaaacagagaauucucaagugaggaaacuugaacugcugagaagcaccuaaagaaaugucuaacauccuucaucuucagggaagaugaaaaucaaaaugauauugagaugacaccucacaccagucagaguggcuaagaucaaaaacucaggugacagcagaugcugacaaggauguggagaaagaggaacacuccucaguugcuggugggauugcaagcugauacaaccacucuggaaaucagucuggcgguuccucagaaaauuggacauaguacuacuugaggacccagcuuuaccacuacugggcauacacccagaagaugcuccagcauguaauaaggacaugugauccacuauauucauagcagccauauuuauaauagccagaaacuagaaagaacccagaugucccuccacaaaggaauggauacaggaaauguguuacauuuacacauugaaggacugcugggcuauuaaaaacaacgaauucaugaaauucguagguaagugaauggaacuagaaaauaucauccucagugagguaauccaaucacaaaagaacacacaugauaugcacucacugauaaauguauauuagcccagaagcucagaauauccaagauacaauucacagguuacaugaagcauaagaaggauacuuugguccuucuuagaagggggaagaaaacccauggaaggagauacagagacaaaguguggaguagaaacugaaggaaaggccauucauagacuggcccuccuggggauccaucccauauauagucaccaaguccaaacacuguuguauaugccaacaagugcuugcugacaggagccugauauagcugucuccugagaggcucugccagugccugacaaacauagagguggaugcucucagccaaccauuggacugagcacaggguccccaaugaaggaguuagagaaaggacccaaggagcugaagggguuugcagccccacaggaggaauaauaugaacuaaccaguaccccugaguccccagggacuauaccaccaacuagaguacacauggugggacuuauggcucuagcugcauaagcagcagaggauggccucuuuggucaucaaagggaagagagaggccuugguccugugaaggcucaguucccaggggaaugcaaggacugggaagccggagugaguggguuggugagcagguggagaggacaugggauggggguuuucagaguagaaaugaggaaaggggauaacaguagaaguguaaauaaagaaaauuucuaauuuuaaaaaaggaagaagaaaggugaauagaagaguaaagaaaauuuuacaaagucaacagcaaggagaagcgaggauaaaggggaauugagagcugguauccacagaggccagaagagcacaucaaguccucuggagcuggggagcuggaguuaaaggaaguucugagccaucugauguggguacuggggaaccaaacucagauccugugaaagagcaggaaacacuuacgcacaggaccaucucucuugaccucucacauagguuuuaaucacuaauucucuacuagguucauugucucaagguuuuccugcuguaaacagacaccauguccaaggugacucuuauaaagacaacuuuuaauuggggcuggcuuacagguugaggagcuuagucuguuaucaucaaggugggagcauggcagcauccaggcaugcaaggugcaggagaagcugagaguucuaaauguucaucugaagacugcuaggggaaaacuggcucccaugcaguuaggaggagggucuuaaagccuguagugacacacuuccucccacaagaccacaccuccaaagugccacucccugggcuaagccuauucaaacuaccacauauaucuuaggggucaaucccugaaacuaaugguucccaauuauuuguuugcucucuucucugaaaacacauaauacauuguauuugguaaauacauguuacucugacauuagugaagagcuccuagcaagacucaucuaaggaugggguccugagacugagagcucauuugcaucugaauccaaagugugaacacaguagagagacugacagacuugcuuuaagcaugaguuuacauuuaggacuaaauucccaaugauccugcuuccuuccugucaucccugugcuguuccucacuauccuugccaucacuaagggguggccagcaggguaccacuugugaguaagaggcaggaaguaccauuuacccaguccuucucauccaguguucucugaggggcccaaugcugauacaagugauagagucuuagggguaaugugauguguugcuaaaaauauucauuuauuucuuuuuaucuuuuguaacucuuuaaagcaggaaggugaacaauaauguuaauuucaauuauauuuugaagucugcuccugcauauauuuaauaacuuugucaaugagaauggugcccaagacaacuaaauagucuuuaauuauuuuacuacuauuauuuuaguuacuauggaaaaugaugagcuucauuauggcauuuucuuauuuaccugucuuuguaccuuuuuauauccccuucuccacuuccuucucugucuccuucucucccacugcugauacuuuacacugggguaugcacuguagagauacgguguguccuuccucgacuuuccacacguuuucucugggaugcgcaacugcacauuuaaguuugaauggagagcaaggagugggcauaucuaugcaguccuggucaaaauucgucuacccacugucauuaucuaaguuccacucucugcuguuagauaacaccaagugauaagugauuuucaugauugaaaucuuagaaaauauuuuacacuuugcauuugaaauuggauacuuacauauaauuugguuaauuuaauuuaauuuuaaaauuagcuaagcuuucaccaucauuaucuugcauuuccaguaauacuuaaggaguaaaaaugguuaacucauaagcugugaaaagucaucaaagggaaggugguugaauaauuuuuaauuuugguaauuaauaacaauagcacaaugcuuuacuuuggcugacuucaguaucaacuuguuuugauuuugcuguuucuccauaugcuuaaaucaaaauugucuuuucauucuuaauaggccauuauaaaauauacugauuccagucauuaggcccuggugaacaucugcucgguccuaguagaaaugaagagauucuagauagacuaucuagauagauuaucagaguauugcaacaauggucccuaaaaccuaguauuucuucacgauucccaugcuagaagaagaugaaaccugaagccugacagagcaggggcuuguuucccagacagaagaguaucacaugguuugaaaacuggucgagaacugcuggaaauuaaguuggacuacaccuugaccagcacuggucugguaugcauauuuugugcccucuguuuaaaccaagaucucaugauaggaccuuaaaaugagcuggauggguaaaggauuuagugugugugugugugugugugugugggggggggggugaccucuguguuucucuucccagcaugaccacauggaaaaaaaauuuuuuuuuugcuuuuuaagacuuuucuucuauugaccuuuugaggaaaggugggugagccuugcuucuaagggcuguccgggcucaggcccugaaacuugcacuucuguuggaacuaauacauggagguuaaaaaccauuaugggucccuaccuugguguuauaugcuacuagaugugacagcuuugcuucaaaucaugcugaugcuauuauaagugugauaauagucagaccagaugaacaaagcuagaccgacaaaaccacacacagcauggaguccugucacagacuuccuguaaccuggagcuccaaagaacuccuucugaagguuaccuugccuccuuggcacuuucucaaagcucagugccaagaauuaccuuaaagagauucuagggcucuaccccagagaaccucauguaaugcucuguguuagcccagaacucaagcucuuagccuguugaaacccuucagcuguguaacuugcagagaauuuuagcugaugugcaaaguugaucacaguuggugaucaagauagagcugguaucuugaccugagauacugaacuacugaaaucaauuuagacaaucucuuucaacauuggcucacacugcaaucaccuauaaagagcccuuaacaacagaguccugcccaccaccccaccaucucacugcuagcaguaacaagcauuugaaaagauacugauguauucagucuaggguggaauucaagcauuggaguuuaacuaucuuagagagaaccaacagccuaaggguacucagaaucggaaaggcucgacccacccaccagagugaaggcaaggccuagacuuuuaacaaugcagucccagaagcagagguuugcugagauaaaccccaccagaaccuccuccuucacaguucccccagcacaguggaauaagaccugaaguuacagcacaaaaccaagcccuuccccuuguuuuaggcugcuggcagaaugauuuaguaguucuauuaucacagaaacuccauuauaauuacaguguuugaauuauauacaaaacaagaaaaauucagaagggaaaguccuuuaaucaaaacuguaaaacagaacaguuucuggcugcaguuaaaagcaaacucuaaaauguuaagagucggcucuccagucuucugauuccugccucuuuccuauaagagugacgcuacauacacauuuuuuucaauuaaacgguuugacaauccaaagaaacgcauggugcaugauuuaaugagcguauacuguaugccugguaaucggcaggcugacaguucgcucacuuccaagugacaagagggcacagcacauuaauagaaagguuucaggggucucuuuucauuaaaaagcuuuauagucgaggaacauccaacuguauuggucaagcugucacugaaggucccuggugaccuuaaguuucugucacucucuaaguguucaagucuggaugauggaauuaacuuuuaaaaacauagaacuaacaacacaauguagacauugaaaguucucugguguugucaagaggguguggugcuuugauaccaacuccaucacaaugacuacaaaugugaauuauucuuggaaauaaugcucaauugauuacauuauucaauauuuuagaaggaauucagucuauuguaaauacauauauuuuugugacagaggaauagucaaaucugaauaaaacacauggauuuuuggucaaauucuaucaguuucuuggagcucagguucuugauugauaaguauggaaguaacaaccacuguauauggaggucaaagauaauuccucauaaucauggcaggagaagaacacuuaaacugacccucagaggcucaaaguauggaguauguaguauguaaugacaggcuggugcccuugagacuuucaauaugagcccgcaugcacgauagaggagaaagaaagcaauaccccagcaucaauguaaaauggagucccauccaacgcuaccaagcacccaaagggaagauuuugugucaugaaacaagaccucaggacgcagugcaggcuggacuguagcucacucuguagucaggguuagccucaaacuugugauucucuugccguagugucagcauuacagguaggugccacagaucccagaaaucauauuuaugucagugacagugauuuuaaugaucaccuaguaaacuucugacauguuuaagcuuucugauaauaagacuuugaaacuugcuauuuauaucuuugaucugucuuccagaaaacuuagugaguucuccaguucaguguguguuugcaaauccauuaacugguagugguagauuuauuucccauuuuaguagauguauuuuagugacuuuauugaaaguugucuauaaacuauacaugaagcaaacuugucacuuacaaugguaagguagcuauggcaaaagucuaugucacuugggucuaggcaagggaucuucaaacacaaucugaagagguagcuauggcaaaagucuaugucacuugggucuaggcaagggaucuucaaacacaaucugaaaaugacauagaaccucucuuuacagacugugggauuaaaauuuauugccuagaacauagagaauauagaaaaauguaucuuuuauguaaaaggauaucauucaggaaugucaauguuuuuaucucaaauaugggacaauaaaauuuuccuuagauuguugugaugacucagagaauauuucuaaagucagucaauauagcaucucaugcuugguuucauuguaaacuaugccuguucugaucuuaagauaugaacucagcauagcuggucagaagucaaacucaguguguagaucucacacuucacuuagaaaucagguaugcaaaaaaaaaaaaaaaaaaaaaaaaaaccaaaaaccaaaaaccaaccaaccaaacaaacaaaacaaacaaagaaagaaaucagguaugccaccaaugcucccagccugggcauggauccauaccagcuggcuuucucuauugcugcugaggagggaaaucuaggcuagcuucccacaguuuuuuauucuuaauauagacauguggaaauacauagaugcaucauaaugcauauuugauuugcagcuucucagcucaguguucaguccaucuagaacugggccauugucacagaugaaauagcaagcuuccucauguuuccuacccauugaccacagcuagaguauggccaagcauaccaguaagacauugcuuugucuucaggggagucuguuggaagaguacuuuaauucuaucagugcauacucuguuuuuguuuguuuguuuuaagucagaaaaagcuuccuccacugugaugugguuggggaaccuuugaaaauuaacuuggccuugaacacugauacccaucaguuucauggucuggggaaauacauugagccuaccugagccacagaguccuccagcugcuaugggaauacagagaauuuauaacacuauugucaccaggaauaggguaagagcaccagcuagaauggacuuaacauuuaauuuaauuuaauaugggcacuauugggauuaaauuccaaaggcaucuguuuuguuccuagauuguggaauaugcucaaacacaugaugcauugcaugaggcaaacagcaauugaaaacauugugaagaaagauauaagcuguuggucaccccaaggucaccauacccuccaaugacuucccuuuccuuaucuguguugauguccauuauccuggcuacuccuuaaccuggugagcuacauaugccucuugacuaugaucuagugcuccaaaaacucuacucagaaaaacauaaacagauuucauuuggaauuuuaucagcuauauauuuaccaguaauuguuaugucuuccuaacacaauaacccuuuuguaaaauacuuucucucugguaauauuuuuugucguaaagugucauuugucugauauuuaggaagguacuaugcaugucuuauauuguuucuacaguacaucuuccccaucaguucccuuuaagcuuaugagaaucuuuauauguacaguugucucucaauuuaggaucauuguacaugauuuuacaauacauucugguaccgcugccuuuuaacuagaaugcacaaggccaguucaaaauauaagggcaauguuugcauuuaguaguuugguuuuguuugguuguuugauuugcauauccacuucuuuuucuccucuuucucuuuuucaauauuuuuguguuguuuuuauaaaacaaggcaagagguccucuguaaauuugaggccagccugaucuacauaucagguguuaagucagcuagaacuacauagugagauaucccugcccaaacaacaacaacaacaacaacaacaacaacaacaacaacaacaagaacaacaacaagcguuucuauuuucccaauugacugcuuuucuuacuggcuguccuaggaaauaaaaucuauauucguaggaaauaaaaucuauauuauugaucauccuacagcauuacuuggauuacuuuuauacuaucucacauaaaguugaaagccucacaucuaugagguccuuuucucaccccacaaucuuuaagccauacuuguccuguguucugcagcuacacacauuguaucacaaaccccaugggacaguguuguuguucuuguucuacauauuuuuaagauuguaaaauagaaaaaguauuuuauauuugcaauucuaauguauuuauccccuccugaacauuuaagauucucucugaugugccuuacuccagucuuaguggcuuccuuugauaucucuugugcugcaggccuuugagcaaugaagcccguauacuuuguccuaucugaaaauguccuugucuucauucuuaaaguauauuuuaacuaugcaaauaauaagauucuuuuguuuguauuauuacuguuuuucuauccucccuuuuacuuuaaaaacaccauuuuuauuuuaggcuaaugauaucaucaguaggaaaagauuuugcaguaaagucugacugacugaguucgagucccaggaccuacaacaugguggaagaaagaauagacuccuacaagcugucaucuggucuucaugugaauaccauaaacacacauuaucacugcccaucucuuaccacagauacuuaaaugcuaucaaaaacauuaagcugugguuuguuuuuguuuuuguuuuguuagacuuuucacuuuugaaaagacaacaauuccuaaaaaguauugugguuccuguuaagacucucucuucuaugucauauuuucucaaacauacuuucuucacaauucuaucucucuucuuauucugugacuccaauugcaugugugcuagacauguucccucucaccauacagcugccagacccuggacucuuuucuuuauucagacauuugaauauuguuuuuauuucugggccuaagauauacaguugucacagcucuaucauaaggguuacugaugcuuuuccuggucaccuccaaaugcuugaaggccacacaggaaauuucuacuucaguagugacagcucuccauagaugacuuccaaaaucuggcucaucuuggaauaaaugucagauaauugccuuuucuuuucaaaauugccccuauuuucuuagcuugcucucugcuaugcauuuugacucgugccgugugaauguacacauguaggagauagaagagggaaggucacuuucugcuucaguucuuuguggaacacugaucugcuuugauaggcagguagauuagcuaaauggaacugaacagggucuuuggaggcuguucaaagcucagguuaguuuuuuuguuuuuuuucguuuguuuguuggcuuguuuguuuuauuuuguuuucagauauggucuuguuaucuaucccuggcuagucucaaauucacuauggagaccagguuggccucaaagucauagcagucaaucugccccgaaugcugagguaaaaugcauaugccaccacuccagcugcuuuagucacuuuuaaaaugugcucaugcuaucgcucaucggguaagagcacugacugcucuuccaaagguccugaguucaauucccagcaaccacaugguggcucacaaccaucuguaaugagagcugaugcccucuucuggugugucugaagacagguacaguguacucauauaaauaaaauaaaucuuuuuuaaaaaaugcgcucaugcgccugcuccuuauaagcuuggcccaagaacugcccucaaauaugacaacuguuuacacacaaaacuaggagcuucucucuaccucuggcuuucucaggaauuuaagcucgcguugcaguggucacuacugccuccucgucuauaguucgggucaucaagccuaacaggaaauuucuaauaggagguuggucagcucacaugacauuaacuuuagccugcuuucagacuaaacacuguaaaauaggaacucagcuuucaaguucugaauugcagcucugcaaagcaccuaccuguguaccuuuagucuucuugccuucagguaacagggcaaggguagaucuauuuauaaccuucaucccuggucaugucuggccuaguagagccauaccagaaguggagauagagaaaacacugagggaauaggcucuuguaucuccuaaugacuccuuaaccucuacccaguaucuugacuagaaauaccugauuuuauuccuaacaagaaacagaaacaggccuggugcgccaugucaaggauacauggcaauuggacuaaaaucacagcuuaacauuaaaugccaaaacaucacacagauacaguggcauuuaaccucaaggcaaugagguuuguaccaaccauuccuccaaagauuauccacgaaggacuuuguuaaauucuuuuguauuacuuguguggccuuagauaucucuauaucugccucauuuacaugguugcagguaauauucuaagacaaaauauugaaaauucuucaauauuaaaacauagaauguggauauuuaguuccauggauaaacgugacaucagugucuugaccaguaauuauaaguuccaugucuugaaagcuucuacaugcaaggcaccauccuaacagcucuacaucuauuauccuuuaaucuuucauaaccauucuguggaacaauuccuaagacuagucuuauuucauggaggaagaaaccagaguucagagaggcuaaguaggcugacuaagaucaaacagcaaaugccaaaauuguacagaaacagcaaaaaaugggagcacuugaaaugauuaggcauuguccuuucuuguuaggagagaaagagaaggcuuucuaagcacagaggaauaagugagguuucuaagucuuggaaaucacucauuuuuaauuacuuuccgcaauaauugcugccuuucauuuuuaagagcuuuacuuucaguguuaaaaugccaagcaaaacaagaauacugaaggcuacaugcaaagauucaugggaaaagagcaaguggugcagguucucuaugucaaguuguuacauuucuugucugguuuauaaguaaguauucuggagaggcaaggcaucuacuaaggagaagucagaugcauuaggcagugaaaaggagagcccccucaccccccgcagauucagugaagacuuuuagaugacaaaaccauguccagcaauaauacacacucuagaggcaguucugcccaauuucauaaacuucgcauaaacccagagguuucagaggauuaugggaugacagcaaagcaggcaaagccaaagccaaauaggucuacaagaugaaguggagacaggagacagggucuucacuggaagcaagacaagguauaagugucuuuguuuuuuugauucaagcagcaguuucucacauaugcaugcacacacacacacacacacacacacacacacacacacacacacacacacucaagaccuagacauggagauauuguuaaaggaggaaacauaagaaggaaugacagaaaggaacagggguguucacugagcacagccugucaugagacauacacaugucugagauacuagaauucaggcugauggggagcucaaggccaagcagagcugcucaguauauaugaggcccaucugaauuacauaugugacucuugguauaaauaaaugaguaaauaaauuaguauuuuuaaaacucaaauaaaauaguauaacucauucaccacauauugggggaaaugaccagaauggaauuguggggccaagggacaagcuuguguguguguguguguguguguguguguguguaugaucuuuccucaaccaucaacguaucacagacaacaucccuagaacaaaagucugacaugcaaaguuuuaugugauaugagaaacuuuggagauggaaacuaaagacugaggaguagcccauuucuuauucuuagauccaaaacuaaauggacauuuguguaggaaugugauugagcaaaaugaucaugaccuacuggucugagaccuacuaagcuaagaaggggaccugacuaagaccuagggauacaauaacuucuuggcucuccugugugccuuuccacuuacuagguuuggaacaaacuccuuguagaaugaguuuuaugacugaccacuguuagacauggugggucagaaaaaaaugaaaggccagucuuauauauagcacagggugggguugggagguagguauacugcagcuugucucaguuuuuauggcugguuuuaaaugaaagagcuucauauuucuacagccugccauggggaaggaagacaugcaagagaaaauuggagagacggcacugccaacuccccuagcaugccuaaaugcugugacuuggaagacugucuucugagcuuugucaguccauuucuucuucaccuuuucuuuuaagcugcauauaggacucacccagagaaaauauucagucauaaagggaagggauaucucuacuuggucuuugaggaucuugauaaaauucaccauucacaauccuaaucuguaccaguagagccaucucugagcaagacuaacuguaggaacagggaccgggagauguggacaaagaggagauagagcccacaaagacuccugggauucagacuccagagacugacaucaggauggagaucuaauuuuauuguuuaauacauaagcuuauauauaguuuuucagccaauuagggugugguuguguauucaagggcaaaucggaauacaacauguguuguuuagcuaaaucugacucaccugccccugagccuguauggaagaaaccagaucacccagggauaauucugugaagacaggggaagcaaccaccgcccuggccucaggucuuuuguguagucucaccagaguguggggagcugugccugaucauauauuguguaagucaaaucaggacuccuccagaagagccacaggggcuucacgcuccaucccacuucuuccuccaccagguuuacuuucaugucccccauaccaacccuccacucuuuuagaacacaucccuugacagaggacuccucuuguugcuacuaauuucaucucgauucugccaucauccucaaagccacacacgacauuacaacuugacucugugacuacuuaaucuuucuuuucacaauaaagauuauugagugugugccuaucuagugggggaagaacaaucuaauggcaugucaguccagugcaaguacagcuguacuucaugggaaguaaaggcaaugcuauccuucagaaagcgaagccagcagucauucuuuuauuuaguugacauaauauuuauauuccaacuguaaaguggcagcuacaaauaggagcaaagaggagguaaauucucuaaggggaucuagcuguaaauucuuaccauuauaaaaguucuauuuauaugcaaaagagugugacuaauacuauacgggcauccccauaguaggucaauucuauacauucuuugcaaagaaacaaagucaagcaagugcuacugugcagaugaguacuaccuccuugggguccucagugcaagauggagaguucuugcagaugugugaccgagcagguugucccagggcaccuagagaaaaaaaagaaauucaaauguccacuucaguggcaguuggacagcuucuagacacaaugucaugcaacguaacugugaagaacacuaagcuggcaugccugcuuuaggaauucguuaaagggcucuguaguguaguguagcuucuguaagcauugucauuacucugaaggaggaagauguggcucagaggaguuauuaugacucauauaguaccacacaaaggcagggucagagugguacuuuaccugucuacauucugauuccuaccccaaggcauuccuagaugcagcaucuggccucuucaaguauuggauuuucaauaagguugacccagauaauagucacaagaacauuucccuggcuuuguggaauucuaugucaaacucacuaaagagucacuugugaaucaccuaacuuccucuccuuugaaacuuuagagaugacuauaauugauuacaaguaggaugucuuaggguuucuauugcugggauaagacaccaugaccaaaaucaacuuggggacgaaaggguuuauuucauuuauacuuccagauaacaguccauuagugaaggaagucagugcaggaacucagguugggcaagaacccauagacgguaacugauguagacaacaggagugcugcuuacuggcuugucccucugacuugcuggccugauaccaguccuggaauggcacuacccacaacagucugggaccuuguacaucagucacuaaucaagaaacugccuucuaggcuugccuacagacagaucuuauggguucuauggaggccuuucucuucucuggggugaugcuagcuugugucaaguugacauaaaguaaucaaaacagaggagaacacaggcuucugguacagcuaccuagguuuagauccuacacagcuguuaaucuaauugaccuuuucacucuaccucugucaaaugggcauaauaauauaugagggaugcaauuuagaggauauuuuuuuuuuucuuaugugaaaguaacuaagagcccaacagacucuaaugcuuaccaaugacucaauggcauccccgcuggccagcuucucucuaguauaaucucucccucuucuuuuccuucauaugcccaguuuugaaauuaaaaacaaacaaacaaagcaacaaaccuaaagucacagaaccuaguucauucucugggauuuuuggaagagucauuauuuccuuuuuaaaaucuaauuauuuuucuucauaccacgauacuuguucugcucauaaugagacugaaaucacucauccauuauccagcaaauauuuacugcagaucuacccaugaaguauuuucuauaucucugaacauaaaagccucacaugcuaccuguauccccauaguggggaaagagacaaagaaaauaaagaugccaugugcuugaguaauuaaauggugcuaagugcucugggaaauguccucccccugcccccuacccccaccacacacacacacacacacacacacacacacacacacacagagagagagagagagagagagagagagagagaaguugagagugaguucuaauuuuccagguccugagaauggaauaggauuguugaagacaaagacuaagaugguaucauacuggaaugggaugagucacauucagcaggaguggcuuacaucuaagaggaagaccauaugaauacagugacacaauaggagacuaccccuaaugacagagcuaacgugaggcugcuacaaggcaagggacucuaaguuuuguuagcaagccaccggaauccaguaagagguggaaucccaucccuacaaccccaacauauccauucccagggaauuuccuccguggaacaugguccuaauggcauucugauuucagacagagucucaagagcugccagaccaaaaaaccaaaacaucucaagcuucuguguuuugagugcugcccuaugaaaugagcacggugaauaugggaagauguuuacauuuuuaaacaaggagauuaagaaagaucuuacuaggaauaaacaucucaggcaaaacaggaaugaaauucagaaagcagacaauaaaaaagagcuuugaauaaagauguuuuccaggcagagggugcagaaugugccugacaauguugauacauuggaagggaaacuaguauggcugcuaaaaagaggccagagugucaggagauggggaagcaggaaccagcagcucagaacaauguaccacugcuauuacuugggcuuuuauucgcuacaggguaugaagcaacuguacaguucagaguugagguggaccagaagcuggcuugcacuaguaagaucucccugacucuucagugagaauaaacugaagauaagaccacuaagaaaucuggggaaaccugaagaggaaaacugcagccagucugugugaacagccggaguggggacuggacagcucuagacuguauauucagaagaaaagauacaaauggcuggcaacacacuggaaucagagguacacuccuggcuucuuaaugauuaaacuggauagcaagacaauucaauaguacuaaccaucugaagaagugaucuuccuaugagccagucaugacaaacacacagggaacauauugggcaggcauggacuaagaaaccagaaucuauaagaaaccuccuaaaucaagaaaaagacagagagaagcacaacagaguaaugggaguuguucaaauaagaaacuacaauggaucaugaacuuaagaaguucacucagcagucagcaagaaaauggaaauuaaaguaauaagauuucauuuuccuuccaucccaaguaguuaacaugaaaaggccuggcaaaauucaauguugcccaagaugugaggaaaauaaugucauauuccaauuacuccuggcagaaucaugaauugaaacauuauucuagugagagcuuuuauuguauuuaucaaacgcaguauuacauauuccaugcauagugauucacccuggcagaugcgcagagcuugauaaacaugcauacaaggagguacaugcuaagaagaguaucauaacacugguuacuauaacaaaacuuugcaaugaucuaaaaauucacucccaaaaggaaauggguaaguaaaauuuguuucauauauaguaugcaacagucuuaaaaagaauuaguugguuuuauauauacaaaucaguacacauuucacaucauaaauaguuauuaaacaacaaaaauaacuugaagcacaccaacauauauuccuggggauacacacacacagauauauauauaucuguguguguguguguguauauggggaaauacaaagaaugaauugggacacacccagauugacaggauuuggagcaggaagugaacaugucaggaagaauagagagugaaagaaaagacaggaaauuauagggacucuagguccaucaauaagcauuuugaaaagaaaggggaaagagaaaaaaaaagcaaaacuaugaaagcaaaucugcccaaugauggaaaucuggaugcuucugguuucauuuuuguaucuguuuguaccuuaaaguuuuuuuuuuuuuucaaauaaaagaaaggaggaaagaugaguggagggggcaagggaaaaauggaaaagaggagagaaguggggucaaggagaaagagacaguaagggugggggaaggaggcaaguuugggugaguagguggcagcgaggaccagagagggugagggagggugaggaggaucagagauagucagggugcacuuaaauucgucauaagaguuugcucucuaaacgauagaauuccaaucugugggguaucuugcuauuguagcuuuacuuuccuuguugcuuauuuuguuuguggugcuggggaccuaaaccagaaccucagacccucuagaugaguguucuaccacugccuuguacccccacccuauaauucugcuucaguuaugaguagagaccaucuuugacucaucccaggcugccucagccugcagaauagcauggaaguucaucuaggacagggaacaaaugccauccagagggacaaggagcccugugccaguggauuccagaaggacagcaguagcacuagcgcccuccccaccccaauucuuggagcuacuaacaccaaagggaagagaggaacacagguuugcugacagaguaaaccaaaaaguauuccauggacaucuuuccaaccuuuaggaaacgcuuguugcaauuuucuagacucaagggaacaaugugcuugauuaguccuccgccgacuuagcaauuuugcuuuuuucaaauuucuuuccuugcagcaugcucauuauuaaccuuauauguucuagggcuggagacaaggcuuuuccuccuaaaaggcagaaucuucacuuucaaaaauuagauugcuuuaaggauaacucauuuuggucacucauaaucaaaagauccucucugaaccuagggggucaccugucaaaggggcagcauuuguuaagaaggguccuuaucuuccuggagggagacucuaccgaggaacaaaaccuuacagaagaugucaccaucaugcaaugcaagccuaaccugagccuccaaguuugaacugguagauaacauuuguuugaaagugcauuauauacaugcugacaucagaggccuuugcucauaacuuggaaaaggcagcccagccuugaguacuuggccaucccaagucuuuccacacaggcagcuacaaagcagaagguaccaaucaaagguuggauuugccucaacugcuuggcucaugucauacucucgauauucagauacuaucauucuguguaucauuauacagaccagcuuguacaaaugguuuggauugauuucuaacaggaaaacaaggcagagaaauaugugauuauguuacagauguaaguguguaauuuugugccuuucacuuggacaaugcuaaacaugcuuccacauuuagauuacacuuuucagagcaucuucuacacagaauaguucaauuugucugccuaaguguucauaauuauguugugugcugugacaaacacugugaaguacuugcugcaucucuacagacaagcacacagcagagaguacucagcugggggccaucccuacuaacaagaugggugaugauuuucaaccccaggaaaaugaagaguacuccugccuuugguuuuauguuuccauuucuagauaaaaacacagccaagauuauaggccugggaaugcuuuuuuagcaaaauaggauacagucuugcauugugguuaaggacauggguuuagacccugagacuuauaagucaaauaggugcuggccauugguguucacacuuguguucccauugguaagcaggguuuauaauucugccuucucaaaggaguuaucaggggauuucaugcaugauucacaaaaagggcauacuacauggcuaaaaccaggacaggcaugaccaucaccuucuguccucauuggagucacccccauuaugcuuuuccagaucuuuguuuucacccaccauccucacagccauucaaggcucauuuaaaacaucacacacugcauuguuugguaauugauuacuuucauucaauuaaugaaguauuuauugaguauauagcugucagacuuaaugcuggggccugggguucuaaaacaauaauaaaauaauaaaucuccagagagcuauucaagcagacugugaucaaauaggauggcuucauuucuuucaagcugaaagcagaaugaugggggaaaauaguguguugguucuaagcaaacaaacaaacaaacaaacaaacaaugaacugcauuaggucugggaccagccgcacaaggaagaugcaagcaaguggcaggaggaugguuuccuaagaauacaaacacagccccucuucacuguuacucaaagucagcagaaaaccauacaaugagucaucagauuuaguaaaacuuuaugugaaucaccaaauacugcucacuuucagaggaacaccagucaagacagaaaugaaacuagucucgcacuuacuucucaacaccuauuccuauguuugagaaguaugcuacaguuagcauucaucuuggagccaacccaccacaccuguuauuaauuuuacuaucaauuuuuuggaggcagaauuuuagcucucuagucuaugcuugcuuggaacuugcuauccaguccagguuuuccuagaaugugcaauaauagcaccagcaaaaagaaaaggaaaaaaaaugcugaauuuuuaguauaccaaugcuucacaggacaaauaaugcccgcugaccaagauaacuucaucuaauuuaguucauuucauggaccuaacaacucacacugcuagacagauacauuucuauuuccuaguuaauuauugugcuacauacaacacaugcauauaauagcuacagauucuuugcaaauugauaaaagaaaaagaaaagaagaggaagagaagagaagagaagagaagagaagagaagagaagagguagaagggagaggagaggaggggcagggagagaaagaggcacagaaguacauguuucacucuacccuagucuuagcauaggauaaaauucuguaaugugccucuugcaguuuucacaguaguugcucacugaagacugaaaaacacaagcuuccuggcucaacuugggaacauuaggaauggggaaaaccaaucagaccaaaauuccaccacaaaacaugacuauaggagauuggagugcacuacuucaauagugauguuucuuuggcauaaagauuuaucuaaagugagaggauaguuacuguggagauuacaaauaaacagaaacacuuuuaggagaagcucauguuaauagaguaacucaauguucaaguccacuuccucuaaauuccuacaaauaugugccacccgaaaucacagaaagaaaucuacacaggaaaccucauucugcuuaccauggccuuccugggcaucucuccauaaauggccuucaucgguuagguuugugguggcguuugaaccugaacucaaagcaucuaugaguaucucuuaugagaaacauauauuauuaagcuucuuuuauuucccccauuaugugaaccuuuguuguagggucugccccugccaaaaaccaaaguaguaaagaaaaaacuucauuuucuuuccauauacuugccaacauuccaaauuaugagggagaaugcaggguaggggaagaguuuagcaugauuucuauuuaaaaccccaaaugucccuggagaaccagagauaaccacauaauaagacagcauuaguuauaucuggaaaugugucuuaaugucagaauauuucucuuuguuacucuagugcuagaaaaaccaagagaaaugucagaguuugaacuggugccugauggaggaaaacauuaagcuuuucuaugacagaaugagaauauauuugcaauuuccuaauguuuucuugguuugggugaagacauaaaagacaaaugaaaacccugccuguccuuuuguuuuccuuacacaggaaaaacaaaauuauaaaaugaucugucucguuaacuaucaggaagauggaagugaauuuaaaagacaguuuuuucaauaccggagugcuguaaaguucugauuucaugacuaguucaauucaauucacauacacacaugcccuguauaugugugcuaaaguaauuuaacagccacaagcaguguacagcaugcuuccaguaacuucuaccaugccuugauucucuggcagauacaaaaucuugaugguuaaauuauuucugcauuguccuaagaaacuccccaguguuaauguguacacaccacuccccucacccaauaaauugcuaaaacugcagagagaaucucaagcaaugguacuugaggcaacuguuacuaguuaaagaggaaauucagagagagagagggggggaccgguuaggauagcugaugggauucucaaaaggcacggggaggaaggagcagccgcugaauaacacagguuuuuuaaagguaaguuaucccuuagagcaauuaccagaaugugagaguuccccucacaccucucaaccuuacacucugaaaaagaaucucuucuaaugcaagacuaagagagccaauuacuucagcaccaagccacauccuaaaucccugaacuuggcaguuaaaguuuuuuccccccuuagaaaauguucuucuagaaaucuucacuaacaacucugacuuucuacauuuagacucugaaaagaugaaugagaacuaagcaauuauauaccaaaguagagaggguacugagaagggccuacagucuuagcucaaccaccaaggagcucugagaucuaguucauacuuagaguaaaaagcagcaagcauaacaaugaacaaauacagggcuuuugguaugcagaggguuuuccagcagcugguucauuccugcacaauaaccuuucagagaggaaucuccaccacaccaugugacaaaauguggagcaaugggcuaugcacagauggccuggucuccagucgagcugaggucuugaaccccaugggacccgugggugguaauuuccaucuacaugggaugguaggcauucccccauaucuccuggacuccuguugaaguuaccacccccagaacuccuacaggagaagcuguggcuauaggucacauacagaaugccccuagcuucuggccuucuggcuagacuccuccucacaguuaccuagcaacagcaagauaacaagaccaguauaagaggggcugcuuggccccucuccccucucuuaagcuucuacuuucuucacucucucuccuuacuuucuuacucucuaagcuuuuaccucucucucuaagccuucaccuuucuuacucuauaacucucuuucucuuucccuuccagcaugggaugccagagacugagaaccugguaccgggggcugccccuuguccacccccagcugugugggucaguggcuucacacagccagaugcccacccaaggcacguggaaagcauccggcaguccucccaugucugccugcccaaagcacaggaacucuguucggacucuggcuaucucccuccccgcucuuccccuacaucuauggccccacaacagaacggcagguaaggagcaugcuaaucagcuuugccaggcuggaacugaauaucuguguccccaugaaggaguggcuuauggcuuuagaggccauggucacuuggcuuuguuacucugggccaguggcaguacaguguauguaccacagugaaagugcaugcugaaggaugacaaaggacaggcaagagggagcuugugugcccauagcccuuucaaggaccuucucuuaacgcccaaacuucuuccaguuagaccucauauccugaagacuccaguacagccaaacagaaccaugggcugcagaccaaacuuaaacacaugaaucuugggaagacagucuugaccacaguuguugagaacagcuuaccuacauccaccaacugaagaggugagaucaggauuccagcauaaaaacucccacccagaacccaccccuuagcaacacacuguguauacaagugugauaaacccugaaggugcacuagaaagcuacuuccagcaaccagggucuacgauuuaugaggcacaguagcaaaauagaaacauuucaacauuggagcuuuuccaggcucaggugguaguuucuucucuaagcccaggauaauacugcagauauuccuuggcuuauggugcauguagauucuagaaaagucaucacaaguugaagauagacauccuaaguagaaagugcauugacuauucauccuuagcuuagugacacaguccccucauggucucauggcucauuggaauuaugcuuacuucuguggccuagcuuagagagaaucaugcccaccuaucacuacccuaggaaaagaucucuguggagaauuugaagccugguuuccauugaauacauacugcuuuuguaccuucaucauuaaaaaucacuaagccaacaucaucccaagucggauacccccuaguuauagagacaguggucacuagcccacugugagaaggcuugcucaauaccaggcacuaucuaagcauuuucucacauugacucauaagauauucaauacuauucuuugauuccuauuuuaaagacaaggaaacaugggcagaaucaacuaauuauuugacguaaaucauaagcugucucugccugucuugucucucugucucugauucuuucucugugucucuuucucuguauguguacguguguauaguacacgucuguguaauauauguguauuguggcauacacauucagaggucaaaggagggcacaggguauacuguucuucuacucucuacuuuauucccuugagacagauucucucaacaaacaugaagcccuuuucuucuucuggcuggcagcuagcaugcucuagugguacuccucccaucuccacccuccccucccugccaugcccacaagcagugcuggcauuagaggggcacaaggccauaguuccuaggauccaaacucaggugcucauguuuguaugugaggcuguuauccuuugagccacuuuccagcuccccauaucacaguuuccaaacuguggauccuggauucucuuucuuagggaauagcucaaauauaugaggaacucacaguaauagucaaaugacaucuuuccuauguugcaaugucuggaauaauuuaauccacaguucaagauaaacuggaaaauucauauaaauaucaagacagccuacucugucauucagcaguguguguguguguguguguauguguguguguaauuuuuuaacaaaaaaagagcucaggguugagaagcucacucagugcauaaagcuauugucacacaggagcaaggagucuaaaccccagagcacacauaaagacaggagcaguaaugcugucuuuaaugugccuaagguaaagugggaagcagagacaggaagaucucuagaugcccaugggcgagucaugcugguggguauauucagcaacacacaagaaaaccuuucuuaagaaacauagaagacaaagacuauuacccaagaauucccucugaugucacacaugggcacaaaggacaggcacaagagcacauaugaacagagagcucacauauaucugcuacgugacacaguaucuuuugauuacuuggguagcccuucccuuugggcugauacuguguuauucuaagcugcacaaaccuggguuuccugcucucacuagagaacaaaucuauucucuuauucauuugagaaauuauuuuuuaagaugcauuuuacuuaacccaaucgauugaaaauauuucaacauguaauaaaauuuaugauacauuaaaauuuuuauguuaagcauucaagauucagaguguucuuuauauuuauagccaaucugagcucauggugccucugagugcugaggguccauccacaugucagcaguagcuccaguacuacuucauaaggguauugagguuggaccacacaauccuagugggaggggccuagaagagccaugguuauugcuauuucuaaguuucuuuucuuaggcuggacagauuuccuaacacaggguccaucuagaccuggaaugaacaggaccccacaguggagucuucuauguaagccuccuggugcuuugugguucugcugaccuuugcaugcucugggcuacucuuucugaggcugaagggagagugagaggauugguccuagcucugcaggaggcaaggacugaggaaucucacagguauuuagaaucuuuucaguguucaauaaauauuccuuaauucccacuuaauucacagugacaauaauaccagauccuuucuggaaacgcaccaucauucccccaccuagcucccuuauaaaucagccucuggcuuuugaagcugcuccugugauuauagucauucauugccuaacaacagggacacauucucuuaacaguucuuaggcaacuucaucauccucaaacaaugugguggauacuuauguaaacuaaaauggcuacaguauuuccaggcaauauaaacuuacaggauccuguucagauaggcuauaccccaaucaaaaagucagacuaugaacaauaugaacauuaauuuuauuuuuuccuacaauuuagguaauuuaacaucuauuuacauguaucaaguaccuuugcucaauacaacccacacgaggaauguaccacuuguucagcuacuauauuacuggagcaccaucuuguuucuaguugguaggcauaauuugugggaacauauuaagauguuuuauccauuuuuuaguuuuuuucuacuugauauugggauugauuugugucuucccaauacaagggcuuuuuguuuuguuuuguuuuccuuuguuucuuuuuaaguucacaguuugaaaauauuucuuacucuguagcuugucuucgcuucuccugagaaaagcuuccauugaauuacauaucuauuuuuucaggaauacucaugcuauacuaagucucaaaaugcgguaaaccaauucuuucaacuucauuguacuucuuuaacacuguuuuaauuacuguaauuacuuuguuggcaaauaacuuuuagcauaauguugccuuuauauaaccuaagauuuuaaaaggaaagacaugaaacuuacauguaauuugggacauaaauacaauccuuacucuggcccacccagucauucacagauaagugguggguuuuuauagauaauguuuaauaacucgaggaaguucccuuaaauuucaucacuucugaaagaucuuuucaaaaaccaguguugaauuuuguuaaauacuuuuuccuuauggaguauauuuuuccuauuuuuuuuagaauuggauauuuucuuuauuuacauuucaaauacacaaacccuuucccaguuuccccuccucaaccuccccuaucucauccccucucccccugcuucuaccaggaugcuccccuacccacccacccacccacccacucccaccucacugcccuggaauuccucuacacuggggcaucaagccuucacaugaccaagcaccucuccucccauugaugccugaaaagaccauccucuacuacauauguggcugggucaugggucccuccauguguacuccuuguuugguggcuuagucccuggcagcucuggggguucuguuugguugauauugggguugcaaaccccuucagcuccuucaguccuuucucuaccuccuccauugggguaaccaugcuaaauccaaugguugguugcgagcauccaccucuguauuugucaggcucuggcagagccucucaggagacagcuauauaaggcuccuuucagcaagcacuucuuggcauccacaauagugccuagguuugguaacuguauaugggauagauccccagguggggaagucucuggacuggacugccuuuucuucagucucugcucuaaacauugucucuauauuuugucuuguaucuccucccauggguuuuguuccccuuucuaagaaggaccaaacuaucuacacuuuggucuuccuucuucuugcauuucauauggucugugaauuguauauuggguauucugagcuuuugggcuaauauccauacuauguguguucuuuugugauuagguuaccucuguuaaugugauaaauuauaucgauuagcuuuuuaauaauuaaccaaaaucauauugauucacuuacuagggaaccaggcuugcauccuuggaauacacucagcuuuaucaugauguauaauucuuuuucuuucacauuuuuugcuauaauuucauuaagaauuuucauuuauacauuuaccagaguuguggcaauguagcuuuuauuuaguuuuugcacugcuuuugauuuugggggagucuugguaauguguuuauaaaauuaacuagaaagaaauaguauaaaauugacuuccucaaugaauguacuuaggccuaaacaucauuguacauuuuuuaaaaagaugaauucaguuuccuuaguuguuaugaguuauauuaucuauuuccuguggaucaacuucaggaauuugauagugauguauuucaucuaaguugucaaaugcuugguaaauacagugaucugucauugcuauuaugauggcuguuguaucuguagugauagcccuugcuuccugacuccuauuuagucuucucucuuuggagguuugucagcuuuacugauuuucagagagaaucagcuuuuccugcuuuauuuguuuuaaagauuuuuauaacacauaccuuuuauuauugugauuuaagucuacuuccaguuguuucaagugaaguguucuuacagucugauaacagcucagcuaaguucuauacuuagcuuauggguuuauuaauaaacaucuagcuauguauuugcuauauuuuaagacaccuuauguuuuguuuguccucuuugcuuuuuguauuuguucuuuauauuuuccauacuuuuugugagcuauuugaacauucgaguaacuuacuuggcauaucuaaaguguuuuuagagcaccacucugcacagcuuuaguauauguguuaaauaucacauuauauauucauaaaaugaacagauucuugguaucuucauuauaccacuuuaaauaagaauuaaaaccucuuuuugcauccuuaccucuauucauaaaauaauaauccuaacuucuucucuacauaucugcuucaaguccuuaucaaaguguucaaucuuugaacaccauuuacaacugucaagaucacuuuuucuuuucuuucugguguuccaggauuccauuuucacuguuuucaugcuuuagaaagaucugcuggcagcagauucucuugguuuuccuuccuuuaaaaaaaagaaaccuuucacuccuucauucauugcugaaggacauuuucacugguuauaggauucuagguugacuguugacugauauuuucaaguccuugaagcuuuaaauuccugaguggcaguagaaacacucaagaagaaaagaguauaagagacugcaccuucuugaauugaaauaucaccagaauaaucugguucuagcaggagcaacagacaugugaaaaauuacagucacuuaugauauugagagaaauacucuuauuuugauuaauggucaaagaauggaaugagugcauuuggagagaagucagauauaacaggcaggugucugagguucaggaugucuuagaagcaaguggacaugguaugggaaagaugguacaucugggagcugcuacauuugaagcacugauuacuaaacucauacacuguuaaaguaguuuucacuaaauuacuagcauucucuuuagucugauauagaugugaaucuaguuuuucgaaguguuaggguguguuaauggccaaaaagagaaagaaaacucuaugaguuuugucuucugcauucuaauuugcaugugcuccucucugucuguugaucacuucauugucucuguagcuaaugaaaggagaaucauacuggcauccgggcaaagugucaggcagcaagagaagggaaggucuuuaacuuucccacagcucugucacaacauuaaaaauucuuuuuuuuuacacaaaaguauauuuaauaagaaaacaagauuuccuuuauuuacacuucaaauguuauccccuuuccuaguuuccacucugaaaaucucccauccucuccccccuccuccugcucaccaacccacccacuccugcuuccuggcccugacauuacucuauacugaggcauagaaccaucucaggaccaagggccucuccgcccauugaugaacaacuagaccauccucugcuacaagugcagcuagagccaugaguccuuccaucuguuaucuuugauuggagguuuaguucuaaggagcucuggugguacugguuaguucauauuguuguuccuccuauuaaaaaaugugguacagagcuaaacaaagcauucucaacugaggaauaucgaauggcugagaagcaucuaaaaaaaaaaguucaacauccuuaaucaucagggaaaugcaaaucaaaacaacccugagauuccaccucacaccagucaaaaugguuaagaucaaaaacucaggugacagcagaugcugguaaggauguggagaaagaggaacacuccuccauugcuggugggauugcaaacugguacaaacacucuggaaaucaguuuggcaguuccucagaaaacuggacauaauacuaccagaauauucagcaauaccacuccugggcauauacccagaagaugguccaacuuguaauagggacacaugcuccacuauguucauagcagccuuauuuauaauagccagaaacuggaaagaacccagaugucccucaacagaagaauggauacagaaaaugugguacauuuacauaauauucagcuauuaaaaacaaugaauuugugaaauucuuagacaaauggguggaucuggaggauaucauccuaagugagguaaccuaaucaccaaagaacacacaugcuauacacucacugauaaguagauauuagcucagaagcucaaaauacccaagauacaaucugcaaaacacaugaaacucaagaagaaggaagaccgaaguuuggauacuucgauccuucuuagaagagggaucaaaauucucauggaagcaguuacagagacaaaguuccgagcagagacugaaggaaugaccauccagaaacugcccucccucuuacccccccauccccaagauucaucccauaaacaaccacuaaacccagacacuauuacagaugccaauaagagauugcugacaggaaccugauauagcugucuucugagaggcucugccagugccugacuaauauagaaguggaugaucacagucauccauuggacggaccgguccccaaugaaggagcuagagaaaggacccaaggaacauuaaaaauucuuaacauacauuucacauuauuuacugagggaaaauuuaccaaugccauuggcuacaaaggaaauagaugcuuguauacuuuguaaaauuugcacuccacuuuccauaaauucucaguauccagagaccuucagauuguugcugggucuauggugccuugcugauaguuugucaggcaccuagggccuuuucaaggaaggagacagagcucuuuccauaggugcugaauaguuauaggacuacagccaacacauguuugauggucaaaccaucauuucagaggagaagagaaaaaccugaagaguauaaugaagcuaacaacagugccuaacuacuuccuaguuuauuuuuaguccaacuguuugaaauaaguguuuguuaccuucaugcugccucucaggaggcauauauauauuuguucuuggagacauggaagagaccuggggauugggaagauggcauagucacaaaagugcacgcugcacaaaugugcaaccugagcucagauccccagaacugauguaaaaaguugucacagugcucuauaucuguaaucauaaagauguggaggcagagacaagaagauccucauccagucuugaucuccaaauuuaaggaaagaccccccccccaucucaaaaaauaagguggaggagaauaauggaaauugcccuacauggaccucuggccuccaaaugcauguuugugcacaugcacacuuguacacaugugcgcaugcacgcgcacacacacacacacacacacacauacacacacacacacacacuaaaauaaaauaaaauaaaauaaaauaaaacgaaaugaaauaaagugacaagagucccucugauuuaaucuacaccauggaaucagguucuuuaauuuaauuuacuuauuccuguauucacuuauguuuauuuuaaauuuacuuuuacuauuuuuaaaguauguaugugccaaugugaggcuguaggcacccccagaggccagaaggacugcauccuccuggagcuggagcuacagggaguugugagaugccaugcuugcauguaggaaguggaacucaggcccucucuaaaaccaccaaggacucuuaaccaaucagccaguucuugagccccagguucuucaguucucaaauguuaaacuguuucagaauaugaaaucugaaaacugccaauaaaaaaugaagaugucagugguuacauuauauuagcagacaggaaaaggagccaaaacaaguccacugguuagggccugaagcaaaucagacuggaaagaaucaugacugugcuccauuuccauuaacauauuuccucuuuaaauucacauuuuuuuaaaucuuuugugauauacuguuguuuucuguguuguuucuuugaauauuguguguauuguccuaucaaggguguacuguccauguguacagagcugucaguuuguacaguguugucaguguguguaauacugucaaguaugcacagugcucucuguguguaccgugauaucaguguguacagaaccguuaguguguacagugccaucaguagcuucagagcugucaguguguauagaacugucagugguuacaaugcuaucaggguauauaguacuguuaguauguacaaugcuaccaggguguauaguacuguuggcauguacagugcggucuguguguacagugccaucaguggaugguguuuacugcuuuggcaaugugaaugagucaauucuucagagguaggaacacaaaguauuucccaccaaguuuucuuuccagaaauccucccuagucaugucagauaugaaguaagauuuuuuccuacuuguuaaagguuugauuaaauuucagaggcagguaugugagagagaacaagagucaacuuggacauaugcuguucuuaaacagguuaagaguggcgguauacauuuuuaguuuuguguucacaucccuucauuuugaacacagauguuuuuuucuacgugaaugaauuuuuugugacacucuuuuuuucuguacugccuugcuuucucaucuguuuaugcaacaugcuauaccaaaauuauauuauaagagaagaaauuugguauucauggacaaaaacaacaaaucuauuagaaauuauguguauuuuguccacaacaugagaugacguuauagagaauacuauauuccauauaaacaauguacaauacauuaugaugucguguaauuaugaaauauccccuauaggucuauacuuaaaacuuguguucuagcuacugauacugggacuuagcuggcugaagcgaaucacuaacgacaaagcuuugaagguucucgaaaaauccuugguuugugccccucuuucucagcuucuuaaccugcugugauccuaaaagcccuagcauacacacccaccaccauggacuuugucccacuuccuugccauuuugaacuaaaaucucucugaaaccauaauucaacaguagcuuuucuucucuuaaguuguuuguacuaggaguuuuguucacagcaauaacaaaaauauaaguaaaaugacuagauuuaaacuguacaaacuaauggccucucauagaccuuagcauaccugauaacgaaauaagaagucauggcaggguuggagacaugccccagugguuaggaacaugcacuauccauccccaaguuugguucuuaacaccuacuuuggguagcucagaacugccugugauucaaucccaacgggaucugacacucucuucuggccucugugaaaacacgcacaaagcucaaauggaugcucaaauaagcacaucaucaagucuaggggcuggagagaugacucaguuguuaagaguacucauugcucuaccaagauccuagguuguuuccccagcaccacaugguuggucacaacugugccaaacucaguuuaggggauccacuacucucuucuggccucuucacacaccaggaaugcccaugguguguguguguguguguguguguguguguguguguacccaaacacauagaauaaaacaaauuaaacuauuuuaaacaauaaaagaucauuacaagacuuuuuuuuuuccuuuucauauucuaucaaucuuuauuuuacuuucuucuguuugguucaauguuuuaucuaaagaagucaacaugcaauuccucauuccguuuaccacacggaagcugaaaucguuauagacccagcauauuuugaauaauuaacuaugccaucacauguuaucuuucagaagaaaucaacuguaaaguguggcaguaaaggaacagcugucagucuacgacaugcaucccuuugagaggcugcugcuugcacuguauauguacauaaguuauuagaacaauuagaaugcauccuuguugucuuuuaauuagauuauuccuuguuccgguaauuauacuagacaagggaaaaaaauaguuugaggauucugaaaucaucuguagacugagggaagugagugaucaauaaugcuaaucuacuggaacacuuagauucuugggaaagauauuuuuaucugguguguuccccugcauaaucagcauuauuucucaaugucuggcucaucugccuaaaguuugaaaguaacuacacuggacaaauaacagauauuuauuccacuuccagaagcuugguaaggcuuggucgccuccuccggccaauggcucaaacauugcuucauguccuugaaaaauaacaaguaaccacaaacaaaagacuuaggauccuagaaauaucgaacagucugaauaccuaacagaaaggauagaagacauuucagauucagaucuacauaauuaucauaaacuauccuggcuugaaaauauauucaaauugcuguaauguagucauaaauaauaaagccacuaacuaauauaagaaggauaacuaucauccccauacaugcagagcuaauugguagaaauuaaccggcaggcugauagaaaggaggcgaguucagccucuuucuuggauuggagauuagaacacaguuugcacuccuguggccugugcaauggucaccagccauggagaacacuucccagaacuuucaggacucagaaucugaguucgggaauagguaucaucuguccucuggcaaaaccaggcaguuuguuaaacaguguuggaagacacagaauugaccccagugaaucuggaguucucucuaauacuaggcaacauagaugcccaucccccagcccagauuacaggaagcucaguuggccccagucaaugcacaguccuaaugagaccaugucuagacaguauugaucucuuaccaggaaaaaaaaaaaagucagacugugacuucuuuucuagcuuaguccagaugacauccaaauaugauauuucauucacacauugccucccuaaacacagucauuuuguuugcaacacacuaugacacaaugguuuauuuucaaguuaucaggacaugugaaugcuuaaugauagucaacuagcacauaaggaaguuaguuauccuagggaaaugggaugagucuuugauauauauuuauuuucuuugcuaggcaagagaaacaggcuuugaacuaaucagaggggcaaauaaccugaaguuaauuagcucaaguuaauauagguaaaauaucccaaggagaaaguguuagcuuauuccaaaagacuaucugcgaaagcccugggagaacuccuacaaacuguuguguaucccaauuuggaagaaauguuucuccacaaaagcaucucuuuaaauuuucagguacaccaaucaaaacuugaggguccccacuucucuuaccuucagauuaguccaaccuaucagguagaauacuaucuugaaggcaccaacgucuugcauuugguugcacuguggggagguauuccaaaguaggcugagcauucaugugccugcagaaagucaggaaggaaaugcagccugcaguugcugcagcagaggaauacagacuacagacagaugagauagaacuggguaucauaaucuguuuuaguuaggguuugcauugcugugaagggauaccaugaccaaggaaacucuuauaaggacagcauugaauuggggcuggcuuacagguucagagguucaguccguuaccacuggggcggggggcggggggcaauggcagugccaagacaggcauggugcaaaaggagcugagaguucaacauccuuuaacaaggucacaccuaauagugccacucccugggccaaaaauauucaaaccaccacauaagcguaaguggaaagcagcauuacaucuuucucugugggugacauggaauaaagaccacgacauucagaugguuccugaauaugcaauggucucaagguugguuuuguucacaugggggaaaagaccauguugucauguugcaaugaugccaauguacaaaccaaucaugaagaaaauaucaucccauccccuaaagaaaaauaauccaggagacugucaccaguaucacuaguuuaagacacacaucaccgauugcaaagugauuaauucugugcaugcuaacuaaauguuuuauuagucuuggaacuaguucacuaucucaagagaccacaagaaaguaccacucacuuauaagaucuuguacuggauuaugaacuguuugagcuuuucugcccaaacagaaauugagcggguuggcaguaggggugauuguauaacuugaacuguauauauugauaucacaagcuacuuuccccaaaugcacuguaugcaauuugcugugauuacagaaaaguccugcaguacuccuuaauggacuaaaugcaaaccugucacacauuuucucuucucaguaugugaagggcacguguauagagagaggugugagagagugguacuaaguucacucuaugauucuuaaacaaggcagguaacaacaggaaagacugggcagagcaugugauugugguacauuuccguggauaagaguaauguaugggcccccuugacccugacccacaggggaaggcacacacauguuaaaccuacuuaucagaggagaacgaauggaagaaaguagagcuugggaauguaucaaagagauacaaaacccauuuuaaauaaggcacaacuaguugggacuugggauaaucuuguagaaacuuuacucucucuaguaaaagguaaauucuugcacauguauugccaguaacaucaaggcucacaucauugcgucuuauuccagaaccuuagcuaaacauucugauuuggccaaacacuaaaucaguuaaacuuaauaggagaaacauuucacuauugauuagguaaucuauuuaaaauaugcauuaacuuagcacacaggugaggaguguuuuagucaggguuucuauuccuggacaaaacaucaugaccaagaagcaaguuggaggaaaggguuuauucaacuuauacuuccacauugcuguucaucacuaaaggaaguugggacuggaacucaagcaggucagggagaaggagcugaugcagaggccauggagggauguucuuuacuggcuugccuccccuggcuugcucagccugcucucuuauagaaccaagauuaccagcccagagauggucccacccacaaggggcuuucccccuugaucacuaauugagaaaaugccuuacagcuauaucucauggaggcauuuccucaacugaagcuccuuucucugugauaacuccagcugugucaaguugacacaaaacuagccaguacgauugaccccuugucaacuugacacacaaacacaucccuaguaagccuaaacccuuauauucuuauucauccccaaggucuaaauaacuuuaaacaucccacagucuuuacauauucuuaaaauuucaaucucuuuaaaauauccauaucuuuuaaaauccuaagucuuuuuacaauuaaaagucuuaacugugggcuguuucuuccuucaagagggaaaauaucagggcacagucacaaucaaaugcaaaaaucaaucuccaaucauccaaugucugggauccaacucaugaucuucugggcuccuccaagggcuugggucacuuuuccagccaugcccuuuguagaacaugcguccuccucuaggcuccagaugccuguauuccacugcugcugcucuugguggucauuucaugguacuggcaucuccaaaaacacugcaugaccccuucaguccugggccaucaauugcaacugaggcugcaccuucagcaauggccuuccauggccucucacagugcugagucucagcugcucuacgugaccccuucaugccuucaaaaccaguaccaccugggugaccuuuacacauuaccaagucccgcugcagcaggaaugcaaccuuggcuaucucuggaacacagccucuuugugcuuucagaaaacacuucccagaagaugucaccucaacaaugcuggucucuucuuaaucaccgcuaauuucuuagcuccagcuaaccagcaucaauagucccaguaaugcaaaggcuuugcuuuaguaguucugguaucuuguuaaucacagcugauucuucagccccagcuaaccagaaccacagaauaaucaaacuccaaaauagcaauggcccugaaaagagucuuuaauuuucccucugaaaucucacaagccaguccuccaucuucugcacuguucucagcauuaucuuccaaacuccuacacaacaucugacagagcucuuaacaccaaauggaucuucuagcccaaaguuccaaaguccuuccacaguccuucccaaaacauggucagguugucacaggaauaccccacuaugcugguaccaauuugucuuagucaggguaagaguaaguucuagaaauaagaaaucagacaccucaacaaaaagggaugaagacauuuugcaccauuuagaccauugauuuucauacauuucagauaaaauuauuggcauuggggcguaaagaacccucugcauaaacacagcauuuuguuguuguuguuguuuugguguguuguuuguuuguuucucucugccuccagguuauaggagugcaaacacuaagucuuguucuuaagauuccccuaucuucuaaugucaugugaucaucuucuucuaaugucaugugaucaucuucuucuaaugucaugugaucauuccuccuaaagacuagccaauacucagggcuggagaggugccugagcaguuaagagcacugucugcucuuccagagguccugaguucaauucccagcaaccacaugguggcucagaaccaucuaugagaucugaugcccucuucuggcuugcaguuauauaugcaggcagaaugcuuuauacaaaaaaaaaaaaaaaaaaaaaaaaaagaaaagaaaaaaaaagaaagaaagaaagaaaagaaaagaaaagaaaagaaaagaaaagaaaagaaaagaaaagaaaagaaaagaaaagaaaagaguacucaauggucuucucaaguauaagaucaguuauuucucggugucauagugaagacacagagguagcuaccagcaucucucauuucuuuuaaaagcauaaaccagccuuuucuuuucaaauguggucauucacguguauaaugauuuucuaaauuuuguugaaaucauucuuagucuuccaaaaucagaacaaguugcagaaaauguuuuaauuuauuuaugaauuaggucuggucuucauuauugcuuuacagcuucuguauuagccaaugcugccuauaacauccugacaauucccccucggguaugugcuuguucucuguauuauaaucuugugaucugcuggauuuuuucugauguucuaauuuguucuaaaugagugaauuucaucgguuuugguuuccacuguucuauuuauuaaauucacugugaaugugguauuuauuuucaaaggagucauaauucuuuauuuccagcuuaguauuaacaaugaguuuaauaagcauuauauuuuuaaauaucacaaagacaaauuuuguuaaaauauuaguguuuaauguguuauauuuccuggcaaaaauaaauuaaugcuacauaaccuuuccccauuuauccaaguuucuaagagaaauaucauuauuuuaaagcuauguuaauggaaacauaaacacaacagggaaacugaagggagaaugaggagcacauaaggccaaaggcaaagcaaauagugcaauuucugagacuaaagggaagagaaggagagagggcgagugagagcaggagaggggaggagagagggaaagaaaaagagggaggggaagaaaaguaagagggagagagaaagagagacagagcacaagaaaguggaaaagugagagugggagugaaggguagggaagcaagaaugagagagacagagagucagagacagaaagacacagagacagagacacagagagaacaugaguaaugugaacagcuaccuggcuccugaacuggagagggagcaucacaggaagaauauuaagcaaaacuacagaaacuuccagguucuugaagucaugaguaaacggaaaugaaacuucauauacaaacuucauauagcugucucuugugaggcuaugccagugucuaggaaauacagaaguggaagcucacagucagcuauuggauggaucacagggcccccaauggaggagcuagagaaaguacccaaggagcuaaaggggucugcaacccuauagguggaacaacauuaugaacuauccaguacuccccggagcucgugucucuagcugcauauguaucagaagauggccuaaucggccauuauuagaaagagaggcccacuggucuugcaaacuuuauaugccucaguacaggggaaccccagggccaagaagugggaguggguggguaggggagugggugggaguguaugggggacuuuugggauagcauuggaaauguaaaugaagaaaauaccuaauaaaugaaaaaaaaaaaaaaaagacuggaugaaccacaagggauccaugagauucauggaugggaugcaaaugcuucccgaaguugcuauuuauguguugcuaucuacccuuuaguuuccaugacaugucucaaagugugaaauacaaauccgaccaucccauacauuuucaaaaauucucacccugcuugaaaugaaguuccaucaacaaauucacagguugaugucugggucaagcucacagaugacuggaauauuuuuaaaacauuauuuggaaacauggaaauggaagugucugucagugucaaauauaaagaagagugacugcgacagaaccagacaguuguaaaccacuugccauguauccgcaguggagggagaagaggaaaaucaagaggaacuguguagugugguuuacuguguaguguguucucugccugggauuguucacagagcuguacacacuuggagcuuuggugcuucccuccacaacucacccagaaaagcggacucugggaugaucuggauguggagagucugcaagucuuugcugaguuugguuauuuaaaaugagcauagcauaagauaacaugcacaggaaauagaagaaaucaaaaacggauguuaaaauaauaucaucuucccacacaaucuuagauauuuauaaauuaaacaucacuaauaaagacaugccauauaggaagaaaaaugugaaagcauaagaugaacuaggaauugugaaacuuauguuaguguguguacauauaugugucauaccauauaaaauaugauauauaaaauauaucacaagacauaaaggcauuccagugagcuaagcaaccaaggcacagccauauuuuaaggaagaggauuuaaaucuaaagccagagccucagccaagaguggcacagagcaaaauaccauugaagagcucuaaaacaccuguaggaugcauguuauaucgcuuuguguauucaagcugacagcaaauauuugagaacaaacaacucagcuaggcuaaaagaugaaaauaaagaaaagcacccauguaaacacauacuuauccaaaccaccuugacuuuaaggaaauaccaaauuuccaccacugagucuuuccagguaaaagaagguaaggcaagagaggccuuuacuccacaugcuacuauuuucuuuaagcucuuucucucucucucucucucucucucucucucucucucuuucucucucucugugugugugugugugugugcucucaugcaugugugggaaugagauggacuuuacuggaauauaugcauauauguauauaacaagcuuggauuauauugaccccuuaucuucuuuuaucucuuuuccauccuacuguuucaauacuaucauuucauaacuuucauguauuuauuaaugaauauauuaauugcuaaggcuaaauaagacuugaugugcaagcauuauucacaggaacuaaccuagagcagaucucaguaauauugugagauuuuuaaccuaagcaguauucauuagauccacauucacaugcauuggagaaaaaccugccuuuuuucccaggcuugcuuugucagguacagcccccuagagcaacucucacuugauacuuuaggcauggaggaugugcuggcuaguuuuaugucaugagauaaacuggagucauuuuggaagagggaaccccaauuaaagaaaugccccgacaugacuggcuugugggccaaucgauguagaagguagguauucacauuccuaagacugugguccuaggugccagaaggaagcugacugagcaggccauguggaacaagcugguaauuagcaugccccauagccauucccucagcucccgccuugugugcuugcuuuuacuuuugcucaugauagacugugaucaggacauguaagaugauucuggugaugauguucgaccacagcaauagaagcccuaagacauuccggcuucagaugagucugcuguccucaacugggaugcaucucagaaggcuggcuccuugaagccagagacacagcauacguaucccaagcgacagagcaucaaaagaguaugguaacuuucuccaucaaaaaacugaacugaaaagauaacccaguugguaaagugcuugccuaacaagcaugacuacccauguuaaaucucuagaauacacauaaaauaucuaagcgugguaggcugauaauccuagaacugagacacgaugguucuugggaauauuggccagccaucugagccuucuuggagaguuucaggcuggugggagauccugucagaagaagaagaagaagaagaagaagaagaagaagaagaagaagaagaagaagaagaagaagaagaagaagaagaagaagaagaagaagaaagaaagaaagaaagaaagaaagaaagaaagaaagaaagaaagaaagaaagaagaaagaagaaaagaagaaagaggaggaagaggaagaggaggaggagggggaggggaagagggggacagggaagagggaaggaaggaaggaaggaaggaaggaaggaaggaaggaaggaaggaaggaaggaaagaaggaaggaaaagacaaggaaagaaauaaaagaaaaaagaaaggaaagguaaggaaagaugcaugaugucugaggaaaagcauaagaaacuguccucuggucuccaccuacaagugcacaagugugcacuugcaccacuacccccaaacacaccaaaaguaaaacaucaaauuucuaucaaugucacuaaaaucaaugagcaaugaaacccaaucuuaaauccaagggaucucuuauuacccuuauagcagaugccucaaaaaucuagaaacaagugcuuucuccuuucucuuuuucuuccccgacuuuccuuucuuucuuuccuugaaacuguugacugaggucaaugaagaucaaauagggcaaucaaauagauuugccucugagccaacauaucuggaccaaccucauugucaggucuuuauaugaucucccuccaggguccucugugaugggaacaguggucuugcucagcaauuucacccucaacaaaugaagaaagaacauuuuucuccuggacaugugcguaaugcagcucagacacuuucuccuucccuuccuuccuuugugcucacugcuugccacugcccacccuggccaccaguucauaaauucauagugagucucuggaugaggccugggguagguagcucuggugaggucugaugcggacauuccugucucgggugcuuggucaucaacuguuuuccaccccucuucucguuguccuuccugagagcuuuugcuuccugcccucagcuugcacccgcucuccuuucuccuguuuguuuuuaugccuuuccagcauuacagugcaacuccucugcccuuacagauccaaacuuagggauuuaauucuacuauaaaacugcccuuucuaagauaauuuuagcaacauuaacugaaagaaaauuuucacacuuuuggaaggccauagccucaggucucagcaauaacuuuuaucaugucucauaauaaugacuacaguuauaguacuuuccuucaguccaaguguaacacuucaaagauuuccucucuucaacucccaagauucugguucaaccacuuuaggagucuagaggugcaggcuuuugagucauuaagacaaggguucaaaucuagcuucuggcaguaaauuaacuggguggaacccugugagccacuaagcuuucugaauuccaauuucacaucugacaaacauaccaaaaucuaccuaaugggaacucugugaagauaaagugagguaaccuuuguaaaauauaugcaaugucagggacacgguagcaucuaaacaagguuguuauuucuuauuguuaugugggccuggcucugcuucugcccuugguguuagcaaucaggcaccuccauagccagccugaaggaucuggcaacagcagggcaaucuuuuggccagccccggggggaccuggagacaacaggacaccucaucacuagcugccgagaggcgacacauucccacugucauuucauguuacauggucuccuccugcgcauguguggccucauucaacccccacccaccccauuucuuucuucuccccagaggcagcuucuuuauccccucuccugucccagaauaaaucucccaugugagaccucucucagagugugacuucuugaaucccaccacguagaaccaacacuugggguauuugggaaccacuacgaguucccaagaucucagaucuugguccagcagaaugggaaaggaguaucuucuuugagauaauuguuuaguguuagagcuuuucuuuauugagagaagugaaacaccccuucuagacacuauucugugaaauagcucuuggaugauauucggugaaacugcagcuuucuuuauccgaagugaacaagggaacacauaccuuggggaguggggaguggcuuuucagggagaccauacauuauuggcugggguuggcgaguugggaaugcuucauuucaugaaaagagauuccagaugcuuaugccuauaauguggccaagaggcuaccagacuucccccagaaagauggagguggggucagggaaucucaggcuaugugcccugggggcacaccgacugcgaauagggaggggcuaucuuuacaccugagggaagucaagcugagauuuuggucucaaagugaaucuccuagguucaaauaacuccuccaaguggcuuuuccuauggccaagucuccuguagcacuuacccacagugaugaaugaaaugagggaaauuuucccuucacaaaggcuuagacaggucacuuaaagggcagacacuguagaguauggugugaaagauuuauaaucccagcaguggggaggcugagcaagacugaggucaaggccaaggucaguguggauuauacagugagguccaggccagcuuggaauauguuguuaagacucuguuuuguuuguuuguuugacuuuguuuuuguaaacaacaauaacaaaaacaaaaacuacaacauugacauuaagucacuggaccccagucucauacauacagacuguggcagucugacugagcaucuccuccaugggcucagacgguuccauacuugccaacccauuagggaaugggugggcuguuuuggcagguuuguggcaucacuggaggaaauguguuacugaggccaggcuuggaagucccuaaagcuuugugccauuaccagugaucucucugcugagaugugaccucucagcuguuccugcugcaaugcaugccuucugccauacuuccuaucaugauggugauggacucuaaaccccuggaaccuuaagcccaaaauaucuguucuuucuauaagcugcucuggucacagugcuuugucauagcaauagggcagaagguaauacacugccuuguacauuauuuucacgauugagaaguuacuacauauuuucaauugaaauuaaaaguuggcaacaaacauaaaguuaggaguuguuauuuuccacauaaaauaaccuagauaucuaguugcauauuugcaccaaucacugacucucuaaugucauaaaguauaccuccuuuaaauauuuugauauuaaaaauuuuuauuucauuucccccccaaaacuaauuauuuuugucagagauuuuaaaacuaaccccuacaaagaaaaacuuagaaauugaauugcaaaaaucacagguuaccacagccaaaauagacacaggcuagaaggaugagacaaggugccaaagaggugacuuggcagacaaaggcucuugucuccaagucucaagaaccugaguucuagccugaggacccacaugguaguaagagaaaacgaauccccgaaaagucaucugugggcaccugaguaccacagcaugaacacauacauaugaacaugcacagggaaacaaaagaaauggcaguaaagagaggcugagacaagguagagcagagaagagaggagaggcugagagggaacacaguccaagggcgagugcugucaggagugcugcccuuccacccaacaacacaggaagaucacggagcucaugaugcuggaaccacucuccauggacacagaugaaacaaugggacaccccuaacugcacaugcaaaaggaaaaaaaagccugucauaccccucuacagaccuuuugucaaaguucagcuagcuaucuaagugccauuaauuggauccaauccaucagaauaagucaggcuuuuacucugagagacauucuuggaaaauucacagauggguccugauguuuagagagagcccuugaacauacucuuguaucaagcacaccugcuuuuaaaugcuacuuuugcuguuuacuuguuggcaaaguuuccuaauuauuacaagcuaaucuuccugaucucuaaggugauaacaugaagaacacuucucuuucggugaccccccccccccaugugugugauuuccucuuucccuucuuugacccacaccguuuuaaaacccaauucuuacuuuuauuugugaaauuuaagcaugcaaagucuuauuuacaaguuggucaaauugcuacacuacaauguggaccaagguugguuucuucuccuuugagcuuggggaagucuggacucuacuguuugccuguuuccuuucuuuccagcaauaacuuguaugaaccaagguguuuuggauagucuaccuuucuacauauucccuucaaucccuuuuuccuccuucuccuuuuccuuacccaacccccccaucuccuuuauuuuuuauuuauuuauuuuuaacaucuccaaagaguccuucacugguaggagagugaaauuuccagagacugcaucaaagaugccagcucuacugacacauggaaaguuugaaaaaggagcauucagcagggaagagucuuaaaagaccgguacuauaguucaaacaucaucuuucuucuccaaaacucacacugaaauuuccaaauucgauagauuugagcuaugguguggcauuuaaagaguuagaaauaguugagaggucucaaugccuucacaugaggagcacaugggcgcuugacagaugagcgaugcuuauacagcaaggcugcaguuuauguuuuuagaugccauuuucaccuccaugauaugcuuugaucauauucagccccugacacucucuugucccucucuuuccuauugaucuccuuuucucucuuaaauacuucucugaauacuucaugucuuaaaaaacaaacaagcaagcaaaccucuauauucuguauaggagagaaacccaguauuugcuucccccuuuucuacaaaugaugucauuucauucuucuguauggcugaauaaaacuguagugugcauacuucacauauuuucuuuaucagucauuugcugauaaguaucuaaucuggcucuacuuugugacuacuaugaacagugcugcaaaauguacgugaauaugcaaaaauccuuauguacugacccuuuccuuuaggguauauacucaggggugucuuaucuccacuuuaaucuucucguauuccuucauacuuucacuacucaggauucuugagcaugcuauuucuuagaaagaaccacuaggaagcaauaugaaguugaauuuaagaccuguguuccaucagccuaccuuuaucagugcuggucacuggaaaguacuggaugcugaguaguuuuuucuuaccaugucaaauauuagggccucugaccuugcuuuucccucucucuggugcucuguaucagggucuuuaauccacccuggucucaacucugguaucuucucuucagagaugccuuaucuaacaauucagucuaaagcuguucuuugcucuugucauuuucuuaacgggucucaucuuaucauaauacuccacuuuauuugcacauucauugcucaucccugccuuucccaaaugcauccaucaaagacaucuucaagacauaaguaccuucuuugugguuccuuuaccagagucagguuccugucacuagguaggagugcaaguuacuuauauauuuauaugacaauguauccaacagaaacaaucuaaaggaagguuuauuuuugggcagcacuguagagggcuacaucaaguagucucuuggugcuuucaucaagguggagagaauggggggcagagcaguugacaucauugugggacaaacacaggaauggagacaccaguucuuugauggcuuucuuccuggagcuuaugccaucaaggccccaggccaugagcauggugcuuccaauaucccagauagcucuuucuccagaguuaaauaaacaacucugggaacacccucagagucacagccacagguauggcucacuagccuccuagaugacucuaaagacaguccaggugauaaugaagaugggccauuauggcagguucuuaccuccuacagccaacuacacucaagaaaaucccuuaggauguucuccguggcagaaucaaaacaacagguacuauaaugaaagcuuuccaauuuuggggaaaagccuucucuaacuugucaguauucauauaaaucauuuauuuuaccuaaucauugcuuugagaaguaucauucaacuugucacagcaaaaagcuccguacaaggacacaaccuaaugaaugccccacaugccuuaagcacaggccuccuuucauacucccccuccucccccacauuuguuuuugcaguuguuuuucuuaauuacaggaucaaagugcucuaucucuauacuacucccucccuuaacccaauuccucucaagaaagccacaauuuuagcuaaauacagcucgggggcaucuuaacuuggggagauuauaaauuggagcugagagaguuucuaggaaaucaucucaauucuccacagaauaaaauaugaugcagcuucucagcagguccaauaaaagacuucaagcauaagugcacaucugaucuuuggggaucagaugaagucauugguauacugaugugaguuuacuaagcauguauuuuuaaugcagaacaaagcauguccauacuggggucaaacucagcacuagaauguucacagagagacuugggagaaggagacagacuuucagcuuuuggguuauauuuaauaaguaaccuauguccgcugaugggagaaucaauaaacugcccuauguuauuuaagucagcaccccuuucuccuccuuuuguguaguucugugcauauaauugggaaaguucccugcacacaaaguguaauuucauucucuucaauaccacucuucuuucuuaaucaaaauaaaauauaauaagacaaaaacuuucacacugaaacucaccaaagcauaccaacagaagggaaagagcccaaaagaaggcaaaaaauuuagagaugcacuuguucacacacuugggagugugggggguggggggaguggggauaaccuaaauugaacuccuacaagauggguauggguagacugaaguggucaauuccacuuccaguggagggagggggacaccaacccacccauaaaaccuucaacccaaaauuuguccuaccuauaagggauaaagauauagcagagauugaggaaacagucaaccagugaccugcccaacuugagacccaucccauuggaaagagccaauccuugacacuauuauugauacuuugcucugauugcagacaggaaucuagcauaaaugucuucuaagaggcuucauucagcagcagauggaaacagaugcagagacccacaccaaacaucaggagguguucagggagucuuguggaagaguagggaauagaacugagccagcuggaggggacaaggacaccacaagaagaccuacacagucaacuaaccugggccuauaggggcccagagacuuaaccaccaaccaaagagcauuccagagcuggaccuagacccccuagucauuuguagcagaugugcagcuuggccuucauguggguccucuaauaauuggagcagagucuuucucugacucugucaccugccauugcauccccuuauccuaccuagacugccugguugugauucacucagggagaaugugcuuaguccuacugcaacuggagguccuagggcuuccuuggggggggggguuaaugggggaagggauuugugacagugggacuaggaagagaggagggaugggggagggggauugggauguaaaaugaauaaauaaauaaaauuuuaaaaauacuaaauuaaagccauacuauauagcagaagaccugugcagauguguguaggcccugugcaugcuguuucagucucugugaguucacauugguuuugcugaauugauuagagggauuuguccucuucuucauacucucuggaucuuacauucuuuccacaggguucccugagcucuaagaggaguaauuccauuuagagcucuguggcccagggucucucuucuccacauaaugucuggauauaggucucuuauuuguucccaucugcugaaggaagaagauucuuugaugguggcugaguaagacacugaucugugacuauagcagaauaucuuuaggggucauuuuauagcuaucuuuuccuuucuuuuucuuuucuuuuaaggaccaguaguauuuguucuuacuuuggccucugggcuuucuagucucugguuauuggucacccaaucaguguuggguauggguucuaucuaguagaguuagcuuaugucaaaucagauauugguugauuacuccuacaagcuuugugccaccuuugcccuaucauauuuuguagagagguuagcauuguagaucaaagguuucauggauggauugguguuuacauuuuucuuucaguaggcugcagaguaccaaagauacuagaacacaggagcaaagguuauauguaggcaccagcuaaaccuuuucauguuaaaugaguuguguggguguuaucuacuuacaaugggaccuuguuaucgguuugugaaggucaaccuauugucucagcaacagucuggcauguucagaggugagaaaccuuacuacagcagguccugaauauuccaacauagcugaaacaaagaaaaagaacuuaaaagagccuguaugaaugaaagagguacuuaaagaggaaauggacaaauacagugagaaauaguagaaaacacaaacaguggaaggaagugaauaaaauuauuuaagaccaggaaauggaaauagaauagucaagcuaagggaacucugugaaugaaaaacauagaaacccaaauaagaacuuuagaugccaacuucaucaacaaaauacaagagacaaaagacagaaucucaggcauuaaaaauaugauagaaaaaauggacacaucauucaaauaaaaucuuacaucaacaaaacuuaacaugcaacguaucuggggcacaaaacauccaagaaucugggacacuaugaaaagaacgaacaaaagaauaagagaaauagaggaaggagaagcccagaaaauauuuucaacaaaaucauagaagaaaaauuuccuaaccuaaugaaaggaugugccuauaaaaaagcauacagaacaccaaauagauuggaucagaaaaauccaaucuauuggcauauaaugaccaaaacaguaacaacacaugauagagaaagaauauuaacaguugaaagaaaaaaagaucaaguaacauguaaaguuagaccuauuagaauucuaccugaauccucaauagagacacucaaagcuagaacagccugaacagauaugcuacaaacucuaagagaacagagauagcaucccagaggaauaugcccagcaaaacuuucaaucaguuuagauguucaacaucaauaacacucuuuauauuaugcuuucugucaaaaaucauaucaugaugguucuguacaaccuucaaugucuucuggaccaauauuucccaauuugauguguguguguguauauauauauauauauauauauauauauauauauauauauauaauaauuaauauauauauauauauauacacauacacacauauacagagaggcacagagacagagagagacagaaauagaaauaaagacagaucggcuaacaccggggguagcuagggcgcagagucggcugacaccugccagcuacucacaagacccaccacgggaucuuaagaccucuggugacuggaacacagcaucugcuccaauccaaucacgcuggaccugagacugcauggguuagagaagcagaaaacccggccugaucaggggcacaagucccuuccaguccagccagcacagggguacuuugggcguggagucugcagacacccggaagguauacacaggacccuccacaggauauuaagaccuccgugaguggaucacaacuucugccaggaggcagguucgaacaccagauaugugggcaccuucccugaaagaggagagccuaccugcagagaguacucugagcacugaaacucaggagugagcuagucucccuggucugcugauauaguguaacaaaaucaccagaggaacaaucucuaaacagagacaacuacaacaacuaacuccagagauuaccagaaggcaaaaggcaaauguaagaaucuuacuaacagaaaccaagaccacucaccaucaucagaucgcaacacucccaccacacccaguccaaggcaccucaacacaccccaaaaacuagaccaggauuuaaaagcaaaucucaugaugaugguagaggacaucaagaaggacuuuaauaacucacuuaaagaaauucaggagagcacugcuaaauggguagaagaccuuaaagaggaagcacaauauucccuuaaaguauugcaagaaaacacggccaaacaggugaugaaauugaauaaaaccauacaagaccuaaaaagagaaguagacacuauaaagaaaacccaaagugaggcaacgcuggagauagaaaaccuaggaaagaauucuggaacuauagaugaaagcaucagcaacagaauacaagagauggaagagagaaucucaggugcagaagauuccauagagaacaucggcacaacaaucaaagauaauacaaaaugcaaaaagauccuagcucaaaacauccaggaaauccaggacacaaugagaagaccaaaccuauggauaauaggaguagaugagaauaaagauuuucaacuuaaagggccagcaaauaucuucaacaaaauuauagaagaaaacuucccaaaccuaaagaaugacaugcccaugaacauacaagaagccuacagaacuccaaauagacuggaccagaaaagaaauuccuccugacacauaauaauaagaauaacaaaugcacuaaauaaagauagaauauuaaaagcaguaagggaaaaaugucacguaacauauaaaggcaggccuaucagaauuacaccagacuuuucaccagagacuaugaaagccagaagauccuggacagauguuauacagacccuaaaagaacacaaaugccaucccaggcuacuauacccggccaaacucucaauuaccauagauggagaaaccaaaguauuccacuacaaaaccaaauucacacauuaucuuuacaugaauccagcccuucaaaggagaauaacagaaaaaaaaaaaaaaaaaacaauacaaggacggaaaccacacccuagaaaaagcaagaaaguaaucccucaacaaaccaaaaagaagacagccacaaaaacagaaugccaacucuaaaaacaaaaauaauaggaagcaacaauuacuuugccuuaauaucucuuaagaucauuggacucaauuucccaauaaaaagacauagacuaacagacuggcuacacaaacaggacccaacauucugcugcuuacaggaaacccaucucaggggaaaagacagacacuaccucagagugaaaggcuggaaaacaauuuuccaagcaaauggucugaagaaacaagcuggaguagccauucuaauaucaaauaaaaucgacuucuaacccaaaguuaucaaaaaagacaaggagggacacugcauacucaucaaagguaaaauccuucaagaggaacucucaauucugaauaucuaugcuccaaaugcaagggcagccacauucauuaaagaaacuuuaguaaagcucaaagcacauacugaaccucacacacuaauagugggaaacuuuaacacaccacuuucaccaauggacagaucauggaaacagaaacuaaacagggacacagugaaacuaacagaagugaugaaacaaauagacuuaacagauaucuacagaacauuuuauccuaaaacaaaaggauauaccuucuucucagcaccucaugguacguucuccaaaacugaccacauaauuggucacaaaacaggccgcaacagauacaaaaauauugaaaucaucccaugcauccuaugagaucacuauggacuaaggcugaucuucaauaacaacauaaauaauggaaagccaacauucacauggaaaaugaacaacacuuucucaaugauaccuuggucaaggaaugaauaaagaaagaaauuaaaggcuuuuuagaguuuaaugaaaaugaagucacaacauauccaaacuuaugggacacuaugaaagcauuucuaagagggaaacucauagcucuuagugccuccaaaaagaaacuagagagagcacacauuagcagcuugacaacacaccuaaaagcucuagaaaaaaaggaagcaaauucacccaagaggaguagauggcaggaaauaaucauacucaggggugaaaucaaccaaguggaaacaagaacuauucaaagaaucaaccaaacaaggagcugguucuuugagaaaaucaacaagauagauaaacccuuagccagacucacuagagggcacagggacagcauccuaauuaacaaaaucagaaaugaaaagggagacauaacaacagauccugaagaaauccaaaacaccaucagauccuuuuacaaaaggcuauacucaacaaaacuggaaaaccuggaugaaauggacaaguuucuagacagauaccagguaccaaagcuaaaucaagaucagguuaaugaucuaaacacuccuauauccccuaaagaaauagaaacagucauuaauagucucccaaccaaaaaaagcccaggaccagauggguuuagugcagaguucuaucagaccuucaaagaagaucuaaucccaguucugcacaaacuauuccacaaaauagaaguagaagguacucuacccaacucauucuaugaagccacaauuacucugauaccuaaaccacagaaagauccaacaaagauagagaacuucagacaaauuucccuuaugaauaucugugcaaaaauacucaauaaaauucucacuuaccgaaucuuguucuugacacaucaaaacaaucauccauccagaccaaguagguuuuauuccagggaugcagggaugguuuaauauaccaaaauacaucaacguaauccauuauauaaacaaacucaaagaaaaaaaccauaugaucaucucguuagaugcagaaaaagcauuugacaagauccaacacccauucaugauaaaaguucuggaaagaucaggaauucaaggcccauaccuaaacaugauaaaagcuaucuacagcaaaccaguagccaacaucaaaguaaauggugagaagcuggaagcaaucccacuaaaaucagggacuagacaaggcugcccacuuucuuccgaccuauuaaacauuguacuuggcguccuagccagagcaauucgacaacaaaaggagaucaaggggauacaaauuggaaaagaagaagucaaaacaucauuuuuugcagaugauaugauaguauauauaagugacccuaaaaauuccaccagagaacuccuaaaccugauaaacagcuucaaugaaguagcuggauauaaaauuaacucaaacaagugaaaggccuuucucuacacuaagaauaaacaagcugagaaagaaauuagggaaacaacacccuucucaauagucacaaauaauauaaaaauaccuuggcaugacucuaacuaaggaacugaaagaucuguaugauaagaacuucaagucucugaagaaagaaauuaaagaacucaaaagauggaaagaucgcccaugcucauggauuggcaggaucaacauuguaaaaauggcuaucuugccaaaagcaaucuacggauucaaugcaauccccaucaaaauuccaacucaauucuucaaugaauuagaaagaacaaucugcaaauucaucuggaauaacaaaaaaccuaggauagcaaaaacucuucucaaggauaaaagaaccuuugguggaaucaccaugccugaccuaaagcuuuacuacagagcaauugugauuaaaaacagcaugguacugguauaacgacagaaaaguagaccaauggaauagaauugaagacacggaaugaacccacacaccuauggucacuugaucuucgacaagggagcuaaaaccauccaguggaaaaaagacagcauuuucaacaaauggugcuggcacaacuggugguuaucauguagaagaaggugaauugauccauuacuaucuccuuguacuaaggucaaauauaaguggaucaagaagcuccacauaaaaccagggacacugaaacuuauagaggagaaaguggggaaaagucucaaagauauuagcauaggggaaaaauuccugaauagaacagaaauggcuugugcuguaagaucgagaauugagaaaugggaccugaugaaacugcaaagcuuucguaaggcaaaagacaccgucaauaagacaaaaaggucaccaacagauuuggaaaggaucuuuaccuauccuaaaucagauagaggacuaauauccauaauauacaacgaacucaagaagguggacuccagaaaaucaaauaaccccauuaaaaaauggggcucagagcuaaagaaagaauucucaccugaggaauaccgaauggcugagaaacaccugaaaaaauguucaccauccuuauucaucagggaaaugcaaaucaaaacaacccugagauuccaucucacaccagucagaauggcuaagaucaaaaauucaggugacagcagaugcuggcgaggauguggagaaagaggaacacuccuccacuguuggugcaauugcaagcuuguacaaccacucuggaaaucacucuggagguuucucagaaaauuggacacgguacuaccagagcauccagcaauaccucuccugggcauauauucagaagauguuccaacuaguaagaaagaaacaugcuccacgauguucauagcagccuuauuuauauuagccagaaccuggaaagaacccacaugccccucaacagaggaauggauacaaaaaaugugguacauuuacacaauggaguacuacucagguauuaaaaaaaaugaauuuaugaaauuucuaggcaaacgguuguaccuggagggcauuauucugagugagauaacccaaucacaaaagaacucaaaugauauguacucacugauaagugguuauuugcccagaaacuuagaauacccaaaauauaaguuacaauuugcaaaacacauaaaagucaagaagaacgaagaccaaaguguggacaauuugccccuucuuagaauugggaacagaacacccauggaaggaguuacagagacaaagucuggagcugagucaaaaggauggaccaucuagagacugccauauccagggauccaucccauaaucagccuccaaacgcugacaccauugcauacacuagcaagauugugcugauaggacccugauauagcagucucuagugagacuacaccggggccucgcaaacacauaaguggaugcucacagucagcuacuggacggaucacagggcccccaauggaggagcuagagaaaacacccaaggagcuaaagggaucugcaacccaauagguggaacaacauuaugaauuaaccaguacccuggaggucuugacucuagcugcauauguaucaaaagauggccuggucggccaucacuggaaagagaggcccauuggacuugcaaacuuuaucuaccucaguacaggggaacuccagggccaaaaagugggaguggguggguaagggggugggguggaggguaugggggacuuuugggauagcauuggaaaugaaaaugagaaaaauaccuaauuaaaaaaaaagaaauagagacaaagauagagauugguaaauagagauauauuaucauacaucgggcauaaagaaauugccugcuucuacaugauauccaccaguugugccagcaccauuugaugaaaaugcugucuugauccauucuuaucuccuuauacaaagcucaagucuaaguggauuuaagaccuccacauaagacuggagacacugaaauuaauagaggagaaaguggggaaaagccucgaagauaugggcacaggggaaaaauuucuaaacagaacagcaauggcuugugcuguaagaucaagaauugacaaaugggaccccauaaaauugcaaagcuucuguaaggcaaaagacacugucaauaagacaaaaggccaccaacagauugggaaaggauuuuuaccaauccuaaaucugauaggggacuaauauccauuauauacaaagagcucaagaagcuggacuccagaaauucagauaaccccauuaaaaugggguucagagcaaaacaaagaauucucaacugaggaauacugaauggcugagaagcaccugaaaaauuucaacauccuuaaucaucagggaaaugcaaaucaaaacaacccugagauuccaccucacaccagucagaauggcuaagauaaaaaauucaggugacagcagaugcuggugaggauguggagaaagaggaacacuccuccauuguucguggaauugcaagcuuguacaaccacucuggaaaucagucuggagguuccucaaauaauuggacauaguacuacuggaggaucccgcaauaccucuccugggcauauauccagaagaugucccaaccgguaagggcacaugcuccacuauguucauagcagccuuauuuauaauagccagaagccgaaaagaaccaagauguaccucaacagaugaauggauacagaaaaugugguacauuuacacaauggaguacuacucagcuauuaaaaacaaugaauuuaugaaauucuuggacaaauggauguaucuggaggauaucauccuuagcgagguaacccaaucacaaaagaagucauuagauaugcacucacugauaaguggauauuagcccagaaacauagaacacccaagauacaauuugcaaaacacaagaaaaucaagaagagggaagaucaaugggugaauacuucauuccuccuuagaacagggaaccaaauacccaugaaaguaguuacagggacaaaguuuggagcuaagacgaaaagauggacuauccagaaaauaccccaccuggguauccaucccauaaucagcuaucaaacccagacacuauugcauaugccagaaggauuuugcugaaaggacccugauauagcugucucauaugagguuaugccagugccuggcaaacacagaagugguugcucacagucaucuauaggaugaaacacaggccccccaauggagaagcuagagaaagcacccaaugagcugaaggggucugcaacccuauagguggaacaacaauaugaacuaaccaguacccccggagcuuguaucucuagcugcauauguagcagaagauggcuuagucggccaucacugggaagagaggucccuugguauugcaaacuuuguauaacccaguacaggagaaaaugccagggccaaaaagugggaguggguggguagggaagcagggcggggggaggguauagggaacuuuugggauaacauuugaaauguauauaaagaaaauaucuaauaaaaaagaauauauauuauacaaccauacuaauuguacaguauuuuacuucaucucuuugggauguagacuuaauauaagccucuaaaagacaaacuaaaagccagagcucaauauguucuaugaauauuaucuauauauauuaugaauguuaauuuuucauaucaucucaauuggguccuggguuacccgaauacuuaauacucugacauuuucaauugucuuuccucauucaggaaacugaaguccagacugcaaaauggucagcccuccuuugaggaagaaggguaucuagccucacguugaguugucuucccccacacugcaacagaagcauugaauccuucguaagaagaccuuugacccauggaugcuaaucagcaagccagagucuuuagcaguucuuaguuuugucagccuccacaacuucaugagacaauucaucacaauaaaucucuuuccauguauguuuauaaauauuccaauaguucuguuucucuggagaacccugacugguacaaguguuaaacccagaggaaagaguaacuacuuccaucagucuggcagccagacccaugccucuuaaggggcgacucuuuuuuuuuuuuuuuucaugagccauuauacuguacuccaucauucacuccagagaucucgaugggugcuggaaacuugguuguauuauaucaagaugaaauggaucagggaggauacugugaaagcagaucgaaggcucauuagaaaggccggucacaaggcagcuuggaagaugcugguucuccuuuucaguacaaagagaugaaagggaaccgaaaagucgggaugggcaacuuguacaaaaaagaaguuaaccagcuacuuacagguacuuauacuuugucucucauugacuuaaucaacuguuuagaaacacacgcuguacucagauucccacaccugugucuauagugugacaagcaccauucacugcggccaguagguuuccagagcagaaaaguaggcuuuuuuucuagguuggagaaaagccuuccuugagucccgucugauucugcuagggagguugucucuaaaggugcaaauauaugcugaaggagguagucuggcaaagagcugguauccuugguuauccccaguccaggcuucuucucuugugcuagccuuacaggagaugcacucucacuaccggcauacuugcuagucuuacaggagacucacucucacuacuagcauauuugcugagucacccuccagcauggacucuccauauaugcuugggaaugaugaagcaaagaacugugaaucacagaguuaguguuugcaugaaguccuaucgaaugaccccacacacuucccucuuaucaaaaauccagucuaugccccaguauagggggaugucacagccaggaagcaggaguugcaggguuggggaucagggggaggggggaggagauaggggauuucuggagaggaaacuaggaaaggggauaacauuugaaauguaaauaaagaaaauaucuaauaaaaaggaaaaaaguccucuuuuauguuuauaugaaaguguagaggaguuggagagauggcucagcaguuaagaguauaggcuacucuucuagaggacuaagguucaauugucagcacccacaugauacuucacaacugucugcaauuccuguuccagggauccaacacccucaaagauucauacauauaggcaaaauacugaugcacauaaaauaaauaaaucuuuucuaaaaguauagagaaguggguauaugccaaacaaccauugccgugucaaaccaaauuugcuuuccguuaggaagaagagacggaugggaaccaucagcaccaacaacucacugguagccauuggagcagaaaaggccagagcaccacaccuccaggccccagggauuuacugggguauacuauaugcuaaggacccauuucugguuuuucaucaucucuguaccuuucuucuacugccuuucuguuggaaugacauggauacugcacugugaggcaucucccugcacaugggacgaacaacauucucucuccuugauucuuccuugaauuuucagauugacuuacagugauuucuuucaguaaauugccuaaaucaaguucuauuucugauguuggcaugaaacccagauccuuuuuuggcauggcuuugccauuaagcaacaccuccacucucaugugaauagauucuagccuaugagcagaaauauacugaugcuuccaagaauaaguguuccuuuauuuuaugagaaaacucuuauuuugucuacauuuuauuucuuuuucuagauguauuucaugugaaaacuuucugcuuggagcuauguagccaugagcuacguauguagcuauguuuugaccaugagaccaaaauauaaaugacaucaaggaagaaagacacugcaauguucaugauaucacugagcuaccaaacuaacuaucaggcucucugacuccuagcuuaugaguaaacaaauauucugaggguuuuuuauccaauauuccccaaguuuucuauuauuguaguugaaacaauuuagaauucacauucuuuccaucaucaacuuuguuuccuacaggacaggaggaacauucaauaauaacucaaaauuauacuguuguuagcccagugacauccuccugagaguucuagugccuacuggugagcuucccagagccuagagaauaugccucucucucucucuauccucaaggaaguccucauuuuucauccacaagaggaguaagcugguaacaccauccaauaauaagucaaaacaagcaagaaaauuugcagagaucauguagaagccugggcucaggauauggaggggcagggucaaaggcuuugcguuuugcagaaaacccuacaaugaaagagacacccagggauccacugggauggucacuccagacagaggaguuugcuuacuggaaggcagaugugggaaaaaaugacccaguuggugcuuucaaaauuacaaaagacacagcagacacaaugcaccaggguagaugcaucaaaucuuagauaagcaggauuacaguaaccacaacacacaacuuccaguuucccucagcugauauccuucuuuguucuguugucaaaguacucauaaaacucugaaugucauguuuaucuccauuuuccugagagcuacaauggcuuagcaucacuucugugauaaaaucacugaauucgaucacaacccacagaccugacucccucuccucaucgcccauuacauucuauuuucuucaugcucccagugaugucaucucccaacgcacagcaucuacuguccucucucaggcgcagagacaagcaccaucccagaugcccaugaauauucuugccucgugaauaccugccauaaauggcuucugcgaguguauuucacuuucacacagaggugaagccuacccugugccucuucaaaaccagcuucccagcuugcugcagaaugcugccccaaugcacucuucucuucuuuguauaaugucacacuagugauugguuauuuaauggcuauucacucuagggauuagccauuguaagguucgugaaggcaggggccaugucuuucuuguucacucagcuuguagcacauaauaaaacuccaugugugcauagugaaggacuaguuguaguuuauguuugugcugucaccacuuugcaggguaggggaauaaccacacucaagagcacagaugagaaguauacucaggaaaucagaacagaacaguugucagagaaggcuuuaaucacuagauacaccugccaccguuuuaguuaggcauuaauggaaaaccaggauccuucugaacaucuuucacaauucuacacaacugaggauagggcaguagcaaggaaucagccaggccuggcuuuauauucugcuuuuuucuugaucacuuccaggauuuaaucccuucauccuuggcuuucaucaaauauaaauugggaauaaggacaaaagcauuccaauagcguugugaagaauaaaugagauagcacaugcgcuuagcauagacugagcucacugaguacucaaugggccucuuuguucuauggucauugguaaacacgaaauauaaauuuaacuccaugaagagacuggaggagaagcacaaauguuagcuaguauggugaugaguugugcugcugucauuguucuuuguaccagacaagucuagaagucagcacuuaagagugcugacagggucuccuuacaguuauaaaggucugugugucuuucuugguccucacuuuggccuagugccagcccuggagcaggaaaagaggccugauggcagaugagguugaaacguaacuauccucauuuaaagagcuugagccuaucaggacauugaauuucauucugaagcuaucauugaauauauucaaggacacaguaagacaaauuaauguucagaaacuucuauuagauguuuaacauuguuuugaaguagaugcucuuaggcacccaagugauuggccuugaggagaaaaauauuaauacaacuuguauaaaaccuuugcaaugcaguacacauuaguucuuaguuucugauaaacaugcaguaguagucuuagauuaaaauuuccaguguaaggacacagaaauuacaauuacuagaaaaaagaaaucagaagaucagcaaaguggauuuguuuuauauuaaaaaucuccuaagcaaugauauuauuuugauuuaaacagcaucaaagagaacucauaaaauagagagauucuccucugugacauggucaaagcaaagggcagcaaugaggcagcacugcucaucaugucuaccugaaagucaauaagagcagauccagugccagcuguggcuucaucugcagcuggagccgcacuugcucacagggcucaucgauugaccuccucuaccaaggcagcccgaggaagcaagggcuucuggucccaccuugcacugugacaauaaaacucgucauguucccaccuaaaaaggggcauuuugauggaugccuuauuguaacuacuacaccugacaagaauccuaccacugaguugagccauuugugaauaucucgguaauaggacagaaauugcauucacuuauucacgucagggagaaaaaacaaaaacaaaaaaacaaacaaacaaacaaaaaaucuguacagcugccuugaggccauucaggaugugucaugaagaagaaaccuagcagugcucauuggcucugccagccgucccucugggcuccuagggaccuuuuuuuuuuuuuuuuuuuuuuuuuuaaauauauguaaucauggucugcaaugccuaagugcaacaggaugauuuaaaaguacucugauagcugucuccugugauauuuaucucucccagucuauucauuugugaucuagaugaaaacgugggaugcaaucugcauauugauauucccugaaagguaucagcagcucuucacgaaggaugcuucagcugcuuuagaaaucugaaauauuccacaguuguggaauuuaugacugccauuuccauaaaaauaaagcccuacuaaaagagacucaauucuuuuuacacacauagaugcauuuagugugcaugcgugcguguguguguguguguguuguuacacaugcuacagcacaugaguagaugucagagaacaccguguaggagucagcucucuccuuucacugugugaauucuggggaacaaacucagguugucagacuuggcagcaagugccuuuacauggcaagcuauccugcuguccccaagacauauucaacuguucuaacuaaugugugguuaaauacgugugcccugggaagagauagaucuggguccaguucugggcuucuuguuaaucucugcaugaacugggguaaaguacucgacuaguaacagauauauuaaauuauacuauucuuacuuagcaugguagagcuuaaauguuugauguuaauauuuucuguugacauaucuuuuuuuuggguacauaggcuagacauuugcaaugucucuuaauguuaggugggcucaaaugacugaauucugguuuaaaaaauaagaugcacaccuacagaaaucuuguggacuggcuuuuacuauuuucuuuaaucuuuuuucuucaguaacucuaaagucagccagcuuaagaaccuaugcuuacaagauacaagaaauguggauccaaccucagaaccuucgagaagagccacaacugaauuugagggauuuuggaagaguuaaaaaguaaacuuguuagacugcugaaaaacaauauaaugcugcucacuacaauagcugggcuacaguagaggcuguucauuccaacaacaaucagacuaugauacagguugcucauaauaacaaacaacaaucagacuauguuagaggcugcucauuacaauagucaguuuaaguuagaacuucccuacauagaauggugaccauuaagaacacaaaagauggaccuggagagaugauuuagccauuaaggacagcaaugaucuugcagaggaucuagguucaguccccagcacucacaugggggaucacagccaucuauaucuccaggucuagaggauccaauguucucuucuagccucugcaaucccuagacaugaugcacaaaaauauacauuucugcacauaaaauaaaauaaauagaucugagaauauaaaaaaggugaagcacaacaaaugccagugagacucugaggaaagacagaaauuuacuaucugcuaaucguccuaggagcucaugcaugcacauggaaaagccucaaaacagaaccacaugacccagguauagcuacaggcauaucuacccaaaacauaccauagagauacgaccccacccaugcuuauugcugcuuuacucgaaauaccugggaaaugauaucagccuagauaucauggguguggucaggcauguagaggccagaggaugaauaaggugucauaccuuaggcauuguugaccuucuguuuuagauaguuuuucacuggucuaaaauuugcuaaguaggcuaggcuagaugguaagcagguuucaucuccauucacauggccacguccugguuuucaaaaucuaacuuaaacuuuauguuuggaagccaaguaguuugaugaugaagcuaucuccccagaauuuauuauuaucucaaguauuuacuauuauuguuguuguuguugcgguagagucuuccuauguaucucuagcuggccuggaacuagcuauguagacuaggcuagccuucaccucacagagaucuaccugcuucuaucucccaggugcugggaaaccaccaagaauuauuuuucagaaugucaaccucugguggaauguaccugauguuaucuguagucagaaucucucucugugaagagguaggaaguaugauacuuaaucugcaaagauguuucccuucuagcacucaaaugucauuugucagcuuccacacaaaaugaggcucauuuuuuuuuccccuacacgcucuccuacagauaugggcgacaucucaggcuaauucuugcuagucauuaaagacuuuacucaguuuucuuuuuaagaugcuuuucuaugaaacaagcugcucccaucugaggaagauauucucaaagccacaaagaggcccauaugaggagaaauagaaacccccaucaacaacucgcaucaaucugccgagcacagagguaagacagcucagaaguguaucguccagccccagcuaagcucccagaugaccagcaaccuggucuagaggcaggaccacuccuucuagccugucccaaauguccgacuccuagaaaugacagguaaugucuccugugguuucaggugggugaguuuagguguuauuuguucugcaacaagagacaacuacucuaacaggaucccaagcuuugccugguggcgacuggcucaagaaacuauaaagcugguuucacagucagcugcagcaaguccccauccaaugaucagaccugcacuuggugacaugugcuagucuuguugcaaacaugaggcggggcucacaugcuacugugguuuuucucccaaggcuguauaaugcuaugguuuuucccuuuucccaguugacugcuaaaguuguuuacuucaacucguggguuccuccucuuuagaaggccaucauauuucagucuagcugggcagaaaccagaauauugaaaguauucugucaugaaauguuuguggccauugguagcaugaacccacaauagacuuuucauugacuagagagcagacucuugaccuauuucuuacaaacagccccuuccauaggaacuuacucuacauuaaagaguaaauuaaaaugaaauuaguaaauuuaucuaugcucugucccaugacaggcuuuggucuuaaaguagguaugcuccuacugaacacacaaguacuuuagguuaaguaaaaacaaauaaauaaauaaucuugucuguuuucaaggcaucaaagucauaggggagagacaucauaaagacacgggguauugguauuuauucacauucucagguaugcauaaguagaacauuugcauaucaaagacagugaagacuaaaugccaagugaaaggaauucaugggcauuaacagaucuucaaagcagaggugagagagcugaguugaucagaacaaacuuuagggaggaaggaaguccuaagaacuuuuaacuauggugaauagacaccaucagcaccaucuuguucuccugugguucagccacggagacuccuauacaacucuugggucaacucuggucuauaugaccaguucuauccuaggguuguggcaaaaaguaauguuucagaacuaaguuaggggugggggaaaauccuguuauauucuccaguccccccuugcuaugaagguuauauguucuggaugcuguaaccuucuagagucugcagguuauugguggcuuuacagcuuagguuuuuaugugaugauuauuaggagggcuccccugacaugugauggagauucaccaaaaacaagaaauaaaccagccuuugccuuaugccacuuugauuuagggauaauuuguuacugcagcauagcucagucuuuuccagcuuaaagagcaagauuccuagaaguggaaaacuagagacaacacuaguuacuuauaaaucauacccuauacgaccuuucucaaugacaaaccugugcaugcuacaauauaccuuggaauacuguaccuuaauaggacuagaauuuuuuaaaauaaaagcauaaagagagucaaaggguggcaagacaaugagcugccccaaaccccccaaugggugauuacuacagauuucagaguaacagaauuauugaugucuuugccagagcauuccuuuucucuguguucuuuucuuuugagaguacaagccauacauuuccauuuggaaagcaguauuuccuaacuucuaaaccuaacugggaucuugugaaacccuugcccauaacugaauggccacaaauaaaugccuggaguucccuugaagcaaucccauuuuacacugagaugcuuucucuuuccagcaagaaaguguugcugcccgauggauaccgcgcucucacuguauauugugcuuacugcucuguggcucucacuccucauucuugucuuaguugcuggggccuuauaaaauucagcacuaugaagcagccaauaaggagcacggagccuccaaaagaucugucucuuccaacagaccuuucaguuuccuagaugucaaugagagauucggaccaauuaucaggugagaugaagucuuuauucacuugcucuguaaaugagcuguuccucaaugaggaggauauggucuccaaggaaacaaaacaauggauguuaggcaaacccuuuuuacugacauuagcaccccaaaucaacuuccuuaaaugaauugucuuugaaacugacuuguaaguagaacuugagucuaaagauacaauaaaauaguuuuuuuuuuaacauauuagucucaguuucagacuggugaucucuggacacacaccaaaauaccaagaacaaacucaaaggcuuaccuuaucuucaaauacuuuugaacaaacaugguuugagagacaaaguggagcaugagagaggggauuuuugaaguagucaguuaccugaacuuuaaacauuuuaaugaaucugucauucugaauagauucuuggguuaucuaaguccugaggagccaaugacagaucgguccuuuaguuaaagacucauaaguuaaagucucauaacacaacagaaaagaucagaauguuugcuggauguuuaaaaacagccauaacagugacaaagugguagcuuagcagcuaaaaggguguccugcucuuucagagggccagaguuugguucuuggcagccauauugggcugcucacaacuaccuguaccaccagcuucagaaggaucucuguacauauaccacaacauacaacuuaaauaaaacacaauguccacaaaaaggcacaacacauuacacuagaagauacuaucuauuuucccuaagucuucugaagccacgugugaugccagucuugaccuuucugcaaugcugccuauguaguaauggcuuguagugcagagcauauuaugcccuccauuccaguagcaggaaauaagucaaauuccaugguauugguuguggacacagaguguguacuagauucagaggcauaaauauagccagugaguacugaaguaacaggaauaagaagguagucccaagcccaggcaauacuggccucauucucugccucucacuaccuuucauaaauccagauacauacagaaagugacugccugucuuggaauugcaaacacuaaacacugagacuucggaaaagaccaucucagauuaggggguucaguugaaaucuacacacucuucccaaggacccauauagugacuacacauggcugcuaacccucaagcaaccucugcaagagaaaaaaaaaaaagaaguucugaggagaaggagucaugucagggcuacagaggcaaccugaaagugucaauguauacaaccagaaugcaaaguuaaagcaacgguuccuacuccuguagguugccucaucugcuucuuacuuacuggaacugauauaucuucaggcacucauaucuaauaccaaaagagaggguguucuuuucuacauauccuucccucagaaagagcccucagugcuuugcuuuaugauucuguguaugacugaagaacacaugaaacaaccucaguccucauaaauauccaugguaaacuucauaaacaucugcucccaguaacauauaaucuauguuuuaccacaguauuaucuacuuuauccugaucucuuaucuacuuuguccugauuauaaauucaucuugcucucuguuccagcauguucaauguaugugagcaugaccauacacuuagaaacaagaaaauaaauaucaaaaauauccuagagugcuauggguagauuuaaauaucuaaaacaaaauaugucaaucguacuacagcuugacccauagauauucuccaaaggcccauauauggaaagguuuaauuucugagugaaagcugauagaauccuuagaaagagggccuuuugaaaagugguuaaaucauugcguauuuguucuugaagaagauauaggguccucagcgccuccucuuccucucuuuauuuucuguuugccaugaggugaguggccuccucuaucaugcacuuauuccaugaugagcugccuaauacaggcauagaggcaauacaaaucgaaaacugcuaagcugauuuuguuggcuauuuggugauaauaugaggagacuaccagaaaugacaggaaauagaagcauacuuccaggacaggaaaguagcuauugagaaagaauaaagagcuguacauguuggcaucagacauucaagcaucaugaaaaaaaagucuccauaaggaacuuuacagguauuguugguuugccuggagggauuuggcauugugcauguggagcgucaaacagcuggaugcagucagaaccuuggaguuuuauuucugcuaacaaggucauccucauuagagggucuuggcauuacguuaucuagccuaccagucaugucauauaaugucauauggaagcauagaaugucacuuaacuucuaguguucuguucucucacagaauagcucucucugguucccacagagcucaggccuucauagagcacaggaugacucuggauacauugauuccauguaacuggucaccaccuucuugggacaacacaaagaggcacacucacugcucaguaucacagacuggucaauaauaguccaaguggaagaaaugaauucuuucauuaaucaaaccacaagugauggcaaaugagaguacccugcuccaggaaaacuggguaggaagcagucauuccgcauacucucaugauacccugaacauuguccaaguguuucgguaggugggcuaguuccuuacuaauuucuaccuaagucaaugaacucguaaaaagaugccacaacugcagcccagauagcacaguuuuaagaacacagagagcccuguauuuaccucccuccacauguaguccugccuuucugcccuuacccacaugcacacauaguuuucaguuuuucaacugccacugcucuuauuacauuagaaucauuuugacaagcuauaucagaauaauuuugcguauuuuaccauugucuuuacaauggaaguaggaacguugggaugacaucacaguaaacgcucuguuucuaccgugagccuacccuagggaaagcuccugaucacuucuuccucagacgguucuucccucuacucaggcuuuguacuggagaacggucagcacaaagaucucacuacccacaagucugauggcacaagaauuuugccacaaccuuugcagcacuaaauaucauuuuuaaaaauaauaaauucuuuggauacacaaagauauuuccaaagcucaucuuguuuuuaaaagaguccauauaagccagaaauaguggcacauuuaauguguacaucaagacuauaaauacacuuuuacauuuguuuaauggaguagacagaagcaaauagagaguugaacugauugcaaaaccuucucuugugguagaggcaugcaagacgcccugugaaaucauuccgaaaagcacucuuauauucugucugaugcaggucucuaggggggaccuaccccucaaugguagcuuuaguuuuccauaagugcaugcuuuguugcuuguuguaugaaguccuugcuauaaggaaaugcuuucagacuuuguggcucucaugagcaacugcugcagaaaacauucauaggccauaaacaacuucacagacacuaaaaacauuaggaaggaugcaaauuacucugacaugaauuguccagcuuaggggucuauaaacccaggaauuccgugcacauaugucuucgagaaaugcuuaccuuuugagacacuuaacagcucuacuuuggugagauaacacucuccccuuggcucucucucccucucuguuccccccucuuucccugccccagucucccccacucucuucucugcauuuuaauaaguuggccaauuauauuucuauguuucugaggauccugaacacagaaaacuauagcucaaaauaaugaucauuuuuagaagaaagugucacucagaaugagcuaaagagaauauaaauguaauaacacccuaaaagucuguuauauauccaaagaaguaauaaucaaauuuaugauggcuuuauauauacuuaacucuuucaggaaucugaauuauaaaguugcaauagaagcaaggcaagcaacaacucacaugaagucaggacuucugccuuucaggcuguauacaaacacaccuaaugcccccaccuuggaacuuggaaucagugggcugaagugaugucucagaggucaagaguacuuauuucucuagcagaggacuugguuucugaucccagaaccuacaggcuagcccacaacuacccauuacuuccuuuuccaggggagccaaacccuccucuggccucugcguauacuaaugugggugauacauaaacacauguagaugacacacucauacacauaaaauaaaauaaaacaaauggaucuaaaucuuaaaaacugaauauugcugcuuuacuuuucugugcacagggcaguccuacaaaagacccugaaauucuugucuccuuaaauuugagcuuugagaccucagauugcuuuuagaaaccuguagguuggccuggcaaucaacuuggguuuuguauuucccuagaucuacauuuucuggagggguugggacaaggagaaagugagaaagagaccauaugcccaacaacuucauaaaaaaaucugcaaggcagaaugaaaguggaugaagaaaaggcggaaagauacaaauuuuucccuccagaugauuucucuagcaggaagaaagauuuaaaaucauugaacgugcuuucugauaaccaccuauggcuuucuccaaagagaugcauguaaaguugggcaaguuguuuucuguccugucaggaaaauacuuaguaacagccuuguaaaaguaagcacucgcuguugccccagggagcuguggauuugcuuuguagagcuguuucuuucaacagcuuccuuuguugcucuguauguucugccacaaaaggcccggucuuguucuacagauagguuuaucauucucucugcaugaggacugugcaaguacacaaaccaugugagcugccucuaucugauaguccggccacugcugccucugccuaucugaugauccuggcuguuacuaucagcuguuacuaucugagaguccuggcagggccuuaaguguauuucagaggauggcagguauagugaaauucauacuggggacuacagaggggaaccuuagguagccaguagcucuaaagucaucugaagguaaaagaccuauuuguuaaguaguaauuuuauaaugagcuaauggaaggaaauauuaccuagccaacauauacauauugcuuaagaaagcauuauucaauguuaagaaagauaaaccuccguuauugaggaaauccaauggagagcugaauagcaccauuugcuaccuuggaggugaaucacacagcuauugaacuuugugacccccuagaauaaaagcaauauucuucaaugugaaccagauaugauuauguguaaguuaaacaaggucuauccuucccaacuuuaaauccaaacuuuauguuuuuacaguuauaaaguaauuggccuuaacugaacaggucccaauuccucaguguguggccuagggauggauagguuaaugaaacugugguagccaucuccuugucuauagauaucacugauggugguguugacuuuuagaguugcuauuggaauuaaaaaaggaacuaacuaaacaaagguugggguuuauuaaacuauaaacaaaugauauuucaaacaacaucaacagcacagcaucuugaauuaauguuccacuacaccaaagaaaugcuucggggaagucugaguaucccuugcugaagaucauucuguguaagaaaccaaaccuuucguucacugcaacuucugaagcaaauauaagugucagcuaagcaaggaauccucuccaguucaacauggaaagguaccaauccccgggcugucuacauuguucuagggaaccuggcauaaaacugaaguccuuccagaagugagcauaggcccucagaggcucuuuuauuuucccuaccaccuucauacuaacauucuaguccacucacagauauaaguccuacuugcuuugggaccuguucucaugccuauuugccuagugugcacacuuccuaacgugccuuagaauuuuacuuagcccuugggaagcccuucucacaaugugcuagauagcauguugacugccugguaccaucugcaagcagaccauagcuacaucuuucuuccuucuacuauaggacuaccaaguucauuaaacuuguuccauauaaaggaacccuuccuucucagaaugguuuguaacauuuuugauagaacauggaauuuaugaacucuauacuaugugauacccauacagaaagacaguuaaacucacaaaaguuuugagcucuuacugcaugucaggugcuguccucucugcccucagcacuacaucuauucucaaguauauucgaauucccuaggaaccucuaugcagucagugugagcauuaacuuugcuuuucagguaagaaaccugggacuagaguaagccauguaguuacccuaguaaaaagucuucacucuuaacuagaagaugaaaagucucaagguauucaugucuaagaaaaagacaauuuuucugcuaugcaaauacauacuacuccaagcuuaucuugaucagggauacuggagaagugaucauauaaauauaauuuauugacuuaaguaaagucacauuaaaaacuucagguuaccagaaaaccuaaccucaaucuaccugauaagauguuagugucccuuuaggaagaaccuucuaauacauaaauuaaaaaucagacaaccaaugaaaccuauggcuucauaucaacuggcagaaauuuaagcacugagaaagucuacuuuuuaaaaucauguauuuagauuauugguggggaugauggcauaaaagcauuaugcuauagcauacuaaggcagaaagauuauugggaaauuuaguucagccuaggcuacauagccagauucugucuuagaaaaguauauguauaacacuccuuaacccagucaugugacaaauuaccucugugaaaacaauuauuaaguuaugguuuuagauagaauuugagagacacugacucuuuguucuaguguguuuaagauaaacaacuuuacuaugcccaacaguccaguucauuuggucuagaaugugguuugaaaaccuagaaauguuuuaccuauuaaagcuguaaacuuucuugugcugccuggugcuuuguccacuucacaaaaccuaaaguuauuugguaagaggaaaucuccauugauaaaguggccuguggguagaacguuuucuugauuaaugaaggacccauaguggauggcaauacuccugugcuggcucuagguucuauaagaaagcagauugaagaugccuuggagaagcaggcugguaagcagcauuccuucaugaccucaacuuuaguuccugucuccuggucccugcucuauuuaaguucuggcuccaacuucccugaguaauaaauuacacgcguuaagguggaauaaacuuuucuccccaaguugcuuuuggucauguuguuuuuauuacagcaauagaaagcuaauuuuuuuuucuuccaaguaucuuaaaaguguuucugaggaaaggaaaauuuacaauuuuuaaaugccuuugaaaacauuaauggagucauuugaguaaguaaacacaaaaguuuaacccaagaggguuuuaauguaacauucauaacuguacagguaaucugauuuagucuaaauguuuuuuaaacucauguuuaaauucuaguguucaugauuaaaaaaucccucaaaaggccagagagguaaggauccccuucagcauggagaaguuguguacggcggccugucugacaguuacggagcuaacugagagaaaugcuccagacagaccugggauagaaagacucccccacagagcguuugccuugcagccacagcaucuaguuucugccuggcugccuucucugccugauggagagugcgucuacucuuggauguugucauccauugcugacccuggaauccuuuuuccucauccuuccaaagaaugaagacccagggcucuccaggaauucucuaagcuuccagcauaacugagacagacaggcauccacccuuggagagugagugggugcagaguucucagcauguccucuguaaagauauccagcauugcacugcugcguccgaauuguauaagccaauccuguuuguuauaucaaaugaucuagaauguauauaaugauauauaaugaagaggauauaauccucauuccuuuguuucugcuucucuaaagaagucugauuaauauucccuauaagcaaagguaaguauucagaaauauaaaacuguuuaugacaugccuuugaucaucuguuacaccuagggcauguuccagacuccuacccauagucuaugagaacugcagacugacucugacuucugugaccauaacuuucaguccccucaugugccacacuauacagucacacuggcucucuuccaguugagguacaaguugaaguacaggaugcugugggugccuauuauuuuugcaguuccuuccacuugaaauguuuuucccaaaauccuuuucauagugggcuuauucuucacacuuaauucucagcucagaugccaccuuuuucaaugguaugcccuaauugucccuuccucuaacaaucucugauaccguaacguguuccuuccccuuagagguauaugcaaugccuggaauaugacagucauuuauuugugcaaauauuuauaccugucuucucucccaaaugaaguaaaaccucagcaagaaucauaucuuacuguugucucuaaaguacugccugacacacacuaggugcucaauaaauaccuguuguacugacuagucauuaaaaauaaauaaaaccugucuuuccugaauagaaauucauuuuuaaagcacacugcuauguaacauaaagccuguaugacccaauuaucuggggcuuauuugacaaaucugauuaucuuauuuugggguuaauauccaugaauugcugagaauaggcuaaaugccaagcaaagcacacaagcaaaugugaucccucccuaggacugcaaggauucaaaaaccuuggcaagaugccuaugcuaauuauaaagugguccaauauucaugagaaguacuugaaaagccauuauuuuugccugaaauuuucuuggcugccccauaauuaauacgucaguaucaucaggaggcuaagagaucaaggauggugaggacauuguuucauguaacaacacucauagggacaaugguacuuaguaacagaucacagugacuugugaugagagaaaguaauccagacuuugcacauagcacaugcuagaagccuggggacagaagaggauaagagucauugcuguuggaacagaaaagaagggacgucaggcagguauagaacaggagaaaacauucuagagauguuggaaagggauaaauucuaauaccaucuguuauggaaagcaccauaaucaaaccccaccuuuugucccuaauuuuaaauaaaucucucuccuuaguucaagaaccuacauaucauucuauuaccugguuccccagcauccuucuccuaugccuacaacucucucucaaaaggcagacaccaucuagacuaaaaugcauuagcaaucugugggaaggucucuucacacuugauuuuacaauuugccucuguuguuggccagagcgaauccaagggucaauuagaucuuucauuuaagagcaauguuuguuugacuaggucuuuauauaacaccaauuaugauauuuuuaauuguauucauauauuuuuaaaaccuuucuuauuuuucccuuguagcuaaaggaaguugguaccucaucucuuuuuagccuuugccauuuaggaagcucuccacugcaggcaggacgagcuuuagucccuaccgucuagaguaauccccacccccaccucuuuccuuccuucacuuuuacuuacaguucugucccaauuauuguguuuugcauuuaugucuuuucuuguggguugguugaaauuugcuuugaaaucauaugugauacaaauaaugaauaauuuagugaaauuuuaaaucuauauuuaaaaaaaaacuauguuguggguucuggccagaauggaguaaaugccaagaaacuggucaagcugaagcagcacccagcacugcaggaaaagcagcacccagcacugcaggaaaagcagcacccagcacugcaggaaaagcagcacccagcacugcaggaaaagcagcacccagcacugcaggaaaagcagcacccagcacugcaggaaaagcagcacccagcacugcaggaaaagcagcacccagcacugcaggaaaagcagcacccagcacugcaggaaaagcagcacccagcacugcaggaaaagcagcacccagcacugcaggaaaagcagcacccagcacugcaggaaaagcagcacccagcacugcaggaaaagcagcacccagcacugcaggaaaagcagcacccagcacugcaggaaaagcagcacccagcacugcaggaaaagcagcacccagcacugcaggaaaagcaacaaggacuauuuaaaaauaagaaguuccucucuaauuguaaauauucuucucugugaaacuagaaagggacauuuucucauaaaagcuuaccuaaaaucggaaugaguguuuauuuggagaauaaaagaacauuugaguaagugggguccuagggacuuuggggaagcaaucucuuugauuuggguguaggaugcgugcuccagugauucuauggcugucucaaagaaacagaaauuuaguaacugaguaucaccuggcaucugggucaccuguuucagaggcuguggucuuuagacgccaagaacuaugggggcauguggcuaugcucuaaagagaucugcauggcucacuagugguuaaaacaugcuuacauacuuuuauuuucucccgucucauucaugucugacuuuuaguguuuguuuuuaguaaagcauaucuccugaacauuuucauggaaauaagaaaugcucuaaagaguauaaucaguuuuccacaaaucaaaucuuguucuccagggggucuggcagucugcacuuuggaaccaccuggggaaaucaccugguaggauguaaauaaacucagccaggcuagacaaagauaaaacaaacaagugcacugagugauaaggacaacacacugcacacaggauaugcaaaugacucccugugaccuuccagggaacccauggaaacccaggccauaccaaaugaagcacaacagugaccuagagggguaaggccccaaaagucguaacccacaagacugaacuguuaagaauuauuauuuaccauuggccuaaaucacaagauuugcauguaguuaucuagcaaucaguaacggaaacaacccaaauagggaaucugaaaguucauucuggaagcccguguuugaucuccauacaauugcuucaguagcaaguccuugugugacuagaauacauggcugucuagaugaagcugaauugauugacacucagaacacagaacacucagaacacacaaggaucucucccagaaacucgguuuugacaagcuaccuggagcacauaauuaagcuagcuuggaucugcuucauaacuguagaacauggaguuacuuaugucuuccacuacauccccucaggcaacuugagacuuccaggguuaaagaagcaaugccaaaacucaaaaaucaauagugccauuuaaaugauggcaucuccagugggaacagauacuugacuucaugcaucaaugacuugagcuacagacauaggcauacaucaauaggucgaagaucucauuaaagcuuuuuaauuucugcuuagugguauucggauuuauuugaugccaaagacaggcccugcuacuaaacaaugauacugggucagucaguagaacaugucuuacacacuggccugauagacuucccaggcagccauggcaguuccccuggcugcauuuccuggcuugauggucuacagcuugcuacuugguaggaguucuuuguuguugcaacugcccaucaugcaugaaucuacuucccugucaucuuuugccaaaaacucaauuuucuggaaaaagagucugcuagccuugguuuggguuguucagacaguguuauucagagcaccaggcucccguccccugucccagacccuauuggugaucuucuagccaugaaacagaaaacaaauacugaacuuccaggaagauuauuggaagugggaaacuaucccauuuggguugauaaacuaguagguuggauuuuauuagaagcuuucuugccauuagagggagacacuguccaaggacagacaauggaugagccacuugaucuucuggauucggcagcucuccagaucaggugaaucugcacuuucuucucccuucauauauaagcuaguaagcuacuuuuguaucauuucguccacuuuaaguuguauuuucuaugucuugaaaucauuucucagaaaacugcaauaggcuccugcacagacuucagugugaugaaaugucauuuacuuucucggacagugcaauuuaugacaauuuacuauacucuuucugaccuugaauagaaaaaaaguccaugcauuaagccaacaccacuucaacaaauacuuuucuacuggucucugugaaguuaaauaagcaaauaagcagccugcgacauuaaugggacaccaggcuacaagucagcauucacaucagacauggcacaggguuagaaugucacucuucaugaaaugcaaguacgaacugcaugacuuuccagcuggaaacagaagaguuuggauuauuugguuuucuguucccucucaacccaucgcaucaggccuguugcugggauguggcuaaaucugagcaaugauauuuuuucgaaaggcauucugaugagcagcaucauuucauuugaucuaaaaucugaggucucaucugacuugguaaguuuucuuuuugaauuuaugcuuuuguuuuuugcaaauugauaguaauagucaauauaaauccuucauuuuucuucaaaaaaugaagcaagugggccuguaggucauccuuagagucucacacuuucuuagcuuuggcagugacacuguaccugcucucuugccuccuccuucccaguccccaggccuucuaugcuccucaccacuagagauucucuucacagaguucucauuuggaacacuggacauuagauuaucuccuuucuuucaucccuaagucuacaaccccacauccuguuaaguagcuauccuccauuugggaagggaaauggauaaauugugaauaccuauaaauauaucauuuauugguaucugacaaauagauugauaaauacugauaucaauauugauuauggcaucaaagcaagacauaauaagcacccuauaguguagggacuaucaaauuaaugaugauuauaauaauuucacuacaguaugauggagugccuaugacagaagguuaagcaaaguaguccagaauuaaaaaugcagcuauguuaaaccauaguuuaacagcuaugaauaaaacuucguacagaccauacaagcucauucacacuuuuggguaguacuuacauuuacccuuauauaaacuuaugccauguagauuuucugaaaugaguucauacuacuucuaaugaguuucauggaaauuuuacugaaacuaugcuacacuaguacacuaaacauuuuaagauguagaaguuuaagaaaaagcaaguacuaaaauagucuaugacccaagauguccucuugggucuacuggcaggucaaagagucguugggagcacuguccacagagggaaguuaugaaguucucuaaggacccacagaaaucucacagaaauuagauuaauauacaaagaucagccuggccucugagucuuucugguguucugucuuucuacagagcucacuuuguaucuucugcauaugguccuucguuugagaauuuugacuuccaaaauugugagcuaaaugaacauuggggauuuggacucagaaauagaaaaugacaaagauggugaguuuuacucgguuuacuaagcuuacucauucucuucuauuacaugacccuuccauguuuuccugucccuauucaagccaaacauaacagguuucacuucagguacucccuaaggucuucauuucuuuaugaagguuccuaugucacauaaauguuuuauuaaauuuucaugcuuuuuuccuuuagucuuuggucugucuuuaguuguuccaccuacaaccaaaccccaagcuggacagaaaaaagucuuccuucuucugccuucucuauggcuagucagucaauuuacugaauaauuuaaucuuaauugucaacuuggguggauuuaaaucuucaggaauacaugucugagugucaaugaggacgcagcuaggaaggcugaccuggaaugggaaggcacacuaguagcgccaucuaaggaaagcgugagaccacgcucaggcccagccuuccucccuucuaugucccaaauguaaaugcaaugaaguagcugucucccucuccuugacagugugcuaucucugcuguaacagcuuagaacccucaaaccacacgccaagauaaauaaccauuauuuacuugauuugugcaaaauauucaaucacaacagugaaaagagucaccaacauagguacucugugaacuacaaggaaguugcauuauuuaugauggcuuccucugaaaagcaauuuuggcacauuuuuauugccagccagguauuaugugcuuagccuagcagcuaccucucucaaggcuacuccugucuaaugucuauccucaccucugaacuaccucaaaacacaucaucccuguuuaucucauaucaugcccaucugggguauccaucugggagauacuuuccaaguaaaugcaaguuaaauaccccaaccacaaugaaaaggcuaucacaaaccaagagagaaaucaaggaccuacaggggcuucaguacaagcaaucaaagucagguagacauaguaucccauuugcuguuucccuacuagagccuguucuagaaaaacagagaggauucacuaagucagaaugucagaacugaaaucccuaaaugcuggccaucuucaaaacuaacacuuagguucugacagcuucccaguucauuuccaccaacuaugucaagcauccagcauggugucuaaggcauuuuuauuugaucuggcuuuucuggcauaugaaagucaagaugacaaaagaugacauuucuuuucaaccucugucuaaauuaacuaagucagaaaaggagguaguuccauacaaugaaauauuaauagacauuagcucuaagaggcuuuaucuuagauggauauuaucagauggucuacuguaugccaaaacuauaugcauaguucacuccagcagggagcccagcauguccaaaaugagacuauguaugguuguucuauggauaaaagugaucacuacaugugcauggggggaagaagauagaaacucugccccuuuugaccccagacccaauuuuacagcagcgaaugaaacaggauuuuugucaaaagguaacgaugccaggggugucauuugugaaagaauggagggaguagucuggaaacagagacuagagguagggcuauguagccagagcgaaggccucugggaagacgggacaaacaacaaaacaagaccuaaguaaaguauuuagaguauuguuuguuuguuuguuuguuuguuuguuugaaguaguuuuuuuuuuaagcaaagcacacagaaggauggaagaguccuaccacagacucccacacauccuuuaucuugccaccauuuccuguaucucuuacugcccuuccauguauucccucagacaauaaauacaggcucauccuaaaccauuggagcauuuaguguagacaacaaagccucuaagaaaaggcuggucucuuacauguaccguaugaagugucgaagcaugacuaucacacacauaagcacauaugcacacagcuccucuuuccuucugacaucccuuugcuuuccagagccaugcuuucucaggccccuuugcugguuaacaggauuugagcaggcuuggccuuggcuuuguggaauguuuacagaugcccaaaugcuaccucagugguugauuccuauuacaaacuuuugaaaaggauauuaccuaagaauauagugucucucuggcgauacuacaccaugaagcaacaaugggaaguccaucuguugccauaugcuaaucucaauccuuaaagaaaguguuacuugccaaacuacucuguucuguauggaugugcauucucauguucucuuucauaacuaguaaacaugucaagcacccugcuacccuacaaacuuccacuguuuaauaccuacugauaauuccaggaugcaucuaugacuaauauaauacuuauaaaggagugacuucuuaauucuaccaucccucccauauuuauuagcugauauucuaauguauagauuucucuuucucccccucucuguuucuccuugauuuuccaucuuucaguuucuuugucacugucucugucucucugucuuuucucucucuccccuuaguuacuguuucauacuuuacuguucaacaguauuacuuuaauaucuaguacauacagcaugaauaagcaaaaauuuauuuugacucauggauucucagggcuuugucagguagcucuuguccauacccuuggaaagauccucaagacaguuuuguguguguguguguuauguguguguguguguguguguguguguggagagagagaaagagaaagagagagagagagagagagagagagagagagagagagagagagagagaggaaggaggaggaggaggaagaggaggaggcugcucucauuguaagagaugagaagaaggcagaguccuugaaaucaggucugucaaaagaacaccccugacuccugcuuccuaaguggucucaccuccugacuuuauuacaaccucccaaaagaauaccaccagcuagagacuaaggauucagacuaaaaccucugcaggcaauucguauucaaauugugacaguacacauuauaccuugcaugucugauccuaacaugucucaucucagacuagccccucugcuguucugacucagccaauauucucaucuguucucuuuuuugaugaguuucuuaucuucuaaacaacaaaaccuccagccucuuccugagugugugugugugugugugugugugugugugugugagagagagagagagagagagagagagagagagacagagacagagacagagacagagagacagagagagagagagacuuccccaaggagccauuagauagaaacaguauggagaaugaaguaucuucauugaugcuagaaguaucguucauuuuauccuuggaagaggagagggagcuaggaauucuaaacauauauuuagucaugcauucuuauugacacuuauaauaucaauuuaacaacuccaugcuuuuacuggcuuucugcuauuccauguguguauuauccuuuuucuacagugauaaccuuaguuccucucaagguaucccucuaacccuaaaguagauagaaaacaacuucaaaauuguuccuugggcacuauuccaaacaauagagguaaaaagcuuaggguuucucuccauuuuucuccucuuuaaaacugaagacacacaguuaagguaggaagccuuuuuuauggugacguugucuguccauguacugugcaauugggcauaauuacuucuggauucauuacauuuuucucuccaauccuuguggauuauacuuauaaaaauuaaccuaguuucaaagauaauacuauacaaagguacauccacagaaauaucacuuuuuucuuuccugucuugccuaccaauuucacuucuuccaaguucacguuuccuguauuucuuuggcaaaaacauaagggaaacauucagaaagagggggggggguuggauacuucuguauuucuuuuaggacuuuaggauuuguuuguuuguuuguguuggcuuguuugcgacagauucucacuguguaccccaggcuggcauuggacucaugauaaucuauacuuagccccuuaagagcugaggugaugagacacacauucuuauuccucuuugucuccuaaugagguagagaaugcuuuagaacuucccugaacaaucaacuucuuguaguaaggacuauuaauccauagggccccuauuucacaguauaacauccagcuagcaugaauucaucaagcaagccuuccacacauuuaggaagcuuccauuauuuuauaugaucacaaaaugaccuacaugucuuaucagugaagcagaguauacuuccaugugauuaaagauaauucuuacagcaauuuuaacacucuaugucuuugaucacuuuucuuuuggauuucuggccucucuuuuucuccugaauuuucaauaacaguacauuuaauguuuauuaguacuuugucaguaucaugccauauaaguauuuuccccuaguuuaucacuugagguuugacuuucugaguucugccaugaaaaaggauuuauuuaauuuuccuuuacuuuaaaauuuuucuuauaaugaaauguuauuacaucugguaggugccuucugaaaauccaucuuauauaggauagccuuaaugauuaguuuuaaguucccucauucuguuacagaaagggggaaaguggaugaagaugugccauuugccuaugaucccuugggcaauuuuaaagaugcgugaacuucguuucuucaggagcagccugcccaggaggaucucuccacaggcugucucuccagaaaccugggaauagaagccagauuccuggacaacagagcucacacaccccaacccuggaaauccuucucaggagaaaacaauaagcauaguuaaaagucucuucuguaagcccauacuucucaaaagcaguuauaagcccuaucacaacucacugucucuuagccaugggggucugaaaucuuacuaauguuacgucccuguuucagaaaaagacuaaaacuauacucaucaaaaacaaaugaaaaugauggagcuguuaauauuuuaagccauauuauguaaguacacugaugggucuauguauauauguauguacaggaauguguguacagguacacauauguaaauauguguguacaugaaaccaaaggccugagguggaccuugguguccuuucaaucacaucauauuaucauuuuugcaaacaggguaucucauggaaucuguuuccccaguccugaauuauaagcaugggcuaccaugccuggcuuuuuuaugugggcucugagcuuccuagacccgagucuucaugcuuagauggcaagcacuuuaccagccgagcuuucaacccagucccauaccuauuuaaauuuuuuauauguuugaagcaggcucugccuuuucuucuuuguaacaugucucaguuuuuacacacugugaacaucuuuccauguuauccaguugucagcaguagcuguuuaagagacuacauggcaugcuacuguauagauacaucaaauauuuaaccaaaaacugugcucuuaagacauuuuggcuuuuuuuuuaauaucacaaacaacucagcaacacaccucuuuucaaauaguacuuuaagauaaauauguagcugccaaauuguugguucaaacaguacucagaagagugaaguugcagugugugaagauaacuucucccuuugccuacccacauuaucauucuuuauagucccuuuuaaaaaucucuugauuucuuaccacaagacuacacaauaauacaaaguaugacaaaagcuacagacaggcaaauuuagaaccaagcuucacugauaagucuuuaaaguccuucuaaugcugcuuccagacacuauaccauccaucgaaauaccccccaaacuucacuucguuaaaaaaggaacacugaaaaaaaucuaacuugggguuaggacaauaaaauccuacacuagccucuaacuaccuccccacucugcagacaugugagcuugacucuacuuugcaaaguuuguauaagccaagacccaaggaagccaugucaugaaacuucggguguagcugcucucaucucagaagcuaauuaaaaauccauggacaauucucccuugucgguuacuggauaaauacauuugccuaagacauuugacuucagguccuacucuaacagcccacauuccuaaauuagacuuucagcuggaaaacaacaaacauagauuuuucuaaccagaagcaucugugauuuuccaguaacaugaggcugcuauagacaaacugaccacuuugcacacucuaggaucccaguuuaggauucugaaccugagaaaucuuggcauucuucaaaaacacuacaagaucagaaauacuugccuuaaaaauugauauuuggugugugaaucuucuuaacaaguguuuauuaaacugcauaauucgaaagccugggguguuuccugggagcugaucgcauuugcauaucuuuuuauacuuccuuugaaauuaauauugccuuuuguguccugaacuuaguuaauaaaacuugccauuuuuguaugucacugcuaugagcaauacagaaaaagcugacaaaagaccccugcaaugucaacauaugcuuuguuuuucacuauuacauguuuuucaugugaauauauuaagcuaagaugaacacaccuuuguaaaauccacugauucuguugaauaguaagaugcacaagggugaaaucuuucuauaaugaaaggaagaguagugcuaaaaugggagucaaagaccaggcaggguucauuguggugccaggggcuccauucaaugucccuccaaagggcuuaauuacccugauuucaaaugcauucagauacaauugggcugcuuccuuucaaggauauauccuuguaagaugcuaaaaccgggcacugauuccuuguuugaguggcacugaugauuuagacauggcauggcauagcagggcuggaggaaagguccgucaugaguagcuccaugaagaaauguaugaagaggcaaucucucugagcgccagcaaacccccacuauaaacaguaagccucauggaaguuuuccccacaccuuuggcucccggcagcugcucuacucaagugagaaccuguuuaauguccugggaaagucagugacaagacagaggaagcagggauaguguugagauuccagagcacugguacaagcaagcaaggaaaagcccuuacccuaaguccugucuuugucaacauaucuuacuccaagcucauccaacuugaucaacaggcagagugaugggcacucagggacagaguuagggcgaggggaaugaaguacaacauggaagaauauucugucucauuaaucaauaguccauaagggaaauguguuuaagacugcauauuagccaagagguagagguauaugccuuuaauccuaguacuugguaggcagaggcagguggagcucuguaaguugaaggccagccugaucuacagagcaaguuccaagacagcuauggcuagagaaacacaauauugaaaauaaauuaaaaagagagaagaaaugcaaaugcaaaacaucacaguggacaaaguaccacaucauaguuaaauaaagauuaauucuguagagccaugcucaagacuauauuauaaucauagucacgugcuuuuguguauuuuaaggguuuuuuucuugcaugcacaacauuaaaguagcugaagauacuugagauugaaacguugcuguauuauaauucacuccaguuaugaguguuguaucuauauugaaacuagaacucauuauaaucuuaccuuccuauguuaacucaugaagucaucaauguaguauuuucaaagcuuguguuuuuguuuaugaugauuuuaauuggaagaaaugcuguguugaacauuuucugaucauaaagugaagaucuuaaauuauaggaacacccuaagaucaaguucuuagcacaaagauuuauuugacacagagggacaaagggcagggaaaaagagaugaagacuggagauagaggaugagggagaaggggaagggaacaagagaggaugggaagguauauuuucugggagggugggguaggcaaacaaagaacggacuguggauagagaggagacagcccauaggcaaauggcaguuuauaaagguaaaaggggaaaccucaugguuuaacuuuacuuggucauguuaauuaggugaacuaaaggggacuuuugauugcuggauauccaugcuuugauagcuggaccuuggagaagguccaggugaaggaaguggcuacauaagagaauagaccuuggugacuagcuuuaggauauaaugauucugaauagacagaauuggggagaacggcaaggucugucagagcugcauuuuugauagucagccuggcuagaguuccuuuguaaauauaguggacuuaaauuauugaauuucaaaauuuuaauugguuuuccauuuccuuucccacccccucccuuccuuuuuuucuuuccuucuuuccuuccuuccuuccuuccuuccuuuucaccuuucuuccuucacuuuuuucucaguaggcuccaguaugccuugccacuacucagacccuuguuuagcauugugaauguuuucaucagugucagagauacuauuuccugcauacaagguuuuaagagcuuaaaaguuuggcugugacuccucuagaacaagagccccucuccuguguugcuagucaauguccaaaggcgacaaccuacaugagagaaaaauuagcaucagcuauauccauuuaugcuuaucuacuucccgucuuuauaaauacuuacagcaacuucagugauagcgauucauccugaacauaaacugucaaccaugugggaagauacaggcacaaccuauucacauuagcagaucuaacaacaaaucucuagcaagaauuucagugccaucugcauuauaaguuuuguauauucacacggcaaguucuauugagcucuaauaagggaugaagaaggucuuuauaauauuagauguaugacugccugaaaaaaaaucaagcugagagaaaauauagauggcauuauauauucugcauaagaauaaguaaauauauguauauguuuauuugcuguggauaaaauagaguauauaaagaauaaaaucuggcugaagagguggcuuagcaguuaaaagcacugacugcuuuuguauaugacccaaauucaguucccagcacccauauagccaucuauaacuccagguugauaacaucugacaauuucuucuggccuauauaggcaucaggcaugcacaugguguauauucauuacauguagucacucacaaaaacaaauaaaauaaaauauaaaauaaaauaaaauaaaaacaaugaaucucuuaaaaagaauauaucagaaaaucauguaaauguuugcuauagagaguaaaagacaaaggaccauuuuaacuuuuuuuuuuugaaucaugcagcauuucaugaaaaauaaaagaacucuaagcuuucauaaaagcaagaaaauagauaaacccaacaauauauuguaaauagccauagagaaguaaaugaauucaaguaucuucagaauccaguaucaucaacauauaguuuuaauggaauauuaaaacaaaaccaugugcaaauaaaucuugaacuuuacuuagaaaguuguuuguugguaugguacugguaugcuaaucagaaacuacuuucugugugcuguaggacaaaacaaaugaaucaaugcagugaguucucacugcaggaucaaagauacagauauggaacgcagaaaggcuacauugauacuggacauuaauugcuuauuuauguauauguaucuaacuccuagaaguaaauaaugauauuuugcuuuaauugauagaagcacaauugucuguguaugaguugugcauaguuuuuugagaauuaucugauucuacagaugaugaggauaaaacucuuugcuaucccaaggacuaucaauggggaacuguauaaacauacuaaauauagaaaggcaucccuggacagaaaugaucaacacuccuuagggaagagagccuaucuuaaauuaacaccacauagauaacuuagcugauuugaagaaaaaauaccaaacgauaauguacacuaauagaaaacauuaacaauaacaacaagccauaaaaaugaagcaaucuggaaaguaucacuuucauugagugaaugagcagcuuuuccaguacugacagaacugaauaugguaugauccaucagguaggugacaucacuuagcuaguauuuugaccaaaaguguuuaaacugaaucuacucauuaggaaguaacugguuagaucccacacugcagagcaguguagaagacccuggccugaaauacagauuaacuaauaacaaguaacaagaggggaaauacuguggcuuuaaggaguccaaagcuccaaagagcgguucggccuuuagugaagaucucauguaaagagcuuaaagagacaacaggacaacagcacuuagugagcaauguacugcuugccuagguuguuguagggaaaacacacacacacacacacacauaaaucaaaaagagagacuucgcaaaguauaaaaagcauaccagaacuuggcaauguguuaggucauauuguaaagccaaggauauguuuguagagccuuugggguuggaguaguugccucagugggcaaagaaagagaggggacagagaaggagacagagagagagagaagaggggaggaguaagcugauuccaugacaagcuucacaauauaguucaggagacuauacaaaauauaguucaggagacugggcaaguccagacaagucaguuacuagaaaagacccaggcuucagacagcuagucagaaacuucccugccaucagaagcugcccuaccaccuggccugaggcaaggacaaugggucagcagcaguuuccagacuuccccagcaacaguuuccagcccccacacccugguaaugguucuggaaugucccuaaagauggacucaucagauuaagauacaggucaccuacaccagaauuccucugaugugguuuaaaucaggccugccagcucacuucuggcagggaagggggguugucuccaucuuggaaugaaagaccucagcaugcuggacuucuacagaauaaaaacccuuugcauuuacauacuauuucagucugggguaucauucuuuggggaaucauggacucuuacaagacagagaggugguagggaaguggccagcuagaacacauggagggggggggguaagggaaaggggagagagggagaaagggaucagugagagaagagucagagagagcaaagagaggccaaucaguucuucuuauagaaagccaggccuaccuggcuguugcuagguuugguggagccuagaaggaaugguaacacauauauuccuguuaagguucuugggcauauagcauaauugcauuauuaaauuagagaaauaugaagcuaaaugccaugggacaccuaaaacuacaguacaaaugcuuuuaaaaguacauaaaugagaaacuagaagccaguggauaauugugagaaaauguucacagccagcuccucgugcggguguuugaugagcugcucucuucucaguguucuuuaaucuaauguuccuuaugaauugagaauaacuuacauagauugcaaggcccuccuauugagguaugcagcaguaacuccuucaacgcuggggauagcucuacuugaucaagacuaacaaugccucuuuugugcagacaagaaaaacacaacuucuuaggauaaaauaauuugcacaagccugcauuuggguggcuuugagguucuuguuuuuguugauguucuucuauuuuguuuuaaaucucauuuguuaucagugcauauguguauaugugugucuguaucucugucugucucugucugucucucugucucucugucucucugucucucugucucucugucucucucucucucucucucucugugugugugugugugugugugugugugugugugugugugugugugugugugugcaugcacucauacacgugaugcuagggaggcuagggagggcauaugugucacagaaugcucauggagauaagaggguaauuugguagaauuaguucauuccauccaccaggcaucaaacucaggucaguaagccuauauggcaauaugugcugagucaucucacuaaccuuguaguugagguuuuacauuguuuuuugaggugggccuugugaaauuuggucugcucuuaaacucaccauguaguaaggaugacauggagcucccauucuuucugucucuaccucccaaggucugagauuauagauguguacuaccucacuucuuaguggcugggauuugaaccuaaaauauuuauauuagaaucaauuauccuagacuacugcucuacucuugaaguaaacuauacaucuaccagacaguguaagcauauuaaucauaucacaaugaauauucauaucuaauagaguucugugccccgaucacucagcuguggagcauuucugugguccuggugaguccuuucuacugcacuggaaauaggauuaaguagaagccaaagaauaaagucaggcucugggacuggagugaguucuauuaaaauuuuauaaacauagaaucuaaaaauaagauuaaugaaguauuauuuuuaaguagaaaaaaauaagcgaaguagagacaucauuguacauacauuguacacuaaauaaaucaaagaaagcagaacaaaaacacaagugcuuugagguuuaggcuguguugaagacaguauuguaaacuuguccauuuguucugcugguagugcucccaagcccccugacacaucagaaauuauaccauuagucaauuaaucagcguuuuugcacaauagcacaaugggguauccucuuuaacucaaaggaaucgccagcuucaguaacagagggaagucacagaauggaggaaaggcauaggauguucugcagagcagcagacacagacaaaggcagucacacuaaaaagaaagugagaaauggaaagggaaaugucaggaaucaaagguuaaaagagaaaagaucaguuguuuuuuaaggaagauauagaaagaugucucauaugaaguaaaaaggacuaguggagguucagaaauucuaacuggagcugaagcuugaaaauucaaggcaacaaagaaaagcuuaauaggaagccuuucacucagucacucaccagcuccuucacuuaaccccgaaaauguggaaggcacuuuacagagcugucagagacagaaaacguaagaggguuccuccacacauaagagacucaggcauucaaauauuccugauuuugcaucuucuuacuuucuaaugugacuuuaauuauugccacacaccuuugcucauauucucagcuaagaaaucacagccuuugcauucucuauaacagcaggugauuuuuuuuuuaacagcagcugccauacugaaugaguauacucauuaugaaaugaaaacaaguuuacauuucugauaugcugacagcauauaaugcaguguuguuaaguagugguugguauauacagauucuuccauauauggaaauauacaucuccuaucccacagaggaagugaaugacagggauauauaaaggauuuuaaaagauaauuaagguauccaagauggcagcugauacuuaggcacagucuguuagaaucuccagggaauaaacuuaggccaucagauaaccaccauuggaagaggugaaugacuccugaaaaucucuacuauaauaaccaaguaaauuaggaaacuuuaaaaagcagaaggggaaaguuacagucuuccccagaggaauuggcagugcaugggacacuguacugcuagugggagggagacucucagcagcagauauuuaaugaaauuugcaugcaaaagagggaaccuuuucuccuuagcucucuacuaaccuagccauagaccaccacaguuuaaagaccucagcagugccaggggcucaagaaucacauagucaagaaacucagagaaagcgcuaugaacuuuuuguccugcaaccaagucucaacaauuccucuagaccagugauucucaauauguggguugcauaucagauauccuuuauaucagauauuuacauuaugauacauaauggaaaaauugcaguuaugaaguagcaacagaauaauuuuacagaugggggucaccccaacaugaggaacuauauugaggucacagaacuaggaagauugggaaccacagcuuuagacugcauuaauaaauguuguauaauacacaugugaauuucauguaguauuuagugacaauaaaaaccucauuugagccagcgucuuccuggaaacauagacacaagacaaggacugcuugggguggggugaguacuuaaauagacuccugaaaggcauuccagagguaugaccugccucuaugcccuaacuucacaaaggagcaugcuggacugugggaguaucuuggaggaagggcaaggaaggcugaaagacuuggagcucugaccagcaauccgaagggacuaugcucagacucuagaaccccauucagcucugguccuuuaaccuuuccucccucucuauuuaguaacacguuguuaguuuugcugacuagcuugguccuucuuucucauucuccuucuucuauucuucucuuuucucuuuuugcuauuucauuucuguuuugguauaccuucucaaagacaagagcaagccuuguuuguuggguauccuagucucaacuuccugaggauuaaaacuccuugugcuauuuuaugcauuuuuuaucucucuguuuucauuucacacauauacguaauauauuucaaugagaucuaugucugcuauguccacaucgacugauuaagucccaugguuguccuuuccaacagcacccugaugugccccuuacuuuuaugcucuuuuuuuuuuuuuuucuguaaaugauccaggucagugaguuccauuagaauuauuuauucagguaugaguacuuaucccauaaaagaaaacaauacccugacuuuggaaaauguuuccucaaagcuaauuaagaagguaauuugaaaaaacuaaaaaguaaacaacauuuugauuuuucugauuggaauuacaaaacccaacaaggagucagaguuuucuuccauauauucauaauuuuuuauacauaaauguccagagaauagaggaaaauuaaacuuugauuguauuaauaguucccacgagaucacuauugaauaaaacgauaggggaccacugcuuugaucuaaguuccuauauuagaucccaaaauaacaagcuaaaagcuaaagggaagaguuccacaguugaaaaaucaaagccauugucgccuaccucuccacgaaaucaacaaaaguaauggcaaagucuacaagaugacaaugcugaaggaaacaaagggaugguuuagcugaccugcccugauguuaagcagcaauccgucaaucuccucucuguaagaagcaugaaauggcccauuugcccauccuuauucuuuggucagaucaguucuucaaugucuacagaccaacuucagcucagcuuauuggagugucucuucuguuacauggaaugaaauaguacccagguuguagauaaaaauacagucaaaggagaucauuaaaugaaauuuguuaccauuuuguauuuugacacuacuuaaauuugucagagaaaguuacuuaucuuaaaaucaagaaaauauuucauuuccaaaagaccaggaaaccaagugaaauauuugucuugaauaugauucauucaaaaugguaaaggaaaucucguuuuuaccaggaagcuaucaguucuugugguuaagaaacgcaggcagugggaagaugaauggauuuguguuuuugguuuuuguuuuuguuuuauuuuaaaccaacauuguuaguucuuaauuauucagguuccaguaaaggccugucaauacuccaagucaccucccuccuuagauuaagaggacaauaaaauuuauuucaaccucaucaaaaacuacagaagcaaaugaugcgcccuuaaagaagaaccugaaagaucuuacagggcaccuuuuauauguuauucauuuaccaaauauguguuuucaaugucucuacaccauaaaguacucauuccuuacugaaggugucauuggauuacacacacacacacacacacacacacacacacacacacacaccacuuccacaugauuuaaaacaaugaccacuguacuguaaugcacucugagagcuaagcaaacaucucaucagagacccggguagcuucaguaaacgcaguugucucaggguagcuuccugcagugcacuggcuaguuuugacugcacagagcaucaccauuuccaacacugccaguuucuuuaucuuucaagagaaagcagaagaguccuucagagccaauagggaagagccaauagggagucuaauuucaaacuaggucucauaucagagucuuuucaaauuaguuuuuaaagguuuauuuugugauguucugauaaaaaccucuaacacuagggguuucugucugaugaaugucacagagggaaccaguaagucuggagcagagagaacgaggugacauuauuacuguuauuauauuuggugaaaacaaagaaacaauucaaauuuuaaaaaauaaucuuuacuuauucuagugaucccuuacaucagcacuuuaaaagaaaucacugacaauauuuuaauaaaaugcugacaguaauuacaugaaggugucuauaaaguaauuaaaccuuccaauuaaugacauucaauguuguuucuaccuuuacacauaugugugcagacaugcucaugccagcaacccccauaauuaacuauauaacuauacugaaccaccacuuaguuucagaauaaaaauaaacaaauugauagaagagaagccaagccccaguacaugccaucuggaggcauggaguccaagaaagauagguuucuguuuggaugauaauggcaaaggaaacaugucaaaacagauaucuacuuggacuauggaacugaaucaaacuugaaauuaaauucugaauuaccuacuggguagcauaggcugcuaacucaacauccuugaacccaguuccucuucugugaacaaggaaagcugcuauuauagagacuagacaaagauaugaauauguauuagccagaacuucaucacugugaccaauacccaaaggaacaguuuaaaggagugauuuacuuugacucaaaguagcagaggucuugguuaauuuuugcuuggauccauuguuucauguccaagcuaagaucagaaucauaaugaaggguaugggcaagcacagaggcucccuauacuguagucaagaagcaaagagacaagcagagugucaggacaagcuaugaccaccaaggaugccccauagccuacucuguccuccuaugauccccaaaucugaaaauauccaucaccuccaaauaauaucauaaaaauaugaauucaucaguagguccauccaauaauuagacuagaacccucaugauccuauuaucucucaaagacuagaccaacucugaaaacagccuuugacacaugguuuuuagaggucacuuuauguuaacaaaacuuaagaacaaagagugccagaagauucuacccccaaauuugucaauauacauuaaggguuaauuugagcuuguggggauuuuacaggaacagaugcaagaaaaacucugccuucccucuuuucacauaaaggcaggagaugaacucauaaaaggaccuucucccuauccaucauguaagaguaacuguaugcucccaggcccaaugcacauuuaaccaagauggauaucuggugucagucauuuauaaugacaauuaacaacagugacuacuuauacauauaaguguguguccugagauaggcccuuuucccuuuaccauccuggaugcuucaacuggggccccuuaaguuagacugacacaugacagauuaacuacaggaaaacaaaccuuuauuaaaugugugcauuguggauacaugcugggaguacccagcaacgagccaugccaagacuuuagauuuguaucuggcuuugcaaagcucauaaaagagaguagaguuuuuagagaaauuacaaaacagaggggcaggucuuuguuccuagguaggaagugcugggggauggauccacaggagaaugaaugagggauagaggauucuuggugggguuugugauauagauuccuucuagaguuucugucagcugguaaaggucuagaacuuucucuagugagaaacuaugggccaugguaauaaccuaaugccccaguucucccaggcugacccaguuccuaaagguuccaugaacaacaucauuagucaccagccagggaaacaagugucuaaagcaugaggagggagaugcagcauucacaccgugaugucacacuucuucuaaugggcaugguuuuacaggaugacuugaugcugccccacuugguuuugacaucaucauuuaccuggagcuaagagauauaaguuggcuuccuuaagcucacugauucuuaacuggcuuugaugggcuccuucuaugucucuguggcugugucuggaagacuuuuaucccugugacuuaauuccuacaacauggucacacuucuuuacaggacagcuccaugaacuaagaagagugaaaucagaaguuuccaccugaagauguagucuccgacacaggaacagugccuuuagucauuacccauugaacaagcaagucagaaggccagccaaagggugaggcaaaauggcacacacguuuauucccaggacuugggagacaagacgaaccaagagagagaaagagaaagggagagggagagggagagggagagggagagggagagggagagggaaaaaaggaaaaggaaaagggagagggagagggagagggagaggaagagggaaagggagagggagaggaagagaggaagagggggagaggagaagggggagagggagggggagggggagggcagggggauggagagggagacagagagggagagggagaaggggagagggaggggaagaggggaggggaggggaggggaggggagagaagagguaguaaaaagucaaggguagggaagagauuuccuuucuugaugggagacaccacaucaaaccauauagagaaugaaagggcucugauaggcagugcucucgcagacccacacuaugacaggauugccuguuacuuugcccuuucuuuauucugcucucuugaguggcuaauaagccauuugguuccaauuacacagcuacaugcaugcccacaaugggaacacaagaaaauuuaaaacaugcuaucuucccucaaggagcucaaaauaauacaaucauugaaacaggguauagauauccugaaauucuaauaacaagaaaauacuaaacaaaauauuuugguagcagggcaagacaaucaaaauuguguucuaaggcuaugagucaucuauuuaauucauugugaacacagcaauuacuccccagguucugagaagagaauagaaggggaaguucuguguaagaagagggucauguaaucacauaagccaggcacauaugaaguacuccagagucaggaagccacagcaguggacuccuugagacacauggcaaggaaugaugaucucugcauauucuucagugguaauuauaaguuuaaugugucugaaagaaguuccugccucacaacaucuaucguuacucuucucuucagauaauguucauaagccauuugcggaauccucaccaauaacauaaccuaggauuaauaauggaggauuccucacuaaccuuauaaauuuugcuacaccuggugggggaaaaaggaaaacaagcaaaacuguuuauuggaguuguugaauggcagcuuauaaaccuugccuucucuguuugggaacuaguguuuuucauguuguuuuuuucuuuuucuuuuuuuuauuagcuauuuucuuaauuuacauuucaaauguuauccccuuuuuugguuuccccucugaaagccccuguacuggcuaguuuugugucaacuugacacagcuggaguuaucacagagaaaggagcuucaguugaggaaaugccuccaugagauccaacuguaaggcauuuucucaauuagugaucaagggggaaaggccccuugugggugggaccaucucugggcugguagucuuggguucuauaagagagcaggcugagcaagccaguaaagaacaucccuccauggccucugcaucagcuccugcuuucugaccugcuugaguuccaguccuguauccuuuggugaucaacagcaauauggaaauguaagcugaauaaacccuuuccuccccaacuugcuucuuggucaugauguuugugcaggaauagaaacccugacuaagacagcccccuugcccuccuucuccuccucccccugcucacccacucccacuuccuggcucuggcacuccccuggggcaucaagccuucacaggaccaagggccucucuucccacugaugaccaacuagguuauccucggcuacauaugcagcuggagccaugagucccaccauauguacucguugauuggugauuuaaucccuggaagcucugggguuacugguuaguucauaauguuguuccuccuauggggcugcuaaccucgucaacaccuugggucuuuucucuagcuccuuuauugggggacccugugcccaguucaagaauggcugugagcguccacuucuguauuagucaggcauuggcagagccucucaggagacagcuauaacagguuucugucagcaagcauuuguuggcauauacaaaagugucuggguuuggugauuguauaugugauggauccccagguggggcagucucuggauggucugaccuucagucucugcucuacacuuugucucuguaacuccuuccauggguguuuuguucuuccuucuaagaaggauucaaguauccacacuuuggucuuccuucuugaguuucaugugguuugugaauuguaacuuggguacuccgagcuucugggcuaauuacccacuuaucagugaguacauaucauguuugcucuuuugugauuugguuaccucacucaggaugauaucugugaagagcggguguggccgccaccccaaagaugacaccugggauggcugccaggucuuaugaccugugccugacuuccucauuaccucagacuuagccacaucccagccaccugcacugcgcagacgccaugcccugucagcucgccugagguguagucacuugcugugaaccaauggacugcuguuaugugacuggggugauugggaggagucaguaggguauuuaagucaggccccaggguuguucagcggauuccuguuccugcauugcaaugugaaguguuccugaauaaaccugcuugaagaaggacaacgugguguugcucuuuccugcugguugugguggaaucgacagauauccuccagauccauccauuugccuaagaauuucauaaauucauuguuuuuaauagcugaguaguacuccauuguguaaaucuaucacauuuucuauauccauucuucuguugaggaacauauggguucuuuccagcuucuggcuauuauaaguaaggcugcuaugaacaaaguggagcacguguccuuauuacagguuggcgcaucuucuggguauaugcccaggagugguauugcuagauccucagguaguacuaugcccaauuuucugaggaacugcuaaacugacuuacagagugguuguaccuacuugcaaucccaccagcaauggaggaguguuccucuuucuccaaauccccgacagcaucuguugucaccugaguuuuugauuuuagccauucugacuggugugaggugaaaucucagauuuguuuugauuuguauuucccugaugacuaaggauguugaauauuuuuuuagcugcuccucagccauucgguauuccucaguugagaauucuuuguuuagcucuguaucccauuuuuuaauagguuuauuuguuucccuggagccuaacuucuugaguucuuuguauauauugaauauuagccaugccaccagugcuuggcuuagcccucuaucagauguaggauuggaaaagacuuuuucccaaucuguugguuacacuuuugucuuauugacuguguccucugccuuagaaacuuuuagaggagaaagcauguaagagccucgaacauaugggcacaggggaaaaauuccugaacagaucaccaaugacucgugcuguaagaucaagaauccacaaaugggaccugauaaaauugcaaagcuucuguaaggcuuuugguguuguuaaagcaggaacuuguaaauuucugucucuguuagaacauaacaauggaucggaaggugcugcuuagaaggaacauauaaauuucagucuccgccacaggaaaauaagcucugauuacacugcauaguucagaccccucaggugcuacagugcagauuugugccuaaugaguugccuuugcaguagcagagaauggaauucacaagcuguuauuuaaguuuuuuaaaaguguauuuuucuucugacucuuuuguugccccccuaucucaaaacacaauaugagcaaugggguuuaugaacaucaccacacggcauuuccuguaauggugauuaacacaauuuaagcguuguucuuggggccuuguggcaccgcccacaauagcagagagugacacggcuuugggcuguauauuucaaaccauggcuguuuacauaguuggggguaugaugggcuuuuuaaaaaguugauaauacauaacauuacuagcuuuuaauuucuguuuguuguuaaaaagaaugcuugauucguagcacuuuccuaaaugcagcuauuagaaggucagagccaauggguuugauaauuuugccauuuuuuuucaaacaaguuuuuaaagaguuauucuggauauaaagcauaaggacuuuggaacaaagugcccaguuguauucugcagucauaacauuaugaaggaaagggaguuuccaacucaauaaaacuguaaggauauccuaacaagggauauucuaauggaugauaugaaaucccauaccaaggacuauucucagaacaaagucagcuuuagaacagccuagaaggaaucaaaggccucuguacauccaaggacaaaaggacaaacauguaacugauuauaguuuuuuuaccuaacaguuuucaaauaauaugcauaugaaagauauauauacuacuauacacuggaaaauguguguccugcugcugcugugauccacuauaaaguguucagcccaaacauacagcaugucucauccuuaaaauaugugaccacaaauaauaacaucugucauccacuuuuuuuuaacucauagcacagggguugucauacauagauacauucuuugugauagcuuaauuguaccacagagacuauaaaguacagauaucaaauaauuuauucaccaaauccucuauaguuuggacauuuacacuguauuaaaucauguuuguaaaugcaaugcuacaauaaauauuuguugugcauagauucuugugaacauacaugcuaauauuucuaaggcaaaugauaacaaaaugcaauggggaggucaaagcauauauguauuucaacauuuacagggaacugaauuuccaaagacaacauagaaaugaauggucuuugucaugcugccaacauacccacuaaagaacaaaucccaaaauuaucacagguuuaucauacauuuucugcuaacugauaucuucauucuuuaguaggaugaggacaaaaucauuguuuguuacugagcauaggcauuaaaaauaauuauaauugacaauuaguaugauuguuauaaguucaaggccauucccugacccauuucacacugcauccccacucuucucuacccuagcuugucagaugguuuuaauuugcggauuuccuuagaacauggauuauuugcauucugcagacaucuucaaaaagucauucacaagugcauauuucauggcugaauauuuuuacauaacaucagcuggagcccaucguuccagcauucuugccaagugucacaaccugcucuauuauaucaauaagcagcuucaauuagucauuuucuccccguggugacgacagcuauaauagcacacagcagucugaugaaguuuguaauacaaaguggagaugaggguauuaaaaugaaggcaauacaaaauuagaauagcacacaaaaauauccuaccuccucaguagucauuuggagggcugacaacauuucggauauuggagaguaaauacagaaauucaauugcuuuugaagaacaugaauaaauaaauuugucauagaaacacacucuugccccagauagaagucugguuuguacugacuaauuagucauuaagugccaucuuaaaggaccuuccaaaagaauaaacugaaacaaagcguaagucucaaauaaaauagugaaaugcaaauaaaugcccaugaugagugcugcauuggauguguuguaugacaauaaacacauuagaaggcaugacaccagugacucucccacaagaccuucaugcagccuugaccuucucgugugguuucccaggucacaaagcuucaccgcagguucacuucccuggcauauagucagagccuccugaaguuuuaccucuccucucgucucuuuuagucccuucugcacacaacagcuaaaguaaaaauuuuaaauuauaaaucagaucacaucacuucuuuuccuccaggcuuucagagguuucuaucacaguuaaaaugggcuggcaaggccuuacauaauacaacccuguuggcuaugcagcucugcuguuccuuucuccuccccacuuuggcuucugucaaacagagucugaacccaguuccuccagcccuugcugguacuacuugccagaggacucaaugccaucuuccuaggcaucccuucuucacuucaccuguccccaaauguuaccuccuuagagaaagauuuaugauccccuccuaauaaaugcacuuucucuauaugacuuaacuuuaccuagcauuauauaagauauauauuaguuguuguauuuaauugucugguauguauauuauguauacuguuuguuauuaauggaaauuaucuauauauaauuauauuaaauauauauaguuguaaauaaggucuagugaaaaauuacauugaccuuauuugguucaaauucauuugauucagcauguaauuaguucuuaguugacaugguguucuagaagaauggauugugaugcaaucucauuguggagauagaacuguaacacaauuugagagaugaaugauuaagauacauuauugaaaagaguuuaaaacauuaacagagagaggcaaugaguaagguaggcaaugucaggaauucugagaagggucuagcauaggcaaagagaauaaagagcagguucaaggcgcagccucauacaaggcuuucaaaucacccaugguaaaucuugauaacaucaugggagagggauccaggggagaaaauguaagcacuaaaagacugggauaaagguaaugaaagaaccaguuuccagguguggcacagccuggaacuggcaaccucuuugguuaccugcauugggaaauugucagaaaagaguucgggaauggaguccugugacgggaacaacaguucgggaauggaguccugugacgggaacaacaguuugggaauggaguccugugaggggaacaacaguucaggaauggaguccugugaggggaacugugagcacuugcaggaaaacuccaagaaaacaagacaagagucuugucaccucaguuucuacaaaaccacagaauugcucuugggcugcauuuucaugccacucccuuguagaguggauuaggagguaguuuacuugagcuguugcuguucauaugucucuaugaaaaacuugguuuuggguuucuaucugcaucuggagcugauucugugccauagagcccagaacugauccuugccacaguucuucauacccaaauugcucccagacagaacuggucuccaaggagugcugacacaagagcuuacaggagggacaagucacagagacagcaagaacagcuaacaccagagauaaucagauggccagaggcaagggcaaaaauauaaacagcagaaaucaaggcuacuuggcaucaucagaacccaguucucccaccacugugaggccuggauacugcaauauaccagaaaagcaagacucugauuuaaaaucucaucucaugaugaugauagaagacuuuaagaaggacaugaauaacuuccuuaaagaaacacaggaagccagauacacggaaucuaauagaagagaaaguaggaaagagccgcucaugcucuaagaucaagaauugauaaaugggaccucaugaaauuggaaagcuucuauaaggcaaagaacauagucaauaagacaaaucaacaacauacagauuggagaaaaauuuuucacugaccucacauacaauagaggacuacuauccaaaauauauaaauaacaaaaaaaaaaaaaccaaucuaaucaaauaaugggguacagaacuaaacugagauuuuacaacugaggaaucucgaauggcugagguccagcagaaagaacugaaacaggcaaucucaggagguaggagguuggggagacccuccagaaugcaccagagaccugggagguaagagacucucaggacucaaagggagggaucuuagaugaaaugccaggcagugguggugguggggacuuauagagccaaccuccagcaggaagacagggcaucaaaugagggagggggggcauccuauagucacaacuuuuugucugaaagaaauacagggauggaaauggagaggagccugaggaaaagaaggucuagcaacaggcucaaaguggaaugcagaucaacgggaggucccaaggccugacacuauuacugaggcuauggagcacucacagcaugaagacccaacaagaagcugaaagacucagaugcagguauuugcacccauccaauggacagaagcagcugaccccuguuguugaauuagggaaggcugaaagaagcugaggagaagggugacccugaaggaggaccagcagucucaauuauucuggacuccugaggucucucaaagaccaaccaggcagcauacaccagcugauaugaggucccuaauacacauaaacuagaagacugccaggucugugcucauucagagaugaugcgccuaggacagguggacaggggaugggaauaauauauggagguuaaaauuaauuaauugguugauugauuaaaagaaauacaggagagcacagguaaacaucuagaaguccuuaaagaggaaacacaaaaauccuuuaaagaauuacaggaaaacacaaccaaacaggugagguaauugaacagaaccauccagggucuaugaauggaaagagaaacaauaaagaaaccacauagggagacaacccugaagacagaaagccuaggauagugaucaggagucauagauaaaagcaucaccaacagaauauaagaaauagaauaguggaucucaggggcaguggauaccauagaaaacauugccacagcagucaaagaacaugcaaacugcaaaaaacuccuaacccaaaacauccaguaaauccaggcuauaaugagaagaccaaaccuaaggauaauagguauaaaagaaggugaagauucccaacuuaaagagccaguaaauaucuucaacaaaacuguagaagaaaacuucccuaaucuaaagaaagagaugaccauaaacauacaagaagccuacagaacuucaaauagauuagaccagaaaagaaauuccucuugucacauaauagucaaaacaccaaaugcacaaaacaaagaaagaauaauaaaagcaguaaggggaaaaggucaaguaacauauaaaggcggaucuaucagaauuacaccagacuucucaccauaggcuaugaaaacuagaagauucugggcagauguuauacagaccccaagagaacacaaaugccagcccaggcuacucuacccaguaaaacucucaauuaccguagauggaaaaagcaagauauuccaugacaaaaucacauuuacacaauaucauuccacaaauccagcccuacaaaggauaauagauggaaaacuccaucacaaggugggaaacuacacccuagaaaaagcaagaaaguaaccuucuuucaacaaacccaaaagaagauaaccacacaaaccuaauuccaccucuaacaacaaaaauaacaggaaucaacaguuacuauuccuuaguaucucuuaacgucaauggacucaauuccccaaucaaaagacauagacuaacagacuagauauauagacaggacccaucauuuugcugcauacagaaaaugcaccucugugacaaagacagaugcuaccucagaguaagacuagaaaacaauuuuccaagcaaauggucccaagaaaccagcuggaguagccauucuaauaccaaauaaaaucaacuuccaaucaacaaguuaucaaaaaagaugaggaaggacacuucauacucaucaaaggaaaaaucuaccaagaugaacucucauuucugaacaucuaugcuccaaaugcaagggcacccacauucauaaaagaaacuuuacuaaagcacaaagcucacuuugcaccucacacaauaauagugugagacuucaacagcccauucucaucaauguacagaucauggaaacagaaacuaaacagagacacagggaagacuaacagaagcuauggaccaaauggauuuaacagauaucuauagaacaauucauccuaaaacaaaagaauauaccuucuuuucagcaccuuaugguaccuucuucaaaauugacaauauauuaggucacaagacaagcugcaauagauacaugaagauagaaauaaucccaugcccccuaccagaucaccauggcuggucuucaauagcaauaaaaacaacagaaagcacacauacacauggaagcugaacaacaccccacucaaugauaacuuggucaaggaagaaagaaauaaauuaaagacuuuuuagaauuuaauggaaaugaaggcacaacauauccaaucuuuugagacacgaugaaagcagugcuaagaggaaaacucauagcucuaagugccucccaaaagaaacuggagagcgcauacacuagcagcuugauaguacauaugaaagcuguggaacaagaagaagcaaauauacccaagaggaguagaaggcaggaaauaaucaaacucagggcugaaauuagccaaguggaaacaaaaagaacuauacaaagaaucaacaaacccaggaacugacacacaaaacacacagauggggcaaccuguagauuacucccaaaaauguggccauggaaagggggaaaagagcacugaacgcaguaccuggagacaagacauccagaagacaaacuccacagcacagaguagggggagguauaaaugggagacacauagccaacaaaaggggccuuuuucaaauauucaaggcacuugcuggacauuaauccacuacuugcuaguuaauaguuaucuaccgccuacagacaaucaagcccacacagacuaaggugaagccuuaacugccauucaaaagguuuguguuucuugggcacacugaacuugccuuugucuaucaaguaggugaaaguaacagcauccacaauagaguggauauagagaucaaauggggucaacccauuuagcagaguguuugccuacaauaaacauuagguguuuggacaugagaagagagucccaucagcaucaaaagagucaagauaaaucuguagaagaaaaacuuaaacuggugggacaucuccauuuacauugugcuaauacuucaugugacuuggcaaaaagggaaagcagccacaugccacucuauuuuauugaugaacugucaaaggcauacaaagagaagcauugucuugacuggugaugacaacugcuaguggcagccgugcagagguaaagagcucccuggaaaaacgaaaccucaaucaagugagaucaacaugaaacacaguggaaaucaucucaggggagacaaagagaguucuaagauagguacucaacagguucaggcucaggacaaggguagacuacagggacaaacaaccauagcacuggagaguagaagagugaucugaguguagggagagcuuugggcagggacacagagcauuuacucacagaaucuggaaugugaaugguauugaugacaagggcaagaaacuccuggaggcuucuaaguagagaaaggcaaaggaccaugaggcuuaauagagaacuacugccaaggcuggagcuagaguagacaugaaagagugcuugccuagcaugcacaaggcccuggguuccauccacaguacugcaugaaaugacuggcuguacuuguguaaacugcagaauacaagagguagaagcuacagguucagaaauuuaguguugucagugccuaaguucaaggccaaucuggccugcuuuugacaaaggaaggugguaacuguaagguaccuagagagugacugaaaaagaaaaacuaacuuucaaguaucucuuuuauuaauuuguuguugaaaguauuuauaugauacacaaguuuuauggaggaaggucauauaaccacauguucauucaacaacucauucagucauuaaucuaucuauuuaguaccuuaauauauauucaaauauacuggaacugaguuuuuucuaucaagaagagaaauauuauaacagugauuuuccucauuauauccaaugcuaugccaauuaucaagaaguguguguguugaggggggaggagaacugaagaguagggccuaaauuuaaucaaauauuuuuaauuaaaagcuuuucugcugagaauagauagccuuugaaagcuuguguaaacuaaauaaauuauauguaaguauauuagugacauuauagcuuuuuaaaucacauuauaucuucuaaaaugucaaauacuuuugaaugucaaguaccucccauccccuaaaaaaauaaaugacacauaacaccaugaauuguccacuaaaguucagaccagaacagucuauauuuaacaauagaacauucauuccacuguagaccagguaagacauacauguccacguggggcaguuugagaaaggggaaaacagguucccagacaacacuaacuuucaguucaaccccugaucaugcaagaacauuacaaugaaaucaugguaauuuaauaaugcagcuggucagccucugcacauaguagaaagcacaggaaaauaaaugaggcuugcaugccaaaaagaggcaaacuucuccaggcggugccugcagcggagagauaccugcuaauaauacacggcuuguaucuccauucauuaugcaggaagccagccucaaaaggaauucuacaaaguucuaaaaguggaaauaaauaaagaagcuuaccugccauggcuggaucucugagaauggcuuggaaggacuauccacagauaauccagugggaugcaguaaaggguccucagaugucaagggagguaauuacucuugacuugcacgggcacauuugcuggauaaauuagccuccucaacucauucuuccauugggcaucugauacagaaacuguuuaaagcacauagcauucucuccgguuuuuaucauaacagacagagaaaaaugugcuccaaguccuugccaaagaagucugguauuagauggggacccauuaucuuugaccuuuuugucuuuaccucuucggucucauagaaaaccccccaaaacuacuucagguaaagugacacagggucucggaggugccugcuuccuaaagaaagccauuguuucugcauuauagaaaaugacaugaguugagguuaaugauugcuucuuucuuuuccuucuuaaguuuaaacuggccuguuauuugcucaaagguuuaaccuauaagugcuagaagccuuugcuuaucuggccauguuauuaauguguuacucaucagccauuucuguuucuucccagacacuccucucuaauuaucaagacaacuuuaacauuucuccaucuugcauucuuuaaagaacaauucugacaggugacugccaccagcuauugugucuaaagccagcaaugaaaugcaagaggaggaacaguuaauuaaaauuguggacuccauuuugcauccuuucauagucaauaaauauacaguugaagaugcuucccagcacgugaugcagcagguagaagguacacucuugaaugucuggcugcuaaaagucagaaccuaucaguguaacugagugcuuuguaaacuucuugcuucauuaaucacaaaacuaauuuagcucaguuagcagagaacuuuauauugagaucuauugagaagguguuugcaagaaguaaaguaucugcuaugccaacauagagacuuggauuugauacccagaaccuauaucaaaauucaaauggauggaucugggggauaucauccugagugagguaacccaaucacaaaagaacacacaugacaugcacucacugauaaguggauauuagcccagaaggucauaauacucaagauagaauuugcaaaacacaugaaacucaagaagaaggaagcacaaaguguggauacuucaauccuucuuagaagggggaacaaaacauggaaggaguuacagagacaaaguucagagcagagacugaaggaacaacaauccagaaacugccccaccugggaauccaucccauaaacaaccaccaaacccagacacuauggcagaucccaacaagagcuugcugacaggagccugauauagcugucuccugagaggcucugccagugccuggcauauacagaagugaauguucagagucauccauuggacagaacacaggguccccaaagaaggagcuagagaaaguacccagggagcuaaagggguuugcagcccccuaggaggaacaacgauaugaacuaaccaguacccccagagcacucugggacuaaaccaccaaucaaagaaaacacacggagggacucguggcucuagcugcauauguagcagaggaugaccuagauggucaucaaugugaggagaggcccuugguccugugaagguuuuaugccucaguauaggggaaugccugggccaggaagcaggagugaguugguugagguguaaaggggaggggggagaggacagaggacuuucagaagggaaacuaggaaaggggauaacauuugaaauauaaauaaagaaaauaucuaauuaaaaaggaaaaaaaaaagucagccaugguaguaugggcuuuaauaccagggaaguaaaauagguggauucgugaagcuuauugucaucuaagccuaccgaaccaaugagucccuggccugggaaaaccauuuuucaagaaacuaaauggauugcuccugaagagugacaccaauguugaagucuggcuuccacaaaugagcaugaaggacauuucuucaaacacaugaacauacauguauacacacgcacgcacgcacgcacacacaguguuuucuagaaauaagucaaggaacauauuugcaaucuacagguaacuucugggaagaaaucccccugaugauucuguacaggcuuaucuuaguugauacuuuauuaguccaaacuuuagacuucugugacuucaggcaucuguugucagccauccaccaaaaguauuacauacaaaguucuagaaguuaacaaauuuuaaauuauaugcuuuaugggcauccugaacauacauauuagcaucacacucaaugcuaccugagauacaaauaguauuguauaguguauugaguaguagcuuacugcuagguuccaaugccugugcuauccuucccauuucugcuccuuacagagacaaagaaucaucucagauuaucacaaggaugaauuaguacaguaaaaucuuccaccagaggcuggauuuacagaacauuuauauaguauauuaguuuaaucauuguguuuuauuacuguugacagucucccacugugccuacuuuacaaauuaaacuauauauauauauauauauauacacauauauauuuauauauauaauuagacaguagauacaggacuuggcaaugucuuugguuuuaaguaucacuaugggguuucaggcuacauacccuauagauagggaagaauugugcugauuuuuucaauaauaauaaguauuuaauguaggaaauuagauuaaugaagguauaucaauauaaauaaauauuauguauuuaaaaaccauauauaguucaugauuuaaauauucauacuucaucuuagccaaaugauuguauauuuacaauacuguuaaaugaaaguauuaauuuguguguacaauaauccaacuuuuagaaauuugauauaugcaaauaaaaaauaaaauaauuuuaauaagaauauagcacaagacauacauaauuaucaagcauaucagugacaccaaaauuuaagaaaauaaugaaauuuuuagugcucaaaacaugcaaaauaauauuuaaauguauaauuaacauuaaugauacauauuaaauuauuuucucuaauaagucuuagacgucugauaugcaguuugcacauacugcacaugcuacuuuaaucuugacacauauuaggugcucaagugccacaucuggccagccgccgaagccuggacaucuuuggcauacuucagacgugggggugaagaguaagcuccaucaugccuuuccuucucauuacucucugacaguuaccacgcguacuuucauuacugaacacacuacucuguaauaagaacagguuugacauuccaauaaccaccuuguuccaucucugagauaugcucgugaucauuuccuuugcaaugcacagacagaacacuuuuagagcugggaaauggcuauccuuucuugccuucccuuuaccuucccuuuggaugaauccacagccuuggcuuggggauuugagugagacucaauugcaaaugugcaguguaacuacuauggaggccacugcuuuccugugaugcagccucaaacccaacaggucucguagcacugugauaguagcugaauggcuucuggaaggacauggaauggggccagaaacugcuuaauuugagguuaauuaaauagugaugacaagccuuaauuuccaacuugucaucagacuguaaacacugacugcagcugcagcaaucugcaauaagccuguggaaagagaucuuggccagaaugaaaugaguaugaagcugggagugacaucugagaaauccuaaccucucuguaccuggagauuuaaaggggagcuacuggaggauggauacauugaagcugcuuucuaugcagcaccaccacaaaagaaaaauucugcaucacaugaccaggaggcuggaagaaacaaggguagagaugugaaacugucaaacggagaacuuggaaaaccguccaaucgcucuaccucaguuagccacgaugguuuuguacaaagaaccaggaguccagugcaugcgcuaaggcucuagacacgaagacagauaccaugagcggagaucacuagagaguaggguagaugccgccguguguggggagcuacaaggaguugaacacuucauguacaauuugcuacuucucaaaauacuuuacacagugaauauuagucuuuucauucuaaagacgagacagaauucaaguaagacacacgagucagaaagaggauauagauauauaaugcuaauuguuuuucuaauuuuaguucugucagauuuuucaugugugugugugugugugugugugugugugugugugugugugugugugcgcgcgcgcgugcgugcaugugugcauaauaacugcauaaaaaauagagaaaaaaguguaaaaucccaugugaagaucugacacuuuagaauggcaauuuuaacugcagggauguucauucagagggaucuggcuaauccagaaaugugacuuuuuaaaauguuauuguuaguucuuuuauaauucuauacaauauaucaacucgauaugcucucucucucugcucuccuuucuccuccucucuccucucuucucucucucugucucucucugucucucucugucucucucugucucugucucucucucucucucucucucucucucucucccucauccaucaaccccaaccuugccuucauccaguuugugugaaaccugcccuggaauguccauaagacaccagcuauaucacagugugauguuuuucauucgcaaguucuuuucuguuauguuuuaauaaaaaauaaauaaauagacugaaauggaauuucaaugaaauacccugucuuguaagagauagucaaagaugcguggaacccugacuucuuccuacaagccuaaacuucaugagcuaccugccuggagcugagaaacaggauugagagagcaaugaaugugaaaagggaaaaacagaagaggcaaaacaaagaaacccaaaccagggcugcccucucagaggugaaggggaggugggauggggagagaacucugcaaggagagcacuugggauguaaacaaacacacacauaaauaaaugcagggaaggcagccccaguaagggagagcagaugaccuaggagaaaaggguagggggauuuguguuuuaauuccaaagaaugauuauccagagacugcuccaccuggggauccaucccauaaacaaccaccaaacccagacacuauggcagaugccaacaagagcuugcugacaggagccugauauagcugucuagugugaggcuaugccagugccuggcaaauacagaaguggaugcucacagccacccauuagacagagcacaguguccccaaugaaggagcuagagaaaguacccagggagcuaaagggguuugcagcccccuaagaguaacaacuauaugaacuagccaguaccuccagagcccccuaggacuaaacucccaaucaaagaaaacacacggagggacucguggcucuagcugcauauguagcagaggauggccuaguuggucaucaaugugaggagaggcccuuggucuugugaagguucuaugccucaguauaggggaaugccugggccaggaagcaggaguggguggguuggggagcagggggaggugggagaggauaggggacuuuuguaggggaaacuagcauaggggauaacauuugauauguaaauaaagaaaauaucuaaucaaaacaaaccaaaaaauaaaaaaaucaaagcuccccugauggacacuguccaagguggacacugucuuuuucuugcagacccaggcuggggcuaauuuuauuucugcaaugaagcucucccaggaacucccaguaacacaggaaucugacaugguacugaaaggaaauaaacuuaaaaggagagagacaccucaaaggucuggccacagaguuacagaugauaagaaaucaaguuaaagacauaaggauguuauccugaaaugagaggaaaaugaaaagagccauggcagcugcuguuagugguuauaaagcuuuaacucaucuauccuucuagaaaaucuuuuggaacaagaaaaauucucauucaccaguuuuuaucccagguucugugauaaugcuagaaaaauaacaaugagcauaauuauacuaucaggguauagagacuaauagcaauagucuauuacuacuaauaauaaaaaaaucacacaaaguagaaaauuaugauaacuauucuaaauaaugggcacacuaacuguuaugauuaugcacaagauagugggcaagaaucaacaauaggaucaagaauaauuuucaguucauuacugaagaagcuucaaaccacaauccaggaaucuccccuagcgcaccaccaccaagagcacacuccuuuccaggaauuagaggcagcuuauaagacuaaugauuccacaucguacauaaaauauuuccauggguggcagaaacaaugggcuagauaaauuuucuuagaacuaggaacuuugugcgaaaaucaggcauuuucuauaggagcaagcagaacuagauuuuuaaacugcuguucuuuaaacuucuauauguacucugacacuuaucucuuugcucacaggcccguaggcuucaugaugacggggcccagugcuuuugcccgugauggaacaccagggaauggcacagagcacauaucaagcacuugugaaauagguaauauccuauugugggcccuguaaaugagauuucaugaauaauuaauaaacaugaaugccagucaaucacucaccuccugauuaguaauuagguucccuugccuaaaaagccacuuagauccauuaaaaguuaauacuguucuccagaacaaaguacacugugcaugguaugugcagagcuccauuuccaguaagcaacuaagucauacagaagaccgagucuauaagcuaaagcagccuccacagucuccucacucauucacugcuugagcuccucugauguuuaaagacuagccaggagaacagcguucugcaacuagagaaaauaacaugagcagguugccacguuauguuggcauucaggcugaacugcguuuguuuccaauuugagugcuacccugucuaugcaaugaagaguacauuagagcagaucaauauaaaaccaagaugcuauauguaaaaugcuaagggucuauucauugaaaaauuaugauccauguuauagagcuuagccaggucagaguuaaauuaaauuauugaucuguacucuuucucccuuuucugugugacaaucuccuaauuuuuauucuauacauuauugccuacccagaaaaacaaaucauuuguucuaugcucagcaugucugcuggcugacaauuuucuagaaauuaauugccuucuugguauagucagauuuauaaaaugaguucugcucacacaaacaccuaaacacuugacauauuuauaaacuuuuaugguaugaacucaaguggaaagaaagcaauuuccauuuuuucuaaauacaaggaaaaaaagaaaccuuuuucuuaauagcaucccauauauuuuacauuugauauauuucacugauucuauguacuuuacauuugauauauuucacugauuccauguacuuuacacuugauauauuucacugauuccauguacuuuacauuugauauauuucacugauuccauauacuuuacauuugauauauuucacugauuccauauacuuuacauuugauauauuucacugauuccauauacuuuacauuugauauauuucacugauuccauauacuuuacauuugauauauaucacuagccuuccauauacuuuacauuugauauauuucacugaugagaucaaacugcauucacuugacuuuuuaaaaauuguauugccgagcgaaaugaugcaaucaacacuuugugaacuggaggcuuuucaaucucuagaucaagagcuuccccugagauguguaaccucagccucaaacccauaaggauguaguuuuaccaauugcuguggugauauccucaaaugaaaaacaaaaacaaacaaacaaaaccuuaaccuuccccuuccccauucacucucaaagugacagaggaauguguguugaauuaguuuucucuuauccacugaaaagggaauuugugcaaauagucuguaagaaauauaaauuccagaucacguuaauuuaugaaaaaaaacgagcuaacauaggaguuugugauagcaacaaucucugauuugcagcucuauuuagccuguaacucuuuccuaccgaggauauauuuucacucuaaggaauuauaaggcagagggcccuaugaugacuccaacacagauaugcuuaaucugacuuguacuccaaacgaggcagaaaucaucccaaaauauccacauugaacauuuauacuaaaguauagaaagagggcauuucagaauaugauaagcaaaacaugcagguuacagaaugucugcuccucucuagaggagaggccaacuguggcauuguccacuggcugucacugugagaaacagcuggcauugugagcaugucucauagucccacacaaaugccaaccccugugucugggacaaggagauuccaggcucacagcaggccugagggaccagccaucucuucagaacuucuccaaauccacuagaaaucagugucauuccaaccaagacuccaggugaaaguuaaauacuaguauaccaacaaaacuaauuaaaaguaaaaaccaaaaccuggcuuuugugucaccaucucugcccaacuguguuucuguuaggugucaagaaacaaagagaaauagagcugaagggagaaaacucaaagaauuguagaagugaaugacagaaaggaccaacaucucaaacaggaagaccacagccugccuaccauguggaagcaaaaacucccaugucagcaggcuuuucccccaugaugauccguggaagucuuggauauuuucuaugcaguuuucucacugaguuugccccuuuggccuugacguucucagaauauaacauaggguguauuccuuaagauauggacuucauuaagcaagcagacaguacaaccauguaaaguauaaauacaucaaagcagcuuacaacuugcaaugugguacugauggccagcacacuccuucuaucuuguagauguucuccaugcuaagcccagucucaaccaggcagcuacuugauggauaaggaaccuagauacgaggaguucacuugaugaauugaacaauaaaugccauccggagagauggauucaccagugagggggaacgcauacuguacauuggcaacagcauccugaauccauugucauaacaggaauggcccugccaauagaaaaacaauucuccaaguuuuucccaggaggccaucuccugcaaagugaacuacaaagacaccccuuuccuacuuccaccagagauuuaaggauaaagaauuucucucuuaaaagcaaauccuuuccuaauugaaaauuaaaaaauacucauuguaaaaacaaaugaaaauauaacaaaaaguagaacaaaaguuuuauuucuuccacacagaaaagaauagaauagguuaauaauuuuucagucucucucucucauacacacacacacacacacacacacacacacacacacacacacacacacacaaacacacacaaacauacacauacucuuaggcuuauaguagaaaauuuucauauugcaaacaagaagcaauuagcagaaauuucacaugauauaaucuaauacauauauguuuaagauaauauccugaauaucacuugauggcuuuucuuucgauuaguaaaagcucugaaauagcuuuccauaucacugauuaacaccauagagaaaauuccacagauagcucuuugcuacaaccucugauuauuuuucaggaaacgucccuaaacacaaaacuacugcugcacaggguaacacacccauuuguucauagaguaacucaauaauggcacaggcuacuguaacuauacaacugaaagccugugauuuuuacucuuuggucuuucaaagaaaagguuugucaacccugaccuugaguguaauaagcuacagagaggcuagacauccacgacacaacaggacauugcacagcucgucagacccacagcagaucaauaucuuuacaaagacuguuucuacguuaguguuucaugcuugguccaaaguuuucugugauaaaauuucacaaacauuagaaaagaagaguacuaagcaauacgguuagagaaacacaacaauauuuuaacuauauaaauuauuauaaauuaagccaagauauaaauaaaaucaagcaggcuuuuacaaaaauucauuucuuuggaaauauuguauaaucauguacuuuaaauauaaauguaauuuuguuaaacaugugaaauaaaaacugauuacuaaaauaaaaagacuggaagcuauauuaugucuuggaucauugccuugaaaucugaaaaguucagacuggauuccuuucugcaaaugugcagaacccagagacuuaacagaggagucaaugcaguauacauuuucuugagaaacaucuauaaacaaugucugaauuucuacaaguuuuucauuaauuaggcuuuaaucuacguggcugugccauaugccagaaaaucacccaaaccaaguuagaggcaauuuuacugccauuacuuuaagagccauuuaagagauuuucuaugggauaaagauugggugauuuaucaugguuuuaugccccuuuaaucuguucuaucuucccauuguaaaauaaauauugguuuuaaaauaaauaguucugccuagauuuugaugagaaaaauuauccuguaaaucauaagcucaugugugccaaacucuaaguccaauguuaacuaguccauucaaaagaaaaauaagucaauuuuauggaauaaaauccaaggaaggcuauuauuuaaguauaucaucagugcugcaauggaauagguuugaaacaugagcuuccuuacaucguuucuuuuaauucucaaaauaacucuuaguugauggcaaaauccucuuuuagcuggucuuucagaaaacagucucuuuacccuauuuuuauguuuuucaaacuucaauauauaaguuauacagguuaaaaacaagaauaacaugaugguuauauaauauuuguaucauuuuuuuucuauauauagauagucaauuccuuaggauauuguacagaggucccagaaagggacauauuuuccaaaagucaaguacucuggaaauuaagauuuaaaauuaccuccaauguaaaacuuguugacuacauuuuccauuuuccauauuuauuggguuaugacacauguauaaaauauaguaaaauauggaguuagauaugguaauaaagcuagccugcuaucgauguguuuuaacccauaaugaauacuagaaauaugagacauauauguaauuuuagucuuuauaauaaacauuuaagugcaaaagcaagcuaaauuucauaguauuuuaugcaauccaauaucuuaguauuucaauaaguagccuucauacaaauaugaaauacaaguaaaccaaauuuaauaauguuuuaugcaauuuaauauaucuuaguauuuccauagguaguccucauacaaauauugaacuacaucacacucuuugguuuucuuuuuucaccaagucacugacaacccuuguguguuuauauucguggugugucucaguuaagauuggccacauuugcacuaucuaguagguucugugguggaccgcaccugucaucacuccacagcucacuuugacuagccggguuugcccagugcuccaugcagaauggcaucucuuuguucauuucuagauuuucuucucugauauuuuggaauugcggauuucauuccagauuuuuuuuuaaaucacugcuauaauaaagaaauuggcaaaguccugacugucccuggaucucuacuuccuuauuuccauggaauagaugcaguggucugucuguccguacccucuucuaaacaagcagucaugauucugaaagagauugguuuaccuuuuccaccauccauguuucuguguguuuucucuacagauaaugaucuuaaucuauuaaugagauauauguuuguacuucaaagagauuugggaauuuguguuuggcuuagagaaauuuauauuccauagcaauuccugaaacuguacacguaccuuuaacauuuccaucuacaauucuauuaaggucuucuaucuuuuccauauagacuuucuuuguguucugcuuucagacccuguaccaacgucucuuugacugaauaguuuaagucauuuagaucacagcuuaaaugccaucgguugaaacacugucuaggaaaugaagucauaugaggagauuugugagugcuuguaauaacacuccaagcaaacaagacaagagucuugugaccucaguuucuucuaaacaaagaaauauucugggaauauguuucuaugcucucccaauggacaauaugagugaucuuacuuuagauuacuuauaaucuaacagugcuugcuguugguauuuaauuaaguguuuaggacccuaggaaaagacauauuuuuugguuucuuuugucauaguuugauuaaacaaaugagaacuuuauuugugugaccuuccuuaaaccucaaaguauaaguugucugauggucugaguaaaguuggcuauugcauaaguuuauucuaccucauuuaucgacuccauucucccagcuccaacuaccucuagagaggugacgaguggcaccuguccucagguccuuugggaagcccugaagguagucucugaacacuagacauuggaugcugaguuauuuacauaauuguaauuugauuuuguuuuguucagauugugacugucuacugguucuuccauccucaaguaagaaaguaacuuauuuuucaacuacaggagcugacagcugagagaauauuuuaaagaaccuuuagacuuauacaguuugaauuuuugagauuuacuauuuauuuuuauaugcauuuguguuuuggcugcauguauuucugugugaagaugccagguccccuggaaaugaaguuauagacaguuuugacugucauguaugugcuaguauuugaacccaguugcucucagagaacagucagugcucuuuaccacugagcugucucucuagcccuacuuuuugaauuuuuagacgucugugggacuuuuaaauuuugaaaugucuuauauuuugauguugauauuacauaugauucuaggagaugcagaagaaacugaggucacaagacucuagucuuguccuuuuggaauguucucacagcacucagaaaucuccuuacaugacucucucacuggacuguguccuaacaguuaacuuucgaguaauguuugcuaaucuacccuuucaccuauuaugauagcuccuuguaacacacuguaaucuaucuuguauucuacuuaccauaauuuuauaacugacuauuuuauagcuauauuuuuaaagucuauuucauuuuugacauuauguuaguaccagcaucauuccaacuucaugacaauuuuccauacacacuggguaagugaauuucccuuauagaaagccuuauuuauccuaagcaucuguguucucaaucuauauuucagacauaaaguuaggguaugucaucauauucacccuuauugggauguuuccauauauagucccauaaagaaguuacucaaguacuaucuuuugagauuuuauccuuuggaauaucuguauucaagaccucuuuuccauuucuaauuauauuuauucgcuuuuucuccuguauuuuuaauacucuuuauucucuuuuucucauguauacacauagacauaaagagauaaaaagaaacucacucacacaaacugauacacacacauacagaagacaaauauuaaaguaacauuguuuuauuucaaaagauuucuuuugcuuuguugauucguacaaucucucucucucucucucucucucucucucucucucucucucucucagauagggucucauuguguaccucagauuggacuuaaauuacuaauucucuugacucuaguucgcuagucuuaggauugaagacaugaacaauaugccuuuuauuuuucuaauauugcuaccauuucccccaucuacugucuuuggacuuauauuuucuaucuuucauuucucuuagauuuaauugccaaucuucauucauuucuuacacucaauuauuaaucuauaagcacauccucuaugugcaccuucaaauuaucauacaguguuaaaguauauaccaauuucuguaaauauuuuuuauuugaaccucauuugagguuugauucugauguaccaaauauauguauuuuucucuguuucuagccuuccaacuuuuuuauuuuuuauuagauaucuucuuuauauacauuucaaaugcuaucccgaaaguucccuauacccucccuccacccugcuccucuacucacccacucccgcuucuuggcucuggcauuccccuguauuggggcauauaaaguuugcaauacccggaguuacugguuaguucauauuguuguuccaccuauaggguugcagaacccuucagcuccuugggugcuuucucuagcuucucuauuaggggcccuguguuccaucuuauagauggcugugagcauccacuucuguauuuuccaggcacuggcauaugagacagcuauaacagggucccuucagcaaaaucuuucuggcauuguuccaacugguaauaggaacacauucuccacuauguucauagcagccuuauuuauaauagccagaagcuggaaagaacccagaugacccucaauagaagaauggauacagaaaaugugguacauuuacacaauggacuacuacucagcuauuaaaaacaauggcuuuaugaaauucuuggacaaauggauguaucuggaggauaucaucguuagugagguaacccaaucacaaaagaagucauuagauaugcacucacugauaaguggauauuagcccagaaacaaagagcacccaagauacaauuugcaaaacacaagaaaaucaagaagagggaagaccaauggguggacacuucauucuuccuuagaauagugaacaaaauaccuaugaaaggaguuacagagacaaaguuuggagcuaagacgaaaggauggacuauccagagacuucccuacccggggauccaucccauaaucagccaccaaaccagacacuauugcacaaugccuuccaacuuuuuacaucugagaaaacaaaucuucaucaauguuaaagcuuucuauauaauauauauuuucuuuuaguggaauucaaauaaaauucuacauacguccauucaacccagcuaauaaucuauguaguuuaccauucuugauccuuucaaauacuuaguauguuuaucugcuuuggagacaaaaauauuucaaauucucagagcaugguuguuauacauuuuuuuuuacaaaucuuuaugauucuauuuucaauuaaugaacuuaugaaaagguccuaccaaguugugucaauuaaaaccugauauucccuguggacuguccuuucaucauuagauauaaucucuaucugaaaggaugauuuuguuuugaagcauauuuugucugacauuaauuaacuuauuucaagugguuuaugugauacauaaauuuccaucuguuuucuaccaagcuucccauguccuuguccuuaguagagauguucccuguagagaacuuauaagauacaucugucuccaaguuaaaagacuucagcaauaaaucuuuuuaaauuuuuauuuucauuaauuucuaguuauguguaugcuuauuuguguauugguaugagcagaggccagggagauuaucagauagauauccuggagcaacaguuauaagcagcugugggcuaucugacuuuagugcugggaacugacaucugucuucuugaccacugggccaucucucuggcuaucuauucuucaucacauaauauauaaguuuaaucuauauuuacuucuaucacuggugaguugaacguucaaaucaaacuacucuaauuaauucacagucuuucaaaauuuaugaauuuucccccuguaaauacaaauuucagcacagccauauaaacauuccuguauugauacucaccuuauaauuuaccuauuguaauagguauuucagacauauccauagauuauauucuuucaaauuaguaguaagauauuauacaaguaacaaugauucccaaacuaaggguagauugaccacuucaguuauuuaagugaaaguaagagaaugcauuucucaagugccucuggggauacauuugccucuucuuucaggauuguuucaggguucagacaugccagaucccucuggagcuggaguuauagacaguuaugagcugccugacauagcugcuaacaacugaacucagauccacuguaagagcaauauaugcucuuaaacacugagcucucucuccagccucaucaccaucauuguuguuauuaaaauugaaacccacaauugcucguauuccagaucacuucuguaucccaggcucucaucucuuauccagagcauguuuggugguuugaguagguuuguucccccaaagacugaugaauuugaguguuuggcccacucuuaggaguuauggccuuguuggaggaagugugucauuguagaggcaggcuucgauauuauauauguacagcuauguccaguguaauacacaguccucuucugcugccugaacaucaagauguaaaacucucaguuucuucuccagcaccauguuugccugcauguggccaugcuuccugccaugauaacaauauacuaaaccucugaaacuguaugcuagccccaauuagaugcuuuccucuguaagaguugccuuggucauggugucucuucacagcaauggaaaucguaaccaagacagcauuccaaaccucucuauucuuucuuuccccaucuuaguaccucucacccuguagucaaaugaaaaaaacgagaugugcuuuaagaagucaaauuucacuuuauauuucaguguuucucaaacuauaaccuacaaacaugauuuuauaucucuaaagaguauguuaaacuuucuuguuuuaaguuguuuuuuuuuuuaauuccacguaauguuuggaagaauccagaugccagccugacaauugaauugugcuucuaagagcugugucagauguugucuuuucuuuuauccuaucaccuaugcucccuucuuaguguuacuggccccaaacaguaaagugacagcuuuggacuuucugcaugccagugcacacaucuggcugccuaguucccguguucuguugccacaauugucccccauaugcuauugugcucuuuaguggacaugauuuguaacugaaugauauuguccuagaauaauaacuaauuaaguuauuuaauuaaugaagacuuugguaugacauuauaaaaauucugaguauggcaaaguaaugguguauuuuaauuguuaggggcuaaugagaaaagcacaaagaauuaauauguaaaugauguguuuauaucaaaugaaaagccagaugacauguggagacacuguacagaagcagcacaucucccagccuuucaugcacaagcaggugaugagagccugaguugucaacagcaacagcaaaggcaugcaagugcaaggaccuuugccacagcagucuguauacuuaauauauuuaguaaucaaucaucaagaguaaacuaaaugcuugagcaguaaacacugaugggaaacaacauuccagguacugauaggaaagagauaaacaagacagcccaaaccccuaccacuguggaaauuauacuaagacaauaauaagauuaauauaaauuuaugauaugguguuagggaguacccagcccuguaaaggcuaacgcagcauguugaggagacaaagaaugcuaagagggucacugugguaggaaaggcaggaaagacaucuuguucuugagaaauaaugaccaagcugaacccugaauaugauaguggcaaugacacaccuagaaggaaagucagacagaugggacagcagaugcaaagaugcugauagaggagcacacaugacaucucuauagaacauagagagugcugggugggggagaauggggacgauggaaggauagaggaguaaguguguuugggugguuagggugggaggcaagagagcaaacaugauacaggaauguaaagaaagaucaaaucuuccauggccugagauggcggugaagggacuggauauucaccucugaaguccagggauccaccacugagcucuguuuauccauugugcagagucaaugauagagguguuggugguuaugaacacagguagccuuggugacuggcuggaagagaugaggugauugucucugcuuguuuuuuauuucccuagaauaaucuaaacuaggggaucagcugagugggagaacuggggaugagagcuaggaguugaggucagugaagaucauuaaucauugucuuggagaauagaaguguugcccauuuucuucugugauccaagaguaucuuacccccuuaagagugacuuuuuucucuaacaaaagagaggaaguaacuucuagaauuuugcuugaaaaucauguuucuugcuuuuguguauuaggcaaaaaaguacucugauuaauuacaaacuguaagcucauaaguaauaaaaugcagugaacaaaccuuucuaccauaccugcauaaugacauauagacaucaagaauggucuccugcuauguucccaacagauuagguguagaaugaagagcugcccuguccaccaggaagcauacaccagucugaguccaaugucacuugucccauucaggcagugggccaugggcagacagagggcagguaauacguggauauugacuaauauuacauuucaucagaaugaaaggaacugccuugaucaguucucucucaguauuuccaacacuccauuuuauugccaagugcucuccgucucaaacaggaggcaaaguuuccauuuuaauagacccagauguaucaaugaagagagagccucugcaaguucauucagcacacggcucucacaagccagguuccuuggaugacaggagucaaguucucuuggacuuucagguaccuuaagaguacucaccucaccagguagauucccagaauacaccucagccucaaauuucucuagaccuucacagugaauuacccacaagacauaggauacguuaaccuugcaccugaaauccaagaacaggccaaaagucccagggaaggcucgugaaccaaagaacucauagaagcugaaagcccugcuagggcagagcuugccacauacccagcugugagucagcuuuggauccaggauacagauuucuacuccuccuguaugacaacauuuauaguugcuaauccuuagcucaugaugaacuaagaggcuacuguuuauuuucuuguucuacuccucuggacuugaauuaguguaaaaaccaaaaugcaugcuggugccaggccacuaagacuaguuaauucuuucagccuuuggcuacuguucugaaacaaaaaagacucucagaagaggcaauggagggauugcuuaaaacucaacucugcuacuuagaaaaaacaagucaagaagagaaguguggaaacgcaauaauuucccccaccucugucggccugaaagcucuucugguggaggaaccccuugguaguaaaauauguaaauauauaauacauuuuauauauguauauauauguguguguguauauauauguguauauauacauauauauauguauauauguauauauauauauauauauauagagagagagagagagagagagaauuuuccgguagaacugagaguugaaaggagcugggacuggaaagccaccuacagaugaagccacauaaugaggaguuuuucaaaaggucagcacuauucuucaucccuaccauugaucgccaucaucuccaauguguuugucugucugacacacagcagaaauccagccauaaacagucgccagaaaaacuaaccuuauuuuaaaacauuuaaaaaggucauauagugggugucacugaagcacagggccacuucuccuuuagaaccccugcacaugugagaacugggggcaucuaaaacccuuucagugagcugauguacucagcaaguuucaaauguucuguuucuuucuguaaagccaguguugguucguaagcaaaaccgggagcaauuaauccccucuccaaaccacaccaaggcuaggggcaagggguguuuuccuuugaacauuggaagcuaacaucugcagucccugcuuucagcgggagugggugccaaguguucaacuucaacaugccauaccacauucagaaacaugagagacacuacucccuguucccauuugacaaccugugugugugugugugugugugaaacaguugaaugucaaaugaaacuauauuuucaagcagaaaggauucagaagauuaagucugaaaaguucuagagccccuuaacuaaacaugcaaaggauauuacuuuagcccaucaacugaacugacuucauuaaaaaauagaucgcauucuucccucuaucugcaaauuuaucaacuucuucuaugaucucacuaaaucaauaagguauuuuucaucuuguagauuaauccaaguuccugaguuaugaaaaaucccuuucucaggacuuuguuuuucaaaucucggaacagcuguacauuuacauacaacacuguguuauucacagauguuuuuaaaaaucagaaucaaauuagaggggaaaagucaaaggagguuagagaaaagauguaccuauagucauauucaauguauuauaagaaaaucuggagauccugucaaacauaagaggguguucaauuaauuuuaauguagcucuaugguagaauauucuacaacuauuaagaacuguuuaaugcuggaguauuuuaguaauaugaaaaaaguauuugcaauaucauuaaggaagaggcuaucagaagaacaggagaaagcauaguggucuaauggacagaaacagggcuggcuggccaggcuaacaagagacagagaggucugagcucaguaagagacugccucaaaauuaugauggagagcaaauauugaagagaucugcugucaaccucuggucugucaacacacacacagacgcacauggcauauauacauauguguauauacacuaacauauaugaaaaacauagccuacacacacaaacaaacccauacauacacacacacacagacacacacagcccaaacaaaaaccaggugcauuauuaucaaauuuccugcauguuugauaaauauucauuggaugaccaacuuuauuuauuaccacuucucacacuagcauucuuugcagauaggaaugauuuuauaaaaugagauaaaagcuaucucauauaaagggucugccaggguaauucuugucugauuaaaaaaacuauacccaucuagcacauguauucuguuguuuauccuuugccuucucaauauaaacauaauuauauauacaauuacauuauauauaauauauaauuacacacauauauaauauauaauuauauauauaauauaauuacaauauauauuauguaaauaaacuauauuauauacauauauguguauguauauauguauguauauaauauugaaaauuucauacaucuuuugaucauaucuacuccucuucagcucuucuuauacaacuuuauguguuaugugaguuuuuaaaacaaaaauccaguagccucaauagacuaggcuuagccacucuccuuaaugugucaauuauagaauaagaaguggugaaaaaauagagaagacauuuauccaaugaggugacacuggggagaggaacagcgaaggggcccaaugaccucaaaugcaucuucagaaugcugacauaauuuuuguguuuacauaaaggacagcaagucugagcauuuaagcagacuuguucaagguguggucuuucucucuacuguggcaguucuauggguuuuuaaaaagugauccaaggacuuuuugaagguucacuuugguccucaugcauaucuguccuccccuggaugguagaaccuguccuaugaccucugcuauucccaggacucagagugacucaaauggaaagguuauggcuaaugaacuugugcuguaucuccaugcaaacuauaaacacaaaggagggcauugcugucaggggucauccuacuuuuacucaccucgugagcccaaguaaagaguggaauuuuuuagcauaggcacauuuaagugccggcuucacaccugaaggaggcagagccacacugugacccugcaggaacaugcagagugagagagcaaugcugcagcacuuccucucaaagcccugaagaguguggcuaugggcugaaauuucucuaacguguucccaacauacaggauauucuauuucuaucacuuugcuuacguguagcuuucaauauuuuuauuacacauuugcauuuguauuguuuucuuauuaagaaaauuuauacugaauagaaggggaaaaaagguguuaggauccucaagagcaaucugugaauugagacucaacucaucugaaaggcaaaagcacaggcaaauaaaacaugccuuaaggagaguucuucugaguuguuuaaugcuauggauauuuucauuccuuucugaauuuugucugucuauugcuauaaacacuacagccuggaaaaggucuacuauucugguggauacugaggaaggcauugaggaccuaaacacaaagacagaugagauguaaaagaacuaaagaagugaauaaagaauuccaggagugccaauucucuugcuugacagcacucagcuucccaccauuaaaacaagaaugaaaacacacaucugcugauguccaaggaccuccaucacuccauuacaugagcaugacauugacaucuagcugaagagugugggguuuguuguuauuuuuguuugcaacagugucuuguuauuuagccuggcuggcaugaggcucucuguguaaccaaggcuagcuucaaaauacagcauuccuucugccaccauaaccugugcacugagcuucuaggcaugccucaccacaccaagccugaaagacuugcaagaugauagaaguggggucaaaagucaugggugauagguuuggucuucuguaauaagcacuauagggcccuuucauauaaauaaacaaugcggucggcuugaaugguguaaauaagauucugguuuuaucuacccaugucacacaaggcaacugacucauggccacaaaucaggaucucaacacaccaugaaaacggggagaagaaaacagaauugugcagucucccaugggauacuugauacuaugguggaccaaccccuaaugguauaugcaguuucacugauguaguaggacuuugggaauugcuccagagcaaagacagccacauugccuugaaugcccaaaacaggaucguuaaagggcaucagaacaugcuacaucauaguaugccacuguaacauaagaauuauucugagcuaaagucauguucgagaacauacugaugcagaagauaaaauccacacauagaagaugaccucuuuguaucagaagcagaaggacuaaggguuggugugggguagcaagccugagagcaagagaauucuauacaaauaggucucauuaaaaaaacauuuuuuaaaucaauguuuagucuuauauaauuuaauuacuuuucauagacuguuucuuuguucaaggagauacaaacucauaaaggcucugccguucuucaggccuuuguuuccuuaugagagcucaccauuagaagaaaccauauuaaauaaaugcauaugcuuuucuccuguuaguucauugugucaauuuugucucaaggccaaucagaaaacacucuaagaaaguaaagagaaaaucugcgucucccacggcaaccaucuugaaaacugaaagguuccucccuaguucuggagaaggacaaguguaggcauguuucucagacauaauucaaaacucagacugaaaacccagggacuacguggcacaaaugaaugccacaaacauccacaguccccggacugugcagcagcagcagcagcagcagcauguacuguggagaccuguuggugauguuugucuucucaguggacucgaagcccucuggaggcaaggacuauuuucuuccauaguugcuggcaacugcuaggccuuccucuuuucaagaacucugaaaaaaacugagauaaaugcccaggaaacagaauagagacagagacuaaaagaccccuccauucaaggcuuuauccauaugauuuaaaaagacaacaacuuuuuaacuuuccuaaucugugcugaaaggauagagggagauuucauuaaaaucuguuaaguaacauccccuucucugaaccugacugacuggaaaugacuggucuuggcaguuccuuccaucaccugaucccuguauaagccaauagagccccuacugugaugacuggacaaugcuagcaucucuuccugucuuccacaacaugugacuauguuggucacucuaggaucuggcaggcaggaauaaccagucccuaucagaucaaagcagaaauggcaaacccagcuugucuaugucccauccagaugagcaaugaugaccugagaagauaugacaagggugccaggcugcauugccauugauucccugcuggggauuucauggagaaauauccaucaugguuauauaaagggcaugcagcuuaucuccaacuuuuucugucuucaaaaaaauaaacuaagaaagacaggaagcuagaaaucagaugauugagcccagaggguuuuuuuguugaauaaaaauccuucaucacugccccuuaauuauguaaauuuucuuccaccaagaguaauacucuuauuuauugaaccuccccagcacucuccugguaaucccgagcaggagccacucugcaaugacucaagccacauuugacaauagacuccaaaggacacaugaugucaucugcuaaaaagacucagugcagacggaaagccuucugaccuaugcauaacuuugcucugcuuucuccaguuauuuauauacuaucggguggacaaauguauauuagugguauuuacacuuggcagcuacuuuuaaaaacacauuauucaauugggauuugaagcuuuuuauggccauuuccugaccagacuucauaaacaaagaacaaggaaagauauaacaucuuuaaaauuguguuuaauagucucuggagagucuaaagaggcuucucuccucuaauuguuuaaaauuguaguagguaagauaguucuaacaucuaucugcuuaccuauguauuuaucuaucaucuaucuaucuaucuaucuaucuaucuaucuaucuaucuaucuaucuaucuaucuaccuaccuaccuaccuaccuaccuaccuaccuaccuaccuaccuaccucuauuuaucuaucaucuuucugucugucuaucuaucuaaagcugaguuuaaaaccccaaaacuaagauauagaauucacuuuccaauuuggaaaucaguaaguuuguaaaaaugugcuuugcaaaggaauggaguauuuuggauauuucuauuuguacaaagcuguggugaagguaguuggagaccauagcaaauuaccagggaauagaauuguuaugcaguauucuuuggcuuuuaaauuaaacuaugaauuugacuuuccaaaagggguuaaccaugaguuugaugauaucaaaaugaugguuuugcaacagugcugacuuguaacuacauugcagagccucuaugcugagaaggagugagaaggcaugguucagccuaaugaaccaaggcuugagccuccuucuacucgugggaagaauugauuaaccucucauagguaagagcacuuuuugcugacuuuuuuucugugguuuuccacaaagccacaaggugggguacacauuucucaagguuuggggaaaagaaauuagauuccuuccuuguuuggagaaaauauggagaaacuuauuuuccuuaacaauaucucuuugcuaauuuccauagguacucagauaaucuaacauagcaaguuauggaccugaggcucaaauaacuuuauaucuuaaauaauuuuaaaauaauuugcagacuggauuagggaaagcaaauuauuguaaguguuccuucucugccaauucauauauuaaggacagacaucaauaucuuauaauugaguuauugaccucugaggccugacaugguuucaaaaugcuuuuccucaguccuccaagaaaaugcuucggauguaauggguuaguaaugagaaauaaucacauagaggaguuuguauguuauuugcuuaucaaaucaauuuuauuuucuuaccauaaacucuuagcuuuuagucuaaaacuaaucuuuuuuauuaaaaauacuuuuugauucucauaaaaacauuaaaacaaaccagcaguuguccaccaugggugauugaaucccuauguaaaagaggagcaaagagaaggcccaaacaggaaaccaugaagaugcucacauguucacaaagagaaguuguagccucacacaucuagggugacaaaucuuagcagcaucaguccguggaaacacuaugagcagaaggagacacacagcagugucuucuaagcgcuauccaucagugaacaauucacacacauucuaaagcauugaucgccuucguucuaggaugaacacuauccuuaucuuccagugaggcauggguauuuacauagcagaagggaagacccuacaauauuuucaaguucaauaugugcccuggugugaaggagacaggacauacugacaauguaaugguuuauuuuuaucauacccaaaacaaaaauauaucauauucuaauaugacaaagaaugugaaaaagaaaaaccagagaaacauaaauggaaaagucauguaguauauccauucacucgcuucaagggauaguacuggacuugaauacauaguaguaguaguaguaguaguaguaauaguaguagagugugugugugugugugugugugugugugugugugugaauguauguguugugugaaugugugugugugugugugugugaauguguguggugugugaaugugugugugugugugugugugugaauguguguggugugugaauguguaugugugugugugugaauguguguggugugugaaugugugugugugugugaauguguguggugugugaaugugucugugugugugaauguguguggugugugauugugugugugaguguguguguguguguguguguguguguguguguguaucauuuugcacauguugaagucagaggcaaacuugcaguaguugguucuucauccacugggugccuuaucagcugauccaucaaaguagccuuguuauuuuauaacacaaaauauuacauaguauuuuucuuaaucccacaaugaagaagaaaacacuucugguucaggaagaugcaagcacacacuuuacacacacaaauaucucaaaauaucaacuaaaaauagggaaaguguuuuaaggaucaaaacuucacucauagacaauagcaucuuuuuucuacuaauguaacuagaauagcucagaauuuauaguagucaaauaugcuaauacucuacucaaugaucauguguaagcauauuuacauuuuccuacuaagaaacagacuaacacucuacuuaguggucacaagauucugcacugauucaaauagagaaauuaaaaacaauuauugggcgccuaagguuauguuuguauauucaaacaaagauaauaaaagucacacaagagcuuccuucacugaaaaucaguuauuggcaaaaaacauacaagaagcucaaguaaaagaauuuuagaacuauaucauagcacggagaaucucugucugucguccuguuucucccucuguguguguuugugccucugucucugucucucucacuuuuucugucucucugucucuguguguaucugucucugugugugucuaucgcugucugucucucucuugcucuguaucucucugccucucugucucugucucucugucucugucucucugucucugucucucucucuccccuucucucucuccagaaucaguuugacucuuucucugugaaauuuuaccuuguuuccuguuuuccaauuggaccacgucuacuucaguaucaacggggccaacuaugucuuuguaguuuaaguuuaaauauucaauguauauuccaaaggcccagaauaacaaacuaucugcuucaaccaacuucaaugaauauucaccuacauguguucuaaucagguacaacuguacaguaaggguaauuccucuagggaccauacacaaaaguagaggugugacgcugaccaagaaagaagcuaagagaaaagggcccacagcaaagagaaugcaaguauucaagagaaauccccaaauuucagugaauuuuucugauuuuaaaaacauauccauaagccaaauuggguucuagugauguacaacacaacaggcugcugcuauuccagucuuacaagaucauccuggggaagaaguacugaaagccagucuucggguuuaaaaagaauuuccacaguuggccauguucaggcaggggcuacaacaagcuuggauuacuuacuucugguaaaauacauccucuguugugaaacacaucauuuuuaaggucuuagucaagaucaacuacuaagccugacauuguaaacugucuugcagaacuguguggcuuuguagaaaaaaauaguaagauaaaaaugaugaacucagaucaaugcaaacuagaacuaaaaaaaucauuuaaaauauuuaaaagguauugagauugggcgggguucaguugguaaagugcuuggcacaugcuuaugcaggcuagaguuuggauaccuagaacccacacaaaagccugcaugacagugaauacuuggcccuggccaagagaucaaagacaggaggauugcuagaacucauuggccagccagcuuagccaaacugauggacuaggcucagugaaagacugacucaaaaucaaagguagagagcacugagaaagacaucucaugucaucucugguuuccacaugaacauacauaugcauaugaaccuuuauguaaaauugaaaacuacucucacaugauucauaucacagcaauaaaaagaugacaaugucucuuuucuuuucugcauggcucaaaaugauaccguggcuaguuacagugcauccugccuauaccccuucuccccaaugcuaugggaacugguguguguguguguguguguguguguguguguguguguguguguguguguuauguaucuguguguguaugcaugcauaugugagaguguguuugagucucagccauacaaauuaacuacuugaaagcagaacuaaucucuauucuacuuucuugcccauaauaccuauuuauugaauauauguguguguguguauauauauauauauauauauauauauauauauauauacauaugcauauauauucacagugaaauuuuucuuugcuuuucuuuuacagugaaauuuuuuuuuuguuuuuguuuuuguuuguuuuuuuucgagacaggguuucucuguauagcccuggcuauccuggaacucacucuguagaccaggcuggccucgaacucauaaaucugucugccucugccuucugagugcugggauuaaaggugugugccaccacgcccggcugaaauuauuuuuaaagcuguuaaauuuaaauauauuucuccucauucuuuugaauaaacuacauauauuauacuuaauuauuauaaacucaaaaacauacaguuauggaugucuucugguccuauuuagccugaaacuuuuaaaaaucuucuucuugcuuucaauuugcauaaguuucccaguauaccuauaucaauauagauauaacuauaccuggaauagaaguaugacucaggguaaaauucucuacuuggacauaaaauccauacauggaaauguaugagaaccuuggagacauaugcucuaugugcauccuacaugacuucuguucuguucuaaagacaugauucuuggcaaauuucccacagaacugagaaauguuuagcaggaauuaauuuuuaaugaaauaagcuaaaaaugaaauagaugaaccauuacuuauaguuaagcccugcuugcuaguaauuauugaaggugacacugguauauuuuaucauugguaauuggacgaguuuggccaaaugucucauuuuucucaugaaaaauaguugcaauguuucaauuuguaugcuauuuuaagucuggugaucuuuuaucaugugcaguuugguagccuaaaauuuguguuaagacagagcauaguuuuguggcaauaaguauagcagagacauaaauguuagauaagguuuauucuucugcacguucaagucuuuaauacaaggcuauaucuuugcgugggugagaacugucuucucugacuuccugcuucagucaaaaggauaguugcuuaaugucuucuuugcagauuuagugauagaauuacaauuucuucugugaggacagacaauguaaacagagggcaaacaggcauauggagaaauauacaacauucuuugccaaggaggacaacauggacagacggcacuaaauuaagucaaauagguuuccuggguucaacauugucugucuuuaauauaacucauagucuaaaggauuuuuaggacagacgauucaugaucuaccaugcuugccugucuccacaaaggcuuuauguaguuauugcuuguaggaauaugugugcuauuagccaaaccuuugcugaaauuuacauuuaucacuaagugacuaggaugagaauauaugaacuuuuuagcaugucugauaucaucugauaaaucagucauuuauguuucauuagacucucugccucuggcuucccucugaaguuauuuccuauaauuagucauagauaauaaacucuuuacucuacaauaauuuuaauauccuauccauucauauauauaugauuucaaaggaguuagcauguuccaggcugaguagauagacuuuaacauacuugauuucacagcagugagcagugacaggugccagugagagacuguagaugggggccuaauccauacuagagaggagaaaucauuuggguugaaaucugaagagagggguuaauuacagggccgugguuauaaaacaugcaaaggucuuugcuuccacagaagaacugaguuucagggaaagaaagaucaccauaucuggaaugcagaaaucaugaaagcaaguuccaagaagaauccagggagacaaggcucuauuauagagucuaauggcagaaauaaaugguuucuccacaaugagagcaccaaguucagauucuaaaaauguuccuaucacagacaauauuuuggagagggccaaaguggaagcaaagugaucagucuaaaggcuauugcaacaauuuaacaauagaacaguggcaguauuuauuauacuccaagggcacugcauuagacuuccauuacauaugugaugagaacagacacaccgaagugcaagucagaaagagauuugggaacuggcaacaagugagguaagagugcuguaguggucugaaugagaaugggccccauaggcccauauauuuguagcuaaauacccuucucccuccaucccuccuuccucucuccucccuccccacucccuccuucauucuuucauggaucacaugaaaucucuuagcuauuucucuagugcuaugccugccugccugccuacuugcuggccuuuugccauccucugagcccuguaacucauggacucauucucuaaaacugaaggcccugaauaagugccuuucuaaguauaaaauaaaauaaguugcuuuggccacgguguuuugucaugggaauaggaaagcaacuaggacagguucuaucagacauuuuaugcauaaaacauaaggugaauuacuucagucagucucuaaguuuuacuacccagucagcugauguuuguuuccuuuucuauaauacagaagauucaccuugauuaauacauuuuuuaaaaaaaacugucauguucaaaauaacagacacuaaacauauuuaagaguuugauggacugacugaugauuguaacuuuaauuuuuucaaauccuauuuuuaaugauguuucuuaaacacuuuaacuucccuuguagaccacuacccaccagagguaguggggaagagaggauacaggaagaaagguucuuuggagcaagucucucuguuuugucuggaaaucagcaguguaauucauggauuagcagacagcggcaacuugauccacucgcaaacauuucacagguacaucaacagucuaguucaguagggucuggauaguaacaucaguggcaugaccuaacagagacagccaggccucagccuaagcuugagcaagcaggaggagccaggagaaacacuaggaggaguuuuuggcagugccucucucagggaaguaaagaucggugaaaacuagcaaagacacgagacucacaagcauugcacaguuagcuguaccagcaagccaaguucugucucuaucacuccaugaaguccuauuuauacccucuaaacaucucauguucuccaugugccuugcuucagcaugugcauccaaucagucugaauucaaggaaacuucaagaaacugcagcacaccaccaaaauuuuucagguacggaucuuucuuugaagcccugacaaaugcagcucaaccaugcaauguaaggcgaaccaauacauauguguuguuagcaaagaauccuucauaauguguccuuucacgugcuuccuuuagaagaagauccucucuccugugucugcuucagugaaauguuccuucaugaauucgucauggccuuucauaucuguguccacuuuaacaaagcauuccuucacguguuugcuccaacaaaauaccaugcaaccaauuuucccaagaaucuuuaaguuuccacuucaauuauuuguuagauuuuguagaaaguagagucaguccuugguuuuaggauacuugaaguuuagaagauugaauaacacauuauuuuuguaacaauuauagaaaaguacauauaaaaguauaaaagaaaagaauggggccaaacuuccugccugaugaauggcuuuggaaugaagguuuaggaauauauucuuaguuugauggcuaguuauuguuuggaccuuagaaacauaauuguuuuguaagaaaagcagaacaaaaaaggugcuauccaaaauaagaucaauaaaaucuguguuuacuaugccaggcuaaugaaggacaaaaccuauaauggaagcuaaguucuuuacauuagacuuuuacuacacauggguugguaaacaucuacacauuagccuccaacauugcaaaagggcuuggcuauauaugaauauguggugacauaucacuauuuccaccuuaacuauuagagcuacauagaaguuguuacaauagugauggauguuguaugauauguaccugugugucuacauuccugugugugacagugcaguaguugcaugcauggcacacauguuggaagucaaaggauaaucuuggguauugguccugguuuucuaccuaguuugaaacaagcucucuugguuguucaccaugacauacaccaagcuaaaagcuagcuagucuaugauaagggauccucuuuugcagccucuccccaucucucuauaacacacugggacgauggacacacaccacugugcccagcuuuucaaggguucugaagauucaaacuuggguucccacuuucuaggcaagcacguuuccucugagccaucucuccagacuggaaagaguuucugacuaagaaauggucauaagagguguaaugaaugcuuuaccaguaaacaagccgcuuucaaagcaaagugguaaagagccacaucuuguuggacucaagaugauuccagaauggcaggguaaacugaaagcaggugugagauuuccuuacuccuuuccaacuuucagaugugguccuugaaagauagcagcacaucacaucucagauagccuaauuaugaggucccccaaauugguguguguaaaaauugccuuacagccuauaaagaauacagauuuuuggccaaaacaagauugaauugcguuggcuaggauuucuagaaugauuaauaauaaauaaauuacucaugaccucagcauaggagcucuucauaucuccauauugaaugugagauuuucuguaguuuuguucauuuuuuucuuguuuguuuuuuuuuuuuuaauaucauuuaucgguuaaagagaaucaacuuucuucucauugaacaauuacacuuggucuuaaaugaauacuaagugcuaucauuucccccuucaucagcugauaugguccuaugguuuuuuacuuugaaucugguaauauaaauuguacucacagauuuuucucauagucaacuugccauucuggaauaaaauauauacccaaaucugauguauuaauguucuauguagaauuuuugcaccuaucaucacgaaaaaaaaaguagacugugaauuuucucuucuuuaacacucauuuuugucuuuaggggucaaguuuauccuggguaauaauguauguuuauguauggcucacaucauuauuccuguguggaauagucugguguuaauuuuaacuggugacuaguaugugagaguauuuacaacuacagucuuuuugacacagaauaauucaaaucucuauaauguauuaugcuaauuuaacugcauuuuagaacuaaaauuaguuuauuaaaaauuucaaauuuauuagagccgggcaaugguggugcaugccuuuaaucccagcacuggggaggcagaggcaggcggauuucugaguuugagaccagccuggucuacagagugaguuccaggucagccagggcuacacagagaaaccaugucucagaaaaaaaaaauauuagaauaaaauggugguaauaucuuuuagugcuuuuuucuguucuaauccuggaaauuugugucauaguuuuuuucuuaauuguucaucaauggauuuauuagucuuuucuaugaacugacuuuuacauuuuuauuacuuucauuacaaugauuuuucucuguuuucuuuauuuucuuuguauuuguccuauugcuucuuuuuagauucuugguauccuacugauuuauagccuuucuucugaagauccaagguccugcauuucucuguaagggcugcuuuaccuuccaucuuaacaucugacugaugcuuugcacugucaucaguuaacaggauugcuaacuuugauugaaaugcccuuuuuagcacauacaagacauaguauuuccaaauguuagacuucucugaacccuuuuuagauuuuguguucagaauauagacucuagaauaaguuuuaguggaauagucacaucagaaaugggacagcuauaucauucccuccccucaagcuucagagaagagggaacagaaagacuguaauagccagaagcaggggaagauagugucuuccuagauaugaaagagccagguucaugaacucacaaccuguacaagaugaagccuuccaucuucuagcauggauggagaguuuuaugaaguuccacuccuaaaugagagguacuggcaauugacuguuguuggaggaagaaaugucaguuguaccaaaagugugaccucuaauagguuguuugugcuccaggguaagucucacuacgaucauucccacccaggcaggucuaauuggaccucguaggucauaaagcaaaagaaaagagaggagagugcgauguuugggacaugucucgaagaacuugaaggaagaaaaaagagagauagacauagacaugacaaauacauuuuacacacacacacacacacaaacacacacacacacacacacacacacacacacacacacacacacacauauauauauauauauauauauucucaauuuaguuuauuuauuaucuaauucuuaaaauuagauaaaugaaguaugguuuaaaguuuucaaauucauugagaagcucucacauuuauauauauggucuaugugauccauauucaagaaugcauacucuucacuugauagauuugguugaaaugccacaaaucacacacagaucaagugcuaaaccuaguaugugacucuucuacaaguauacugauguuuucauuuauguuugaacuuacugaaagcagaaugauaaaguucuaagacaaaagauuuauauuucuucucucuagguaaucaaauauuuugaaaccgcucaacuugucuuuuuacaggcagccauauuggucuuuuguuggugcuugcauauuuuuaaauacuuuuuaaucuuuauaugauuuaauauuugcaucauaucauuagucuugcuuuuauaaucuaguauggaaaucuuuggguuuaaauugaaauauuaaauccucucuuauuaauauaauuacugcuacauugguuuucuagucaacagcuucauuuguucuuuuuuauccccggauuccucguuccuuaauaacucuuuugccuucuacuaauauucauuuuaucacuucauuuuccauaucagauugcuaauuacauauucuuuuuaauuuuuuauuagauauuuuuuuuacuugcauuucaaauguuauccccuuuccuaauuuccccuccaaaaucccccuaucccuuucccccucccccugcucaccaaccuacccacucccacuuccuggcccuggcaucccccaauacuggggcauagaaccauugcaggaccaaggcccucuccucccauugaugaccaacugggccaucauuugcuacauaugcagcuagagccaugagucccaacauguguuuucuuugguuggugguuuagucccagggagcuuugggguuacugguuaucccccuccuagggagcugcaaaccccuucaacuccuuggguauuuucucuagcuccuucauuggggacccugugcuccaucuaauggauggcugugagcauccacuucuguauuugucuggcacuggcagagccucucaugagacagcuuuaucagacuccugucagcaagcuguugcuggcaucuaucugcaauagugucugaguuuggugguuguacaugggauggauccccagguggggcaaucucuggauggucauucuuucaauauauuuacccucucugaauaagaauuugacaucacauuaaugcuuuguacccuacucuaccacacacuauuaccauugccuuugacuguaauucuacuuauauuauauuuuaucuuauuaguucuuuaauuuaauugagacaggguauuacuguguaagccuggcuggccuggagcuuguuauauagaguaaccugaacucaaacucaaaaagauacuccugcuucugccucucaagugcuaggauuaaaggagugugucacuaugcucaaacuauguuuuaucuuuaagcuuuuuguuacagaugauuuccuacacauacaaauacagacaccauaaugaaauggaaugacuacagccauuuucccauccuagcuaucaguaauccauguccaauucuguucuagcucaucccugucaacuuuuccuuuaccauacuauuuuauacaaaugucauacauuagaauccuuauaacuaucucaauauuuaucucuaaaagacaaauaguaggcuuuuuaaagcauacaaccauaacaucaccaaacacauacagacuauucuagaauacuauugaaaucucagugagcguucagauuuccaaauacaucaacugccacuguugcuuuccaagcauucugaaaucaaguuuuuuuauuagcucugaauucuauaguugguugauauaauuuuuaagguccauuuaaccuauuaguucuccucaaaccuuucuuuguuuuaauuuguuacuacugguuaauuggagaacgugucuuguuagaagcacauuuucccauugauuauauuuuuuaccuucgagguggcauaugagaagcacauccuaucuggauacauuuucauaacuuucaaaguuauuagugcuuaguuccugaaucuauuauguccuaucuaucugucugucugucuaucuaucuaucuuucuaucuauuuaucuaucuaguauagauaauuucuaccuaucaacagcauucuacaaguaauaauauaauucuugugggauucuuuuuguguguguaacaccuaaauuacuauuaucaagacaacauucccucuauuuguuuauuuaacuaaaagaauuacagaauaaaggcauaauucuuuauacacuguaauucaaaauaacaaauuagcucucuagcuuucucccacugugaccaacugcuuagaacuauauuuaacauuugaacuaaaggauuuaaaacauuugauaauuuuaaucuacugcauuacuauccuuaacuuaugaaaugcuuaaauuaucccaccuuaauuuauuuggugagaauuuaaacuuuauuagacaccacuuugucuuauccuauuaauuuaugacacugacauaucuugucucuugagugcuuuuauuuuuuuuuuccuaugauucuaucuuggaccaugucccugucauggaaacuuccaucaaaaauuucaguguagaaaugguaggcacucauuauguaauuuuaccauucauaaauacaucuuuucugaaggauauauucacuaaguauaaaauuuuagauuuguaaauucuugauacuuuggaugacuuuaacuauuuucuagcuuccauuguccuauuuaagauguagaaauucaauuaaugcuucuuugaaauuguauccuuauuuuuaucuuuggguuauuuuaacauuuuuauuugccuuuauuuucaguagucuuaguauuuucuaucaauagauaaauagaugauagauagauagauagauagauagauagauagauagauagauacauuauaccuauguaauagguauaauaauuaaauuauuagguauuuagguaauaauaauuagauaauuagguauauaauuagauuuucuuuaaguuccaugaaccuaugccuugaugucucacaugaccuuuguugaacucagccaacaucucuuuaaacacugaacccacccuccuuauucgaaccucugccugggccuccaacuaccagccuggacuuugaggcucccucaaauguccauuauggcaucauuuuauguugcugucaucccuuuucaguucuguguuuuaaaucugaguaucuuuccccuccacauugcucuguuuuaauaugucuaacauguuguuaacucuaccuacuaaaauuuuuaccccauucacuauaauuuuuaagacauucauuugguuguguuuauagacuaaaucucugaugaaauucuguuuauuaaacauauuaauuauauaugugaaauuugugucuuacaucuccaacacccaaaucacuuuggagucuaauguuuuggcccucuuuuagucaugguuuuuagucagucccuauuucuuuuaauauauaccauuuucaguuaaugacauauucacuguuuauagagacugugcaugucugaaaugauguuuucuucuuccaaagguguaagcagcaaaauuucaggcagguugucaggacccaacugagggugguguccuaccagccugcucuaauccuuggaaacaacucuucccuaggcucaguuaaaccccucaguguuucucagguucccacagccucaaaaaccaagaacucugaagugcuggggcucuuccaacaccucugcuuggaucucacugucacaccagcugguucgagcuuuacaucuguugaccucccaccccaacccaggguaguauggugaguucucucccuggugccuuucucugggacaggcuuuuguaagugcugguucuuacaguaagcaagaacuucacugcccuguaugauauuaaggcauuuucauuucagaaaauaacauuuuaaguuacaccccuugucugaugaacucacacuuuuauugcccuugauuuuuaauauucuuaagauucagaccuauucagaucauuucagcguaauuacaaagaaacauguagcuaugcaaagcaaauaagcauugaccuucacucagcaaucaaccucaaauaaugucaggaaaucugaagcuuucccugggaaaaauauggaagggaagagaaaggagaugcguuauuuaucauggacaauacucagcacaauuuuauugcuccuuggggaaucugaggcuuuuaaagaugcuauuauuauuuggaagcucuccagagagcacuaaggauuaaaaauagcaccugcacucugcuaagucaaaucaccuguuuauugcccagagugaugaaaaucauuuaauaaaauauuacagauauugcucagaaucaugagcacaauucauauguucagcaacguuaaggagaaugcucgugccuagcuuaauacauauuuguuagauggauaacucacauagugagacagagauaauucacuuccuuaaagaaucagaauuuugagcaguaaaaaauaaaacuucuguaagcaucuuaugauuugguuugccuagaaccagcacaaaacuuuacagcuguaaagugaacaugguaguccaaccaguaaucucugaaccuggaaggcuaagguugaaagauaggucagacugaaguuaaaaaugauaacuugucucaaaaacaguaaauaagagccagagaaauggaugguucaaugggugaaggccuggagacaugaguucuauccccaaacucauguaaaguugucuucugaccucuaaagcacacauggaugcacgcuuacucacauagaccauagacauacacagacaggaagacagacagacagacugauauacacacacacagagagagagagagagagagagagagagagagagagagagagagaaagagaaagagagagagaaacaaaauaagaccuucccccuuuuggguaugaauuuacauguggccaugcacccauguacaccuauggauuuguacguggaggacagagguugauguuggaugcuuuccuacauugauuuucacccauauauugaggcaaggucucucaccauaaccagaguucacugacucagaaagucuacccaaucagcuugcugcacauccagcugggauugcauggauguuaaaaacuccaguccccacacuugggaagaaagcacuguguacaccaaggcacugauguagguauugauccagccuuuauuauuauuauuauuauuauuauuauuauuuuauuauuuuauuauuuuauuauuauuaucauaucucucuagaguuccuuuggguaauccaucuacuccugcuacccuagaaagacaaaaauagggacugugacccaggucugguuaacaacugcuccuucccauuggcuacaguuuuaaguucagccaugagcaagugaucccagauagucuuaugagucucauggcuggauuuuacuaugacuacuggaaagaaaaguuucuaucugaucaaugaauuaauguaaguuucgauguaauaaucacuggacaaaggaggcccuuggaugagugagaccaacauaccuguagcguaagcaaauacaggcuuuauugguaaaacaauuauaauaacugaaagucauuacuguccaucaaaccaaaucuccuuacuauuuaucauaagggcugcagcaacaguguacuuaagacugaucuauccucauucagguuuauggauaaaaugccaacugcccagggacacaaugugugacauuagucucuuucaguacauagugaaauguauuacagacgaguaauaauguuuuaguuucccccuucauuugcaugaugcucaagaauaacuccugaaacucaucaguauuacucacaaggcuucaguuuuaaaguuucaaaguuggauuauuacuaaccuguuccuugcagauacuuaguuauuuggauaauuaagugcauuaugcaaggcccaugggaagaagaaagcuuuugguauugugugaucuuaaaaagucugucuugggccagacauauggcucuuagguaaaggaauugcugcgaaagccuagugaccuggguucaauccccagagccuacaugaagggggaaggaaauaauugacggcacaaaguuguucucugaccucuccauauguuuuguggcauaugugcuggcacacacaguauacacacauagaaauacacaguuuucuaagcaucugucuucaugggcuagugcuuggcagagacuccuagaugugugcagacaaguuaacuaggcauaguaucuguccauaagcagccugucucagucacaggcaggaaaugaggcccauuacuuaagguugcccucugaccuccacaugugugcugacauggaaacacacacaaaggcacacauacacaacauaaagaaaacaagggaggaaaagauggaaaaaaggaggaggagagaguuucgagaaggggaaggcaguccucagcguuggcuaauagaaugguugcugacgguagcugggaggaaaaaggcucugaagcaagcgcuccucagcaucuucuguccuccaggugaacucggccuuaggcauauguacagacuguggaccaugcacuucuaccuauggcauuuaauuaggggcgaaguaaaauguguaggaccagaauuuuaaguauuauuuuaauaaccgucaugcaccuaauuuccaaaugauuucccuucucucuggagaggcaucuaaugucaaacucguaugcugaacucugaccuugcuccaucacuccuaacuaaccacugucugggagaaaugaauucaaaguuacaugcaaugauuucagaaagggaaauacaaccacucucaaaagccaggcaacugagaacuuaaaaggaaaaugagaggcuuguugauuacuuaaagcagaauuuaaguauuccaaucacuuccaauagcauguuuugcccacaucaaauucaccaaggccgucaguuucaacucuuuccgugugauacauugugaaagcuaucuuuuuaccuacuuaaguacuuacauacaaggugacuaugugcaggggaacacuaggaaaggcgcauagcaguaagugacgucugaugucuaucaaaugaacucacagccuuguaucagcucacugagaauugaugcugcuuggaaacuuuuaagacugcuuucacagcaccgcgcaacccacacuacacacacacacacacacacacacacacacacacacaccaguaaugugcaagucggugcauagugcacaaucuugccuaacuggacauauugugcaugcgaggcuagcugagagaacugugcauagucaaaucuaauuuccaguuaaagcuuuucugaaauaaaacgaaaccaauccuauccacaccgaggaaacauuagccugcucauuaacuucccuaaacaucuccaugcagcaugugccgugagaagccucauucagaacauauucagaagagaccuagugcaugcuggccaccagaaagucaaaacaagacuuuuuauuucagacuauuugcaagcacaggucucuauaagagggagggaaacagaacacuguaggauuguuccaacugcaaacaaaaggaugcucccuuagcuguucugccuccauuuggagcaucagcucuuacuugauuacucuuccugugaagaaaauguuuuucuuaaugaccccuagaggaaaacaaugauuugauaaacaagaagugugacacauaaagcagucccacaccuguauauguaaugucaucugggcccauacauuucuuaaagcagaaauagagcuguuucucuccacuccaauuauuucccuaacccuggaggcccgugcagagaacaaacauucccccuguucgauccacaaauaaauaaaggcuccagugcuccaaaaggcuuuuauuuccaucuuuuaaaguggucugaauguuuauuaagaggguuuccuuuauuaacuccugccugaaauuuuacauggcaguaugcuugaaagucgcccagcagggaagaguuuggacauguuccaucagugugacagccugaugaugggugcauguaugcaguuccuguugauucccugguaaucuuugcugaaguacuguuggguccacagaguaggcccagauuauggauuuuuuuuucuuucugcuucacagaugacucauaaucaaucauacauggggaugaaaaugaaagacaaaguugcuaaaacccauuuccacuauuugcucaaagcagaaguucucagagguagaggugaauuuguguacugaccagcagugauugucacagcacuggcucagcauuuuagucaaaacaggccacuccugaugguaaaauucugccaacggugacuauucugagacuuaaagacagaaacauagcaugguucucuuuggucaucagcugugaaccauuugacagggcugcugaaaaucaaauucagaucuacucuuagagcaguaugagcacucagaucuccacccucuaucugaaaaaauuuuaacaggguaucgcuauguagcccuggauggucuagaaugugcuauguagaccaggcuggcugcaugccucugucucccaagugaugacauuaaaagcuugugccacuacacaaucuucuucuagaaggccucuaacuagagacaacacaagacauuaugaaaaaaucaauggcucuggaauuugacagauccaggcuagaaacucagugaugugacuuaaccugaaaccagaagucuuaagggaaucucuugacccucuuucacauuaaaaaacaaaaauguuacaagaaagaaacaugucacucugagcaauacaguggguaauaaucccuggccauacugaauaaauaccuacaacagacuauucuaccuacaggaaauagaaaaggagaugggaaguuacauggugggauaugccuugcauuuccuuacacucugauucugguuuagacuuagaucuauaguuuuggauuguauagaucuguauacacauuaagccaaacaucucuuccaugacgaauauuuccaaucucuaaaaagcuacucuuuaaucaagcauuuaguagagucagaaugcagaaauaacucagguuuguuuuauuuuguuuuguuuuaauguuuugugcucuucgaacugggaagcuggcccagcaguugcccuccuacaccuggcugcuaacauuuccaauaacaaguccuuguucugaaguugcuccuucuaaucucucgucucuaaucugacacuaggcggcucaccguuguuugcccagcaugugaugcacagguuccccucugcacacauccacuugggaaucuaacuuccucuagaggaaugcaggagguaauucugaguuaacaagaggaaucaacaagaaaacugcuaauuuaauucuuucccugaucuccccacuucaaguugauagaaacaaacauauaaaacccaguguuauuuaaaaaaaaauaaggaggcaaaacuacagacuugaguaaaauaaaaaucaacagaggaagaagagugggaaauacacgcuuccuccuccaauuccgcuggacaguucugcaaccaagauguggaccccugggaccacacauucgcaaaugcuguaaugauugcuguuuucuuucauuuuuaaaggauguguauuauauacuguccugcgcuauuagacaauaauuaagauucacuauugauuuuuguugacaaugauaacggcacugcugucacacaucuuauuauauuuaaagcuauacugcaagcucuucuuuauuauugcaauauuuacacuaagaauauaguggagguaguagcuuucuucacaguuuaaaaagaaucacagaccuuuuacuccuguucuaaauagcugacuugguagcaaucuugucccuauuuuauaaaggauguguugcauuuugucacuccuuauaacagccaccuggaagaucauugcaucgccuuggaagauggcuguauuggccuauguagugguagcuaaauaaaugagauuccuguggaauguaugcugugcugcaugcacucauuuguuuagcccuuguuuugaucuuccacaauacagaagaucagcugcuuccuccaggaaccacugaaugagaucugauuggcacugacuuugauauugccucaaggccaugauaaugacucuuauucauguggcagcaauauucuggaggucccauugcagcagggagagccuaacagccacugugguaccaacucaugacaugacaaguuuuugcccugacaucaacuucuguuacaggaucugcaucguccuagcuucaucucucuaagauugggauacagagaggauuugcuuccuuugagcucauucaagcaaauauggaaccaagcaggugaaugacuauugccuccuuuauccuacuggauugagccacaugauacugaccuaucuguagguuuuagcaauuucauauaaucugaauuuguaucuuguuuagaaacaaaguuucacuguuaggaaaaacaaaaacuaagccuuuuccaugauugugugauauugaccagagcaaauuaucucaaauuuauuuauucugauggcacauguuuuuauauaaaacauaaggagagaaucuuuuacccucauuuucacuuuucuaaaauaaggugcauuuaauaacauuguuuagaaaauuccccuucccaagcaacaacuaucaaucaaaauaagcaugaccccuuuugucagcauugggaguaagaaagauacaaagacaaugaaauaucauuucuaucuccaacaacuaaccaauaagacuggacagagaaaaaaauugagaaaaaaaugcaaacggugaagguugaaguaacaauauaagaaaugucacaagacaggccauaaucauuugccaaaagaguggaauagaauguaagugcugagagucgugcggcgggagcaaucacccagaaucugauuugagccacuuuccaucuaauuuagcuuaucagucgaggagcccgccuaccuacuuacugcaggaaguuaucccagaagaugaaaaucaccucacugccuacucagaacuccuggacaaugcauccagagaaauguaugcuggaggucucagacccauauaagaaaaggcaaaugagcacuucacucuccuuuguugcaguauguagcccaggcuguucugaaagcccugguuauccagccuuaggcacuacaguuuaggauuuccaugucugcacacacacacacacacacacacacacacacguauucucuuuucuguugacuccugaaguuuacuaacuucuucuagagagcuggaugaagacaguuggacaggacagguagaaaacuucuaacugcauguauugacucuaaguauucacucuaaagcuuagcuaccucauaaccaaguauuuuucugauacugugauggcucucaauacucaguuucaacccuucagaccaaauaccaagaguaaaagucaaacauagauauaaggaacuuacacaugccuguugaguuauacaugaaacuacaugguugccuaauagccacuagauguuuucuuacucacagcccuuccaugguucucuuggcugugguacuccacaugaggaugguacuucacaagaaagagggucucuagcauauccauggauccucuacaagagcagugagugcuuuuuaccacugagccaucacucuagcccacaaacuaugauucuuaauaaucugucaaaggaagaaaccaaggcccuacuuauaaagagcaaagaacaccacuacccacaguaagcacuuggcagucaccacccuaaccaagucaaaucucaucuucucaaacaucucaaauacucaucaugcuggaucuuuaacguucucauuucugcuauguccuuguuccuccugagcagcucugagcauggucaucuacuguccuaaucaguuccuuucucaacuaaacuuaguugaggaagucccuugaucagauuagccuguggucaugacaaugagaauuuguuuucacugauuacuggcugugggcaauacuauuuuuaggcaggaggcucuggucuauagaagaaagaggaugagcuacaaaacagugucccuuugugguuucugcuuuaauuacugcacgaauuccugccuggauuucccacaaugauggacugugcccuggaaguguaagucaagcagacuuuuuucucuucuaaguugugauuggucaugaugcuuauuaacagaaaagauuuuagaacaacaacucccucucucucaauguguguguguguguguguguguguguguguguguguguacaccacauguacaccugggcaagggagccccaggaauuccccuauaucuauucccagcuuuucaugugggcacugagaucagagcuccccguguuugccuggcaagcacuuugccaacugagacauaguauuaggguuucuauugcuuugaucaaacugacugaaagcaacuuagggaacaaagaguuuauuucuuuucguuaucaaaggcagucagaguaggaagcagcaggaaccagaggugugaacacuauagaggcuauggaggagugcugcuuucugacuugccucacauggcuugcccaaccuauuuucuuauggcccucccacauccuacaggcuugccuacagccugaucuuuuuuuuuuuuuuaaauuagguauuuuccucguuuacauuuucaaugcuaucccaaagauccccuauacccacccccccaauccccuacccacucacucccccuuuuuggcccuggcguuccccuguacuggggcauauaagguuugcaaguccaaugggccucucuuugcaguaauggccgacuaggccaucuuuugauacauaugcagcuaaagacaagagcuccugaguacugguuaguucauauuguuguuccaccuauaggguugcaguucccuuuagcuccuuggguaauuucucuagcuccuccauugggggccaugugacccauccaauagcugacugugaucauccacuucuguguuugcuaggccccggcauagucucacaagagagagcuauaucuggguccuuucagcaaaaucuugcuaguguaugcaauggugucagcauuuggaagcugauuaugggauggaucccugcauauggcaaucacuagaugguccauccuuucaucacagcuccaaacuuugucucuguaacuccuuccauggguguuuuguucccauuucuaagaaaggguaaaguguccacacuuuggucuucguucuucuugaauuucaugcauuuggcaaguuguaucuuauaucuuggguauccuaaguuucuggcuacagccugaucuuauggaagcauuauuucaauugguguuccagucucucagaugacucuagcuugugucuaauugacauaaaacuagccagcacagucauacauacaugcaucuucauugccuuucuuuacuccagagagguguuuagcaugacaaauaggaaugacucuauuugcuuugauucagcugaucuccuauugugggcauauauguaggacacacauacauuuacauguuuagaugguagcuuagcccagaaagcagagaaauauucuagcuucuaaaaugugcuaaucagggaagucaagagaagaaaagaaagcaaggaggcaggaguagaggaaaaguaauuacuggcugcaucccuguacuagcugcugaauguugcaagcccaguucguugucaguucuccuugacuucucuucugagcaaggcuauaugagagacugcauucuugaacagaaugucccaaggaagaauggaaaauggacucacuacccaguaaauguccacuuauacaacuacuagguuagacauacagaggugcugagcuagccacugcucagugauaaaaggcaaggccaggacugaaggagugagcugacagagagccuuaaaccaguagcaacaacaguaucaggacuguccacgacuuaguucuguaaccaugggaacagcacaaagcagccaagcacauagaucaggaauggagccuaaccugaguuuggccaagauagauaagaaaaugagaaaaugucugaauggacuguuauagaaguaugacacacacaugcucaccaauccugaagcuuguacucaugucaaauaucuucaaaucucuaauaguauuuugucuggcugagccaaauuauagucucuaagcccuucuuaaggcagggcuguaaaaggcaucacauucaauaagauuugacauauguccagggcaauaaaaaaaugcaguaaagaauguuuccuauagauuaacucauuggauauccucaaaguugccacauucacagaacaaauauuauucaccucuauuccauaacagacaacugaaacuuagagauagucucaugcuuuuaaagcaaggaagaaacucgaaaaaacaaaaaugaagacuccaaaccuggguuuacauaaaaucuaacauguaauacacacaggaaccaugugacucacaaccaugugagucacacaacccugcuaauucagaaagaugagguggucacuagguuauauggugauuugcagacaaaauguguuaauaugauacauacuugcuucauaaagcaaagacuccaugggggacauuucuggacuggaggaagaacauccgccgugguauaguuaaaaaucgguguaccaauuuuuguuguaauaucugauauuaacuauaaaaucauuagugauuccucuccugcugagagcugcaugccuuugggguagacuugacuggggcaguaaagaacgaagaaaugacagguacacauacaaagaaggugggucucacagucugauagagauuguaccacaguagucagaaacugcaucuaugguauacauuugaauuaagggucagguuuauguauacagugaaauaggcaucuuuauugucuuaguggaauggaugucuuuauaauggagcagucucaaacagcaaacauagaaccagaggaggcucaggaccagcacaaggcuuugccaugucucugagucugacuaggaaagauuuuaccauucccauguaucagaggcacuaggguccuugacauggccauacuaauguugacaauaugcacaaacucagaacuucaugcucuuccuacacugaaacuacccaugcaaaugacuggguacacauucuagaaaucuaauaaaugccauccaaaucuuagcaagaccacguggaucuggcacucuuguggaucugauauuuagguguuaauguguaucaaauaagugcccagagcuguacaaagaacuguucgaugcacagauggacacgguacuauuccucccccuuuaaguuagugugaccugaaguaaaggagauuacccagcugcacggcacggaaccggauuaggaaauugcaacuugaaauauuucgaaacuaaaguagaccugaauaaaagcagaacaugcuugccauuccugacgcgcucugauuauuuggagagauggcugcuguuugugaagcugacugcacugaagugaagcccgggaaucggaggugcugggcuuagggcguuauuaugauuccuaauaauacugacaauucuuuuaaauaaaucaguuccuuacaagaauuuaagaaagcugcuuggguagagaugaguuagggguguuuauacaaaguccugagauguauguccugagaugucugucaguccugagaugucugucaguccugagaugucaguccugaggugucaguccugagguaucaguccugagaugccuguccugagacgucugucaguccugagaugccugucaguccugagaugucaguccugaggugucaguccugaggugucaguccugagaugucaguccugagaugucaguccugaggugucaguccugaggugucaguccugagaugccuguccugagacgucugucaguccugaaaugucugucaguccugagaugucaguccugaggugucuguccugagaugucaguccugaggugucaguccugagaugucugucaguccugagaugucaguccugaggugucaguccugaggugucaguccugagaugucaguccugaggugucaguccugaggugucaguccugaggugucuguccugagaugucugucaguccugagaugugugucaguccugagaugucaguccugagaugucaguccugaggugucaguccugagaugucuguccguccugagaugucugucaguccugagaugucugucaguccugagaugucaguucuccugaagguguuggacagaagcgcuaaggucgguguucauuaucuucugcauuuauuauucuuauuuugaaaucugauuauuuucauuccuuuguuacuugggucaaaagcuaaaggaaaauauggaucaaacaugauggaaagcuauuuucuuguuugacccucuuagaguaguguuuucaauauuucaaugaugaaggcuauaaucuauucuuaaaauaaauguagacuacuaugcuaacuugcucagauuugguuuccuagucauuuaaauguuuuucuuuaaaacuuaagacuuauagacaugaauuuauuucggauauauuucuauuuccuuugggaauuccauaccuauaauuauuucuuaauuuucuaagguaacauggcaguuuucaggaaaauagacaaaacuagaaaucaguauguaagcaaaauaagcaagauucagaaaauacuaaucuguucuuuuucuccugugcagacucuagugguguguguguguguguguguguguguguguguguguguguguguguguguuuguguuuagggcacaaaaguagaaaguagacuaugaaaggaguuagaaaaccuuagugagggcagggcagagagaguagugaaauacauagaccaggaaacuuggacuagugggaugccuccgcagguaaaggugcuugccaccaagucuaaagacccgaguucaaccucugccauccacaugguaaaaagagagaauuaauucugaccaguugucuucugaccuccacacaugggccauggcauacacacacacacacacucacacacacacacacacacacacacacacacacacacacacacacacgauaucaggucauuuggaagggaagcugcaaugugaagucagggcagucaaagcggaacggagggagauguaaguaagaacagaggacacguguugcaaagggaacacuuuuuugcaguuaagaggauuggagcucuggcagaggacacacaucugguucccagcaccacacagaggcucgugcccaccugcaacuccaguuuccggaaauuggaugccuucuuauggcuuccuugggcaccuggaguacauguggugcccacacauacacgcaggcaaaacauucguacacauaaaacaaaacuaaacaaaucuuuuuuaaaagagguauaucuauagauggcauagugaagccuuuguguuuuaaggucuuuccugacuuugcuguaaacugcauagacagcaggacucaugcaaauguuuaagacugccagaaauguucuuucaagagcucuuaccaacuuaagucaagcugaacauguuguucccacuguagagggccugggagauggaaaugauuauuccaaauguacugauugucaacugaaauuuagagaucaccuacuccuugaagagcauacagcaggccaucaaugaagcccuuaccuuuuuccacuacuauccaggaauggaaugcucugcuuuuucugauuucuagccauuugguggggaggaaugcuuuuuaauucauguuugcuucccugugaauuaccaccuaaugguuauugcaguaguguuuaauaagugauguguuaucccugggcacuggaauuagcaucauuacucagagaugguaaacagaaguuugcaguuguguacugccuggagcuggaagcaucaauaaaagccugagguaggaggaagagaugaaugcacagacuugaaucagaggcaagggaugcaauuugaugcagaauauuaagaaauccugccuagacuagcuaaggaauacaauccuucaaaacucugaagcugaacugcccaguuacguuucucauauggcuuuucuuuccuucccagagcauaaaaagcaagagccuugcccuucacguacauaauucuugugcauacccuaggaugcuuggcauguaauauucuagaagcaaugugcuaugagucucuuugacaaugguugcuugggggccagggauuuuaaucugcauccaugagcuaaagacauuuaaauuuaaaacuugugagcaaauuucugaacaacuaaaaggcugcugagugagaaagugcagacacugaccuccagccauccaaguggcagucuacauacaagauagggaaaagcuuguuacuaagggcauguguguuaacuccaugcacagagaaaaagacaggauuaucacugguccuaggcaugcuguuagaaggaguggcaucgauuuaagaauagccagauauccuuguaugguggcauuuuuuuuuuaauuuugagacuuuaacauaaaaauacacaugcuuuuuaucauuugugucccauacuaugcucugcgguuggacaugaaacaguuuccccauucugguauuuuacaaagagugaaaaauaauaacaguaagaagaggaucacuuucugggaucauaugauuaguucugacaugugggaaauugcuucauugccaggagucaaucccugccauugcgagcaucuucccuucacaaaauuaauaacauguccaguuuccuucccucuugcccuuuccucucuacagacugcagccuccuauugccuucaugugaagucacaguuuuaacauaaccuuuucuuuauuucuaaaacagugcuucucagccuugcuaauguugcaacccuuuaguacacuuccucauguuggggugaccccacaucuaaaauuguuuuuguugauacuugauaacuguaacuuugcuaugauuaugaaaaaauaacauaaauaucugauauguauauuaacugauaugcaaccccccccccaaagggcuggugccccacagguugagaaccacuguucuaaaauauagaaggacauaagcuauggggucauggugacuucuaagaugugcuucuaaaaagucuuuuauccagacuguugaauacuaacagucaggcacuuuucuagaaucucagaacaugacaauugcguaggacgcgaaugagcacaaugauuuugagaguaguguguguucagaaggaaguaaggcaguagaugagugggucccuccucaugggcacugaaagaaggacuugguggaaggguaacaucugagcugagaguugagugacaagaagucaccucuucaggaugauaagcagaaggaguggcaucugcagaggcuaagcacugccugaaguaagucgggcuaugucaagaccagagggagcacacaccuuggaggacuccugugaggccuguggaugugaagugaggucagccagaguaggagauucaacccuacauucaggacuugguuuuuuaacuuuuuacuacugacagaaaaaccaaccaagguuugaagccucagagcaauuguuccaagggcauguuuuaaaaauugauaaugguacugauuaugauggggaaagauggacaaggacauaucccaaagauuugacaucuuuaaagagcaugcaugucaguguuugucagugggagugagugagaucaggaaugcugggcugaacaucuagagugaaauuaacaugugcugugcuuggaggaccucugcugagcuuacaccacucccagcuucuccauguaaaccgaggauaaugauuccuccaagagucuccgugagaauuacaugagacauuucuaaaaccacagggugaugcuagaggcugggaccugcucagugaacaaacuguuguugguguuuuucucaucagcaucauugcuuggaggagagugaaggauggggcugaagaacugagcagcuagcuacucagggaacuuacacuaaaaaggagcacucugugucucauguccucccagcaggagcacacagaccagaagaagcacccuguguuucacauccuuccauaaauuuauaccuugacaaugauaguguuugaauuaaaaaagaguugucauacaacuaggaaaauccagaugcuaauaaccaugacuguaaaucaauaagcguaguaaauucauacaaggaaauaauucauagaaacaaauaauaaauggcuagcuuaccaagaaccaaggcugcaucacacaaaagcauucaugagaaaaacuagacugaagagauggcaugcuacauaaaugaaacucaagaauagaugagacuaaucgguuugcuguaccuuaaguuauuuaacuauaucauuucagauaucagaauaagcuagacacauaaacaaauggggcuucauaaacucuguaaccucagaacccuuaugagccuguuuauuuccaaggcuggcucucccuguccagauuccaaggcucaacccauauagucagcuacaaugggaaacuaacacagagacagaugaagaaaggcuuuacuuaaugagagggcaaccauagcauagcaaauuguauccaggaaugacuucagaagccacuccacugguggcagguggcuguuuaacuccuuaacuuccaguuguccugcaucccucugcauuaagugaaagaccuguaggcauaacagcuucuucucuauauuagaaaugaugcccauguaccuugaugcuugggacagaccccguucuaugcuagaaauggccuccaacuaccuugauauucaggacaagacagcuuccuuucuguaucagaaacaguguccauauaccuugaugccgaaaaaagaaacacaauggggaaaggaaggacauguucauacaguauccuguggcguuucacugaggaaaauuuagaaggcagagcagcugaauagauucauuuuccugauagagcacauaccacaaugcaaaagucauuaagcccuaucaugugacauuaaaaaugcuuucaggcuacgaucagcugacaaggcacccagggcaaacuuuaugaguguaucaucacaaucuacaauucagaucauggacuagcuggaaauacaugcucucuagaacagcucagaguuugucagcuucuaucgaagugaaaaaugguagcagagaaaagcuuauuuuccuggaaacacacuaucaaauaauaaaacaauucaggagccauuuuugcaaaguaauaacagagcauacauaauugauugccuuucaucuuugucucagggaauucugaaucacuagcacuuuccgcaaacuuccauccuggaucuggcugcccguuuggcagugccagaaaugcuuuuugccccuucccuacauuauucuuuaguugcuuccugaguaaaguucucauagcccaacgauucuugcaguguguacaacgagccaucccaguggaucccaaaaguaacuucuagggcuggacugauuugaacuuaugaucucaccgcaggcuugcagaagaauacaacuucccagggagguaaaauucucuacuaugaaaucauguccuaacucccuccauuaaaccaacuaucacccuaaaagcagaaaauaaauguuuauauuaugcuaacucuuugccuuaccaaauguugauagauagcugugucauaaacuauaaauaaauaauucauuccaaaauucaucaugcguugcagggcucauagaauugauaccuugaaagagggcuugagagcaucaccugggaguucugauuuaugccuccaccacagaaagaaauguucucucucucucucucucucucucucucucccuccaucccaucccacauucccaucaugcacaugcaugagucacaugugucugcugaguccugaaaaugacaaauacaggaucuuagauguguuaugagcauaaaauagacaaagauuuugaagacuggcaaugaacaugguauuaaguguaucucuuuaauaguuuuugaaagcuggaacgauagcuuugccaguaaaaugcuugcuuuacaagccugagugaguuugagucucagaaucaacauuagaaaguaaaaauaaaaaguugggugcagugguacauagauugggaaggcagguacaagcagauuccuaagugcuuacuggccaaccagccaaucaacuccaggccaguaaaagacuuugucucaagagaaaaaccagaaaaaaugcaacagcaacaacaacaccaaaaacaaguugaauguuccugaggaacaaugcccacgguuauauuguacugaccuacacacacacacacacacacacacacacacacacacacacacacacacacaaaguuacuuaucuguauauacauauauacacagcacaguuuucgaauguguauauucuaucuagaaucaugaauuaucuuuuguuugcuaauaagcugacuagaagucccaagguaacuucagaaugggaucuucucaacaaaacaauuaaggaaaaauucaguauuuaugacuuuccacuucauugcucagccuccauggaagaaggaacagaagcuaaagcuccaccugaucacuaagaaccaaugacccccaccuaagcccucagaaaaugcuagaaagacaguuuggggagcgccuccauguagcugaacaccugagguuuccuugguggggcucauagaaaggauauggaaauuucccuuuuacucuuuccauaucucuuccucugugucauuccaaaugcauaucuuccucuuuauccuccauaauauccuuucaaauagacaaguaagguaaggguccggucaagagaauccugacuuauaguuuaucggucaagaggaaaauuaaaacaaucuggaguguguagcuaguacuggagugaggucagucuuugggccugugaucuuaacuugaagucaucuccagguaacuaaugucagaucaauuugguuucuagaacagccaaggucuucuuuugguccuuagcuagcuaguauucuuauuguugagacaaauaaccaacaagaaguaauuugaugugaggagaguuuauuccggcuuacacuuucaggguauauaucccgucuugguggggaagccauagcagccugaacaagaaacucaauggucacauugcauccucagacaagagacaguguggacaagaaguggagacgguuuauaaaaccccaaggccuucuccaguaccuacuuccucucauaaggcucuacaaccuuugcaaaggaaccauuaucagcuaaagaccagggguucaaacagaggaccuccugggggaucauuucauauucaaacugcagcaccuccacagagcucacguacuaucugcuggauauggaggaaucuaucuaucuaguguuaaaagcaugaugugagaaugcaggggaaacgggacugaguuucauccauauccuuaauauuaucagauggaguuaaauaaaauacaucauuaaaaucaacuuucaccgaauuucuauaauuccuuaauuucgcuauuaaaaauguuuuauuuacuugcaugguucauauagccuuuugcuugauccauacagaaaaauaugcauauauaaacuauauacgugcuaucuagagcaauauauaauagguaggagccuacucaacaugcauguucguguuuaugaacauguguauauucauaaauugccucucauuauucuagauggauccuaaggaaaauuauuugauaaaucuucugccuugaaggucaacaggauaacucaugagacuacugccauaugaaaguuaacuggaaucucaaacgaaaaccccuccagucccaacacccaacgcauaaguagggaggucuccuucucuaggcuccucguccuuuuuagggccucauguagcaagaacucacuugcugcagcuacaccuucucccucccuguuucccuacccugaccuggauguucugugcaguguuuugaagcaugcugcaaaagcacuugggcucuuucuaggagacauaugccguacugcaagaugcuauccuggcuauuagucacugccuacuuuaggucucuggagaaugcugccuguuucacucuccagcacucgaguuuccucuuuuugcuuaauaacucaccacacuguguaaauguguacaaucucuaaaacugcaggaacagccuugaagaaugauuucuaaauuaccucacuuagaaaaaaauaugaguggguucucuguugcugugauagaguaggggaacuuauaccagaacaucucaaaccauaguagcuauuccuuccucgaguaagugguuguuaggaagugcauuuuaaaaaggaugacuuuccagugaacacuuuaauuuucauuuaaccuucccagaaaaaaaugaagugcuuuguguagauucuuuuggcuuuauuuaaggccuaaagauuaguucugaacugugcuaauugugggcuuaggaaugcaaucauccugaguaccacuucagaucugcuucuaagcccugcagaggagaaacuccuguuuauugcuaacucaaaggcaugaaguuacuuacuuaauugugacacuaaacuucaagucgaagugccaugggauggcuacaggcaaagggcuuugcaguggacaagucugguggauaaaggagugugaggcaggcuucuggguguguguuugcugaccauuuaccuuuaauuaaaauggagugauauaccagugaagcacauuguaaugguuacagugaagcagagaccgaccacugaaaggacagcagauuuccaucaucugaauuauuuacuuggcuuuaguucuggcuuucugcucuugcuguuaagaucagagcuaauucacauucucuaucuguuguuuaaagaaaaauaaagagccugaaauuuuggccaugagaaauguccagcacaaagcaggucaacuucuaagcaucugagaauguggcugagucuguacugccugagaauggccagagcuagccaagaugucaugugguguuauuuuucuuccuuuuaaaacacagagacuucuuaaagucugcuaaaauggaugaguuguucuuuuuguaugggagcacuggaauugaugucaucuugaaagauuuaaucaguucagccaccacuaagccuaacacucccauauggagaucaaccaaaguuaaguucgaguacguuuggcauaugcuauguuuacugggugugaugguuuguauaugcuugguccagggaguggcacuauuaggaggugugaucuuguuagagucagugugucaccgggguuguaggcuuaagacccuuauccuagcuuccuggaagccagugcucugcuaucacccuucagauaaagauggagaacucucagcucauccugccccaugcaugucugaaugcugccauguucccgccuugaugaaaauggacuaaaacucugaacuuguaagccagcuccaauuaaauguuguucuuauaagaauuuccuuggucauggugucucaacaguaaaccccuaacuaagauagugggauuacuguaacucuucaguaguucaagaaaaauaauucaucuguaaccucuccuaaaauuuuaauuugggaaagaauaacagaaaauauuaacuguccaaauacuuguauuacaaaguaaaagaaauggguuugcugaguccugggugccugaguuauggucuauuguugacaguccuuauauuuuuuuaaagcaugcccacuuacugggguauaucauaugagaagagauauuccuaaccucuuaggaauaaaacaagcacagucucugccuucagcaauaaacaguuuucuccauguggagucuuaacagagcuaaacucagagagcuuugcagccacagcagcagcagagagcacgaaacaguggcucuaccuuggugugcuugucuguauacuucuuugguuuauuuuauuagauaucacuaucuuggcauggacaucuagcuuucuucucuuaaaagaauuaaagugaauauaccuggccaaaaaucccaccuggcaauaauggcuggugcugaguggugcuugccaccaccacugacauguuuuaugguuagccagugcccuauuaccuauuggcuuuaguauuguguuauuugaguuguucaacuugcuagacaugacaagguaucagagacccugucuuuucuacuccccuuacuaaauacuccucuguuuugcuuuucuaaaagaggagaaaagaggaagaaaggcagacaacacacacacacacacacacacacacacacacucacagagagagagagagagagaggaagagagagagaggaagaagaggaagaagaaggaggaggaggaggaggaggaggggagggggggggggggggggaaaaaagggggggggaaaaaaaaaaaagagaagaagaagaaggagagggagaagaagaagaaggagagggagaagaaggaggaggaagaggagaaagaggaggaggaagaggagaggaggaggaggaggaggacgacgacagugaugaacgggagagagggagaaggagggagaaggggauggcaggaggaagggagggagagagagacagagauagagggugagagaaauauucucucuuacugacuuacugguaccaaaauguaaaucuguguaagaggcucaaaacuaggaucuacaaggcaaaggaaucaugcuguuauaauuacauuugucagaagaaaugucuagaugaucagaagucauacaauaaauaccacaaaaaauagcaugcagacucagaugugugggacagggugacuccccacacugcugguaagaacauaaaugaauaacauuauggaacacauggugguauguccuuggaacacugaaagaacagcuuuccaacccacuuaggacuugaacuagacauauucacagaaaagaucaugugcuaaagauauaucuuuccuccuguguuuacuacagcaaucuguguaauagauaagaagcaguaucuacugagagucccauuaaggguaagugggcaaaauauaugauggaguauuacccagcuagcaaaggggagagauccuguaaucaggaacaguagaagugagucuggagaacacaugcuacgugcaguugaauaagccagacacacaagagcaaauacuauauguucuuccugcauguaagaaacuguagcaauucagcuuacagaagucgcugcugaccaucagagcugggaaaaagccagagguuaucagauaugaagauacagcuggauggaaagaaugaguuccugggcucugcucacaaucgggugacugccaguaaaguaucauauucucagacaagcuagaaaagauguucacacucccaacacaaaugaauaggaaaccucuuagaugguguccuuauuacauaugugugucagaauaucaacugauaucaauaucaauccaugugcaauuaagacauauucaaauuuucuaugcaacaaaccaucagcagaguuagcaaagaucccacaaaaugaggacaacucuuuaccagcuaacauuucagacaacaagcuaacauccagaagucacaaagaauugcaaaauuaaaugccaaggaaauaaagcugccaaucaauaaacaggcaaaauaaacugaauaaacauuuaucaaaaaggagacauacauagaaaaaaaacuuaaaacuguucaauaucccuagcacucuggaaaaugcaaauacaaucuuuguuuagacauuaccucaccccagucagaauggcugccaucaacaaauaggaccgcaaguguuggagauuauggggagagaaaggaaaccuucuucucuguuggcuagcuuuaucaacuugacacaagugagagugcuuuuagaacagggaaugucaguggagaaaaugcccugaccacauuguccuguaggcaagcuacuguugcguuuucuugauugaugauuugugcaggagugugguaccacuccugggaagguaguccugggugcuauaagaaagcaagcccugaagaacaagccaguacucagcacuuuuucagggccuuugcuccaguuccugccuccagguuccuaccuugaguuccugcccugacuucucuggaugauggacuacaaguuagauuuaaaauguuucccaaauugcuuuugcucaggguaucacagcaauagaaaaguagcuaacauaaugaggguacaaauuaaucuagccacuguggagaucaauuuguaguuuccuuagauaauuaaaaacagaacuacuauauaacccagcuauuuuacuccuaaacucauacccagagaacuucauacccuauuguagaaauauuugcuccuuucucuuuauuguugaucaauucaccauagaaaggaauugaaacuaacuuaguuguucaucaacagaugaauggauaaauaaaauauuauauaugauacuuugauauauaaaauauaucuauuacacauaaaauauaaguauauaugugauagaauacuacacagcucuaaagaaaaacaaaguuaaacauuuuccaggaaaguacauggacuuagaauguaugagauuaagcaaucucagaaagaaaaaaaccuuaauguucuuuaucauuugcaaaaucuuucauaaauacaugauaauauacaaacaaguaacugcauguacauauagggacaguauaacauaaaaaaagagaauaagcaagaauaaguaucaggggaucuagagagacugaaugcugaugacagacacaguuaagaagaggacauaaacugaugguuuuucuaguucuaacuuuaucagagacuuuuggguuuggugauggauaaguacauagaauauauuugauaccaaaaauguaaauuuuacugugaaauuccacaauuucuguugugucuggccaguagaucacaaccuggguucuagccuggaaaggcauuuuggaaaccuggaagagaagaggggcuagguggcgagagaaaaugauucagcuaagacaggcauucugaucaaagcucaauuuuacuguuccgcacgcaguuaugaaggaagggggaggggcccgauucccaccaaauaaucucgggauccaguagcaaagcggcagguuccagcagugggcauggcagaaagauugagcgggaagcuccaccccugaucaagcagguuucaggcugggggaggggagacuacaaauuucuguucugaaugccuauugugacuguacugaaguucacugaaucauguaacuuagggucugauuaauuuggauauguaauguuuuuauuuauuugcaaguuaauuugugggagcuggaggucuuuucuuuuacaauaaagcuuauaacauucaaauauaaaauaaauucaaauaauuagaagucccauccaugucucucccuuaauauuagaaaccauaugguuuuacaauaaauaucacuucaugcauuuuaaauaaguaacugaggcuagaaagaguugaggugcaggcaugggcaauggcuuucuaaauggggcucccagggcuugcaaaaugggagcaaacauggacaaauagaaucacaucaaacaaaacaauuauuagagugaagagauagccuacaucauaggaggaaaucuuucaaccuauucaccaggcauuaaucuaacaacaguagauuaguauccagaauauauaucuagaauugauauccagaacucaaauaauuaaaaauacaaaagagaaaucauccaauuagaaaaugagcuaaauugacacacauuuccaaauagucaguugacaccaggaaaaagguucaacauccuaaggcagcugauaaaugcaaauuaagaguacauugauucugugucacccaagccugggugccugucauaacaaucaaugacaaagaaugaacccugaggagaguugggaaggaacucuguuggugggugugaccaucagccagugcagucaguaaggagugaaugugaaggcacuucauaauagcaaaacaaaaaacaaaaaaacaaaacaaaacaaaacaaaaacaccaacuggcuaguuuggugucaacuugacacaggcuggaguuaucacugagaaaggggcuucagcuggggaagugccucuaugacauccagcuguggggaauuuucucaauuagugaucaagguggggaggaccccuucccuauaagacagcaggcugagcaagccaguagaagcaagccaguaaaaaacaucccuccauggucucugcaucagcuccugcucuugaccugcuugaguuccaguccugacuuccaucagugaugaacagcaauguggaaauguaagcugaauaaacccuuuccuccccaacuugcuucuuggucaugauguuugugcaggaauagaaacccugacuaagacaaagugguaccagcauagugggguauuccugugaaaaccugaccauguuuuggggaagacuguggaaggacuuuggaacuuugagcuagaagauccauucauuguuaagagcucugugggauguuguguaggagccuggaagauaauguugagaacagugcagaaaauggaggccuggcuugugaaauuucagagggaaaauuagagacucuuuucagggccauugcuauuuuggauugugaagauucugugguucugguuagcuggggcugaagaaucagcugugauuaacaagauaccagaacuacuaaagcgaaaacuuugcauuacugggacuauugaugcugguuagcuggagcuaagaaauuagcugugauuaagaagagaccagcaucauugaggugacaucuucuggaaaguguuuucugagagcacagaggcuguguuccagagauagccaagguuguaccuugggcuguggcuggacuuaguaauguguaagaguuacccaggugguacugguuuugaaggcgugaaggggucaugcagagcagcugaggcuuggcacugugagaggccauggaaggccauuggugaaggugcagccucaguugcaauugauggcccgggauugaagggguaaugcauuguuuuggagaugccaguaccaugagaugaccaccaagaacagcagcagcaguggaguacaggcagcuagagccuagaagacaagauguguucuacaaagugcagcgcuggggaagugacccaaucccuuggaggaauccagaagauugugaguggaucccagagauuggagaauuggaguuugauuuugcuuuucauagugacugugccccgauguguuucccacuuuuaaaaaauuaauuaauuaauuaauuaaauuuuuauuagauuuuuucuuuauauacauuucaaaugcuaucccaaaaguucccuauacccucccucugcccugcuccccuacccacccacucccgcuucuuggcccucgcauuccccuguauugggguauauaaaguuugcaauacccaggggccucucuucccagugauggcugacuaggcuaucuucugcuauguaugcagcuagagacaagagcucugggagguacugguuaguucauauaguuguuccaccuauaggguugcagaccccuuuagcuccuugggugcuuucucuagcuucucuauugagggaccuguguuccaucuuauagaugacugugagcauccauccacuucuguauuuaccaggcacuggcauagccucauaccagacagcuauaacaacuuaccuucagcaaaaucuuucuggcauaugcaauagugucuggguuugguggcugauuaugggauggauccccgggugggguagucucuggauaguccauccuuucgucuuagcuccaaacuuuguuucuguaacuccuuucaugaguauuucguucacuguucuaaggaggaaugagguauccacccauuggccuucccucuugauuuccuuguguuuugcaaacuguaucuuggguguucuauguuucugggcuaacguccacuuaucagugagugcauaucuaaugacuucuuuugugauuagguuaccucacaaaggaugauauccuccagaugcauccauuuguccaagaauuucauaaagccauuguuauuuuuuuaaaucuaaucuuuuuuuuuaaagauuuauuuauugauuauauguaaguacacuguagcugucuucagacacuccagaagagggaaccagaucucauuacggaugguugugagccaccaugugguugcugggauuugaacucuggaccuucggaagagcagucgggugcucuuauccacugagccaucucaccagcccaaagccauuguuuuuaauagcugaguaguacuccauuguguaaauguaccacauuuucuguauccauacuucuguugagggacaucuggguucuuucuagcuuuuggcuauuauaaauaaggcugcuaugaacauagcagagcauguguucuccuuacuaguuggaacaucuucuggauauaugcucaggagagguauugcugguucuuucaguaguauuauguccaauuuucugaugaaccuccagacugacuuacagagugguuguacaagcuugcaaucccaccaguaguggaggaguguuccucuuucuccauauccucaccagcaucugcugucaccugaaguuuugaucuuagucauucugacuagugugagguggaaucucaagguuguuuugauuugcauuucccugaugauuaaggauguugaacauuuuuucaugugcugcucagccauuagguauuccucaguugagaauucuuuguuuagcucugaaccccauuuuaauuggguuauuugaauuucuggaguccagcuuauugggcucuuuguauauauuggauauuaguccccuaucagacuuaggauugguaaaaauccuuucccaagcuauugauggacuuuuucucuuauugacagugucuuuuaccuuacagaagcuuugcaauuuuaugaggucccauuugucaauucuugaucuuacagcacaagccauugcuguucuguuuagaaauuuuuccccugugcccauaucuucgaggcuuuucacuacugucuccuguauuaauuuuagugucucuggucuuauguggaggucuuugacccacuuagacuugagcuuuguacaaagagauaagaauggaucaauuugcauucuucuacaugauaacauccagcugugccagcaccauuuguugaaaaugcugucuuuuuuucccacuggaugguuuuagcucccuugucaaagaucaagugaccauagguguguggguucauuucugguucuucaauucuguuacauugaucuaucugucugucacuguaccaguccaugcaguuuucaucacaauugcucuguaguacagcuuaaugucaggaauggugauuccaccagagguucuuuuauuguugagaauaguuuuagcuaucauagguuuuuuauuuuuccaaaugacuuugcaaauugcccuuucuaucucagugaagaauugaguaguaauuuugauggggauugcauugaaucuguagauugcuuucagcaggauagccauuuugacuauauuaauccugccaauccaugagcaugggagaucuuuccaucugagaucaucuucaauuucuuucuucagagacuugaaguucuuaucauucagaucuuucacuuccuuaguuagagucacaccaagguauuuuaucuuauuugugacuauugugaaggguguuguuucccuaauuuuuuucuuagccuguuuauccuuuguguagagaaaggccucugauuuguuugaguuaauuuuauauccagcuacugcgcugaagcuguuuaucagguuuaggaguucucugguggaauuuuuggggucacuuauauauacuaucauaucaucugcaaauagugauauuuugacuucuuucuuuccaauuuguauccccuugauguccuuuuguugccuaauugcucuggcuagaacuucaaguacuauguugaauagguagugagaaagugggcauccuugucuagucccugauuuuaaugggauugcucugaguuucucuccauuuaguuugauguuggcuacugguuugcuguagauugcuuuuauuauguuuagguaugggccuuuaauugcugaucuuuccaaaacuuuuaccaugaagggguguuggauuuugugaaaugauuucuccgcaucuaauuggaugaucaugugguuuuugucuuugaguuuguuuauauaaugaauuacguugauggauuuccuuauauuaaaccaucccugcaucccugguaugaagccuacuuggucaugauggauggucguuuugauguguucuuugauucuguuugugaggauuuuauugaguauuuuugcaucgauauucauaaggaaaauuggucugaagcucucuuucuuuguuggaucuuuguguaguuuagguaucagaguaauuguggcuucauaggaugaauuggguagaguaccuucuguuucuauuuugaggaauaguuugagaagaguuggaauuagguuuuuuuugaaggucugauacaacucugcacuaaacccauaguuuuaggcuuuuuguguuugggagacuauugaugacugcuucuauuucuuuagaggaaaugggacucuuuaagucguuaaucugauucugauuuaacuuuauaccuguuaucuaucugggaaguuguccauuuuauccagguuucuaguuuuguugaguauagccuuuuguaguaggaucugaugauguuuuggauuuccucagguucuguuguuuugucuccuuuuucauuuuugauuuuguuaauuaggaaacuguccaugugcccucuaauaagccuggcuaaggguuuaucuaauuuguugauuuucucaaagaaccagcuccuuguuugguugauucuuugaauaguucuuuugguuuccacuugguugauuucagccauaaguuugauuauuuucugccaucuacuccucuugggugaauuugcuucuuuucuuucuagagcuucuagguguccugucaggcugcuaguguaugcucucucuaguuucuuuuuggaggcacucagggcuaugaauuuuccucuuaggacugccuucacugugucccauaaguuugggcauguuguggcuucauuuucauuaaacucuaaaaagucuuuaauuucuuucuuuaugucauccuucaccaaggugucauugaguagaguguuguucagcuuccauaugaaugugggauuucuauuauuuauguugauaaugaagaucagccuuagucuguggugaucagauaggauacaugggauaauuucaauauuuuuguaucuguugaggccuauuuugugaccaauuauagggucaauuuuggaggagguaccauguggugcugagaagguacauccuuugguuuuaggauaaaauguucuguagauaucaauuaaauccauuuguuucauaacuucuguuaguguccaugugucucuguuuagcuucuguuuccaggaucugcccauuggugacagugggguguugaagucucccacuauuauugugugagguguaaugugugcuuugagcuuuacuaacguuucuuuaaugaauguggcugcccuuguauuuggagcauagauauucagaauugagaguucaucuugguagauuuuaccuuugaugaguaugaagugccccuccuugucuuuucugauaacuuuggguuggaaguccauuuuauuugauauuagaauggcuacuccagguuuuuuggggggaccuuuugcuuggaaaauuguuuucuagccuuucacucugagguagugucuuuccuuuucccugagguggguuuccuguaagcaacaaaauguuggguccuguuuguguagucagucuacuagucuaugucuuuuuauuggggaauuuaguccauugaugauaagaaaaauuaaagaaaaguaauucuugcuuccucuuauuuuuguuaaauuugggauucucuucuugcagcucucuucuuuagguuuguugaaggauuacuuucuugcuuuuucuagguuguaguuucuguccuuguguugguguuucccuuuauuauccuuugaagggcugaauucauggaaagauauugugugaauuuggcuuuguggaauacuuugguuucccuaccaauugcuggguauaguagccuggucuggcauuuguguucucuuagguucuauauaacaucuguccaggaucuucuggcuuucauagacucuggugagaagucugguguaauucuaauaggucuaccuuuauauguuauugacuuuuuucccuuacugcuuuuaauauucuaucuuuauuuagugcauuuguuguucugauuacuauaugucgggaggaauuucuuuucugguccagucuauuuggaguuuuguaggcuucuccuauguucauaggcaucucuuucuuuagguuuaggaaguuggguugguuaugaucaaaguaugccauagucauguuuggauagauugugguaagaggcuggggagauggcuuuguagguagaaugccugcaguucaagccugaagaccugccuuuugauacccaaugcucauguaaaaagccaggcauggaggcaagcucugguaauccuagcacuuggagggcuuguacagaggcaucuccaggaauugccaauuaaccuaguccaauugguauuuuccaaguacaauguaggacuuuguccccaaaaauaagguggaaaaugaucaaggaagacaccaacauuaaccucuucccuucacaccaaaaugcacaacuaaaugcacgugaccuauaagcauaacacaagcgugcacgggugcgugagugcacacacacacacacacacacacacacacacacacacacacacuuguagacacacccaaaacaagacucauuaucuugucaauuaauauaugguaguaaaaaugucuacagacuuuccauaggggcaguaagcgcuccuaacacaucuaugcuuuuauuagguaucuauaggaagacauuugcugaguagaggcaaaugcagaagaccuccauaauaacuuuuauaaaagaugcaguggcuuaaacuagguguuuucugugcugggccauaauucagguggagcaaugauuaaaugaauggguagaggagccaguucagaugcaugagguagaggcacugugggagauaaaugaggagagggaucaguucauugugggaggugcaacuaaaaaauggagaacccuguguguguacauugaauucagaugguuaggagacaaaaaaagcuuauagguaaugucacugccaccacagucacucugcucugaagcuccaaauuaagccagaagcucaaaugaugugccaccuggagaaccaaaucccaggaaccauacuugcaacaugcagggacuaaauaguaacaucaacagcauaagggauugcaggugugaauucauuuucugaaacaauaauccagagaaucugucuggugacagugcuuuaucaaaacagacagucucaaggaguagaaagggauccuagucauggcuucuuguauauggacaucaagaacaggaacuauguacauaucauacuuuguuccucuucaaagcaaagauuugugaaagcaaauuauuuaucaucuaguaugacaauuaaaaacaagagauauuguggucuggaaaaggaaugaacuguccugucuuuuugcaguggaccugcccauuuaggaaaagaaaauaagaaaccacccaaagauacucaaagccaaagauaggcuggguuccuugaacacagauguaacauacggaguuuacaggguuuucaaggagugucaguggaagugaaagacccuaagggcuuuauucagucccacacccuccuuacagcuucccucucugggcuggggucaaggcuauaccaaguuccauucucuacccacaguucuuucaggaggagcagaaacugaaagagccacaacaugaggacucaccaacguucugacucaggagaggcgacaccccaaaaucacccacaagaaacggucuugcugcaaacugcaagaagauuuuuauucaagagcgcucucgggcccacggucauacaccacgcaggaguagaggaccguggugccccgaguagcugaguaaggggguauuuaaaggaagaaaccacaacucaaggagguggggagggcguuguuggaaaauaccaaaaauaccaguuaagagucacaaggaaguguaaagucacaaaugucacaaggaauaccugguaauugugaggguuauuucucaagacaguuucuaagagccccuaacaauagcacauuugcauugcagguuccagcaauggucagggugggucagggugacuuucuuugaaugaacacucuuugaacccaggaagcggguggauggaggaaggaauguugcuaucuguuuuaugaccagcaccuggagcaauaagccacaaagaccacacucccaagccugggccuaaaagccucgaauuuuguuuuuacuuugcuauauuucuucaaaacauucuugagaaaaacagaauguacugacugauagucaccugacccucuggaaagucucagaguucaaauucacgucaugucaugaucugccuauacuugcuagccacuagauuuaaaugucaauaugcuuagccaauaaguuuaacaaguaaccuugcugauguaacuugugccucuaaaaaguguaaaaacugcuuguaauggucauucgugggucaccuucuaguuacuugccuuguggguuaauuaaaggucgauccugaugcaccuggggaaauaaaccucuuuuugcaucaaucugcaucucgggugucucacucaguaugucucacucgaaguaaguaccucugauggagaaucagggucuuacugaagcacuaccgguugcaggaaggagagagccagaaagaaaggcagagagcugggucauccacucugggcacauauuuuagcugacucauagucaaaucaaguagauaacugagauuagugaucacaacugccaaacaccaaacugucccuuaagaccccuuaagguuuuuagcauaugaauuagaauuuuaacauaugaauucagugagaagucaacaagcauuccuguugcagaaggaagugccuugaucuugcugagaagaaagauuucuacucucugguaaucagucagugaaacaggccaucucacaaaugagaugccuuucaaagaggggaauaagcucucaguuguaacccaggcauggaagauaguucauaccacuuuuccagcuugauguaauuaaguaacuuucaagcgcugacuuugagggaggucacuuuugaacuuggaaccaucaagcucccauaagguuaagaaagguacuuaagacacaacaaugaaggcacuguggggacagcuuaggcaguaaagugcuugcugagcaaguagggggagccaaguugauauaacacccauggaaaauguugagcaugugagacaugccuauacuccuaguacuggggaagcagagaaaggagaacuccuggaacuuguugcucagcuggucuugcucaacuaaugagcuauacagcuuuacugagggacacuguuuuuaaaaguaaaaucaagaguaauagaagaagacacucaauauggauaauauauaugugcauaaaugaaagagagagagagagagagaucaacuuagcuaaagcuuggcccacuuugcccaacaucucugccugaucucuucacucucauguaaccaccacuuuccccauuacuacuuuaacaaaaucgaaaauauuuggggaauuuuuuuuuucuuuuagucagaccugacugaagagaguaaaaaaucuauaaguuuuucuucuuuuucauaaaaaugccaccugcauuuaccauaagugacuacaauucauguuguaugcucuugccuggagcagccucuauacccagcaugcccugucacuacacaguuuggcugggauacccaccauguggaguugcccugggcucuguugucccuagcagaugcugcuaagaggcuuaaggcagucuccccugaucaaacacugccuguguucagccacuuguggaauuuuacaguggcuuaaaaaauacuaaggcacugcagaagagccuuggguguuuauauaaauaauugauuguauauaaaaucucccaggagagaucugugucagucuacagagagccauaucucaggggacccaugcuguuugucuggaaauucaacacacugagggcaaucugaaaucugcaaagaaaaaaaaaucuaucuaaaggggaacaccacacuuuuauugcuuuguaagauuaagaaacuuacuuugguuuaaaauuuaaguugacuccuauuccucucugacaaaacauuaaaacccagucauugaauugacccagcauugcuaauuacuccuucugacauuaaaguguaucaacauguuuauguugaaagccuuuacuuaaauauuuuuguuaauucuaauauucaauuauaauuuucuucuuagugagacacgaugcuuaugccccugaaaagccaaaacuguaacugcucuagugcugauuuucccagcacuuauuguuaauuaaaagguaaaaaacaaaaaaaacaaaacaaacaaacaaacaaaaaaaaaccuauuacuaggauaucggcaaucaggcuuucaaagccagaaacaucaauauccaguaauugagaacauuuuggagcaaaauuuuaauaagcaaaaaagucaggaggagggaaauguuauuauuucaaauggaaauaagaucaguauauucuagugaaaaguuauaauugcccaugacuucuaggcuucuguccaauuuuucuccuguagcagaugcuaaagaaaaggaguaucaccaggccuguccauuucugcaguauuuacagauauaauacagcaacagucuacuguuggggacuuuagcagaagcuaacagaagauacacucugccacuguguuugugggcuguacuuccuccugaucucuggggugagcagauaggucauuaaguaaaugcugugcuggguguguacaaagcauaguaaugugcuauguugaaggcacagauuagaaguacaaacauaaagaagugcaaaacccaauauuaaagacaaguggauaauacaauccuaaggaccagagcagaguccuggaacaagucuguaauaccagagauaaugcugagacucacacagcugaaccccagacugcuacucauaaugggaacagacucaagugugcuucccuucuuuaucugcucucccaaacaccaagacacaccaucuaaucuaugagcccguguccacaugcauuccaguuaacuuugccccacauuuccucuggcaagccaaacauggcccuuucaaauuagaauaauuugacaaagguucauugaagggauuacuuauaaaacuuugaaaaguaugcagggaaagcugaaugcauauccaauacuauggaauuguuauaauccuucagacgaagaagagaagaaagagcaaauuaaacuagaaaggagaagguggguagagaggcuaguuucagggggaggugugagcaucuguaaaagacugagccagcauggcucaucagaaaaacuucuguccucaucagaaaaagauuucuguguauaugaguaugcauguguaagcauguuuauguagauaugagugugcaugcaugaauguguaccuacaugacaaccucagauuauuccucaaguuauuccucgauaacuuuguguuuggggacaggguuuuucacaggagccugacaucagccaagcagccuagccugucuggccagugagcucaaaagaucuaccugcaaucaccuucccagcauuggauugcaagcauacaccaacauacuuguauuuuuuaaaaagugagucuaauaaucuaauacagguccccaccauuuugcaacgagcacuuuauaggcugcacccucuccccagccuagaaauguuuucagccaaugcagaagaaaguuccuaagcacagagggcucgagcuaggacuugcauuauaaaaucccaucgacagcuguuaggucuggagagaaagaggaguaggaaggggugggaaugaugguuucugcagugacaguaguuguacuaacacuuacagucaugauuaccaucaugauacacauuuccauagucuauggauaauagcuucuauaacucacaccaauaguuccucaagugugguauucauaucauugcuggagucaaucaaucaauuuuguugauauuacaccacaaagagcaggguuuguaggacuggacauggguugaaauagcuuuauuucugauugugaaaugcaguaaaaauggucuugaugcaaugguugauacugucaacuugacaggauguaacaucacuaaagauaagccacuggguguguuugugauugaagaucuagauuagauuaguugagguuguaagacucacacaaaauguggguggcacugagguuuggaucccuaccaugcacaaaagaaagagaaagcaaacuauaugccaguaugcacucucucuguuuacuggcauggaugucaugugaccccagccaccacacuuuccccaaucaagcacugcacccacaacuuguaagccaagguaagccuuaugguuuguuugauuuguuuuuguuuuuguuuuuguuuuagucgagcauuuuaucacugcaacaugaacaauaacugauaugcaugggcccuggaguuaauaugagggauaaaaagaggauauguucauagagcucuggacaagguauggaagagggcaaccauaaaguacagcaagucauuagccauagcaaggcuggcaguuccgacauggauagggucacaguaaaagacacugaagugugaguggucccucuucuucugcacugguaaaaggccaagaacaguccauggugccaugacuccuuucuagaggacuccugcucuagaguuaggguuucaguuuaaaacaccaaaguacacucaggagcagccuugggccuuuuacuuuuuaggguucugauuuuucauuuaugauuucaacaaacagcuuauccaauacaauuuacacaauuauuuuguuauaagaagagcaaugucuaugacuaugacagguguuggacaacacaaugcaucaugaaaucuaaaugccacucaagccaaagguugcaaauauuugagaagauauuuggcauuuuagauucauguucuaggcaggucacuauggaugcuuauacuuaauuuuuuuuuucuaaccacuuugauuuucaaaaaaaaaaaaaaaaucagagaagauacagaaagaacgcuaacugauuggggaaaaaucauuuuuuucaacuuucauuugaagaaauacuuuacaguuuuaaauauucucuuuagauugaaauuuuacaauaaucuaggaaaaaaugaagcucuaguaaagaaauugaguaaauauagaaagaauaaaauaucauugagucuaguuuacaaaugcacaagaauaaauucauaaaucuacaguuaaaauuuaauaauuugaguuaccagauaaaaauauugcuguuuugauaugagcuggaauugacccuaugccacaaaucuccguucacaaauccagccuggagagaacugauuucccaggagugcugacacaacugagagcaugggugagaccaccauucugcucaaauucuuggcccaagaaggucccacccagaggcaucaggacacaggaaccaacaaacacccagguacaggauauguccaguucugucuacacccuggaccugaccugugccacagcucuccagacccaaauuccaccggaagagagcuggucuccuaggagugcugacacacagguuuacagaagggacaagcuacagucagagucagcaagaccaucuaacuccacauauaaccagaugguaagaggcaagggcaagaacauaagcaacagaaacaaagguuacuuagcaucaucagaacccagaucccccaccacagcaagcccuagaaaccccaaccuaucagaaaagcaagacacugauuuaaaaucacaucucaugaugaugauagaggacuuuaagaaggaaauaaauaacccccuuaaagaaauacagaagaacacagguaaauagguagaagcaauuaaaggggaaaaacaaaaaucccuuaaagaauuauaggaaaaugcaaccaaacaggugaaggaauugaacaaaacaauucagaaucuaaaaauggaaacagaaacaauaacgaaaucacaaagggagacaacacuggagauagaaaaccuaggaaagagaucaggaguuauagaugcaagcaucaccaagagaauacaagagauagaagaaaggaucucaggggcagaagauaccauagaaaacauugacacaacagucaaagaaaauguaaaauguaaaaagcucuuaaaccaaaauauccaggaaauccaggacauaaugagaagaccaaaccaaagaauaauagauauagaagagagugaagauuuccaacuuaaaggaccaguaaauaucuucaacaaaauuauaaaagaaaaauuccuuaaccuaaagaaagagaugcccaugaacauacaagaagccuacagaacuccaaauagaauagaccagaaacgaaauuccucuugucacauaagagucaaaacaccaaaugcacaaaacaaagaaagaauguuaaaaguaguaaggaaaaaaugucaaguaacauagaaaggcagaucuaucagaauuacaccagacuucucaccagagacuaugaaggauccugggcagaugucauacagacccuaagagaacacaaaugcaagcccagacuacuauacccagcgaagcucucacuuaccauagaugaagaaagcaagauauuacaugacaaaaccaaauuuacacaaaucuuuccacaaauccagcccugcaaaagcuaauagauggaaaacuccaccacaaggagggaaacuacacucaagaaaaaagcaagaaacuaaucuucuuucaacaaacccaaaagaaaauagccacacaaccauaaugccacauuuaacaacaaaaauaacagguaucaacaaucacuauuccuuaauauuucuuaacaucaauggacucaauuccccaauaaaaagauauagacuaacagucuggauaugcaaacaggaugcaucauuuugcugaauacaggaaaugcaccuuagugacaaagauagauacuaccucagaguaaaagacuggaaaacaauuuuccaagcaaauggucccaagaaacaagcuggaguagccauucuaauauuaaauaaaaucaacuuucaaccaaaaguuaucaaaaaaaaaaaaaaagauaaagaaggacacuucauacucaccaaaguaaaaucuaccaagaugaacucucauuucugaauaccuaugcuccaaaugcaagggcacccauauucauaaaagaaacuuuacuaaagcucaaagcacauauuguacuucacauaacaaauuagacuccagagaaccaaauaacccuaugaauaaagaauucucaacugaggaaagucuaauggccaagaaacaaagaaauguucaguauccuuagucaucagggaaaagcaaaucaaaacgacccugagauuccagucagaauagcuaaguucaaaagcucagguagcagaagauccuggcaaugauguggagaaagagaaacacuccuccauuacuggugggauugcaagcugguacaaccacucuggaaaucagucuggugguuccuaagaaaaguggacauaguacaaccugagggcccagcaauaccacuccugagcauauacccagaagaugcuccaacauguaauaaggacauaugccccacuaugcucauacaagccauauuuauaauagcuagaagcuggaaagaacccagaugucccucaacagaggaaaggauacagaaaauaugguacauuuacacaauagaguacuauucagcuauuaaaaacaauaacuucacaaaaaucuuaggcaaguggauggaucuagaaaauauccugauaagguaauucagucacaaaagaacacacaugguauguacucacugauaagcugauauuaagcaaagaggguggaaugcccacaauacaacucacagaccaaaugaaguucaagaggaaggaagaccaaagaugcuucaguccuacuuagaagggcgaacgauauaaucaauggaaguagagggugggagggacuuauuaggcaugacccccugguugagggauggggccacccauccaucuccaaaauuuuaaacaagaauuucuccugucuaaaggaaauacagggacaaagaguggaacagagaaugaaggaaaggccauccagagacuaccuuaccuggggauccaucccacaugcagacaccaaauccagacaacaauugcugaugccaagaagaucuugcugacagaagccugauacagcugucuccugagaggcucugccagauccugaccaauacagaugagaaugcuugcaaccauccaucagacugaguacagggugcccuaauggagaaguuaggggaaggaccgaaagagccgaaaggcccuuaucuagcaucaauggggccuguaaaggcuugaugccccaguguagaagaaugcuagggccaccggugaggugggagugaguugguaggggagcacccucauagaaggguaagggggaauuggguaggggguuuugcagaggcguuacugggaaaggggauaccauuugaaauguaaacaaauaaaauauccaauucaaaaaaaaaagaguguggagccagccucuucaccugaauauucaauuaaaaaaauaguaacgaaagaaagaaaaaagaaaagaaaaaaagaaaauauugcuguuuuguaggaaaaagugaggaauacaaauauauuauuuaaaguuguagauauggaauauuuuguaauuuaucuuaauguuuuaauccuaaauggcacucuuucuguauuacuuucaaauguuugucauggaaaacugaagucucucuguguucauccuuggugaugaccaaucugaaugaucacagacagcuugauucuuauaucuugcuugguugcuugcuuagcagccauccuugcagccugucuaaacaauucucugugcacugacauuugcaguaauguauuuauaucacagaguuagggccugucauuugacauuaugagaggcuguauagcccaauacccagcauaucucacuuccucuuccucaagaggauauaguaccuuuuuuaucuguuuuguuuaauuauuuuggcaggcauuaacaguagauuauggaaaaucaauggagguagacuagauuaauuuagguuccaugggguuaagaagugucaugugcuuuuaaccuuguuaaggucuauuugagagcaacaacuuuguccucuuuaaagaaaaaagcuuuaccauaggacuuucaucuuucuuuuauuucauuauuuucuuuuuucuuuuugccucugugauaguuacuguugguuucaaacuugucauaccugagaagaaggaaccucagaugaggaauugagucuaucuaucagauuggcucauggacaugucugugagacauuuucuuuuuuaauuuacuauucauuuauuuuuauguguguggguguucuuccuacaugcaugucugugcaccacuuacaugccuggugccugcagagaccagaagagacuggugauuuccuggaacuggaaugauagauaguugagcuaauuaccaugugagugccaggaaucaaacucagauccuguggaagagcagucagugcuuuuaaccacugagccacaucucuagccccuguggaauuuuuucuuauuuuauguaggaggacucugcccacuaugggaaauacuaucccuggaaaaguggaccugcaagguuuaagaaagguugcuaagugugagccuggguguaaucuaguaagcaauguuccucuguaguuucagugccaacuuccuccuugaguucucaccuugguuucauuagacagugguuucauuagacaguggccgauaagauggaaugaaccacuuuuccucccaugcauaagggaaacuuaugguguuuaucaaaucaacagaacccaaaccaagacagucuccuguuaaaaauuaaaucacacugcgaaacugaccaucaauagccaauugugcauccugacuuuagugcugaauuuugugacaaaaagaacuugggauuuccugagcuuucagaaugcucuaggaaauuauguguucuuuaacuucagagccuguugguguucacccaccuucagaucccagaggacccuugugucagcuggcugcacccuacuucccacagggguugcuguuccuguccuccauagcauagcccuuggguaaccauagccaccaggaucagaggauccuggaacaggugcuacuaugugugguccucaucagcacccagagcuaaacacugaggaaugagauggucaggauaagagcccacuugccugcucaaggcuauacugagggauauauuccuauuucagagauugcccauauggcccaugggagcacccagccuugcuaguuucuuccuguucccuaauucccucgugcacaaccugcuuuucccuaaaagcugccucuuccuggucacuacucacagcaaucacaguuccagggaacccaagccaagauccaccagaaguggacacuaauggucuuccaguucuugugggugacugaugagcucucagccauuucuaaaaugcucuguccaaagugcuuuacaagcacacucuagggagggagaggggcaaaaucauucgucaguucuaugacugcaugcaaggaaguuccuaagguccuuggagucacaucauuacagaacucggaaaccagcuacucggaaaccaggggaaggcugcaguuggcaaggguugcccuucuuggcgggugucgggcaugguucugcacugcaauuuuccuguucuagaagaacaaaagaagucuggggcuaguggaaaagaagcuaugacaggcugagcaucaaacuacaaacagcccuuugaagccuugcugauguagguggauguguuugugcacucgcuacuggaucaagucucacagugaaagaaaggcaagcucuccacuuaacucugugcuguuaguaaugaaagcuaucaaaaugaagcuggaaugggccucacuguugcccuguaaaucuaacacagacagcuuaaugagagagggacauuaucuuuucucacacuccaguuuuacucacguaagaaaugugccccauauuggcaauuaacuugagagauuaauuaaacccaacagccagucucauuccuuccauagugccuucugauuccaugggaaggcaccagcaugcugugggcacuuagcacauguuaaauaauaauuacuaaaauaacccaacuaaucuggacucuguccuuuagaaaacuggcagcuagcuuccacaguaaauuaauuccacaaucagauacaacuauucaauauuucacaugguccuguuucaaacucugccauaugacucccaaauccccaacaaauacugcccaauaauuauuucuucucccaggaacuuauucaauuauauuuaauaugcauuauagguuuccuaugaauuaaaaaaaauagaaaucagacaaaacauaaacuuggagccaguuugggagaugacauuuaaggugccuguguaugucauccuauaccauagcuaacucuaacaugagagcaaaaugacaaucugugugcagacaugacucugcuugaucugggccugggucgcuuucucauuaauuccaagauucuuccuaacuucuugugugaauuuuuucucugcuugcuuuuguuuguuuguuuguuuuugguuuguuuuucuggauguuaguuuugaacacagcauccaauaaacaauuugaggcaugaaaacuguaacacuguggaacucagcuacacucucagccaauaguuuugugcuuuuuauuuuccuacaugcuaaaauguccucuacugucacauguaagauggagucuuaggaaguaagaagcuuaaaauuuuacaauuggccaaaugguuuuacaaugccuugguaaaagucaauaaaauguuguacuaacugauugcuuuggaaucaugaaccugccuugguuagcaaguugguaugguugccaacauguagacacuguacaugaacaaugauuucuaugcaugcccacugcucccaaagaaguaauucucaacaaccucacuacuaaaggcgucuauuuuuucagaauagaguauaugucuuaaauauuuuaucuagccaagauuaauaauuauuuuccucuuuuggugcuauuagaaaagauagguacccugucuaauggaaauugugaucaacaaauggccaaaauuaggacagagaauucacaggucuugacaauagaaaaaugugacauuucuguugcacuucucagugacauggcuacugacacccugcagaaaaagacaaaaaaagcuacacuauuucccaucuguuuuagagaaaauucuauaacaaguugauguuuuaaaccuagucuaaagucuuuaauguggaaaaguuacauuagcaagucuuuuguagcaagaagcuucaucaaccaagguggcaucuugacacuagaaagagacaauaauuaacaucaagccccaaugucccaaaaauaauaacaucaucugaaacaugcaaaguccuggcaugacuucagcucuuacaaaaaguguuuccauauucuugacaacaaagcauuccuguacuugauaauaaguagaugauaauaugaugguuguguuuguuagacuuacaaugaucuuaaaacuuuaacaaagcaaaauauuuaauauaacuggccuauagucuuauuuucuacucuggcuaauauuuguaacccacuaauuacuauaauggugaacaacaauaagcuugugcaaagugucucacaugcacugagccauucacucaggugugcaaggcuaacugacagauccuuugacuacacccauuucccacauaaagaugcugguguccacugggauugaguguucugcauagccacagggcaucugucccaacaauuaugagguauagaaauccugauauucuguucaagcugcugguucaggcuaauauagacugugcaaauagcaauauaauaacuuaaauuaggaugagagcuguccucaguucugucauacuaagaucaagaucaagaccaggacuccaugcauauuaaguucauauacaacuccauguguaguucgcaagcacucuacaaacuaagccauaugcaauggcugaguacagauacagucuaugcaauaaaaagcauggcuuacauccauucugauaauuugucuuucuuccuuguaacacguaccccuagcuggucuagaauucacuguauagucaaggauaaacuugaauuucuggucuucuugccuccuuaguucuguauuuacaguuguauaccacccugcccagguuuaugcagugcuaaugaucaauaccagaacuucauacacauuaaguuuauacacaacuccaugcauaguugacaagugcucuaccaaguaagccacaucuucaaccaccauucaucaguucacauauacaaaauacccaagcucacuuugaauuguucccauuguugcaaaacuaugcaaggacaaauagauaaccuacggaacugacagcuguauuacaggaaguaauaguugaaaaaaaugaaucuauagacugccauugcauucucagugcauguacaaguaaugauaugacccaucaucuguaugaugauacauuaaugcuaaaucagggaugguaauuuaauucacaucaccuagcaugaaaaacuuguuuucgguagaagauucuguagcuaccucucucucuccaaguagaaaucuugaggagacaaguagcagagcaaccagaagucacacacauggcuaacuuaacaguauuuagagucaaauuacaggaggcucuucucauguuagagagcugugugaaauuuuuuacaacuuagacaauucuauacaacucauucugaaaugguucucacaugacaaaacaaagacgacucauucauggguauaaaagccagaucaagggcccaucacuuucacagucaaguaguuuacucuuuauucuuagcuuacuauuccauagagguugaucugaaacucuguuuaaggcagaaaccaggcuuacaaauucuuggugaauugagucucaaacaugagaguaaauuauuaaaaaccucaagacaccagaagccaaauggaccaaccaucagcaauuggcaacucaguccuuagucuuccguauucacuggcuuaacuaugaucuuccagcggaguucgcagaacuagauauuuuuaagauaagcaauuucuagauccccaacuuuggcccaagucaggaggcauggggcugacagccucuguuuacacaguuugccuuuucaucuucaaaccacugucaaagaauagacugcuccugaggaagagucccaugagaaccaagcauaagggaaucaauaagacacucagcugagguggugccuggccucccauggguagaaccacugcaagccuccucacaggucuagcaacccauucuaacagaaguccgaauauucaugccaggccaggagaugccuuggaggacagcuacuuaaauaaaaauauucaaccuuggaagacaguaagcugucccucaacgauugacucagcaaacagaauuucuuuucaaaacagauuauauaguggccauuuuccauaagccuagagagccaagcuuccaguuucaaaguuugcaugaaauaacuuucaggcauacuauaaagaaaagcaucaugucuaaacauaccagcuacugggauuuggaguauuuguucuucccaacugugucagcuugagcugggaugucuaagaggugagcuuugaagucacuucuagaaauggagaggugaauauccucccuggaugagaaacaguucuauuuuaaagucaguuuuuccuuccuacaaaauugaacuaauugaguugucagaggauaaaucauaagacaguauuugaugggaaauugcuagguaauuuuugaggaagggaaauacccagaaaagcauuuaaauauugaaugauauaaaaauccauccaacuuaaucuacuuaugcaugugagaaagauuucagugccuuugucuagaaaaauuaaaugucuccagucacacaagggcaugucugccuucugaaguaauacaucacacaaugaaggaacaauuucuuugaaaaaaauaaaaguccuggggguccuuucuggccccaggcuaccuugggugcgaacuuagcagacagucccacaguccccagaggauuuuccacacuacaggcacccuagcacacccaggaucuuaggaucacuggugaguagaacauaauaucuguuccaaagcaaccagcagggucugugccagcaggaacagagacacaggaaacccucccaaccaguggcugggguucauuccagucaacuuuagccccagggcaccuucugcaugaacucaguggauggucccaugguccccagacaacucuccaugcugcaggugcccuagcacacccaggaucuuaggaucccuaaggagaaucagccuccagggagggcucugagccugagacucaagugagaguaccaucuuauauuccagaucucucagagaccaguccaugaaggagagaaugugggcugcaaaagcaacagaccuucuuggacagggucccuuugggacuugauuuuuagccaggaggacuaucugagcaccagaccgcugugcaccuucccugaaagaggagagcuuaccugcagagagugcucugaccacugggacacaguagagaguuagauucccaggacugcugacagaggcuaacagaaucaaaguagggaaaagauccagccagagacagcuggagcaucuaacaccagagauuaccagauggccaaaggcaaacguaagaaucuuacuaacagaaaccaagaccacucagcaccaugagaacccaguacucccaccacagugaguccuggaaaccccaaacacacccaaaaagcaagauuuggauuuaaaaucauaucucaugaugcagguagaggauuuuaagaagggcauuaauaacucacuuaaagaaauacaggagaacacugcuaaacagguagaaguccuuaaagaggaaacacaaaaaucccuuaaagaauuacaagaaaacacaaccaaagaggggauggaauugaacaaaaccauauaagaucuaaacuuagaaguagaaacaauaaagaaaauccaaagggaaacaacucuggaaauagaaauccuaggaaagaaaucaggaaccauagauucuagcaucagccacagaauacaagagauagaagagagaaucucaggugcagaagauuccauagaaaacaaggaaacaacaauuaaagaaaaugugaaaugcaaaaagaugcugacucaaaacacccaggaaaucuaggacacaaugagaagacaaaacuuaauuauaauaggaguagaugagaaugaagauuuucaacuuaaagggccagcaaauaucuucaacaaaauuauagaagaaaacuucccuaaccuaaagauagaaaugcccaugaacauaugagaagccuacagaacucuaaauagacuggaccagaaaagaaauucuuccaacacauaauaaucagaacaacaaaugcacuaaauaaagauagaauauuaaaagcaauaagggaaaaaagucaaguaacauauaaaggcagaccuauuagaauuauacaagaauucucaccagagacuaugaaagccagaagauccuggacagauguuuuauauauaaccuaagaggacacaaaugccagcccaggcuacuauacccagccaaacucucaauuaccauagauggagaacccaaaguauuccaugacaaaaucaaauuuacacauaucuuuccacgaauucagcccuucaaaggauaauaaagggaaaacaccaacacaaggagggaaauuaugcccaagaaaaagcaagaaaguaauccuucaaggaaccaaaaagaagauagucucaagagcagaauuccaauuuuaacaacaaaaauaacagaaagcagcaauuacuuuucacuaauaugucuuaauauuaauggacacaacucuccaauaaaaagacauaggcuaacagacuggcaacauaaaaaggacccaacauuuugcugaauacaggaaacccaccucagggacaaagacagacacuaccucagaguaaaaggguggaaaaugauuuuccaagcaaaugguccgaagaaaaaacuggaguagccauucuaauaucgaauuaaaucgacuuccaacccaaaguuaucaaaaaagacaaggagggacacuucauacucaucaaagguaaaauauuccaagaugaauucucaauucuaaauaucuaugcuccaaaugcaagggcagccacauucauuaaggaaaccauagugaagcccaaagcacacauugcaccucacacaauaauagugggagacuucaacaccccacuuucaucaauagacagauccuggaaaagaaacuaaacaggaacacauugaaacuaauaguaguuaugaaaaaaaaauggacuuaacaaguaucuacagaacauuuuauccuaaaacaaaaggauauacuuucuucugugcaccucaugguaccuucuccaaaauugaccauauaauuggucacaaaauaggccucaacagauacaaaaauauugaaauuauuccaugcagacuaucagaucaccacggacuaaggcuuauucaacuacaacauaaauaauagaaaucccacauucacauggaagcuaaacaacacacuacccaaugauaccuuggucaaguaaggaauacagaaaaaaauuaaagacuuuuuagaguuuaaugaaaaugaagccacaacauaccaaaacuuaugggauacaaugaaagcagcacuaagaggaaaacucauagaucugagugcagccaaaaagcaacuaaagagagcauacacuagcagcuugacagcacaccuaaaaccucaagaacaaaaggaaccaaauucacccaaaaggaguagacaacaggaaauacuaaaacucggggcugaaaucaaccuagugggaacaaaaagaacuauucaaagaaucaaccaaaccaggaacugguucuuugagaaaaucaacaagauagauaaacccuuagccagacuaacuagagggcacagggacaguauccuaauuaacaaaaucagaaaugaaaagggagacauaacaacaguaccugaggaaauccaaaacaccaucagauccuacuacaaaaggcuauacucaacaaaacuggaaaaccuggauguaguggacaauauuuuaagcagaugcaagguaccaaacuuaaaacaggaucagauuaaugaucuaaacagucacacauccccuaaagaaauagaagcagucauuaauagucucccaaccaagaaaaaaaaaaaaagucccaugaccagauggguuuagugcagaguucuaucagaccuucaaagaagaccuaauuccaauucuccucaaauuauuccucaaaauacaaacagaagguacucuacucaauucauucuaugaagccacaauuacucugauaccuaaaccacauaaagacacaacaaagaaaaagaacuucugaucaauuucccuuaugaauauugaugcaaaauuacucaauaaaauucuugcuaaccaauuccaagaacacaucaaaacgaucuuccaugaugaucaaguaggcuuuagcccacggaugcagggaugguuuaauauauggaaauccaucaauguaauccacuauauaaacaaacucaaagacaaaaaccgcaugaucaucucguuagaugcugagaaaguauuugacaaaauccaacucuccuuaaugauaaaaguuuugaaaagaucaggaauuaaagggccacaccuaaaaauacuaaaaagcaaucuacagcaaaccaguagccaaagucaaccuaaguggagagaaacuuagagcaaacccacuaaaaucagggacuagacaaggcugccuacuuucucccuaccuauucaaaacaguaauugaaguccuaaccagagcaauuagacaacaaaaggauaucaaggggauacaaauuggaaaggaagaagucaaaauaucgcuauuugcagaugauaugauaguauauauaagugauccuaaaaauuccaccauagaacuccuaagccugauaaacagcuuccgugaacuagcuagauauaaaaugaacucaaacaaaucaguggccuuucucuacacaaaguauaaacaggcuaagaaagaaauuagggaaacaacacccuucucaauagucacaaauaagauaaaauaccuuggugugacucuaacuaaggaagugaaagaucuguaugauaagaacugcaagucucucugaagaaagaaauugaagaagaucucagaagauggaaagaucuccaugcucauggauuggcaggauuaauauagucaaaaugguuaucuugccaaaaguaaucuacagauucaaugaaauccccaucaaaauuccaacucaauucuucacagaguuagaaagggcaauuugcaaauucaucuggaauaacaaaaaacuuaggauagcaaaaauuauucucaacaauaaaauaaccucugggggaaucaccauuccugaccucaagcuguacuacagagcaauugugauaaaaacugcaugguacugguacagugacagacauguaaaucaauggaauagaauugaagacccagaaaugaacccacacacuuauggucacuugaucuuugacaagggagcuaaaaccaucuaguggaaaaaagacagcauuugcaaaaaauggugucucaacuggugguuaucauguagaagaaugggaagugauccauccuuaucucuuuguacaaagcucaagucuaaguggaucaaggaacugcacauaaaccagagacacugaaacuuauaaaggagaaaguggggaaaagccucgaagauaugggcacaggggaaaaaauuccugaacagaacagcaauggcuggugcuguaagaucgagaauugacaaaugagacuucaugaaauugaaaaucuucuguaaggcaaagacacugucaauaagacaaaaaggccaccaacagauugggaaaggaucuuuaccaauccuaaauccaacagggaacuuauauccaauauauacaaagaacugaagaagcugaaccccagaaaaucaaauaaacccauuaaaaaugggguacagagcuaaacaaagaauucucaacugaggaauacggaauggcugagaagcaccuguaaaaaauguucaacauccuuagucaucaggcaaaugcaaaucaaaacaacccugagauuccaccuuauaccagucagaauggcuaagaucaaaaauucaacugagggcagaugcuggugaggauguggagaaagaggaacacuccuccauuucuggugggcuugcaagcugguacaaccacucuggaaaucaaucuggugguuucucagaaaguuggacauaguacuacuggaggauccugcaauaccucuccugggcauauauccagaaaauguuccaaccaguaagaagaacacaugcucuacuauguucauagcagccuuauuuauaauagacagaaguuggaaagaacccagaugucccucaacagaagaauggauacagaaaaugugguacauuuacacaauggaguacuacucagcuauuaaaaacaaugaauucaugaaauucuuaggcaaauggauggaucuggaggacaucauccugaaugacguaacccaauuacaaaagaacauauaugacaugcacucacugauaaguggauauuaguccagaaacuuagacuacccaagauacaauuugcaaaacacaugaaacucaagaagaaggaagaccaaaguguggauacuucauuccuccuuauaauggggaacaaaauacuuacggaaggaguuacagggacaaaguucagagcugagacagaaggaaggaccauucagagacugcucuacccagugauccaucccauaaacagccaccaaacccagcauaugcuugcaagauuuugcugacaggaccaugauauaccugucucuuguuaggcuaugccagugccuggccaauacagaaguggaugcucacugucaucuauuggauggaauacagugcccccaaugaaggagcuagagaaaguacccaacgagcuagagcagucugcaacccuauagaaggaacaacaauaugaacuaacuaguacccacccccucccgagcuugugucucuaguuacauauguagcagagaauggccuaguaggcuaucaaugggaggagaggcccuuggucuugcgaagauuauaugcucuaguacaggggaaugacagggccaggaagcgggaguggguggguuggggagcagggcagggggugguauaggggacuuucgggauagcaugugaaauguaaaugaagaaaauagcuaauuaaaaaaaaucccuccucauaguauuguguggugcacccaugaauugggcuuugagauaaaauggucguuugacagcauuugcaagauauuuauggucuuaauaaauuuuaugauaacaauagcaaugaaaacucagucuauuuacaauuuuagaaacauauauuuaggguuuucauuuuuaauauucagauucuauauaaugaucuguaaacuucuuaaucauauuacauucaucaaaaucuugugagaugucaaugggauuaaaaaagaaugguuugccuggcgugguggcacacgccuuuacuccccgcacucaggaggcagaggcaggcagauuucugaguucgaggcagccuggucuacaaagugaguuccaggacagccagggcuauacagagaaacccugucucgaaaaaaacaaaacaaaaugaaaaaaaccaaccaaacaaaaaagaaugguuuaaauguaucucuacacagauauauacauguauuuuuguuugaagauaugggcacuacuggcccuauauccaaugcauggcucuauacccauuauacaugaacagaaugaacuugacuuaguauguuuucaagaagcaacacccccaaacagaagaaaaaagaugaagcuaggaauagggaugaccauauuuuauuuauauauguaugaacuucuccaaaauaaggaaacuaaaaaaaaaaaaaaaaccucagcaggaauguauauauauacauaugcacacacacacuuauguacacauacauauacacauauaauaaucacacacauauacacaugcacacacauacauacauacacauaaauacauacacacauacacacacacauacacauacauacacacgagcacauguacacacacauuugguuuuauuuccugagacagggucucauuauguuaccuaguuugguuaugaagauccucaagauuccucucucuugacuucugggauuauagguaugaaaaaucagaccucacuuauguuuuaauuuuuuagaauaugugauaauaaaaaugaaauuauuauacgauuagguuccaagcaaauauacuuuuaaaucacauaaauuuuuuuccauuuuuuauuagguauuuagcucauuuacauuuccaaugcuauaccaaaagucccccauacccacccacccccacuccccuacccacccacucccccuuuuuggcccuggcguuccccuguacuggggcauauaaaguuugcaaguccaaugggccucuuuuuccagugauggccgacuaggccaucuuuugauacauaugcagcuagagucaagagccaccucacaccagucagaauggcuaagaucaaaaauucaggugacagcagaugcuggcguggauguggagaaagaggaacacuccuccauuguuggugggauugcaggcuuguacaaccacucuggaaaucagucuggcaguuccucagaaaaucggacauaguacuaccggaggauccagcaauaccucuccugggcauauauccagaagaugccccaacggguaagaaggacacauguuccacuauguucauagcagccuuauuuauaauagccagaagcuggaaagaacccagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagcccaaaaccuaggauacccaagauauaagauacaauuuccuaaacacaugaaacucaagcaaaaugaagacugaaguguggacacuaugccccuccuuagaagugggaacaaaacacccauggaaggaguuacagagacaaaguuuggagcugagaugaaaggauggaccauguagagacugccauauccagggauccaccccauaaucaagcauccaaacgcugacaccauugcauacacuagcaagauuuuauugaaaggacccagauguagcugucucuugugagacuaugccggggccuaaaucacauaauuuuaaaaugucaguuuuuacaauaguucagaaauaauguucuuuguaauacuugagacuuccuuagaagcuggcaauuuguccagaauccuuccauguucagagaagucaagacgaugucaguauuucuaguaugcucuugacuuguuauucuaaucuggaauuaggugcuguguugcucuguuguccccuuggaaacuggguuuagggugagcagagauuuccuaaucacuggcaaguggguugauuaacucucaaacaacuacaaugcuaauuauuugcuuuuccauaagauucauuacaguguucucucagguaaugaucuucucuugugcuuuuaaaauauuguuguuuaguuuaagaauucaacuucuauguucagauuuucacauuuuaagucuaagaugcuaguguguuucuuugaugcuguagcagauuuccagcaauaaccccguuuuaugugucugaacaaauacguuaucuaguuuagcauggcacagaaagaaggcagaaagggaaagggggaagggaagagaugauaggauugcaucagaaaaagaaguggguaccuccaagcagggaggauauucaagcaaaggggugccuaaauuguauuacuaacucacaacuggauuaauacaugaauuauuuuuucauuuaagaacaaagcuaccugugguuuaauauuucuugucacagcaguaauaccaaccuguaugagauaagaaauaccuugucaaacaaggggaaauguauuucucaaggucuaaggaucauuaucugucucuucacuucuauggacuucaguuuuuguaucuauaauauaagcugguuguucuaaaccaguuacuggaggagggucaggcuaagaaggcuaguggugacaggauuuucagcaguguauccagacucacaaaacuucacagaugcuccugugacgguuuguauauucuugggccagggaguggcaccauuuggagguguggccuuguuggaauaggugugaccugguuggaguagguaugucacuguggugugggcuuaagacccuaguugccuggaaguuaauuuuccacuagcagccuuuggaugaaguagaacucucaucuccuccugcaccaugccugccuggaugcugccaugcucccaccuugaugauaauggacugaaccucugaaucuguaagccagccccaauuaaauguuguuuuuuauacgacuuaccuuggucauaggugucuauucacagcaguaaaacccuaacuaauacagcucccuugaaucacagcuacucccauuccaaacccuugcccuaccccucagaaaaggacuaaaggacagaaacauacaguacuucuuuuuuuuuuuguccuggaaaugaucaaguccaugccccauaugcuuagcacagccuccacaaccaugccaaguucuguacaucucuucuagcaaugaaauucuaggauuccauagcugugacuggaagcaagugucuugacauccaucucaugcccuuugcugcuggaaagcaucacuguuuacuccuugcuacccuacaggggaugagugaggugugugucugcaggggaagugggagacauugucccaucagcccugcagcucacagcugcaugaaucuaucugugcucuugcuuaaaaaaauacaucagaaaauauaaaggccucccuugucaucuugaaggcugucuguuaggggauauguguaaagaugaacuaaaaagauguguagccugcauuaugcuucauuuucugagucaaagacguucucuggcaaagugggaacugaguggucagaacuuugcaacagcaaugaacaaucuuugccagacaaaguguuggaccagaauuugaaaacuugucaauaagaucgccuugaugucaguuaacaacugccuuccaaggaauuaaagugucugcagaugccaggggacaaaugcuucgguuuuuucccgucuguuaaaucuucuuuuacaaauguuagggguucuggccuucagagcauuuguagucacaaugaugacuucuuaccacagcucagaugaccacagucacucacaguuacaaagucccuuuguccuuugcccucggcuuccacucaucuaauuaaucacaucucaaaacccaagaaguaauuguauuaaaaaugaggaggcaugccuccaggaaugucacgguggcuuucuguugguuugcuugauagcaaacagacaaugugaacaugguucaaaugaacuauauaauguuguugguaggacacagagugaagguucuacugcugaugaugggcacaaaagauguggauuaauaucuauuaaucuaucaucugucuaucugucaucuaucaccuaguaugucuaucaucuauccauauaucuaucacuuacuguccaucucauaucuaccaucuaucuaucuaucuaucuaucuaucuaucuaucuaucuaucuaucuaucuaucuaucuaucuuauaucuaucucugcucuuuauaucucaacuuaauguaguaauuugaaaucuucauauuagacuuuaacauaacaaccauaggaaaaauguuugcucauuuacuugagaucuaguggauggaggaguagaggaaaauaaagaucuggauuuuccagggacagacaaacaucaaagcaaggaggaacaaugcagaccuucaaagggacgucuuuuuuccuauaagcuuuucuuccaucuaaugaguguugcugacuauucacuaaucuauucagcgacauaauuaugcugggguuuuuccuucccuuaucugcucucacaggcuucugugaacaucugugccaugugugcaggccucuuccaagcaggaagccuuccgaagaggcuguacucucauaaaaguuguaaauacauuuaagaaauucucugaggcuaggaagccaccugaucuccaaaguaaggccucucaucauaucagccauaaauuaaggaaggagcgggcaggaggauaaagccagagggaggagacgcucugacaaaagggagguggugagugauugauggaaaucaggugauuaacggaacauggauuuuuaaaaaaguaauaaagagugugucccuagggugggaaauaggaaccaacaagaacaaauaccaaauuaucuaaacagaaaaagagcagaacaaaucagaacaacagagaaauacuuaguaccacauauggguuauuuaaaggacauaggggauuugguaacucagcauuuaggagcuauuugucuaagcaaaaauaaguuuauguugccugguucugugaaaguuacuuacugauaauuggccauuuagagaggagaacucacagccauacagguuuuccaucagcugaguguuuccuucuacaagaaauucaauuuacagcacaggaguucacaagaauucccagcucuaggguucccucacuaaugacaugagcaccuggcuuucagaaaucuagaccuggcuccccaggauaucaugcuacauggaaacuguuugugcacaaacuaaacaugaggcacacaggcaguugauaaacacaagcuguucuaaaaauucuucaugguacuagaagugcagacaaaagucacaaauggagggagaugcccauuuuuucuucacaaaagcugacccauacugauacaagggcaaaaucccauaaaauagaagcaacacaaacaacuggaaaugaaaucucucucucucucucucucucucucucucucucucucucucucucucucucccucccucccucccucccucccuuccucccucccucccucccuuccuaucccucucccucucccuccuccucccgcccuguguucaugcguucauuguuugcauaacugcagacaggaaccauuuguuuaaguagaggauaagaugaggagagcagcuauugagauauguaaggaacuccaagcacauucagaagcuauugaaacaggucagacauauauacauaagagacauguacacauaagaaggaggaaaaugugucucucaacaugaguuuugacucaucguaucugucugaauaggguacaucacuccauguugaccucuaaugccaugacuaggauuaagccauuuuugccaacuugcuguuuaauauauucuacagacaucuagagaguagacaaauggauuuauuuuaguaauagcagagcauuacugucuagaaagacauaauauaucuaagauauaacaucucagaauaagaaaaaaaaaaccagauaguauggaaauggacaugcuucaugcauaagcaaguaaaaaauaauugacccaauucauucggaaauaucaaucuggggagauggcuuaguggauaagaguacuuucuaugcaagcaugaggacauaaccucaguaaaaggcugagcauauccguguguaccuauaacaaguaucugcaguucucaggaacucucuggguaaucaggcuaacuaaaacagugaacugccacuucagugagagacccugucucaaggcaacaagacagauaguaauagagggagacacccaauguccuccucugucuuccaaacacacacauauggaggcauguggguuaaaaugguaccugcuacagggcuagggccacuaauggaggcagaugcgggaaguuugacugcgcacaccucacaugcucugcugugagaaaccacaggaccccugcucugugggaaggggaagucacagucugagguccccacggaccugcuggagucagcucuggggucccagacagcguuguaugccuuggaagagcugagaaccgagugcgggccugcaggcagacucuggccuggguccaaaggguaaaggacagaaggcuuuguucccccaaagagcccuagaagauggauuagguugguggagacugucugggaacacugagaggcuucccgcaggagacuagacucggcucagcagaggaagaccugcuccacugcuccagcacagcagauccugaugagagcaguccacuguuuuaagguguuuauuguagaaaggcauagagggagagaguagaaaagcagaggauggccauggccauguggaggggggaagggaauggggagagagagaggaguaaaggagcaagaggcaagaguaagagcaagaggguaagagagaggaggggacaaacagccccuuuuagagugggccugucuguugccagguaucuguggggaggaucaugccuggauguucucagguaacugugggaguagaguccagucagaauaccagggacuugaggcauugcccuacauggaugauggccacacaccucucugugggggcuguggaagguuguagcugcaacagaagccaggggcccaaggggcguggccaaacaccugcugucccucuuagguggaagucaccuaccaggucuuuggaggucaaggcccuagcucgaccaagaaccaggcugucugugcacagcucacagucccagagacacauacccacacauacauaaauacauugcacauacauacaccauuuccuuauacaauauaccacauacacauaugcauaugugcccauaugcaugcaugagauaaauaaauagaaaauguugggaaagaugaauagaaaaaagaauuucaauguuaugaaauucuacuaauaauaaaauugaugauagagauggauggauggauggauggauggauggauggauggauggauggagagguagguacauagauagauagauagauagauagauagauagauagauagauagauagauagauagauagauagauagauguagaugaauggguggaugauauggauggauagauauauagauugucuuaaucaggguuuuacugcugugaacagacaccaugaccaaagcaacucuuauaaggacaagauuaauuggggcuggcuuacagguucagagguucagaucaucaucaucaaggcgguagcauggcagcaucuacguaggaaauggugcaggaggagcugagaguucuacaucuucaucugauggcuccaagagaagacuggguuccaggcagguaggaagagggaauugaagcccaugcccacagugacacacauaauucaacaaggcuacacuuccuaauagugccacucccugugccaagcauauauaaaccaucacaaauaaagauacagauguagauacaaguacaauagagauacagguacagauacagauauagaaggauggaugaauggauggauagguggaaaagauugcucacugaacucacugaauacuuaacaaugagacaaucaguccccuauuuuaucauccccuuuguauuaugagacugucucugaggaaagguaaauuucucaaaguuguucagguagugagugguggaauggaauuugauuaugggaaauauguuagguuggcuugauguacaccugaaaucccagcacacaaguggcugaggacuucuaugugauuagcuagccugggcuacaaaaucuguauuagguuagccugggccacauauuaagucacuguuucaaaaauaaacacacacacacucucucucaugcacacacaugcacaugcaggcgugugcacacacacacacacacacacacacacacagacacaaacuauaaaugacccccaguagaucuaacacaaaggugcuaagcaaaggagaaaaggacuaagcaaaggagaaaaauagaaucuucauuccauguuagaagcaaugaaaaaacacuagaggccuuuuacuuguagacaagcagcaagucgaacugcuuuuaggacauuaaacccaugcauauuaccacugacauuauuuggaagaaaugauguucaaccauguugaagaagagagcauaauagugguucugugacaggaaauagaguuggaaagggaaacagcaagaagcuuaaugggguaggaagcagugaaacugauguagaggaauuguuccuguugcuucuucagcauacuaaguaacuacugggcaaaauacccccauggcaugcuucagaaugacuagaaaaauacagaauucccaaaagacaagaauggcugacuguugaagacuuggaaauaugcauuaccaugauuuaauuaucacacacauaaugugugcucuuugaauuauaauuaaugaggcgcaccacauuaagcugcagaauuuuuuuuaaauaaaaacaaaaauauccaugcuuuuaaauuuuauuucuauuuuuacuuuauguguaggaguguucugucuacuuguaugucugaacacgacaugcaugcuuggugcccauagaggccagaagaggacaugaaaucgcacagaagcagaguuucagaugguugugagccucugugugagugcuggaaauagaaccgguguccucugacagaacaguguucucaacugcugagcuguuucuguaacccaacugauuguucuuaagcugucauaguaucuaauucaccagucacaaggcauguauauguaacuaaacuuuaacuacauacgugcguuuaucuguuauguggaaaauguuacaaaauccauugagaauuauuucagacgguugagacagauuaggaaaaucuguguuagcugaaccugauacugacugugaaauaccuuguauaagaugguucuucuuuuuugcucucuuauauuccuuagaacauagugaauaucgcuauauggguggcaggacuaugcaagcaggagaggagaaaaaaaaacagauuccuagaauacugugagaaugagaccacucaaauguauacuugagucuccuuaacauaaggacuaaaaagcccaacagauuagcauauaugcccucaaaauauugcugaguucacaagauuuaauaauguuccaaaaaccuucaugucuuguagacccuuuauguguaucauguaagguugagacaaacugcggucuccacauuccugaguuuuauggcauaaagcaguucuuccuuccuagcuuuagacaucugcaggagccaacuucugugaacuuuucgcaauuucuucccagaaugcugagaaaagcuguuacuccuugcucuacucaggucagaagguuuaaauuccaggaacgagaugggaaugagcauuuaaggcagugucuuuguuuaggcaacaguuuucaucuccaggauccaucugcagauucaauaacauaggccuaaaauauucagggggaaacccugcauuuacacugaaacuauagauuuuuuuuucuucacuaccauuccccaagcaauacacaugguggcaacuuuuuacaccacauuugcaucaccccgaguagaaguaaccuaaugauaaaacauccaggagcauguuuuacaggaaguaaacauuacaguuuacaggaagacacugucggcugccccugaggaugcucgggcauccauguagcaggcaucugcaaagauccugggccaauucuuuaguuacugacaauuugcuagcauucucucacuggauacuagaacauugauacaauuaggucuucaacgaagaugaacuaagaauucugugugcuucaaauucucugcuaggacuggauuuuauuucuuaagagaugugauucacauuggcuuuucuuuaaaaaaaaaaaaaagagagaaagaaagaaagaagaaccuguaauuaugggcuuaugguuccauguggggaacaaagacggcauaaagaaagaaaacaucaucaagaagcugcuuaucgcuggauguauaaaacuggagcagaccaaugaugccaggugcacauauacuguaacaaaacuauaauuuaaaucaagcuauuaaaauacucaaaagaaaacaaauuuguguuuuuaaaauucaucuuuaaaaugagauauuaccaguacuauuaacaauacacuacaaaauaaaacacuuuaagcauugcuucaguuaauaacuacuggaacuuccucacagagcaagcaugaacaaggcucaaggauggucuuucuuuauacaauaugccaaugauuuuuaaaaacaacauuuacaaaagguguguaaaugaugguguuagagaggccaccugucugugucuaccuguggucagcacagcacuucuauuccccacuuucuguuaccugccacacuuaacagucauauaaaacuuggccaucuuaugaucaguaugcggugugugugugugugugugugugugugugugugugugugcguguguguguguguucagguauacacuuauacaguccauaugggggaacagacaucaaccuugcucuguacuuugugaauugaacugucuucccagaucggacuaacaucuucuugggcacaaaacccagaauacuuuuucuuaagcuuuauuuauuaauuaauuauauauaaauacacuguagcugucuuuagacacuccagaagaggaaucaggugacuugaacucaggaccuucagaagagcagucagugcucuuaccugcugagccaccucuccagccagaacuacuuuuucaagguacauaaccaguuagucauuugaaugucagacaaggauaaggauuuauuaguccaaccacccagggcuuauauauuauggcugcaggacagaacuuauucaaauaauuucacuggucacauaacugaauguaaaggggacacauucuacuggcuguggucaaauaugauuguugcugcaauagauuaagggccccagaagugcccuuauuuaggucagugacuaaaugucauuccagaugauuuuguucuucacgggcaaggucuccaaggugcuggaugucugaaaauguagccugcacaaagguauaaauucuaaauugcugucaccuuugggaaugauaagcacuuuggucaggaaaaaucucauccuucuaccucaugagcaagacagcaacagaauucagacuuauagaacagaaagaaaauauagaaagaauucucaauauuugcuguaaccucaaauuauccaggaaacuagaacugaauuuaggagucauacagauuuugacugccaauugucaccuaucaagagacaaauaagagcuagaaaaggaaacugaacucaagcuaccccacauauuacuaacaaugugccuagugaccacuccaguggagauagcuguaagaagcagguuaugacauugugauucuaugucuuuuuguuuguuuguuuguuuggcugguuucuaugucuuuaucucuaugguuucuguaguuacagccucuaaguguuacuuuccaaaaagugaaugccugaacuuaguaguuaucaaccuacacuuagggaagaacaauggaaaucaauacuacugaauaaacaaagaaucugauguuuacccaaauaaauauuauuucuaguuuauaaguuauagauacauuaucggcaaauaccuuugauuaauuuuuggagcaucuauaggucauauaaauucaauaugaaauguuuuccauggguuuauguuuggaaugcuugguccauaucucacgauguccuuuggggaagcuauagagguuuuaggaaguuagaguugaaaguuggaagacgaaggucacucaaaguagauauuugaagauuuaucauggcuacuuccuguauuucuaugugugcuucuugcccuuaauaaugugaacuaagaugcugccacacccuuccuguuguaguggacucuacccucugauggcaaaagcuccucccucauuccaccaggcauucugucacaguaaagcaaaaguaacuggcauacuauguaacagggccaggagccauguagcuuuugguuuugcuuucuaugguacuggagauggaucugcaguccuguguaugcuaggcagcuauucugccucagagcuaucugucccccacccuuacccucugugugucuaugcacuuugucuuuaucuguaauaagcacaagcugcuuuucucccugguguggagaaaauggacuucuuccacaucuugcucagaaagaaugaggaagagauaagucugcugucccagaaagcauggcuuuaagcucugugccugccauuuuccauuccucuggacugcacauuccucuaaggaagcccugguuacuucuggggucuggaucugaccucugucucaaccaugucuagugcguccuuacuucaccuaagccuugguugcccccgcuacagagcaaacauaauaguagugcaaaacccuuaagaagaagcagguuaauaccugcuuagcgugggccugacucaaacggagagcaggcacaaacacuguaccauugcaacgagucucggcugaucuuggaacucuucacaccagucagauucacagcuuacaauaaacuuuaacaaacacuaagaaauccaauuuauaagcugaaagccaaaagcagagcuggaauucugagccucacugucucacacugagccugagaaccaggcagcaucgagggacccaguuguacccuuuaccuguugcauguaacuguccgugcaccuguuaaaguuuugaagcuuugccagucaauuguuaaucacauuuguuauuuaaaauuaacuaguguaguuaugaaaaugauaagauaucacaaacaaauagaaauauuuuauaugcaaugcuuacauugaacuaauucuacugcuuuauuccuaggauuauguacacuggggugagugaggcagcucagcaguauaugugcauuuucaaaacuugaaaaccugacuucaaucccuaugacccaaauauggaaagcagaaaacugacucucauaaguugugcucuaaacuauacagcuaugccaugacacaaauacaaggaaacacacacaacacacacacacacacacacacacacacacacacacacacacugaaauagacuaaauguaguagaagucauuuuuaaaaugaucaucugcacugauugcauauggaaagccucacccuucucuucugccagcuuucuagacagaaaucagccaaaucaguaaagacaacauuaagaauugguauuuuguugauuagcaaggguuaagaacagacaaaucaauuugcuguaugucuguagcuguuacauacugaacaucacaaaaggaaauaaguaugauuuucaaguguuuaaaccuauuguacaacacugauaacagaaaguacuuguucaucaacugcucuuuuuuuuuuuuuggaacuuuuuuauucgauauuuucuuuacauuucaaauguuauccccuuugcugguuuccccucuggaaauccccuaugcaaugcccccucccccugauucuaugaaggugcuccccuacccacucaucuacuccuguuuccccaucaugguauuccccuacacuggggcauugagcuuucacaggaccaagggccucuccucccacugaugucugacaaggccauccucugcuacauaugcagcuggagucaugggucccuacauguauauucuuugauuggugguuuaguccuuaggagcucugggaggucugguugguugauauugucguucauccuaugagguuucaaacuccuucagcuccuucaguacuuucucuaacuccuccauucaguaccccaugcuuaguccaauacuuggcugcgagcauccaccucuguauuuguuaggcucacuuuuuaaguagccaggaauaucccacacugcguauacccaguccaucaggauugcaauguuacaccaaaugaaaggcuucuggugguauuuucuuccucauuuuugaucucuaccauucccaggguugacugaggugacaacaugaaggaagaagaagcagugucucuaagagccaugguggcaggaagcacagcaucagagaugugccagugaagcaguggccaguguggucgcagcugcagcagcaacagugaagccacagaagcaaucugacaguggccauaacagggacaggcagucuaaggauuucagaguggccaugccucacauaguaagugaugguggaagaaacggaaugcagaaagcugcagcuaaagagaacuguguggcuguauaauagccacuggaaguccuugccacuguaagggugccauaagauggucaggccuuaaggaugaagggucucaaacaucugugcuccagagcuggaacacuagccacugucagggcugagaauccugaucccaaacucugaaaccuggaauguuagccaccacuaaggacuagggaauuccaaucuccugggccuccuacacaagcacuauagcaaugguuaccauaaggcuaaugguaacauugcuagaggcauaucccauagcuacauuccccacaggacucaggcccagcacuagaggacaacaugaaagcuauaacacuggacagugccaccugcugcugcacacagcugucagaacccaaagguugcaaaaucaaccuaggaccagaguuggaaaaucuucugcuuacccacgauuccuaccugggauaaaagaaccccagacaucugaagcaagaugaagagaaguaaggaaaauucucaaggaaaagaauacaguaaauauuggccuaaaccauccauguaguggagauagcaugagagaauguauuaaauugcuuuagcacagugauuaaaacaccaaaggugcucaacaaauguuauccaccacuaugauuguauuauuauuacacccccuacaaagacuaucuuccagagcuuucuaugguguggaaauagggucaaggacacuucaggaaaagagaagaaaauacacaagaaauugaaaaacuauagccuaaugugguaguagcaagagcuuguagaacauuccauaaaguccaggucaggaagggcuaaagaagauaggguaagugguuacuauaugaguacaaacacacauccauuccacacuuacuucugaaaagaacaaauuaauugagucgucaaaguaaucacucuucuguuucuguuucugacagguaguguaaacugugcuucuaauauauuugugcaaagccuauuagggaaugauaaagcaggcaauauucauauauucagcggucccuuaauuguuguuaaauccuaacaacaccuaaaauugaucugcuccaagauuuacuacugugacaaacaucuaccuggaaaguguguaugguaauuaaggggaacgaccacagacuugugacaaugguaagcuuaugaaugagauuuaaacucuuccccaagggaauuacugggugaugcuuauucuguagaugaacaauagcaaugacuaaugagauuuuuuuuuucuaacuauaggagcuugacuuagcccagcuguaucagguaacaaauggaugcccaacccaagugguccagcccaacccaagugguccagcccaauccaaguggucuagcccaaccagaaaauucuuugugagagguaauuggcaugccucuucagugaccuagaaaaugaacugcaagucaagcaggacacaauaaaccacuacaaacugacaugaaaauuagaacuuaguaaaacaaaacaaagaaaaacccucaaauuaaccacaauugaauucaaccaaauuagagacacaagauaccaauagaauugcauugaagcagauaggagagaaauguuuucuuccuuugguucuuuuuaccuacagucaauuauuuggaucuaacagguaaguuuuauuagucuuucuuguccaggaaacaaaguacuccuggccagcauuagaaaacacagaagcaaauguaaggcacuguugauauuguagaacuuuguucccuaaaccacagaggcauugccugggauacuguuagaauagacuccugaaccucacaccccuuaaaccagaauuugcacuuuaaagaaaauccccagcuaauccuugugagguauaaggagaaguaaauguucuuauagucauucauuaauccaauaaauaaaccuuuaugaucugcaguguccaguaaaggggagucacauacaaauauuaaauuugaaauaaaauaaaacuaaaaugcauuugcaugaaccccauuuuaaguguucaguuagcaucaguggcaucuccaucaccauagaaacuucaauaaaagacauaucacugaauaggaugaaaaaacuuauacugaugaaguuuacauucuagaaauagaaacaacuaggaacacaauaaacauaacaagugacuguuauauccaauuacccauauacagauauuuaaaugcuaaacacagaagagagaucagagggguuguggccucacugagagaguuagagaccaugggccaugacaaguguuccacaaaaaaaguucagugucuguauaaagggcuaacauucuugaggaacagcaagggacccacaagccuaugaaauauugagaagagaaggugauacaaaaggaaggaagaaagagugaggaaaggaaggacccuagguagggaaaaggaccuucuucccuacaucagggauuuguaauuuugguccaauugaaagucagagucgaucuucuuucugagcccaguggaggccacuaagugcuccagagggcucuccacaccacaagaccucaggaucaccuuggaaucaugagugaguggaaugcaacaucagcuccaaagaauuguggagggucuugugccagcaggaacaggaacaaaggaacccugcccgaacaaaggcugggauauucagguuggggccagccccaccaucuucugcauaaaccuggucuagggcaucuagggcaccagaggacuguccacaccucaggaccccuagcacacccaggaccuccugaucaccugagagcacguggucgauagaagcaacagagcuucuuggucagguccugucaggccuacauccuuagccaggagguagagcugagacccagacaccugggcaccuuccuugccagaggagagucagccuacagggagaauugugaccccagaacucaggagguggaucagagcuccagacagcuggacgccugcccugaaagaggagagcuggccugcagagaguccucuaccacuggaacucaggugagaguuggacucccaggagugcugacagaggcuaaaagaaucagaggaggaucaagcuucaacaagagacagcuugaacauuaacaccagagauuuccagauggcaaaaggcaaacguagaaucauacuaucagaaaucaagaacacugagcaucaucagaacccaguacacgcaccacaacgaguccuggauaccacaacacaccugaaaagcaagauguggauuuaaaaucauaucacaugauggugguagaagauuuuaagaagggcauuaauaacucacuuaaagaaauacaggagaacacugcuaaacagguagaagcccuuaaagaggaagcccaaaaauuccucaaggaauuacaggagaacacugcuaaacaaguagaaguccuuaaagaggaaacacaaaagccccucaaggaauuacaggagaauacugcuaaacagguagaaguccuuaaagaacuacaggcaaacacugcuaagcagguagacgaaacacaaaaaucccuuaaagaauuacaggaaagcaaaagcaaacaggcaauggaauugaacaaaaccauccaagaucuaaaaauggaaguagaaacaaugaagaaaacacaaagggagacaacucuggagauagaaaaccuaggaaagaaaucaggaaccauagauguuagcaucagcaacagaauacaagagauggaagaaagaaucucaggugcagaagauuccauagggaacauggacacaacaaucaaagaaaaugcaaaaugcaaaaauauccuaacucaaaacauccagaaaaugcaggacacaaugagaagaccaaaccuacaguaaauaggaguagaugaaaaugaagauuuuucaacuuaaaggaccagcaaauaucuucaacaaaauuauagaagaaaccuucccauagcuaaagacagagaugcccaugaacauacaagaauccuacaaaacuccaaauagacugggccagaaaagaaauuccucccaacacauaaugaucagagcaacaaauguacuaaauaaagauagaauacuaaaagcaguaagggaaaaaggucaaguaacauauaaaggcagaccuauuagaauuacucuagacuucucaccagagacuaugaaagccagaagauccuggacagauguuauacagacacuaagagaacacaaaugccagcccaggcuacuauacccagcacaacucucaauuaccauagauggaaaaaccaaaguauuccaugacaaaaccaaauucacacaauauauuucuacaaauccagcccuucaaaggauaauaaagggaaaacaccaacacaaagauggaaacuacacccuagaaaaagcaagaaaguaauccuuuaacaaaacuaaaagaagacaaccacaagaacagaaucccaacuuuaacaacaaaaaugacaggaaacaccaauuacuuuucuuugauuucucuuauggacucaguuccccaauaaaaagacauagacuaauagacuggcaauacaaacaggacccaacauuuugcugcuuacaggaaacccaccucaggaauaaagacagacacuaccucagaguaaaaggcuggaaaaaaaaugguccaaaaggaacaagcuggaguagcuauucuaauaucgaauaaaauugacuuccaacccaaaguuaucaaaaaagacaaggaagagcacuucauacucaucaaagguaaauucuaccaagaugaacucucaauucuaaauaucuaugcuccaaaugcaagggcagccacauucauuaaauaaacuuuaguaaagcuccaagcacacauugcagcucacacaacaauagugggagaguucaacaccccacucucaccaauggacagauccuggaaacagaaacuaaacagagacacauggacacuaacagaaguuaugaaacaaauggucuuaacggauaucuacagaacauuuuauccuaaaacaaaaggauccuaaaacaaaaggauauaccuucuucucagcaccucauggaaccuccuccaaaacugaucauauaauuggucacaaaacaggccucaacagauacaaaauuauugaaauuaucccaugcauccaaucagaucaccaaggacuaaggcugauacucaauaacaacauaaauaauagaaagccaacauucacagggaaacugaacaacacucuacucaaugauaccuuggugaaggaagaaauaaagaaagaaauuaaaggcuuuuuagaguuuaaugaaaaugaagccacaacauacccaaacuuaugggacacaaugaaagcaguccuaaguggaaaacucauagcccugaguaccuccaaaagaaauuagagagagcauacacuagcagacugacagcaaaccuagaagcucuagcaugaaaggaaacaaauucacccaagaggaauagacagcaggaaauaaucaaacuuauggcugaaaucaaccaaguggaaacaaaaagaacuauucaaagaaucaaccaaaccagaagcuguuuuguugagaaaaucaacaagacagauaaacccuuagccagacuaacuagagggaacagggacaguauccuaauuaacaaaaucagaaaugaaaaaggagacauaacaacagaucuugaggaaauuuagaacaucauuaauccuacuacaaaaagcuauacucaacaaaacuggaaaccuggaugaaauggacaacuuccuagacagauacaagguaccaaaguuaaaucaggaucagauuacugaucuuaauagucccauauccccuaaagaaauagaagcagucauuaauagucucucaacaacaaaaaagcccaggaccagauggauuuacuacagaguucuaucagaccuucaaggaaggccuaauuccaacucuacucaaacuguuccacaaaauacaaacagaagauacucuacccaauucauucuaugaagucacauuacucugauaccuaaaccacacaaagauccaacaaagaaagagaacuucacaccaauugcccuuaugaaaaucgaugcaaaaauacucaauaaaauccuugcaaacugaauccaagaacacaucaaaaugaucacccaucaugaccaaguaggcuucaucccagggaugcaaggaugguuuaauauacagaaggaaauacaucaauguaauccacuauauaaacaaacugaaagacaaaaaucacauaaucaucuuguuagaugcugagaaagaauuugacaaaauccaacaccccuucaugauaaaagucuuggaaagaucaggaauucaagacccauaccuaaauauaauaaaagcaaucuacagcaaaucaguagccaacaucaaaguaaauggugagaagcaagaagcaaucccacuaaaaucagggacuagacaagguguccacuuucucccuaccuauucaauauaguacuugaaguccuagccagagcaauucaacaacaaaaggagaucucggggauacaaauuggaaaggaagaagucaaaauaucacuguuuacagaugauaugauaauauauauaaauuacccaaaaaauuccaucagagaacuccuaaaccugauaaacagcuucagugcaguagcuagauauaaaauuaacucaaacaaaucaguggccuuucucuacacaaaggacaaacaggauaagaaagaaauuagggaaacaacacccuucauaauagucacaaauaacauaaaaugccuuggugugacucuaacuaaggaagugaaagaucuguaugaugagaacuucaagucucugaagaaagaaauugaagaagaucucagaagauggaaagaucucccauggucauggauuggaaggauuaauauaguaaaaauggcuauccugcccaaagcaauauacagauuaaaugcaauccccaucaaaauuccaacucaauucuucacugagauagaaagggcaauuugcaaauucauuuggaaaaauaaaaaaucuaugauagcuaaaacuauucucaacaauaaaagaaccucuaguggauucaccaugccugacauuaagcuguacuacagagcaauugugaugaaaacugcaugguacugguacagugacagacagguagaucaauggaacagaauugaagacccagaaaugaacccacacaccuauggucacuugaucuuagacaagggagcuaaaaccauccaauggauaaaagacacauuuucaacaaauggugcuagcacaacuggcgguuaucauguagaagaaugagaauugauccauucuuaucuccuuguacaaaacucaagucuaaggggaucaaagaccuccacaaaaaaccagagacacugaaauuuauagaggagaaaguggggaaaagccucaaagauaugggcacaggggaaaaauuccuaaacagaacagcaauggcuugugcuguaagaucaagaauugacaaaugggaccucauaaaauugcaaagcuucuguaaggcaaaagacacugucaauaagacaaaaaggccaccaacagauugggaaagaauuuuuauuacuccuaaaucugauaggggacuaauauccaaucaauauauacaaagagcucaagaagcugaacuucagaaauucaaauaaccucauuaaaaaugggguucagagcuaaacaaaggaauaacaaacugaggaauaacaaagggcugagaagcauugaaaaaauguucaacauccuuuauaugcaaaucaagaaacccugagauuccaccucacaccagucagaauggcuaggaucaaaaauugagcugacagcagaugcuggugaggauguggagaaagacgagaacguuccuccauugcugguaggauugcaagcugguacaaccacuccuggaaucacucuggccauuccucagaaaacuggacauaguacuacugcuagauccaguaauaccucuccagggcauauaaccagaagaugcuccaacuaguaauaaggacacaugcuccacuauguucauagcagcucuauuuauaauagacagaagcuggaaagaacacagaugucccucaacagaggaauggauacagaaaaugugguacauuuacacaauggagcacuacucagcuauuaaaacaaugaauuuaugaaauucuugggcaaagggauguaucuggaguauaucauccugagugagguaacccaaucacaaaagaagucacugauaaguggauauuagcccagaaaccuagaauacccaagauucaacuuccauaauacaagaaaaucaagaacgaagaccaacacguggauacuucauuccucccuagaauacggaauaaaauauccauggaagguguugcagggacagaguuuugagcuaagaugaaaguauggacuaucgagagacugccccacccggggguccaucccauaaucagcuaccaaaugcagacccuauugcauaugccagcaagauuuugcugaaaggacccugauauagcugucuccucugaggcuaugcuagugccuggcaaauacagaaguggaugcucacagucaucuauaggauggaacacaaggcccccaauauaagaguuagagaaaguacccaaggagcuaaaggggucugcaacccuauaaguggaacaacaauaugaacuaaccacuaccccuagagcucaugucucuagcugcauauguaguagaagauggccuagccggccaucauugggaagagaggccccuuggucuaguaaacuuuauaugccccaguacaggggaacaccagggccaagaagugggagugaguguguaggggugcagggcagggggaggguauaggggacuuuugggauagcauuugaaauguaaaugaagaaaauaucuaauaaaauaaugugggggaaaaaaaagaaagucagaguccuugcaauauuagaagagugaccugauuugacuuaacaguaagucuagugcagcaaaaauggacaagcaagcaauguuugcucauuuucauuagaaguuauuguuagauugaaaaugucccuaugcaaauauccuuguaagggacuuucaacaaguuucaguagccaccuguuaugucuuaaugcauaacacacagaauaaagucauuaaaauuuaucacuguaacaugcaaacaccucagaggcuccaguaauauguguaguugucucuagaucuucaaguuucuauccagaaucuacagacaugcuagugacaagcaccucuugacaguucugaggaaugcaagguaaaguuguuaacuuggcugaaaggagguaucuuguccucaaaaccugccaauuacuuuauuacugaguuucagauacauucuagagaauagaaaacuauuaguuuccaaaguuucuguguuucucuauaugugugcacauauguugaagucagauaucaaccuugggugccauucuucaggagccaucuaccaugugcaugaaacagagucucucacuagaaccuggggcuugcagauuaggugagggaggucgaucccagauaucuaucuugggucacuaccuccuagccagagaauacagacacaugccccugcacccgugguuuuccaggucuggaugcuuucaugacaaguacuuuaucagcugaguguucacccuagcuucauugucuuuccuuuaccaauuuuuaagguuugaaucugcucuauguaugcugccaguucaaugcuagagcuuugaaaaccuggaugcagguacauguaaggguuauuucucagagcuccuggaaacaaggacauacuuuaccaagggagaauauucuuaucuuccagguaauucagcuacagccccaugaacugcaggucaccauagccuguguauaaaaaugucaucauaagccccaaggccaguaugugugaagacagccccgugagaguuauagccaacucaugguccuaaaaagacugagagcugucaccugcagcaguuuauucccuggggaccaccaccaacuguguuccugccacaguucaggcagaaaacugcagcaaggucaccuucagugaauuaaaucaaccgcgcaguaaaucaaggcaugcccggucacugggaacuaacagcucagcugcucauagcaggcgagugcaaugagaaacauccuuuucaugaaucuagaugcaggacucuugagcuacugaauaaagaucuuugcaaucaaaauauggucaauugaauucuagaagccccauccugggggugcucugaccauauuuauucaauuacucuucauucauucauucauucauucauucauuuaacaaguacauaccgaggaccuucccuagucaagaguugggucuugugcugaaaacacucaagucuauguagcacaguuaaagcauucaccaacuccuggcuccuucagaacaaugcauauccuuauuuauacuacauauuuuuaucauuuaggguuuuaccauguguauauguauguguucucaugugcaugcauguguguaagugcacauucacacucagacaucaauagcagauguuucccucaauuacucuccaccuuuauacuugaaucugaggaugucuggucagagagcucuacggauccuccugccuccauuuuccaaauacugggauuagaagcucagacucccuagcuuuucauguugggauggggauccgaacauggguccucaugauucugcagaaggcacuuuaacagguacaccaagucccugaccgauauguuuuuguuugggguguuguuguuucauuguuuguuaauuuguuugagauagggucucugcuacccaggcuggccucaacuucugugcucaaguuuacuaagugcugcagcuauuugugugcacagccaugcuggccuccacuagcuagccaucuacugucaaagguuuguccuuccgaauuauaagaaaacuuguggagagcugugccgugagcaaucgccauuauaagauggcgcuggcuuccacugcgccuaacuaguaaacaagccuuaugcgcaagugcaagagugaacucacgccuagucacugcccaucucgcagcguaguaaaggggugaugggcgagcaacgaaucaggagcugucacgccacaucaggugcugaaaugucacacugcaggcuauauaagcagcgccauuuucccaguucggggucuucccuccugauaaguaagcaauaaaagcuuugccgcaaaagauuccgguuguccugaguguguuauugcugguggggacaaaagcucgggauaaaaacugacaauaaacuugggaaaaugcccaggaccaaccuuauaugcaucacuuuuguuaaaaugagucaagugcagugauuuuauuaugauaacuuuguaagcucaucaagaagcccaaggaaccuaggcuguccuuuuaucuauauauccaguaagcugugaaucucuggaaaacuuaguuaaacuagguggacaucaucuuccucguauaucaauuguaaagauuagauuaaauuguuccuaagggcuuaaauuuuuagaaauggcauaaaauaacuaauauauucucuuaauauuaucuaaguaaaacuggagauauugcuuuauagaucauuugucuaguauuauaugugaauguguaugugauguauauguggauaugaccauauguguguuuuaugaauauauauauauauauauauauauauauauauauacacgagugagcauguguguauauguguguguguguauguugaccaugugugugugcgugugugugugugugugugugugugaugaauauguguguguguaugauggccauauauguguaugugcauaucaugacuauauaugugugugaguguguauguguguguguuugaugaauauguguguguaugcugaccauaugugugugugaugaauauguguauguguguuuaugauggucauauauguguguguguaucaugacaauauauauguaaguguguauguguguguagguuauauauauauauauauaaguguuuauauauauaaaacacuuugguuucucuccucuggauccucuaagcccuagggguugcuuagcaugcuugugagaauggcuuaaaucucucaaagguuucauuucucaugcacaaaagcaaagcaaaugauggggugggaaacagcauuacaauuuaaaguugaaucugagcaaacuggggcugugggagacauacuccucaagggcacuucagaaaugccuuuaaugauucagaggacugggccauauuugcccaaacaaagccuggcucuuugccuggccugugcuguuguguaacagcuuucccuuccuaaaagcagaagcaaugguuuccauguacugucuaaacaauacaugguuuaaauuauuaugacugauaaaaaaagagaaaaacauuuaaauguuucauccagaaauuacaaaaguacuguugggaaaaugugugaaguuuauuaggucacucugggcucuaauauccucagauuauugaucuauaccuguaagcacaauaaauccgagcagccagggaagcggcuucagcucaaaaugagaagacagguuaauugucagaguauugcacuucuuccuggcuugcuuuuguaaaaucacuuaacucgaaaaauucucucucucucucucucucucucucucucucucucucucucucucucacacacacacacacacacacacacacacacacacacacacacauugugacuauucaccaaguguucugugacaaugggaagggugcuaugaaguaccaucuucuggauauggcuauuauacucaggaagccacagcaaccugguuaacuugaacaagaucaagccaguuaugauuugaccauagugggggaggaacucuccagauuuuacuuuuuuuuuuuuuacaguuuucuuuuuuuauuauuauguauuuuccucaauuacauuuccaaugcuaucccaaaagucccccccuccccccccacuccccuacccacccauuuccauuuuuuggcucuggcguuccccuguacuggggcauauaaaguuugccuguccaaugggccucuuuuuccagugauggccgacuaggccaucuuuugauacauaugcagcuagagucaagacagauuuuacuuuuuaaugagcaacuauugccagaugacagcugcuggggaagagaugucaccaagguagcuguccugugcuccaguggacuacuuccaauccaugagcauacgggcaucauucacuugacugaggagguuagaaagaaagaacaaaagagaggagagagacagacagagacauagcgaaggaagaagaaaauggagaggggaacauguugggaugacuggaagggugcugaagaacaguauugagagggaauaagaguauaugucauuguacacauguauacaaccaucauuaauaaauaaagcauaauucuaacaaaagaaaagugguuauugucugcucuagagcacucggguuccaguccaagauccaccuucggggacuauaacuugaccuuaaucuuccugauuauaaaucugugaaacagggaaaacaguaguguuucccaaauccuaguacaaacaauacugggagaacuggaugauauuggauggcauaugagcagccucucucuuucaagaacugcacauuuaacugcaagacuguuaaaguacacguagcaagcauacaaagcuaaagaacaucauuauuuaagaggaguuccugcuacggaaaugaaaaggugaauuucaaacagcucuccaugaaaagagaaaguucuuuguagaauaguugucuaggugauaaaggaaaauaugacaacaauuagaaaagacaucugcaauugguucaugaaauaaucaaccccaauagaaagcaucagugaagagaacaacucacuaaauacaguugaggagcuuuaaaguggaaugaucaaauugucaccugccaaaccuacaggugacuuguggcuucacuaacagaaggucaaaauagcagguguccccugauggugacagcauauaaaguacagccugaggagcacucacacuugcuuaccuaggucaaauccagagaugaguccaguauaagcaaugaaguguacugagaaaacagccaggugacaauagcuaauagcaggccaucuggucucccacagaauaguauguuccgccucugacaggucuacagcagaaauagcaguggggcuauucuagaauaagaaacuuccagagcauauuuaauauaaaguauugaauaagccuuaucugaauuugaaaaaggaaggagggaaaggaggcugucagggaggagggaacagaacagggcauuuucccggaaucaggagaagcagcacuguggaacaagaguaaaagaguaaaaggaaagaauugguucauuugcuauguguggcaauggcacuuauggccagagcuuaacccacuuucugcaaacaacagggaaaggugaacugauggcuccaauucaauuuaaacuaccucaaaagagagaaaggaaagagacagagaaagcgagggagaaaauauacaaaaauguuuaugaguaugaggucugaaugugagcucagcuacacaguacauagggcucagaaccaaauaaaaacacauagacucuuauucuugaguuaccagaauuuuuauccaguagccacaaagugugcguggauuuggaggaugcaggggaucauguggccuccaguucaugaacucuguaugauaucuauauacaugaagugauaaucucugaacucagaugccaaacauagcagggacugcuuguaccgaugccgaguaugguucuaaacaggcagcccaugcaagcccaguggacaggcugagagguaacaugaaacagcaguauaauucagagauggggucuccucucuuacaaagucuuucccuauccccauaucccugcugcagcuccugcucucugccucagaaugcacccaugcauucaguuuaguucgguuuagugcucaucucaucaagguuuaaugccacugcauuaaaacuagcugugcuguuuagaaucuacaccuccugagagacauauaccaagucugugcaagaugccugcccucuugagccucuugguuuacugagcaacacuaugaccaucuuugccuggaaucuacuaugaguauuaaccagauaugaucuccaguuuuucaggaaucuggcgaacucacaacuucugcugucuauauuuuuuuccuaaaagacugaaaauauccacuaaguuauagcaaagcaugauuuccuaaggagaaaaauaaggaaagaaaaccugagcucaggguagccuugcucaucaccaaaagcuaugcucaaaaguaggcuugcucaucaccaauuuucuuccacaaccuucuguggaaacuucugggucuuuauuggguguaggggaauaaagguagugggagaaaacucauguccugccagaguuccagugcucugggcaggcaaacaauggaggacugucccacacuuuccacgcggccccggcugggugucuggcugugggaagcuauggacccagcccacaggguguggacaaggugcaguccuuggucucugggccucauggaggccaaagauaagagauucucagucucaggcaucccagacacugcuggaugcuacagaagagcugagaacaaaauggaggcugagggcacggcuugaucagcccuggggcugaagggaggagagggcagggagagauggggcucugggugguuuccacacaggugagacuccuugaucugguccgaggcuggagcgcaggaaggucuucugggguggggaggugggggagguuagauguggcucuuuaggggaaagccaaucccauuguucaagcacaaacgggccuugaagagcagcaacagucuacgauuuuagagcuuuauuguagaaaagcagagagaaauagagaagguaaaagaaagagagagaccaaccauggccacguggagagagggguaaagggaaagagagaaggaggguuagagaugagaguaagaaagguaagaaaggugagagcuuaaagagaguaaggggccaagaagccccuuuuauagugggcugggcuaccuugcuguuaccagguaacuguggggaggagcauaccuggcuauauagucagguaacuguggggguggagucuagccagaaugccagaagcuugggacauugugugacuccaauuauggaguugagggcucuguggugucaggcaccugucucugcgaacauggcucaauguucugucccuuguagaguuuccuacugggucucuacuaggucacuggagcaagccucauucaaccaaaacaggcugccuuucacggccccauaggucuugguuugggguuuuuuguuuucuuuuguuuuuucugaaauuagaaaauuuauauaauaaaguaaaauaauccucuuaaaacauagcaaagggaaucauguugaugagaauucaagaagcauuugagggucuugaguauauaagaaagacuagucaccaaaguucauauuuucuuuuuucccagauacucacucuuauugaacagacccacuauguggcgacauccuugagcucaggcuaauggcaucugugccaauuaaaguuaauucucuuacaaaaugcaugugccuuccuucucuuucuuccccuucugcuaucuagaugcaaauagcaucaugggccuaggggaaggcagaaacacaaaaugagaaaaaccuggauuccuaaaucaucccaagaggaacgcuccauugccaggagcaacaauaccaggcugcuacaugaaugaagaugaacuccguucuguuuaggcagcauuacacuaugcagucucuguacuaaagaccuuaauaaacaaagcaagucaaacagaagaguaccauguccuaccugggacauucuguugugcuagaaggacagaaguugaagacuaaugaaguuggaaccugaauauguagagaggaagucauaagaaagaggagaauggagagaaguagagacacagaagaaacaaaacuaucaguuaacaguugauauguauaugaguguuuugucugcauauaugucugugcaccaugugcaugugggcucagaaagggcaccauccugauuaguuuugacauuuuauugauacacuuuaaacaauuaaaaauaguggugguugugauggugaugguuguggugguggugguggcugauaagaaauuucugcuggucuaaaaugggaaauuggaggaauuugaaagauuaaagacaaaaugagucaaaacauuuauucaugcuggaaaauuaaaaauucaaggaaaaaaacacauugauugcaacuuuuaucuuaugacucauucaccugaaaauuaaaauguauuaaagaaacaaauauucuaacaaugaucuugauuucaggguaaccagaugcuuaauaaguucuuccugaauuauuauuccauguaauaaauuaaaaagaauaaagacuuagagaacuaccauuuuguaacuacaguuggaacaaggcuuucacccaaaaugaggccauuauuuucagggacaaugaggccaugcaugcaaggcugauggguagacaguauggcaaaguauauaaguaugauggcuggauaaugugaucacacauguaagaaugaugaguggauaguccgacuauauguuaaacauggaaggauaaugggugacuaaggagaucacacauguacacaugaugaaugggcagugaggccacauauguaaguguaauggaaggauugugagacucugcauguaaguagcacaggugaaccaugggaccacgcaugugagauggggaacuugauaucagaaugggcucagaacaucugaaucuaccaauccauguuauuuuuacuuaaugggauacacaucauuuugugauuuauuuuacugugauguaaaaguacaucaaagcaccaauuaugaagucuccugacuuagaaauaucuagaaaaucgaagccauacacaacauacuagguaucgaggugguggaccuaagaaugcacucuucuuggcaccuugacauuugaaaacacacuggagcaggcagcucccuuuacucuaaccuucuucccugaagcaucucaugaaagcgagagaggacauucuuacuauucccugaaaaggccaugcacucucauguaagacaagucccccgaggaccucuuaccacuaaagacauguggacaggaagacacugaacagacaaauggcccuguuaaguuccccacaguguaccucagaucauaaacagcuugccucaucaugccacuccuugaauaccuacuucuuaagcaaaucuagcauaacacucacuacacagguuacccuagggguauuuauuuccuuacuggaagcugcuauaccucacaaaaauuaaauaaauguguaacuuuugguauagaauccucagccaugaaccuaagauguaaagaaaaauauucuuaacccuauaaaaggcaaagcuaaauauugauacccaaucuauuacauacagcaaauuauccaguuucacaaacaaauaauuggcauccuuucagggaccagaugcucagccuuuugauguuguuauacacacaggacacugcaacuuuguuccaacuuagcuaacuauggugauuaugugaucacaauuucaauauaccccaaucucaaagcuuaaacuauaaaaaguacacuuuagaaaucuaugacggagggacuggaaaggugacucugugguuaggagugaguacuguucuugcagaagaccuagguucacaugcaagcaugcucauaaccaugcauaccuccagauccagggcaucuaauacagcuggcuucugcaagcauaaugcacacacacacacacacacacacacacacacacacacacacacacagagccacaaccacacauggcauaccuauacagacacauaacuaugaaaaugucucucucugaggaaauggaggagaggauguuacuauggcaaggauguugacagaaugagacuuuucugccauugccagaccccugcugcucugcagguaucuuugccucuucuucuucuucuucuucuuggguuauuuuuagcuucuauguuucaccgacuaaaacacuugcauuuuuucccuucaaguugcauauuuaacaaaugacgggcccucaagauguuuuugauagauguuuguuguaugaauaauaauuaugcaaaucucaaaccaaaaaagaaauauaacacaugcaaagagguggaaaauggcuaaagcccuucuguacacaguuuuuggaagcuagucugggaaaauuuaucaaggaguugugugugacccuuuuuccaaaguagagucaaaauucaugaggcaaggcagaaguuauacugcauguaaugaugggugagaagcacaucugcucuguggagcugcucuccauacaaaggcucugguaauuuccauauaccaucaaaagauaaaagccugagaaggcaaggagaaguaugucaucuuagagccuaaauauagcuuuucuucaaaccccagugcagagagagcguuaugaguauccauacuaaauaguauuacucuuauauuuugcauccucacacuccuuaugacuuaagauguauaugaaugguccugaggcaucacacaucauuuauugacuuuauccuaaguuaucccaauuauaucccacguaccucacuugacauuuucccagagaugccaaaguuaguugaugcaguggucugaagcucucucucuaacacgccaaagcacccugaguccuuacagucucagaauaaagaguacaaaccucgugaccaguacuagcccaagcaauaucuccucuaaggcucauacugaaagauauggcaggccaaucuugggccuuaucuuuuaaauuuaaauacaacacuguugugcacucuaugaugaagucucaaagcccaugugcauacacauacacacaccucaccucacacacauuccaagucugccacaaaaagauacucuuacaaaagugcaaagggaggagccucucugacugauucuccauuacuaaguggucagucacauagaggcaauguuguauggacugagguuguauuaauguauuuaguuguguuauguauuuauguauuauacauacauacauacauacaauacauacauacauaaauacauacauaaauacauauacuuauaauugauaugauuacacucaaauauauaauaauauauaaaugauuaaugauucagcccacucugagugguguuaccacugggcaaaugguccugagcuguauaagaaagcagacugagaauagcaugaggaccaagccaauaagcagcauucauccauauguguagugcauauauauguauauauguguuuacauguauacauauaucaagaaucuuaaaaggaaagacaugaaggagcauauguaaggguuaaaagggaagaaagaaagggagaauuaugcaaucacauuauaauuucaaaacaaaaaaguuacauuuaaaaauguaaaggaaaugagucucuggaaaaacagaugaaaaauaaaagcauucaacguaaauguccaaaucuguugucacauucaguagacaaaugcauucuguucaauuauauggauuuauaaaccuuccucucuguuucugcgcucaguuugucacacaguggcaccagggcaggagcagccuuuucagcgguacuuugcuacauuaaauuguuagcucuaugcacagagcaaccauggauuacaaaagguucccaggcucugccaucuacugagaggcuaauuacaacuggagcugcuagucaaccuucuauuugggaaaaagugauuguuagcuuuuaugucugucccaaaacccacccugccacgagcauaccacguugagcaaacuauguaacaaacauuaauggauauguuucugucuucugugaugucagaguucauucagaaccaauaaauccaugagcuaugucaguuuaccaaguauguagguuaguuugugucaacuugacacaaacuagaagucaccugggaagaggaaaccucagcugaggcauugccuccaucagauaggucugugguaacaucucuggaggcauuuucuugacugacuauauagguggaaccaccccugggcaaguggcccugaguuggauaagaaagcaggcuuacuaagucaugaggaccaagccaguaaguagcacuccuucauggccucuguuucagguuuugccucuaaauuccugccuuuaauuccuacccuaacuucucacaaagacagaaugggguuuggaaguaugagccaaguaaacuauuuccucuuccaaguugcuuuugauucuuguguguuaucccagcaauagagaagcaaaguaggacaccugguguaguggcuauuccugguugucaacuugacaauauuuggaaugaacuacaauccggaauuggaaggcucaccagugacccuuaucuugaggcuuggagauccuuaucuggaucuugguuuggagaucuugagccauaguggcuauggauuccagaagauugaaucaguucacagaguuaaaagggucacaguucaagaaggucuuauugaaggcaagauugagagcaauauaucugucaagagagucacuauaggugguuagaugagacagucaaggcagagucuggcagcaggccuaggccugggagugaagcaagcagcaucugcacuggaucuuccaggacaugguggacaaacaaggucccuauagauggacaaacagcuggaaugauuaugacauaaucacaacccaagcaggccccuccaacaguggggaccauacugaacugacacccgaggaguuuucucuugaucccuggacagaugccccaugagucagaugacauguuggugaggcuguagauacagcaguaauuuaucaauaguucuguuuuauuuuauguuaucugggagaaaaugcuacuuccuuuguuagucggguguguuugguaaguuuggggccugguuuuucuaacuuggacucaguaugacgaugucugcccaagccacuugcacauguuuauaggugcugcccugagaagucacacagcacucagugccucacagguaguacugggcaggugggugucucgucugucucuggucucgaauuuaaaaugaagcaaacaagucacagccugaaggccacuguuucggacuguuuagagcaggcugccuucuguuaccagauaggagcuccaaagccaauaaccgcagaguacuuaggaaauucguaccaaucauauuguuacugcuuugguaucgggguggggaguugugggggcugugggcuacauucuauuacccagagaacacugguaauugugaaggaaggcaaagaggacaagaaguacugggcugccccuuccccauuuucugcagagaaacacugauucuugaauccauccugaaaagugaguagcggcuggggaaacugaaagguacagaagagaucucaaauagaaggugacgcauugaauuccucauccggccaugccuccugagaagcucuaacuuaaauaacacacacgaugcacucacacaaauaugcucugggaggaaaggggaguugaugacucuucuuuuuuuuuuuuuuuucucaauguacccuagaguuccaaguuugucuuuuuauuuguaagcugccacagcucauguggccuugguaugagcugaugucugugugugucaggcccgcagauucucuggccacucaggaaauuaaugagggaggggaaggaagggcauaauacggaggagagaaauuacucaauugagagucagcaauccagagcaaacccaauuugaaggaaacaauuagaaaauggcccaggucccaaaucaauaagcagagguggcugugggcagugaacauaaugucugauaaugagacuaaacugcagguaagcaaagccugggauggggcgcuccuuggugucccucuggcugaggagggggucauccaucaggaggcuggaaaaggcaagucugaacauaauucugccacccaccaggcacuugaugucaucaccugcaggaauaaacaucauugguguggcuucccuaaucuggugagcaauaaaguccucacaaccugccuagacaugccugaggacagucccaaaggaaaaggaccucuugcagaauauucuaaguucuccacggacuuuggaacugaacuuccuauuagcucuaauggaggcugugcuaauaaauucccucagcucugagcugaacacguguaauucaguaauguggcuguaauugagcgaugucaacucggugugauuuguaauguuuuaccaguaaauuaucucuuuuuuucuugcaaaaaugguaucugauucaaugugauaaggugguuuaaagacugacacacacuacuaauauacagaucauuaauugauggaaacauuaauagucauaucagcuaagaauuaucuuagcugguucuuuauauacuauuaaccuuuuaaacauaacaagcuuuugcuucgaagcagcaaauguuuuggaugugugacucacauccacagauacuuacuguagaacucugaggagagcuguucuccuccccugcacugguccccuacgaggaacccauguuggcacaucugaacugaagaaaaggccuguccccagugccaugcuccugucagugagugaccuacugucccucaaggcacagccacagcccccuucuaaggauacaaaagaaauaaagaaaacccuucuuucuuaaacccauagguagaauuacccuuguaagccuucaugcccaccccaguuauuacuauacugaugccaccuuuagacccagcacagaugcuaguuucuggccacugaccccagguaaaggcccacacaaugaacccuaagaaugugugggucuuuagcugagcaucuaagaaagaaggguuuuguuuauuuaaccuaucucucauuaaagcauagcccaugugugcucugacacuacaacacuuuuucuuuucuugugcuauguuuguaucucucucucccaccgggacuacaccacuagcauaagauuauuucaaaaccuacuagcaagcagauaguacuucauaucugaaggaagaauuaaugaaugagaagaauaauagaugacuggcuggaugaaaaucccuguguguuuuccuuuccuugcaucuguccucccuaucaaagcaauguuuuucccauguagacauguaacaucuaucuacauagagggggaaaaccaccugacacaugacagggaggcucaagucucaaaugaaauaaaauaaauuucuuuuacugcuguuuagaauugcccucaggcugccccagaggaaauucaguccugaagcucauggugucuucuuauauccccugcugucuauccacuggccuucaucaaguuccuauccuguugguuacuggcacaauauuggggggcagaagcaaaggcuauuaaggaccaagggucguacaguuucucugcugaugugcaugucugacugcacuuccacagucaugguaugcuggaggccucuagagauuucucaaacauagaugccaucccugggggccucaaggccucguugggaagaacaaaggaagaaaagcuauccaggacuggggaugugcuuuggaauauaaaguacuugcuacacaaaugugaggaccacaguuugaauccccagcacccauguaaagcaggacgugggagggcacaucuccaauccuaguguucuuuugauacgaugugagcagagauaggagaggcucugaaagucuguagugccacuagcuuagcauauauagcaguauacaauaaagaaacccuuucugaaacaaggaggaagcauagacuauuaccugagguuguccucugaccuaucuauauacaugcuccguggcauaugugcauagacaugcauauaugcacaaaacacacaaacacacacaugaaaaaggggaaaaaugucucucuauaguagccugcagaaugggccuugguaaggacuggagguguuucagugagaggauuacaagcagacuuggcuuggagugguuuuaaaugggccucucacaaguaaacuacacuuggaguaauaacaaaaagaacauugguucaacagaucuuugucagcuccuaugugaggcagugggaauucuguaauauguaaguccacgccuacugucagcugaacuuccauuuaauauuggaaacagacaaaagcaaagaagccaugacgcugaaguaaugggugugcuggaggaacauggggccaaguaagaggcugagcuagcaggagugcucccuacaaaagguucucagggagaacuucaaacaaugcccucugugcagagcgugagggagccaugcagagccccaucaaaauaacacuccuagcaacgggaacagcugacuuguccacagaggaauacuaagacacaucauuucagagugaagucuuuacacguguucuugcaugucuugaauuuuuuguuuuuacuuuguuuuggguucugguuuuauuuggaaaauaagucuuaauaugaagcucaggcucuccuagaacucaguauguaacccacacuaaccuugaacuaauaguucuuuugccugagccuaacaagugcauacaggaauauaucagcaugcucagaucucucaauauuucugaugggccuuugaaaguuuguaguuauuuaauaggauuagguaaguuccagguaugugcuaaaacagaugcaugacaccugagacauggacacuugacauuuuuuugguuuauguuugcauugagaggugugauuuguuccugcaccuaauucccaggcaguguggaaacaaaugaaccauuugguuaauaauaggcugauguguaagggaaauucagucaccucccagcucuaaauaauauagauaugaugagcuuccugaaaccuuugacauaacagacgucuccauacugauauuuccagaggugauucuguuaacccaaacaauauuauuuauuauguuaaauuaauauugcuaauuugaacuuagcuuugacauuuugauugcauuuaauuuguaaguguguucuugcuuaauauuuaucuaagaacuguacauguaacuucauaccugguuuuuagaaguuuaaauaguguucuguucagaaagucuuuuccugugcuaaugagauccaggcuaucccccacuuucucuucuauuacauucaguguauggaaucuuugauccucugggacuuacauuucaugaaggaugauaaguauggaauuauuuguauucuuuuauguguagccauccaguuugggcaacaccaucuguagaagaugcugucuuuuuuuccguguguguguguguguguguguguguguguguguguguguguguguguguauuuauaucugggucuuggaauucuauucugucaauuaacaugucuguuuuugugccaaaaccaugcugucuguuuucauuacaacagcucuauaauacaacuuaaguucagggauagugauaucuccaacaguucuuucauuauucaggguugcuuuagcagcacagacaugacuuagaacaaugaauaaauggaacaucauagaacugaaaagcuucuacauaguaaaggagaucaucuuuugaacaaagugguagccagcagaaugggagauuuuuaccaacuacaugucugauaaagggcuaauauccaaaauauauaacaaacucaaaaaaacuagauaccaagaaaacaaauaacccaauuaaaaaugaaauacauaucuaaacauagaauucucaauagaggaaacucaaauggcugaaaaaaaauauuuaaagcaauuuaccugcccaggagcacucuggauucacgaaaggaacacauacacaaacacacacacauauacacacacaaauaugcuuugacuaucucaaagguugggcaguuuuaauacuucuugcugccagcaaacacucccauccaguauuccugaguuaauauaacaucuuuuaaaauuuauauuuaauuucugcuaccccaaacacaauuagggaaguguuucacaugaccacuuucccugauucucacaugucagcaggccuuuauaucuggucuuucuucuucccuaucauggcgaucucuccuuccuuccucucuccugguuccuagcucacacaaauuuccaagucccaccucauucuaucugcccauauauuggccauuggcucuuuauuaaacaaucaaaaaccaacuagggagaaagaucucccguguuuguuuagacaugcagauuccugauuugggaggacagguuaauucauagcauuagaagcaauccccaacauucacuuguauguguauauuagcugugaagucagugauaaucaagcuauaauccauggaaccauggaggguagguauggaguaauggagaaggggcagaaagaucucccugggaaagggaaauggaauagcuauaaauggauggggcaaggcacuggaaaaggaaggucaagugggaaaggaggguugugggagaggauacgggcaaagacagcuaaaguaguguaguauguaggaacuuccuaaaauguacauauauaugaaggcaaucuaaaugaaauugccaaauuaugaggaagauagagucccaacgggccauuucuugucaccaaaugaagccuccagugccagaauuggauuacaucuaauagaguuguuggccaaaagugccugauggggauccccacacuagccacacuagccacacuagccacacuagccacacuagccacacuagccacacuaguugccaagacuauaguuugcucuccauaaacugacaaucaggccacacugcuaaagacaacguuagcacaauucauugaacacggagaugcuuagcuggcacccacuuaaacccuucguccacacaucccaguguuuuugguacaggaaaguaaucugcaugcuaucaaaagagaagaaaugaaaauaccaaccguuuaucuacaaaagucuacuaccuguaagauauacuagggcaguaguggcaaaaagcuuguaggagugaccaaccaauaacugaguugacuuaaagaugguuccacaagauggaagccauuccugacaggguguaagugaccaagaaucugagacuagauagcccagguaccuacaguaaacucaaauaauauuagucuuuaaaaaagaauguauauaugauaaaaugauucuuaaugacauucuguuauacucauauaauagugccuuguucagccaucuucagaaucacuuccuacugcaguauugggaacaaauauugagacccacagcuggacauuacacagagagugcgagaccuggaaauaccccacccuaaaugggauaacuucaucaaaucccuccccucagagcucagagaaucccauggaacaggauggggaaagagccagaagguauggaggacaccaaguuucauaugaacauaccgagacaaaagcagcaagcacagggccugcaccagguucuugauaguagcuacuguuuuguaggggguuccuggguguguaaacaaguggguugcugauuccugucccuuuucuugggcucuuuuccuuccauugguuugucuuguccaacuuuaaugugaucacuuuuccucuaucuuauuauuuuugauuuugauauuuuuuuuaauuaaaugaauaaauuaacgaaaaccuagcaacuuggguaaagguuaacaacugacacuuauaccugcugcuagagagaaaaucaguuuucucugauggaguaacacuagauaugucaacuauccagggcagaccucauguucaguaguugaccaauauacaauggacuacacaguuuucuuaugucuuuuauuugguuacaauuuuguguugguuuuuuggggggggucauuauuguuugcuuuucuuuuugguugguguuuuauuuuguuuucaugguuugggcugguuauugcucuauuggguuuucaucauauuuagaaauggcucaucagguaaagucuuugacaugcaaacauaaagaacugaguucagcucucuaggacccacacuaaaaaucugguauuacauacugucuguaacacaaacagugauuaccauauucauugagagacuguuucaaaagucaaauaaagagcaaucaaggaagacacccacacacaugcacaaacaugcacacaugggcacacacauaugggcacauacaaacaugggcacgcacagguacacacacacacaaauacacacacauacacaugcucacacaugggcauacacacacacacacacaaacacacacacacacucucucucucucucucucacacacacacacacacacacacacacacacacacacacacagcaaaacaaauccauuucaacauaguuuaccuucaaagaaugguuuccucucacagcucuagacugaaaaaauggugagaaaaaaaaacuugugaccaagauuuaagucaacucuaagcuuugggaaagacuuuugggucagagaacuuaauaaaccuaauggugguagguaaaaacagugcuagcugaagaauaaccucccucagcaaguucuuugauauuauaaacauaaaaagucuaugcuuugaggcuguuggaagaauuuacuuauacauaagccucacauaccuuuuagaguuagccuggcauucauuaugaagcacauuuuguuucacuuuuauuacauauugcuaacuuugcauacauauguggacgugaguggcugugagcuugucacaguguacauacucauuuggacaugacccuggauucuguccugggcacaggaaacuuaauucaugccugaaugguucaaagggagagagaaggcuuugcuuuccucauauaaugaaagauauuuuguucaaugaagcuguuuauucuuuuuuuucccccacagaaagcagugaaacaccuugaauaucuucaaaaugaagagagucggcuaauugugggggcucuacuuguacuuauuuugaaagaaucucuauauauuuuauccugcuuuuaaaauuauccaaucaaaggaacauuuacauuuguaaacauauacacacucuccuugaaacuggaggauacacagacuuuaaauguuucgagggauuuuugaguccaucaaccugcuucaacugagaaaauagacaacugucuugacagcaaggagauaugagcugucagguguggaacacuuaacgggcuggguagcucuggccuuuacaguagcuggaaagaaagcugucugucuccacuguaagcaauaguaaaacuggacccugggagauacaucucuauaucuuggaauguaguccuaacagccaaaggaacguagccucagaugggagcugacuucccaugguagccugcugcuacaaauggggccuuuuaucugucugugcucuugauuaggagucauagcacaugcugcaagucaucaccuccuccccaggugcaagaaaaguucaugcccaggcauagccuuguggcccaggugugggacuaaugacaagaauucugauuucuugcuugauguuucgccuucagaauuauaugaaccugcaaaacacaaccacugucaccaauguguguggacaguuauguucuagauggaaggccacugacaucaaucaccauucuuacuugcugccugccucuuugucuauguaacaguaggcagccauuaccuuccucagcuaagauucagacuggaggccauguuuucuuggauccuaagaguccucucugaaugcucacuucccuuguugcugcaugagcgcugucucccucaagaaugcucaucucugaauguagcaccccaucuccaaguaguaaucuuaauauuccacucauauucuuuacuggacaauaauuagugucacagcaguugucccauaaccaaauaaaaucuggaucaaacaccagucuuacuguuaggggagaugagcugaaggugacaaagugguagaauaacuuggaauagagcauagagauucuagguucugaagcauuuagaggguauaugguaccuugccuggauuccccuagauucaguuuaugugcuugauaugugcauugcucaagcucagucacaguaagggaccucugugccccucucauauacuuagacuauuagucaguugucgcuucccacagcuacaacuuuucaaaacacaucuacauuacaaaauacauauccaaggaauuucauguaugucaaagucccacaccagauuccagaagccuaagacaucuuuuaaauuuauguaagcuguuucuguauuuugucuguacacugcugcuaauaacagcuaauauuucugaaagauggaauguauauacaaauuguuuuauucugagaaagguauugcaauguaaccuagacuauccuugaauguguguauggucuuccugccuugaacucugcaaugauggggucacagauacguaccgucaugcccagcaguaacuuguuuaauuuuuacaaugauuuuauuggaggaaacauaacaacuucccuuuacacaggaaacaacaaaagccuagagaaauccauagacuugcuugaacauauggcucacugacagccaggauuagagucccagcaaacucauuuuguaaccugugucuguaacuuccacaggacauguuucucagagaaagcauuacuauacaugucaugcccaucuguauaauauaccucucugccacauucuugauguuuuuaguaccaauuuacaaaaauguauggucuacaggauagcacauguaguguaguguguagccugcaguauguaggcacauuguccuguauuuaacuagucccuuuuaaugagagcuuaauauauuuuaaauuucucaguauuagcaaugcugcagugaacauaaauauaacauaguauaaaacauagcauaaucuuauuuauauguuuugucaaguauacuguuaggcauugcaaagaauuuauggauuaaaaucuuucaacuucucguugacuauucuaagcugacuaucacaaacuuuaccacagugauuuaugccugaggauaaggggaugauagauagauagauagauagauagauagauagauagauagacagauagauagacagauauagauauauagguauauagauauauagauauuugccugaucauaugguuuuaaauuaaauuauaagaacaugggauucuaacaaauuccuggguuuugaacuuacugggaucaacuugaccaauauuaaaaucagaaaaaaaaaaaaaaaccagcaccaauuuaacaugccuuugucucuccaagacaacucaaaccugaccuuguccucuccaagugcugcuacagaagaguggaccucaugacgccuagacaaaaaaguaaaauaaaaggaauaaaagggcuuuuguaaaacaaaaaugauaaaucuccaaggucacuugagauauuagaauuaucuccuauauccucaggcacaaacuaaaauaucugccgccauugacaguacaaauucaggaaggucucagucagauagaaaugugcaaucuugggagcagaagugaauuuuuggaagcuggguaaauuaccgcaaggcaugaaccugguagaacugauuccauuuagaaaggaguaggcagagucauucaaccugucucucaaacacugcuacucaaacuucuccuagauaauccaggggauauagcaggagucguaguggagcccaaguggaagugcaagcgggagcaggagcaggagcaggagcaggagcaggagcaggagcaggagcaggagcaggagcaggagcaggaggagcaggaggagcaggagcaggagcaggagcaggagcaggagcaggagcaggagcaggagcaggaggagcaggagcaggagcaggaggagcaggaggagcaggagcaggagcaggagcaggagcaggagcaggagcaggagcaggagcaggagcaggagcaggagcaggagcaggagcaggagcaggagcaggagcaggagcaggagcaggagcaggagcagucuaacuauggaagaugcugagcuuccccucccaaaauggcccuuccaagcaugaacugacacaguuagcacacuaacagagaggcaucaucaucuucgucaagaauacuauuggcuaaaauaagcacuaugcaaauucucaaaugaaccaugugaagugguucccugcucucuuagcugggaagacaagaccacaaaauaguaaguagcauuaccagaucuugaauuacuucagcauuauguccaaagaugcauaaccauugcauuguaugggcauaaaacaaagaagcacacacccaaagagcagcagaagcacaaaugugggacaaggaacagacaacaugacagugggauuacuggagcauaauggaacaucugguugauuacaggacucuugcuucacaguguuuauaugugaauucgggcauuuagacaaacauucauaggugcaaaugucugugggagccagaaaggaauagucgugaaccaagagggccaaguauaugcugaagggguagugaugagugucaugaacuuaguaaccaccugaagaggacaacccugugagcucauacaugagacuuguguauacaaaacucacauaguaccagaucauugaacuguuucaagagcugugaagguuuucauuuuuaauguaaaauaucucuauucccagauaaaacugucaauguucuaaaaacauuuugaggcuaagccuacaaauucugauaugugaaaccuaagcaguacugggaaaggcuuuuugaguagccaacuauccaucccucacucauacuaauguaccucauuuucuguggguggaucaaagaccuaauguacagugaagaacuaauucugcuucgcuucaacacauuuaaaucuuuaagacuuuaaggaaugauggaagacagagaccaagacacagagacagaauuggagacagaaacacacagacagauagacagacagacaggcaggcagacaggcagacagacagacaggcagacagacaggcagacaaacaggcaggcaggcaugugcgagugcgcacguagacacacaugcacacacacacacacaaagggggaggggagaaucacagcaacgucucuguuauucucuucuuucucaucuuguauugaaugcuaauggaacagaauaacauuggcagcaauuucgugagcaugaggcaacaaggccaauguauguacagugauggucaaaacaugcaaagggauccuaguugaacagcuacaucaacacagagacuacuuauccuggggaaucuccuacacaaaacaguccuugcauuuuagaacacuaauagcuguauuuucgaauacuugguacugacuccaucccaaugaagggcuguucauucagccucacugcagaguucuuucuguuuauagcaucccuaaugcaggaaaacuugagcagcaucaaguuuacgcaguuagagucuuaacuagaugugcgauaaagcucugccacuugagaacacccacacucugcuucagaaauuuaaauuaugcuccuagcuuuuuuuuuuuuuaagauggauaaaauuucuuacaauaucauacaaggacuaaacuguucucucaguugccaggcaacugcauauaugcugccuagagaccaaaucuaugaccccuugacucuuccaguggguaguggcugggcucuuucucaaagcugauauguuugugaccaaguuugacaccuccuaaccagcagaggucaaggcauagaucugggcuacccagcuguccugggcucauuaccugcaagcuuaugccauuccaaaucacaccaucaauugcagcuucuucaggcaacaccaaaugagggagcucacacuguccccaggcuuaacucccuguccuuuguccugucucauuauauauaccaaucugucggauucagaaaauggaaagauggagaccgaagaaucacugucaggugacaaccuuauaugaacauuauuccagggaacuucccagugaaggacaugaacaacuugcacaaugccccaaggggcuucuacuuccugagacguuuuaaugcacacauaagguaagaugaguuugugaucuuguuagaaaggaaaucucuaauucguugaagaauugaguugaaauuuugaaaaaaaaaaaaaaagaaaggaaaucucugagugcaaucauaggcaguaucacuaccucacagagcugcaagucuauuuuuaauacuuuaaagccauaaaauuauggacuugaaaagucuagagagacccuaaguugagaaaguacaacccaaaaggacugaagagacaguuccugaguguaacccaggaaccccaguuauuucacuccaaguaaaaaaucaugugcuuaaguaacccccagaauauguuuauccucauuauaaaucaaaguauucauccaggcauuccagcuguaucaguacauugcaauaagguuaaucuauaugugaguuacccuguucuacucauuccuugguaaauuagcaauggcuuaaacaggcaugcucuuagucucucauuuauccaguugggaggucuaucguuugggacauauauggcaguuuuaugaauucauuauagaccuugaugccuuuuaacuuaccacuuccccauuccauugggguggccauucucacugugguugucagugacuaaucagucaucauaucugcuugccaacugacagcaaggcagagcccugaaaacccaggacuucaaggauucuccuagcuuagccagcuugaaugcagagccugagauagaucaaaggcaaauacccagugagacuauugggaaggcaacuucaggaaccuggagagaagaagggaagaucugaaggagagcaggaacaauagucacaugcaauguuuuaccucccaugguccaugucauugacagaauaguugacaucccacuaacuccugucccuccccagaagugucaagucucuaccugugccuauguagagacagggagaccuucuuuagcuuugaggaaagcuggagacaggaaaguaauuagauaacaaaacauggguucccuagcagcacagguccugccaucaaacaaugccucaguggcaugguacggggaagguaggagcuacuugaacuaguccagaaagguacucauaaaauuucuuaugucuguacaucagcaacucugaauggcccuucuaaucagagcucagagcuguguguucaugcauaugguuugucacagugagaggauauagaagaaaaacugauauguagggacaguccuaagggaaagcaaacacgcucauaguugccuucuaccuguacagucuuucaggcaguucuugaucaguucagcaacucuguaugacaugcaucacuuaccaccaacaggagaugcucaggagagucucgauuggccgugauccucuugguggagucagucacauaaaaucagagaguacauaugccuuggcagaaggcugacccaggucuccuggcuacagccaaggugaaaacaagccacauuccauucugaggcucuaaggggcauugguuuguguccuugacccacaaggcuguuggcauaauuuuguugaaaguacuguuucccuaccgccuaucaccugagagccaucccacuccugaaggcuaccuacauuuggcaaccucucccuucauccaguucuuugucaacuuuuuaggucagcagugagaguggcucuuucaagucugcaacugggaaaggcucuagucuuaagagguuaugugaucagguaggcccagcugggugaucaaacucauggugcacagucuuaaucacaacuggaaaguccuucuuugccaagucuaauagcauucuucaagcaucugguugcaggcaacuuuauagagagaggaaauaauucugccugaacagaacauuuauuccaauguugccaguucagaaacuauacuggguaccacuacaaaagagcugagaaacuucuagacucuucuaccuuguauccuugauuuacauuguuugacaguccacaacaacugguaaugaacagagacucuaaaguuucacuucuucacugggcccuguucuuacugaaaaaggaaugagaggggguggggggggcagaaaagggagcuguggaagagcaaaucaucaacuaaaagcauuccugggauggauaaucaguucuaaggccauggguaagaccucucuauguguuccagcauucuggaauagacagaugauggaagaauuaaaugaaagugugacauucacacuuauuguuguuucacccuccccuccuucuucauuggaucugacuguucagauacugaaugcucacauccuuacccaaaaacaggaagcagguacucuccagccuugggcuuacaacuuugcucuaauacgaugaauauggucacuuuaugccccauugauagaacuacuuuacaguuugauuugauaugcuggccaaucagcuguaggaaguucuacuuucacuuaagaaaauaaaggauauguauaaggaugguguucuuucucauuucuaccuucagacacuucaauauagggaugcugggcaucccagugcccagauuggagucaggagggauagucuauaaagaaaacgauaccuaaaagggcacaguaagaaaccaaggagguguccugcuucuugcagugaauucuucuauggcccuucuuccaucuacaguuaaaaucuuaacacaaauagguucagcuagauuucuaugacugcaucuaaagacauucuaccuaacauugacagcaaauugcccaagacaaaaaagguucaauaaauaggcaccaucucuauuucuuugaauacacacacacucacauacacacacacauacacacacacacacacacagacucacacacucacauacucacacaguacaugaauugcacaaugcauacucgcuuaucauauuggcaacgaaggaaguuaucagacuuuuccauuccuacuaauucauacacaaagggucaaguuacuauaauugcaaaauaaagucuucuaaaugggaacagagaagugacugugccauuauguccugcauaaaaaaaugcuacgucuuuauuuaaaaaucuaaaacagaggccuccccauccuuuuccuugaaaguuugaaacaacuggccagaggccaugcuuuuauaagagguucccaagaccaacagaucaagauggauuguguauauagucuuagaucaaaagaaagcaucugcuauuugaaaaugcaugggcugcauuaacuuugagucuuaaucaaggaaugaagacugacagcgccuucuccuauggggguuguauguaguaaaguaugugcuuuuguaaaaaugacagugauacaaauucaagcgaguagacaaugacuuuauuuauccccacaacccaacuucucucauacacuuuugcaucugguuuuaaagaggaagaauaacagugccugcaauauacuuugauauuuucuacuccuauuuaaaaauaaaacaaaauuucuaaagcccaggacauuaucuaugcuuuuggucuaacaugaaaaacaaacaaacaaacaaacaaacaaauaaauaaauaaauaaauaaauaaauaaauaaauaaauauugcacgugagcucaaaaccaccccaggaacacugcaaagaauucuugaguagccaagccuuccauucucuugcauauuggucccuaucucagaauaugacacucaauaagaagggcuaacaguguccccuggcccuguuccuguguguuauccugcugcaguuccagcuaaugacauggcugaaaugacuagcaauuuaaauaauggaggcugaagcaggcagcucuaaggacagaaugcugagacugucaccguuuaucaacaugacuggcagccagcuauucaucaccuccuugaauagggucaauguaguuaaaguaauguugauaccaacuaaaucaaagcagcuguuuguuuggcaaugagcaccuacaacaaacuagcuguguuacccaggcaugggcuacuagacacaaggauguaauugauauuaaccaacuuucaggcucugggcacuuacaauaaacaagcuguguuacccaggcaugggcuguuaaauguuagaauguaauugauauuaaccaacuuucaggguccaguagcuuuuucucaaugcaugucacuuuaauuuuuuuaaaggcaugaucagugugugccaaauggaaaacuaaaugagggagagcucacaaacccuuaggccuugaauacuaagugaaaaacuaaccuacguauccugcagaacccuucagaggcuugugggacucagaagagaaugccacaguuuucuuuuuaugaaaagauauucaagugauuuagggaaguaaggcucccuaaccuuaaucuugccgucauucagaaugucugaaaggauucauuguauguccacaucguuacaucagagacugagccuggguccucuaaccaugaaaaccuuguugcucugcuccauuuggaccauccuagaaugacuaauuuaguguuuuaauuuuuucaacauuuuuaaauugacagacuucacagaaaacacuggaagcgcccaacuccauuuccauaaccuccucuaucauggcuguccccaucagugugggauuccaguugaggucaaauguugacuacaucuuucuucuuaauuauggcgcuguuuuuaguaagacuguagauaacuauugggugcuggugggucuugaucacaaauggaaaaaaauuaaagaugaucuaggaggaccaagaauauccagaaaacaaugaagagauuauaaugcuuuguagaagaaaagauucccauagaaucccuuugcuccagggaggaauccuuugguuucugggagcauuccaguggaaauggggggugggggagagggcaagaaagcacgcauagcacuugcaauucaaugagaguacacauaugcaggugcacuucacaugugugaaaggacauaagggggauuggggacaaccuuggguggcauuucuugagcaccacacaucucuuuagggcauaguuucucacuggcuugaauuucucacugcuuagacuaggcuaaaugaccaucaagccccaggaauccaccggucugccuccccagcgcugagauuacacgagugcccugccacacacuuuucgucuucuuuuuuaaaugugugucugaggauagaacuuagguucucauucuuacaaagcaagaauauuaccaacucaucugucucuguaacucuugucuuucuaauaauuuuuaaucuuagacuaaccaucucagaaaaaaaauaucuuuuaauauaaggagagagauaaguggagucaguuaaggaacaaugguacauuaauuucccacuaugcacaaacacaugaagauuuucacacauuuuguuaauaaauaauacuugaugcuuuuguuuacucauuaaucaaaugaguauuuauuuacugugucagccagcucgacagagaaacacucaaagacacaguuuuccuacuuucacauuuuaagucaaacaagaagauuaccaaauauugauggaaguauaauuuuaacuaugacggcaaucacacagugcuuaauaauagcugucaucugcugaauacuugccgugugguagggacugugcugagcauuucaugugaauuuucauuuaguuucucacugccccccucugugucagguacggauguaauuaguuuacagaggagaaaagucaacuacaacuuuuguggccacaagaaaaagaccugagcuugaagcaucagcugcuccuccagugccagaccaacucacaaucugcuucauccacucaugucaggcacaagggaggcacaccuaagcuaugcagaggggaggccuuuaaauucuuaaauguaaagaauugaucagccauugaagauaguauuggccaaaaauaaagugagcucucagaguggcagguacagcugugaguggcugugagaaccugggcuauaccucucaaaaccagaggaaaagaaaagaaaggucuucuuaggacacgaaucacagggcugagggacaggagguggguguugaaaggacagaccauguacugggaacuuuuuaucaacuugagauaaaaccccauagauuaaaacaacacuggaaucugagagguucaguaaucuaagacuacacaaggucuuagcaucaugauuugagcuggaaaacuaugacuacacaaucaacacuucucuccaccuagaccuccuuuauacccuccaacaccucuguaaauacuuuaguuggaacuuuugauuauuccuuucuuuauucacccaaaaucaauuuauucagcaaacacaaagaacauaauccugauccacagguuucugauaggaaaaucaagaagacaaauauguaaauccuaaccagacuuucagacaugaugagugagaguaagcauaugcauuuuccaaaucaauucuaagacacuggguccuuugguugguggaucacuaucacacauuuggaauauagccuagaacuaacaagcauuuguuuaaugcaaggauaaacaaaaacaucucaccuagauaucucaccuaaggauaaagagaugcaaggcaaauugauugccuccugggguaaaucaaagacucucccagagcaugcauuugcuucuggccgagucuauaagauauggauaagucaagaacaggcuaagguaagugugccaggguagacacagauauacaagcauagaaguccauggaacaucugggaaguagauauuccuugcaguguaggaaaggugagaaaguaaacaguaagaacaauagucacaaaagguacaugacaccacuuucuagauucuuuaaguuacaaauaaggaacacagccagccacuauggaagaaauacagcaacagacaucuugugacaaccauggcaagcaucuaucauuccucgucaucuguccugagucuaagguuuuccuuccucucucauuuucugcucaucccaucucuccucccuucaucaggccagaucucagcacacaguucaaaaaauauucucuccuacacauguggcacauacauguaauuccaguaugggagcuggaggcacuaggaucauaagcuccaggccaacaugaacuauauauuaagccaccaucccaacuaauguaaaaggaagaagaaaguagaugaggaagacagggagggaggacgggcaaggagaaggaauaaaacuguggugacagugacagaaauaaguaaggcaaagacaguggccuacaggaagccuuccuggaugucugucagucugcccacaccucaugcacuuuacuguacucagcggaaguggaguuccaucacucugucgcugcccucugagacagugcagccccaucacuguugccacccucugggacagccacuauugcuauuaggcucugagugccuuauaaacagccuggcauguagaaagcacucccaaaauacauuugaaauacuugaguugagugauuaaucuugaggaaagggaguccuuaauggccguaggaagucagcaugguuguguagaagaaaacaucucuuuacaaaguuccagcucaugcuaaccaugggcacuggcuaaguggggugaggcaggcagcaacugagaguguagcagagccagcgggcaguugucaggagagcacgguuccaagagagcagucauuagcaugcaacacuggguaaucugauuuucaugacagacagauuuauuauaacuucuaaauauauaaaucccagguuaugcuuuacagcuaaccuaacaacuugauauaugugucugacaucccgucuuaaaaucagauuccagcuucuaauuaauuuuuauucacccaucgcucuaacuagagaggcagaaaaccucagagggauaaacaauaggugggauauuaguuguaguugucacacucuguagaacauuucucuuagaaacaccacuucaguuuugcuucacuacauuaaaaagagcaguguucauucucccugugaccacuaagaaugucauacagggacccaauagauauuucuaagcuaccaaucuucaauccuucgcggccacgcucgacacucagccccauuccugaaaucaggguaacaucuggccugcuuguuuuacagacuauauugucuaggugguaccaugcuuucccuuucuccaguaauauucucacuaaauaacucuggaagcugaguuucaaacaccacaaauaccucacuuuaaaccaauagcaaugcucauaaaagcugaaaaugcuaucaucagcuuucucugcaaucucacauucguaauucacucacaucagaacaauuugucuccuuggcacuuaauuucggcuauucuuuguaauucuggauauuaggcccuugcuugaaguauagcugaugaagaccucucaggcucugggcuguuugcucugcugagaauuucauuuucuguucagcuuuuauucccaugcaaccccucuguugauccuuggguuugguuccugugcuacugaaguucuauucagaaaguucuugcccaccaacuugaagaauauucuguuucuuguagauguucuaguauuucugguuuuuaauuaaggucuuuggucuauuuugaauuuacuuuugcagaagguggaauuuauaaacuuaauuuuugucuucugcaggcagauauccaguuugcagcaucucuuuuuccaaugcauacuuuugcuuuuuuuuuuuuuuugacauaguauaauuuaauuuccaaguccucuaaucugcucaauugacccaccuucuauguuuaugcccauaccaaacugucuuuaugccucugcuucuguaguaugaguuuaagguuaggcacuguaacaccuccaacuguauuuaccaccagucuauaauaaaaacacauguaaacaaagguacauguauguacaguguacaugcaguaaggagaacaagaaaagguaaauaucaggugaugaggacagacgagauacaggucaucgacgagucaagaaagagaguauauagacaaguauucuucuaguuuugacuguuguggauuuugccgggcuuggugguagauaaguguguaaaaauagcuuugauaguaaaaguguaaaagccaaugugaagcuccauagcuucagaacagcugcucuagcuguaugggauuuaaucaagauauauagaucugggauaugguuaauuuagaugugugaugcuuuuuaucuacaagcucuucauaauaaaauuuuaauuuuuaaaagaacaauuuauuaacaaugagaaguaguauaguuagagcuagggagaacuguauacuuguugaguuuuucaacuaauauaaauuuugaaaacuauacucuuaaugcaugaauauaauuauaacaauuuuuauguguaugacugaugagugacugugggcauauaugugucugaacccacuuccucacacugauugucagguacucagcccagagccauccccauaaucuacgcacaucacuuucugaaugcauucuucuauaucucuugucacaaauacugaagucaacaagggcacaggagaauuaauaaggccaagcaauuagguuuuguucaauuuuaaaauuauuuucauaauaaguuccuuguacaucagacaccuuuuuaacaaguauaaaaucuuucccugaacucuaguguuuaucaauuuuuuuucucuuuggcauacaggaaacuaaggcaugauaucguuuaggaagauggcaagauguuggaggucaccaaaauugguggggacagguguugagaacucagucagugcugaaggcuagacuucaccaccuuauuucugagcacuguacugccucaggauuuaagggaucgccacuaaacaaauuacugaacauguuguguggcuaagcaauacauccaaaguaagaauucagucccacauugagaacgcaucuguuucuagcuuuuggcaaaagguuuuuaaaaaccuaggucuacuuaccugccauguucuggaguguaggcuagcuugagaaauauauaaagugaggauauuuuauauauuaaauauauaaaauaaauuaaauagugaaagugaagaaaaaauugaauuugcaaaauccccuuuuuucugcuuuguugcaauuacauaguuucuacaucuucagcuccuaucagaaguaucugauagugugagggcuacagaggguguuagcaucaaagccugcaccccugacauccuggcaagccaggugaggucacuaguucucaauaaaguguuuaaagaaagaaauuauuagugaaaagcagaaaaggaagguuuauucaguaugacuaugaugagaugacugacaaagaaauucaaugaccccucaagccuucaugguacugacaugagggugaggccacgggcaugaauagcuaagaagucccuaacaagguacaauccuguuuaucacugacaauuccuugucugggaucuaguucccccccacaaggucaugugacaaacugucagaacugugucaagucucuuuccaggaaacaaguucuuuugccuggcccugggcuuugcucaccucuccucccagcaucagaucccuggggaaacuuuaagucaaagagccaaagauagggacauuaauuuguccuuaucuaagaccuaaaagcacaacagcaagggcucacaaaaugacaaagcaagugacuucauuugcuaguccucuaggccauaucuauagaaacaaaaguaauauagacuuccuacaagcucaaauuuaaauauguaaaauaauggauuuccaacauaauauauaccuuaugguauauuauacaaguaauuauaauaauucaaacuaaaaaugcuaauaaaaauuaucagcaaacuccuaaacuauuucuuuuuuucuuaaaugaauucauccugggcuaaaaauuaaauaagaauuuacaaggauacacaaaagaaacauauuacaaaagauccaucuggcuaauuguaaguuuuagaguuucugagacugcauuucagcuacagcacuauuuaguuagugcuuuaucaaacacuuauaaaauaaaaauuaugauauucagaugaaagcauacacuauauaaucaagcccuuagcauggagcuauccuaucugucauucugaggucuggcuugggcaccacugaaguuaacacagcaucuccaguaauagcacaucgccccuuccuccccuuugaccuuggaauuauuagaguaugcugugauacuuuuauaaaccuuauuugaaugugugagguaaaauguagagaugaaaauaaacuugaaaaagacaguuuuuaauaaagaaaaucaauuacuauuuuaauaaguagaaauaauuuuugugcaaaaagaaaaauuauccuuaacuaaaguagauguucaauagauuaguguauuaaugccuacauuuacauguaaauuucugaaauuuauauccaagacuuacaaguaaauuuaguauagaaguuuacaaaaacccauucauuuuugccuaaucauauugacaauuuaaggugcuugauuaaaccccauuugucuuaaggagccaacaaagaacaaagacagcuauaaaagugauagauuggugggcuuuucccuccuagcugucaaggaaagcaaugagaaaguuuccuugguacaaacacauggcgcccagagcagucugcagagaagagcaaucugagugccacuuacugaaaacaggaaaaggaggagauugcccgcagaacucugcugccucccagcucagguaccugcucugaggaagauccaccuuccacugcccagaaaagaugaaaaaaauauggaccucagugaauauccagugcucagaacugugcggcagggaacgaaauggagcuaauuugcaguaacccugauuccuuguucagcucucccaaagcauaauaaaguaaagagguugugccuucagggcuccaauuccagcugugcccacaaguugaaaaaaacaagaagggacauguuaacugcacauaccagucugccucuccugcuguuacucuuccaauaauucaaagagagugugugcucuucucugaaauguuuuaagaugccuuccucauuugucaaggagauauaggugaauuccuggcugaaagcagaacaaagaacaaauugcucucucaaaaugcucgauucuugaggcacuacauuuuaccuugagcucaaaagcaucaucuagguuuaacuaauauuuggaauucugguuugaugauccauguacggcucagcuuggucaguuugguuaguacagcauccuucccagcuguuccuuccucugagaccucugguggaauccuuccucacauaucuuucaucugucugucugucugucuuccugccugucugucugccugucagcagcaaugaccaguguucucuggacuugaggugauccauucaacacccccccaucaugugacauuuuucccacauaugguggaucucugucuuuccccccuguuuaugaacggaggagaaguuggagugcuucugguccauuaccaaacucuccugggcuaauguagccucuuagacagucauuuaugcacaacucuuuuggaauguacaacaaacuccuaauuuccaccauuccaaaacuugugaagauaucugaugcuuauagcagagcuccccuccuuugauguaugcccccuaaacagugaucucaacaauguauugagaagugucuugauuuggacuuucuuuguucuauuacugugaaacuguuaaccacaauggagcacaguauuuggugcuacuuggauuugcauucucaagucauggucacuuauaguuuacucugaaacacacccauguugcuuuucaugugagagcugugguuugugcacuaaagauucauccugcuaugcucugacuacaucuuaaccaguuacauuaacagugaacauaucucagaaucaaaucauauucuaaauaucuuauguaggaaggggacacacuguaugaucaauaaaauuucaaaaaaaaaaaagagagagaaaucagucucuagaucacacauagacucccuacuaaauaccucucagacccgcccauuucuucaccauaauuccccaaaucccauaugaauauccccuuauauuacugcaaagcuuucuaacuucguuccuauguuguacacuguucgacuucaccucaaaacaaaacagaaaacuuauugagauguaaauuucauagaugauaauuuucagaaucccuuaaucauguaaugauaacccaaacaaugguaccaacaccuaaaaauucuauaccauagcucaucucaaucuaauuucucccugcuuaugccaaaauaaccaucagccugcucuguuuccauggacuaguuuuguaaaguuuguacucuaaaugaaugaaaccuuauaguugguaauuuuuuaauccacuuucuguuugucacuuucaaccuuauuguugcaaauacaguugggucauuuuguugcuaaauaaauauuuuaucgagaggaggcucaaaucccaggcgcucuaacacagccaggaucccaggagguuggugacaccaaaucucagggucccagaggcaguuugacuccaaggaacucugacacacccagaauuucaggaucacaucauccuggaaucacaggaucacaggaucacaggaucacaggaucacaggaucacaggaucacaggaucacaggaucacaggaucacaggaucacaggaucacaggaucacagggucacagagacagcugaacuaugaggaguucugacacaaccaggauuacaggaaggaaaggcucuagucauauagaaaggacagguagcacuagagauauucagauggugggaggcaagcaugagaacauaagcaauggaaacaaagguuacuuggcaucaucagaacccaauucucucaccauaacaagucgggaucacuagaagagcaagauucagaucuuaagucacuucucacaaugaugauagaggacuuuaagaaggacauaaauaacucccuugaagaaauaccgaagaacacagguaaacacagagaagcccuuaaagaggaacauaaaaucccuuaaagaauuacaagaaaacacaaucaaacaggcaaaaaaaaaaaaaaaaaaaaaaccauccaagaucuaaaauuagagauagaaacaauaaagaaauuacaaaaggagacaacccuagaguuaaaaaaccuaggaaagagaucaaagagaucaggagucauagaugaaagcaucaccaacagaauauaccagauagaagaaaucuccugggggcaaaagauaccauagaaacauugacacaaaagucaacaaagaaaaugcaaaaagcuccuaacccaaaccauccaggaaauccaggacacaaugagaagaccaaaccuacagauaauagguauggaagagagcaaagauucccaacauagagagccaguaaauauuuucaacaaaauuauagaagaaaacuucccuaaccacaagaaagagaugcacaugaauauacaagaagcuuacagaacucaaaauagacuggaacagaaaagaaauuccuccugucacaaaauaaucaaaacaccaaaugcauuaaacaaagaaagaauauuaaaaggaguaagggaaaaaggucaagaaacauacaaaggcagaccaaucagaauuauaccaaacuucucaccuaagacuaugaaagcuagaagauccugggcagaugucauacagacccuaggagaacauaaauggcaucccagacuacuauacugagcaaaacccucaaugagcauagacagagaaaccaagauagucuaugacaaaaccacauuuacacaauaucuuuccacaaauccagcccuacaaaggauacuagaaggaaacaccaacacaaagagggaaacuacacccuagaaaaagcaaggaaguaaucuuucaauaaaccuaaaagaagauagccacauaaacacaauucgacuucuaaaaacaaaaauaacaggaaucaacaaucacuuuuccuuaauaucucuuaacaucaauggacucaauuccccaauaaaaagacauagacuaacugacuggauacguaaacaggacacaacauuuuguuguauacaggaaacacaccucagugacaaagacagauacuaccucagaguaaaaggcuggaaaacaaucuuccaagcaaauagacccaggaaacaagcuggaguagccauucuaauaucaaauaaaaaucaacuuuuaaccaaaagcuaucaaaacggguaagaaaagacacuucauacuggucaaaggaaaaaucuaccaagaugaacucucaauucuaaacaucuaugcuccaaaugcaagggcacacacauucaugaagaaacuuuaauaaaucugaaaguacacauaguaccccacacaauaauagugggcaacuucaacaucccacucgcagcaauucacagaucauggaaagagaaacuaaacagagcacagugaaacucagagaaguuauggaccaaaugggucuaacagauauuuauacaacauuucuuccuaaagcacaaaaauauauaacuucuuuucaacaccucaugguaacuucuccaaaacuauccauauaaucagucacaaaacagaccucaacagauacaaaaagauugagauaaucuacuauacccuaguagaucaccacacacuaagucuggucuuaaauuccaacaaaaacaacaaaagaaacacauacacauggaagcugaacaaugcucuacucaauaacuuggucaaagaagaaauaaagaauuuaaagacuuuuuagaaauuaaugaaaaugaagacacaucauaccaaaccaaugcaacacaaugcaagcaguggaaagaggaaaacucauagcucuaagugccucaaaaaaaaauauagagugagcuuacacuagcaguuuuacagcacaccugaaaacucuacaacaaaaagaagcaaauacaacaaagaggaguagauggcaggaaauaaucaaacucagugcugaaaucaaccaaauagaaacaaaaagaacuauacaaagaaucaacaaaaccagguucauugagaaaaucaugauauagauaaucccuuagucagacuaaccagaaggcacauagacaguauccaaauuaguaaaaaucagaaaugaaaagggaggcauaacaacagaaacuguggaaauccaaaaaaaaucaucagauccuacuacaaaaggcuauacuuaacuaauugggaaaaucuggaugaaauggacaauuuucuagacacauaccaggugccaaaguuaaaacaggaucagauaaaccaucuaaacagucccauaaucccuaaagaaauagaaauagucauuaauaguuucccaaccaaaaaaaauuccaggucaagauggguuuaguggagaauucuaugagaccuuuaaagaagacuuaauaccaauauucuucaaauuauuccacaaaauagaaacagaaggaacacuacccaauucauucuaugaagccacaauuacgcuuauaccuaaaucacacaaagacccaacaaagaaagagaacuucuuaccaaucucccuuaugaauacugaugcaaaaauacuuaaugaaauucucacaaacugaauccaagaacacaacaaaacaaucuuuuaccaagaucaagcaggcuucaucccagggaaguagggaugguucaauauauggaaauccaucaacauaauccacuauauaaacaaauucaaagacaaaaacuacaugaucauuucauuagaugcugaaaaagcauuugaccaaauucagcaucccuuuauguuaaaagucuuggagagaucaggaauucgcggcccauaucuaagcauaauaaaagcaauauacagcaaaccaguagccaacaucaaacuaaauggagagaaacuuaaaguaagcccacuaaaaucagggacuagacaaggcugcccacucucucccuaucuauucaauauaguauucaaaauuauagcuagagcaaucagacaacaaaaggaggucaaauggauacaaauuggaaaggaagaagucaaaauaucacuauuugcagauaauaugaucauauacuugugaccccaaaauuuccacuaaagaacuccuaaagcugauaaacaacuucagcaaagugacuggauauaaauuuaccucaaacaaagcaguaguuuuccucuacucaaaggauaaacaggcugagaaagaaauuagggaaacaacacccuucacaauagucacaaauaauguuacauacauuggugugccucuaaccaggcaagugaaagaucuguaugacaagaacuucaagucucugaagaaagaaaucaaagaucucagaagauugaaagaucucccaugaucauggauuagcaggauuaauauaguaaaaugagcauccugccgaaagaaaucuacauauucaaugcagucuccaucaaaaucucaaaucaauucuucauagaguuagaaagaacaauuugcaaauucauuuggaauaaaaaaacacccaggauaucgaaaacuagucucaacaauaaaagaacuucuggggaaaucaccaucccugaccucaagcuguauuacugagcaacagugauaaaaacuguaugguauugguacagagacaggcaggaagaucaauagaauagaauugaaaacccagaaaugaacccacacacauauggucacuccauauuugacaaaggagcuaaagccauccagaggaaaaaaagacagcauguuuaacaaauggugcugguucaacuggcggucagcauguagaaaagugcaaaccgacccauucuuaucuccuuguacaaagcucaaguucaaguggaucaaggaccuccacauaaaaccagaaucacugaaacuuauagaggagaaagugggaaagagccucggauacaugggcacagaggaaaaaauuccugaauauaacuccaauggccuaugcgcuaagauccacaauagacaaaugggaccucauaaaauugcaaagcuucuguaagacaaaggacacugucaauaggacaaaaggcaaccaacagauuggaaaaaaaucuuuaccaauccuacaacugauggagagcuaauauccaauauauacaaaaagaacucaagaaguuagacuccagaaaaucaaauaaccccaguaaaaauggaguacagagcuaaacaaagaauuuucaacugaagaauaucaaauggacaagaagcaccuauagaaauguucaacauccguagucaucagggaaaugcaaaucaaaacaacccugagauucuacguuacaccagucagaauggcuaaguucaaaaacucaggugacagcagaugcuggcaaggauguggagaaagaggaauaguccuccauugcugguggaacggaaagcuugugcaacucuggaaaucagucuggcaguuccucagauaauuggacauaguacuaccugaggacccagcuauaccacuccugggcauauacccagaagauacucuaacauguaauaaggacacaugcucaacuauguucauagcagcauuauuuauaauagccagaagguagaaagaacccagguguccuucaauggagaaauggauauagaaaaugugguacauuuacacaauggaguacuaagcagcuauuaaaaaugaugaauucaugaaauucuuaggcaaauggauggaucuggagguuaucaugcuaaaugaaguaacccaaucacaaaagaacacacaugauaugcacucacugauaaguggauauuagcccaaaugcuccaaauaaccaagauacaauucacaguccacaucaagcucaagaaggaagaucaaaaugugggugcuuuagggccuucuuagaaggaaaacaaaauacucacagaagcaaauaaggaaauaaaguguagagcagagacugaagaaaaggccauccagagacugccccaccaggggauucaucccauaugcaguuaccaaacccagacacuacuuuggaugccaagaagugcaugcugaaagaagccugauacagcugucuccugaaaggcccugccagagucuuacaaauacagagacggaugcuugcacccacccauuggacugagcgcaggguccgcaauagaggaguuagaaaaaggacugaaggaguugaagggaauugcaaccccacaggaagaacaacaauaucaaccaaacagucccccaagagcucccagggacuaagccaauaacaaaggagcacacauggcuccagcugcauuuguagcagaggauggccuugucaugcaucaaugggaggagcgguccuuguuccuaugaaggcucaauagaugccccaguguaggggaacugagauuggggaggugggagugggugggugguuggaggaacacccucauagaagcagggggagggagaaugggauaggauguuuccagagaggaggaaaggggauaacaucugaaauguaauuuaagaaaauauucaaugggaaaaauauuuuaucauaugaauaugcuguuuaauugauacacuguguuguuggugaccauuuggauugucuucuacuugaagacuauaaaacauaaugagacugugaagacucuggcauuucuggaaacacaucuacgauagcugcauuuguaaguggccaucuucauuaaagacugucaagcaguuuucuauuaugauuguaugcauuuucuauccugcagcaaugcagacaauuuuucguccucacuggcucuuaguguuauugaucuuuucucauauuagcucauucuggaaugguauaucauauuauucuuaguuaacauuuuaacaauaauuauaggaaaacugguaggcuuaggcauauggaaguuccuccaaaugugaaagguucacucaaauguaaugccugguuuaaugugggguucuucugucuuuugacugauuuuucaaaauauauuaaaucuucuagcuacugcuccuugucaggcauacuauccugaguuagcaucuacuccaaugacuaccuuuuuucccuccauuaacagugcuuuauuacaaaacaagcaaauaacaaaaaauuacauuuuaaugcauuuaucuuuuuuuguucauucacaaaaguaguuuugagucccaguuuacauauuuuccaaccuacucgcuuaaaauguacacaguugaaagcuauuuucuaucuuccuaaguuugauucuagucagcacagugagauuuuagaggacccugaucacccaacaagcuaacacucuggauuuuuccagacaccuuuaccaagucugaaguuugaaccauuuugugcauaaggcaauaacuucuuagaggguauuauccauagguacauguuguguaccucacacacacacacacacacacacaucugcaguuugacaaagccaguaagucuacacagugaacaaccaucacaacuuaggguuaaaauaccucuaucaauccacaauguuugcaauuaaacaguauucccuaccacacaauaauccuuuuuauaucauaauaaaucaaauaaauaauaugucaucuuauguguagaauacuucuucuauguaguguuuuggggagaauuucaguuucuauguacuagaggcccaucaccuuccaagcugguagugucuuuguuuggguccaaauaccugcuugcauggcuuggauuaacucuauccagauucggcucauuaugaaugacauuacuaugaagucuacacauuccuuugcauauaguuucauuucuucagaagauuuuuaaugacuguauguggaauugcaggguuauauaauaacuugccuucaaaagcaucuuucuaaacuaguuucuaaagcacauguaucauuuacguccccacuagcagugugcuaagccucugguugcuccuuugaaacacuuauuuucugaacaguugagucacuucaaugggcaagaaucggaauuucuuugugguuacaauaacauuugguaucuuuccuugccuucaaauuugcaucucucuagugacaguaagagcucacuuuucuaugacucuuugggauuacuguauauaauuauucaguucuauauauuuuguucugugguucuagaaaauacaguuuauauuaguguacauccuauaugcuaccgggcugcuuuuagugaguaucuuuguaggcuugugaacuggggaggggcugauaucaggugcuuucuacauuaacuuuguaagcuugcuaaacugauugcuuaaaguuacaauauaacuaaaugcuuugcaaaacugcuuuaucgccucuccacaauccaccccauuucuuucucuccagcccucucuauacuccacaggacuuuaaauuugaugcuacccagcuauggugaggauagcucccacuuaaugugagucuuggguaaaaccucgaguaucucacuuaacuaccaugguuguuuuuuaaauggauacuguuuauuaaugauguuuauuuaccauccaaaguugauauaaguuuuuaugagaaauagauauuugauccuaccauaaacuuuuccauauauaauaagauguucuuacaguuucucuccuuuuugcuguuauuacaccauccaauguuugugcuauucccagccucauuugucucucauaggaacaauugaauuuuaacaauuuuaaaaaauacuguuugguugacuauuaccuuaugauaugugccuucuugccacuguucaaauguauuuaacuucagugacuuguuuagcuauuauuuucuauugacccacauuauccuucugcuacuuugccacuuaaucaguaaauacagguuacagugauggcucagucaguaaagugcuugucaugcaaacaaaagaccaucaaaagccauguucgugucuauacuuugacaaguggcugccuagggcucacuggccagccauucuaguugaaaaaccccagguucaguaagagacacuauaucaaaagauaaggugcuacaugacuucagaagagacuugauauccacucuggucucaaugugcauuaguacccacaugugcaaacaaacacauauagcauauacacagcaaaugcuuuaaagagaagaaaaaggugacuggcaagucacuucuguguacacuuuuccaaaauuugaaccccuugguauuugucaaugguuccuuuugucauucugcauguaccuaucaaguguuauuugguauguaaagugccuuaaacagugauggaguguauacauuuuucaugggcuuucuauuugcucuguuggauguuuguugacuauucuaucacuaacagaagcagaacuucauaucuuacaaccagaucauacuuccuuuucuucgaauuuuuggguggcuaauccucugugcacauaagaagcuccguccugcacugcauccugaaucaucuuagucuguucuuugccucugcccaguccuuugcaacagcagacauccacaccugcucuucuagucugcaguguucgcauuuagucucaaggcaauguauuagcauggcagcuuccucucaggaacacacugccccugauuuugcauggcuaccugacuuaugucauuuagucuugguuucacugucaaaucugaaugaggccuucuuaagacuacucaucuaaucuuguauuccaccugucacauuccuauaaaugauggaaucuccaugagaggaauaauacuguuauaauaauaauauuaacacaacagaaauucaaaucagaaaauuucaaaacccacaaugcucccugaccccauuuccacauucaauauaaagcaaacaaucaguggggacugccaugccucugggaccacaagagcuucuguguuacaugcagagcaggaaaguccaauuucucugcauucaaaucguugcuuccucacuuucacaauguauguugggaaauggucaugaaagggccacagccucaacucccuaaaugacaauggggauagagaugcuauacauuugauagcauggcugacaucauguaauaaaugguauuuuauaugcuacaugcuuuaaugcagugcuggagucacagaaaguuguucacaaacaggagcuauuaugaugacaauguuguucaugaugauaaugaugauggaaauaauaagcaucugguaaauacuaaaucauucaaucaaacucccagacaugugcacacacacaauuaaauauugugauuaauuucuaccaaguggaugcaaccuucaucacuugcauuaacacauuuuuguaaagacuugguugcugugaguucuaagcuggguaaauuugguauugagaaauacagaccagccauuggaaguacugcaguaucucacaaaacugaaaggaggacugagaagcaaacuuuuugaagaauagaaaucaaggcagcuccagggaaugggaaggcaauagcucacagaugacaucucugaauacuuccacuuaaaugauuaaaucacauuagcaucuguguuuccacucaguucagaaucccaaaucuccaacagugaaaacaugaaaccaguccugcuacccggaccuacucaucucucuccuuagaggcagggcucggcauagacgaggguacuggccaccaucucuguggcucagagaacaguuccuagaaaagcauuuuuauuuuauaacagccaagucaucccaaacuguacagcugcaauccucgggacucuaucuaagacaggcuuucucuaaaaggggccauucuggucuacucuucacucauccugaacaguagcaaccaaguuaugcaccauuagcugcuugggaggaaguuaauuacaaauuaaauauaauugaaucauugaauaugcuuucaagucucuaaauagaauaacaacaugcuaccuuguagaaucaauuuugcaaaucaaagcucagccccuugcuuccuaggauaacagaaggcuuuugugagauuuuuaaguguagagauacaguagaaaaauguuuauugggaagucauccaaauugaagggaggagcugaggauguacuuauugaaacacuucuugaguggcaugcccacugucccgaguucauuuccuagucucucauuaauccagcaucguggugauuaucuaugacccaaacacucagugguggaggccagaggucagaagcucgagacuauccauagcuacauagugaguucaagggcagccugggauguaugaaaccaaaauguagaggaagguauguucuuagauacugugguucauaaaaaccucugaaggaaccuggugagaaaauaagaaguucaccagugcugagauaaguuucauauuugcagacuccaacuuuaauaaaacuuuugauuucaaaauuccuuucuguugccuuuuuaaauuuuuuauuagauauuuucuuuuauuuacauuucaaaguuauccccuuuccuuguuuccucacugauaaaacccuaucccauacauccuuacccugcucacuaacccaccuacuccugcuucccuguccuggcauucugcuacacuggagggagccuucacaggaccaagggccacuccucccauugaugucaacaaggccauccucugcuacauaugcagcuggagcuaugggucccuccaugugcacucuuugguugcugguuuagucucugggagcucuguggguacugguuggcucauauuauuguuccuccuauuguugcaaaccccuucagcuccuuggguccuuucucuagcuccuccauuggugacccuguauuuagucaaaugguuggcugagagcauccaccucuguauuugucuggcacuggcagagccucucaggagacagcuauaucaggcuccugucagcaagaacuucuuggcuuccacaauagugucuggguuugguaacugugugugggacggauccucagguggggccgucucuggauggucuuuccuuccgucucugcuucacacuuuguaucuucucccauggauauuuuguucccccuucuaagaagaacaggagcauccacauuuuggucuuccuucuucuugagcuucauguggucuaugaauuguaccuuggguauuccaagcuucugggcuaauauccacuuaucagugagugcauaccauguguugcuuuuacauacuacuuuagcaaaacaaaaaaguagcauagaccuccuaacacucauucaugagucauccuccagagggucuugaacugcagcagcugggaaaaggcauccagcaaacaaguguagaacuggaaugggagcuggaaaugaguugucagcagagaagcauugcauguauggagagugguugagacccaaagacacuggggaaugucaucagcaggagaagagaaagcuagcuaacauguacgauucccauagaaucccuggcaucagugaauguccccuguccugcugcuguaggauuaucuuauuccuagauuuuuuaauguaagcuaugcuucuuagacauguuuucaguagcaagacaauuauauuucauguuuauaaaaccaccaugaggagggagaccacaucgugaagacgagucuucaguuggaccagugguucgaugcccuacucaggugcuuaccaguugugugacauuuggagauuaguucacccuuucagccuuaccagguuuucuuaucuagaauagugaaagcacuuuuaucuaugccucaauuauguuguuaugaaguuaaaugaggcagcagcuauaaaagcuugcuuccacaucacaaguacuuugcgaacucuuaucauuaucauuguuacuuuucuccuuucaguuuuuaauagacauuugcaagauucauguuccuagcauuuaccuuuagguuccagaacuacauuuaaaacaaagacagcagccugaacaaucaggcuucacacaaauuucaccaaucaccacauuuaaagcuaauaaaauuuucacguauuaucccuaccauucucaaggagaaaaaggccaacuuaguauuuccaaaugagaguggcccaggaucucagaacaaaggaaauuucaaugaucacagagagaugaagacaacagguaugucaagaauuggcacuggggcaccauuacaacaagcaaccaaaugacaauguauagaaugggcucuuuuacacauucuguuacuugaugccuuguauacuuggaaugauuucccuguagcugagaaagauggcucaaggguaaguaucucccuaagagcuauaugaucccaguagcagaggcccucagugauucccucucaguccuagcaacaagucucucucucacaugcccacuauccacugucuacuuccaauucagaaaucucugccacuggaaauagcaaaccacucugaaauaacuggauagagcuccaaccagcacugugaaaugaguuuugauaggagugauccuauuugaaagcauacaauuagccaaccucaaagucaaucaguaaaacgaguaaguaaacaaauuauugugcaucuauacauucaaccuuaaaagaaauucuauacaggugauaauggagagagaaguuuuaagugagaagaaggauggguaagcaaggcagaggauuggaggggugauaacuaauacucuaaaauugggaauguuugacaaagccauauagaggucuauuauuuuauaaucucucucucucucucucucucucucucucucucucucucucucuguguguguguguguguguguguguguguguguguguguguaacucaaaauacccuacauaggagauuauguucauccuggaagcugugaauugccaauuauaaagccuaaugcuagauguggaauaccucuccucaauuuuuuggagaacaucuaaacaauauaagauuauugagauuauugcucuugaguggccaccagaauuauaugguaagauccccauugccaaagauaucacacauauuggucagaagccauggaaaaaucaaguugagacuaaccaggaaaccuccucccugcugguuaccucucacaggacuggaaguugcugugcaggcugauggagggguguggagggaaacucaccucuacucuuacccaccugugcaucacauggacugcauuaauaucuauauagcaagauauacccaaggauguaauagugccauacaugcuaugguuguauccaccuacuuucugauuaaauuuaaaaccugaugucaaggagaagcaugugccugguacugcaaaucucacaagaaguuauuguuggagauuucacagggcccuggacugaaucuacgagucuuuuguuaaauggacagaguauuacaccauaacucuuuaccuauagauuuguacagcucucagacaacaucaaagauaccuucucaugucaugaauggcugcuaauacagaaauauagagcugaucaaacugcacagaauaggugacaaagagacaagccacaaacaugacauuuauaucacaccccaucugaaaggcuccaggaccacugagaaagauggaucagagugacuuuaagagucagagguuggaaaggaccauagcaaaacagugucuuuuguucaugacagacugcugcacuuaauagcucauaguagccaugauugaucuucacaaaauaaauccaauugacauuccagcauagaguaaaaggguuucuuaagcuccaaaccucacugaggggucuuaugcaacuguuggcuuugaugaaaaugauagucagcuuuuaagaacauggcucucagcaggugggccuuaugccaggagauugcuccauagcuauaaguacauggacaguagaauuuggaguugauggguuauuaaaaauauuuuuaacacauaacaacuugaaaaaccucaaaaauacacuauauaaaauaauccagccauauucuaguguuccacuuagacaaaauugccacaucuaucauuguacagagucuaggaaggggucagugggaagccuugacagacaagagaucuggcugaggaacauaaaauaguucuguagauagguaacagugagugagauuugcuuaauaaugugaauacacuuaaagccuuaguguugccuuaugcuugaguuuguuaaaacaguagaaugcauauauguuuugugcauauuucaccacaauuuuaaaacaauaacauguuuuaaauaauauaauccagaaaauauaaagaggacugcucaaagaggaugaauucagagggacuagaaagcaacaaucaguucugagacucacuguaaauauacacugagccuugcugcauucagacccauaugaucugugcauggccacuagguauaagucaugaaaagggagacuuuauuuaagaacuuucaacaauacucuccaaauacaagcuagacuuuuacauuuuaaacuauaaguuaauuucccuggaaauauucaaauauaaauuaaauauucucucucacaagagauaguuacagaagcagaaacggauuaagguuggacuacauuaguggugccuaaaagcaacuuaacaggcuaguccaacauucaacagaauucccuuuuuaguauaugaugagaugaauauauugugaggaauuuauaaggcucaauauaugauaauuuuaauccuaaaaugauaccuucuucucaagugucaaagugacugaucacauuggaaacaauaccaaauuauguugucauuuuccauguuuuuuguguggauugggaauaaaaacuuaaugaagucaggccagccuuuaguguuaggaaggaagaucacacugauuaauuauaaguucugagaaucauaaaguagccuuuggauauuauuugaauuuuuuuguaccucagcucucucaucugaaauggcaauuguauuuucaucuauaccuuuuuuuaggauguuacaaggauaaaaugagccaacaagucuaaaagggugcugucaccaagggucaagggcuauugcuuuuaccuaaagcugcaucuuguguuccuuuuaagcguauuuccacuacuuguguggagugaggcaaaccucagcaaaauuuuacccaaagcuucugccuucacaauugauacagaacgugaauguauccucagagucacaggaacguuuaucagugauaaggagagaacuuugcuuuagaaugccugagccauguucaauacugaggcaaucuggcaagugccaaacaccacuguccucagucccaguacaccgugaguccaggagaaaacaaguacaugaauguuaccugaauguguacguauuugcccucaucugugugcucgugaagauaaaaagacaaaaauugaaauaaauguggagacaauaaccaugguaagaggaguuauacucuuauauccaagaucaguuaaugauaaucaaaauaagccugaaauaugagugccucugccgucugaucgccagcagcaacaacuugucuguguguccauaguccuuucuuuguugcucuuuuaaagucaaacaaaaauguggagguaccaaauaacuucauugucaggagacaaaagaauaaaagggcaccaaugacaucacucuguagaacucccaccccacaccagcuuuuuaauccuacuauuuaugcuuuagaaagcuugcaacaucugcauuuacauuucauggaaaacacuucucuuucugucacucacaggcugucaggauggcauugugucugugcuuuaaaaagagaaacuccguucaacuuggugguugauaaagacauuucguucgcaucccuuaacuaacaauaauuauucuaauucaccacaugaagacaaggaagaaaaaacauucaccuuuucagcuuguuuuucaucauggaacacagagaaggagaaugcccacacuuuugagauuaaaaaacaacuuauuaagucagaaaauuguccuuguaagauugugugcuuuggacaccuccuguccacaagguagaacagcggacaggggucugagauagcaaauuacucuuagauucgaauccuggcguggcuccugcauaaccacaagcaaagcccauuucccucuaagucugauguuccuggucuggaaaauggguauccauccgaaucaagagcuacaggaaauguuuccuaagauaaaguuacauaauuaaaaaauguuagcugcuguucuguuuaucauccugcuucucacaaaccacacacugcucuucucacccauuuaaggcucuuaaaggacaaguaaccuaaggcacuuuccugaguuuuaaagacagagaaagugaauugccugauugugugcagggaaaacugaagugcugcuaaggaaaacacuuagucacaggaaucagaagcccaggaacgaaugugguccuuuaggauaccucuaucagaagaaucacuugcaacaacuucuugucccugaaucaauguuuuuaagauugggauuccuggaagaaagaggcaaagaagacagaaagaugaggcuugcuucagucacacaccacuucuucuucuucuucuucuuuuuuuaauuagguauuuuccucauuuacauuucaaaugcuaucccaaaaguccccgacacccucucccccccacucccccccgcacucucuuauccacccacuccaacuuuuuggcccugguguuccccuguacuggggcauauaaaguuugcaaguccaaugggccucucuuuccagugauggccgaccaggccaucuuuugauacauaugcagcuagagucaagagcuccaggguacugguuaguuuguaauguuguuccaccuauaggacugcagaucccuuuagcuccuuggguacuuucucuagcuccuccauuggggcccugugagccauccaauagcugacugugaucauccacuucuguauuugcuaggccccggcauagucucaaaagagacagcuauaucaggguccuuucagcaaaaucuuacuaguguaugcaauggugucugcguuuggcggcugauuaugggcuggaucccuguauaugguagucucuagaugguccauccuuuugucucagcuccaaacuuugucucuguaacuccuuucuaucaaggagagaauaaauuguuugacaguuccgauauugcuaugguaggguaggggaugcaguuccucucaggacaugucuuauugcacagaaggauagccuagaugcugagcaggcacaaacaccagcuacuacugcaucauagucugagagccaacuggaccaaaugaaguuaggccucuacccuuuccuccuuucaucugucucuuugauaauuagcauuuucauauauguuauaacuuuaaguuguaauugaaacuauuuugaaaaacuuauagguucugcuguucuaaaguguuuauguaccauuuuuauaaaaauuugcucuuguuauaaagaaauuauguuguugaaagcuuucugauggaauuuccaggaaaguaauuuuugcuauggucaaguuauuuagcauuguuuguacuauaacaaaaaccaaacauauaaaguaucuacugaaaaaguuauuugaagauaacuuaaauaaauagucuuguaaaaauauauuuuauuuuuuaguguucaguaagaugauaauuaugcucagagauuagaguuaaaugcaaaauuguguuuugauaaauuuuguugaugaggccucaaugaaaaaggauuaacaauaaaaaccaaugauguaagaauaguaauaaauaauaaugggcuauaugacccauaauuccauuaauauuuucuuccagcuuacuagcugaacaaaucccaaacaauaaaacacacaaaggcugauuaauuuggagucugaacaucuauugaguucagugaaaauaugucucauaaaaccugagucuuccaaucaugcagggcugagacaacucagcuccacccguaccagccuggugacucuaaacauguuacuaauuggcaaaauacugagucaaaaugacaauaauaucaaaggugaaagagggaggaagugacagaaugggcgggaguugauacauagcagugcagaaccuguaacagacaugggagaggaagcacauccaaggccaguacagaagaggaaaucacagcagcaaauugggagcuagacugacacauagaaauucucagauaagcccugugagccugaagacucucauuuuuaaguagacgcaauagcccuaacaggcugucaauggaucugacaaucacccaucaccaaaucacuaugauuacccaguaucuguaagcaguagguaugcacaauuguaugcaguuauuguucuuaauauauggcaaacauauaguuauuuuuaauaugguacugggcuucaacauauaguuauuuuuaauauaguacuuggcuucaugggaaauaucuguacucaagagcauucuuuagcuucuuggcaagaagaaaucaacaucaaauuaaucuuuacaauaaggagauucuuaucagccugagagccucaaaauaaucuuuaaaaauaaauauauauguaccuauauagaugugcacuccccucugcaauggaggauauagguacauacgcacacauacauguacauauauggccauauggucauauagucauaugugcguguuucuuugaugauaaugcaaaaaugguuuaagaccaaugguuuccuuuuucccaauaaguaguaguaaccaaaacauagaauuuuagaaaagaucaguguaaaguugaagagguaguaucugggaguaguuaugaacuccaaucuauaagccagggauacggcucagaaaagcacuuugaaacugcaaaguugaaacacuaaagagaaucugccuagacuagugguucucaacuuucccaaugcugugacccuuuaauaaaguuccucguguugugaaaaccccaaccauaaaaucauuuuuuguugcuacuucacaacuauaauugugcuacugucaugaaucauaauguaaauaucugugucuucugauggccuuagguggcuccugugaaaggguccugauccacagguugagaacaccggccuaaagggaccuuacaauaguaaacggaaacaucauggaagaauuuagcacaaugcccaacacaugauguauacucacuaaaaaugagggcugugaagaugggcuuauagacuuuauguccaguuggcaguagauggcuuuaguuuucucuaacugcacauaacaagcaccaucaaagaaauugaaggaauuuaccaacagaucugucugcuaccagcucagccaggagguccugucgcaugcccacauaagaaaacuuauguguccuaucagaccaccauggccuaaggcugaucuucaauaacaacauauauaagggaaaguggaaacugaacaacacucuuuucaaugauaccuucgucaaggaaggaauaaagaaagaaauuaaagacuuuuuagaguuuaauaaaaauaaagccacaaaauacccaaaccuaugggacacaauaaaagcauuucuaagagggaaacccauagcucugagugccuccaagaagaaacuggagagagcacacacuagcagcuugacaacacaucuaaaagcucuagaaaaaaaaggaagcaaauucacccaagaggaguagauggcaggaaauaaucaaacucaggggugaaaucaaccaaguggaaacaagaagaacuauucaaagaauuaaccaaaugaggaguugguucuuugagaaaaucaacaagauagauaagcccuuagcuagacucacuagagggcacagggacaacauccuaauuaacaaaaucagaaaugaaaagagagacauaacaacagauccugaagaaauccaaaacaccaucagauccuucuacaaaaggcuauacucaacaaaacuggaaaaccuggacgaaauggacaaauuucuagacagauaccagguaccaaaguuaaaucaggaucaaauuaaugaucuaaacagucccauauccccuaaagaaauagaagcagucauuaauaguuucccacccaaaaaaaguccaggaccagauggguuuagugcagaguucuaccagaccuucaaagaauaucuaauuccaguucugcacaaacuauuccacaaaauagaaguagaagguacucuacccaacucauucuaugaagccacaauuacucugauaccuaaaccacagaaagauccaacuaagauagagaacuucagaccaaauucccuuaugaauaucgaugcaaaaauccucaauaaauuucucgauaaccgaauccaagaacacauuaaagcaaucauccauccugaccaaauagguuuuauuccagggaugcaaggaugguuuaauauacgaaaauccaucaauguaauccauuauauaaacaaacucaaagacaaaaaccacaugaucaucucauuagaugcagaaagagcauucgacaagauccaacacccauucaugauaaaagucuuggaaagaucaggaauucaaggcccauaccuaaccaugauaaaagcaaucuauagcaaaccaguagccaacauccaaguaaaggguaagaagcuugaagcaaucccacuaaaaucagggacuagacaaggcuguccacuuucucccuaccuauucaacauuguacucgaaguccuagccagagcaauucgacaacaaaaggagaucaaggggauacaaauuggaaaagaugaagucaaaauaucacuuuuugcagaugauaugauaguauauauaagugauccuaaaaauuccaccagagaacuccuaaaccugauaaacagcuucaaugaaguagcuggauauaaaauuaacucaaacaagucaauggccuuucucuacacaaagaaaaaacaggcugagaaagaaauuagggaaacaacacccuucucaauagucacaaauaauauaaaauaucuuggcgugacucgaacuaaggaagugaaagaucuguaugauaaaaacuucaagucucugaagaaagaaauuaaagaagaucucagaagaugaaaagaucucccaugcucauggauuggcaggcucaacauuguaaaaauggcuaucuugccaaaagcaaucuacagauucaaugcaauccccaucaaaauuccaacuaaauucuucaacaaauuagaaagagcaaucugcaaauucaucuggaauaacaaaaaaccuaggguagcaaaaccucuucucaaggauaaaagaaccucugguggaaucaccaugccugaccuaaagcuuuacuacagagcaauugugauaaaaacugcaugguacugguauagugacugacaaguagaacaauggaauagaauugaagacccagaaaugaacccacacaccuauggucauuugaucuucgacaagggagcuaaaaccauccaguggaagaaagacagcauuuucaacaaauggugcuggcacaacugguuguuaucauguagaauaaugcgaauuaauccauuccuaucuccuuguacucuggucaaaucuaaguggaucaaggaacuucacauaaaaccaaagacacugaaacuaauagaggagaaaguggggaaaagccucgaagauaugggcacaggggaaaaauuccuaaauagaacagcaauggcuugugcuguaagaucgagaauugacaaauggguccucaugaaacugcaaagcuucugcaaggcaaaagacacugucaaugagacaaaaaggccaccaacagauuaggaaaggaucuuuaccuauuuuaaaucagauaggggacuaauauccaauauauauaaagaacucaagaggguggacuccauaaaaucaaauaaccccauuaaaagaugggguucagagcaaacaaagaauucucaccugaggaauaccgaauuguugagaagcaccugaaaaaauguucaacauccuuaaucaucagagaaaugcaaaucaaagcaacccugagauuccaucucacaccagucagaauggcuaagaucaaaaauucaggugacagcagaugcuggcaaggauguggagaaagaggaacacuccuccauuguuggugggauugcaagcuuguacaacaacucuggaaaucagucuggcgguuccucagaaaauuggacauaguacuaccggaggauccagcaauaccucuccugggcauauauccagaagaugucccaaccaguaagaaggacacaugcuccacuauguucauagcagccucauuuauaauagccagaagcuggaaagaacccagaugccccucaacagaggaauggauacagaaaaugugguacauuuacacaauggaguacuacucagcuauuaaaaagaaugaauuuaugaaauuccuaggcaaaugguuggcccuggagggcaucauccugagugagguaacccaaucacaaaagaacucaaaugauauguaccuacugauaaguggauauuagcccagaaacuuaguauagcgagauauaagguacaauuugcaaaacauaugaaacugaagaagaacgaagaccaaaguauggacacuuugccccuucuuagaauuggaaacaaucacccauggaaggaguuacagagacaaaguuuggagcugagacaaaaggauggaccaucuagagacugccauauccagggauccauuccauaauuagccuccaaacgaugacaccauugcauacacuagcaagaguuuauugcaaggaccgugauauagcugucucuugugagacuaggccggggccuagcaaacacagaaguggaugaucacagucagcuauuggauggaucacagggcccccaauggaggagcuagagaaauuaccaaggagcuaaagggaucugcaacccuauagguggaacaacauuaugaacuaaccaguacccuggagcucuugacucuagcugcauauguaucagaagauguccuagucagccaucacuggaaagagaggcccauuggacaggcaaacuuuauaugccccaguacaggggaacgccagggccaaaaaaugggaaugggcggguaggggaguggggggcagggaggacuuuugggauagcauugguaauguaauugaggaaaauacguaauaaaaaaaauaaauaaaaagaaagaaaacuuaugugacaugccaaagccagugagagaaacugcugggacugaccucaaacuuucacuucuaaaagucucacugaaacuuccuggucuggaaagcccccugggacccugugguacauaaacacaagaagugcuuguuuguuuguuaaugugugcaaugccaagcucaccucucaaauagcacaucuacucaucaaguacagucugaccuggaugucuccucucuuuugaaguagcccuuuagaaugcugggaaaggaauuuugcaucaccuuccucagguaagccaacacaaguaaucucucccccugccucaguguccauugaagcuucuucaaaggacugcauggaaauggccuuccaagguucucuaauucuaaaaugauacugaagaaacaugacuucacuauacuuugggggaggggugaaaucacugcacuuguguguacagggggaagccauugugcuugugugugugcagguagaaguuacuaugucugucuaugugaacggggacgucacugcaccugugugucugcagggggaagucacuacacuuaagugugcaugaagugacaucaguauuaaucagagugcccuuugcacagcugacagacaaaggagaugugcucauaagcaacagcuucucaccaacccucagggcuuuaaaucuuuaccaaauaaaccgcaauuuguaaagaacaccccugaaaugauguucaaggaaguuaaagcaggcacagaaggauggaguaacauuucaccaucugccugagacacuaauaaugccuccaccuuacaaaugucuaauugacugugugacagaagcauaaagauccugccacaaucugacaaagaugaucucuccgguaugccaaggucagugcuccuagggaccaauuucaauuuuugcacagaggaacuuccuaguggcagugugacagaugaccuggaauguaggugggcaggacugaacuaaguguacuaugguugcuuaaagcaaugccaagcuggggccacacagagaucaaagaggaagggaacaaguugacauggagcuccaacaagugcagagaguggaggaaaaccugucuagucuggagagagccuggcuucucuucugccucugggguauucagccaggacucaaugcugggaagugcuggggggugacacugugcuuuugaggcuuggauuuuacugggugucauuuuccugaaaaugacagagauggcucagcaauuaaaagcacuggcuguucuuucaaguggacacagguucaauuccuauccccuacagggcagcucauaacugucuauaauuccaauuccagagcuucacacauccacacagauagacauauaugcaggcaaaacaccaauguauauaaaauaaaaauaaauuaugauuguuuuuaauuuuacuuuuugagaggguuucuuccugccuaguucuaaaucaugaaagauaaaaccucuuccacuuacaaauauggaacuuaguauguaaguaguaaguagaauuuuauuuucaccuuauauuaucaguuuccauuuuugauaaacauuaauagucuucuauucaugguggcagucuacaaauuguuuccacaaauuaauuuauguaaaugaaugugaacugcuguacaaaggcaucaggguacaauaagaaagguggugugguacuggugugcagcgcacuuagcauuagcucccuuugugcuuccacucuucccaugagcuccuacacagaagggcuugaauagacagaaguggaggaaacagaagcaucuggcuggcacaaaccuuugcaagucuguuuuucuaaagggagcauccagcaggcaugcuggcccaagccaaauggaaacuggugaccucauuuucugcuucuuccagaucccuguaacuggaggaccacuaaccacaacuaggggguuaaauugccagcacuugagaaauggugugucaguuaaggguacuuacugcucuuccaggagacccaaguuuaauucccagcacccacaacccagcugacaaccaccuauaacucaagcuccagggcuaucuuacaccucuagucucugggggcaccggcacucagugugcaccuacucccacacaugcaugacuguaagaguaauaauaacaauaaugaaaaccugaccauaaaauuacuauguauuucauauacacgguaccuccauauguauaaacccuauacaaacaauagauuuucauauauacauauauuugcacauauguugggauucuuaguacuaauaucaagaacugaaauaaaucauccuuuuagauuuuuuaaacugacaaguagcuaaauuuaccuuuauugauaacuaauuuagaauaguuucauucuacucauagaaaaauuaauuuuccaguaugaauuauaaaaucaauuagauuuuuauuucuuuuuucaguuuuacuauuuuuuuaacuguauguguguaucaggcauuugcacauauaugugugugucugugucugugugucuauguuucuguguaugucugugugugugaauguguguuauacaguacuggguguucaaacacuaagcauguaugauauaccuuuccuagacccuagaauagcagauaugauuaaguuuuucuuuucuuacuaaaccugaaaccaaaccaacuuuaugcagauuuucaguaugguuuucuagcaagcaugccagaaaguaaugucaguauaagaaaugaaaucuauuguugcguuaaaguuccuacuaagacuaacauacguagaaaaguaggauauacauucaaacucauacuagguuguaaaggauuuaucucucccaguguacaucuuauaaagggguguggcaaguguguggaaaggagcuggauaagcgugagagggaggacacauuuuuggaucccacccacauucaaaucugaguauguauaauaagucauuuccacauagccucugauauaaaaaagucaauucccuccauguuccuuauucuucuacacagacaugugucugaaccuacaaaccacacugcugacaaaugaccuuuguggucuuccaguguucacaacaacacugaugacuuggaguccaucaguaaauuccuucaguccaaagccgggcagugguggcacacaccuuuaaucccagcacuugggagguagaggcaggcauauuucugaguuugagccagccuggucuacagagugaguuccaggacagccaggacuauacaaagaaacccugucucaaaaaaaaaaaaaaaaaagaaaagaaaagaaagaaagaaaaggaaaaggaaaaagauagaaagaaagaaagaaagaaagaaagaaagaaagaaagaaagaaaggaaggaaggaaggaaggaaggaaggaaggaaggaaggaaggaagaaagaaagaaagaaagaaagaaagaaagaaagaaagaaagaaagaaagaaagaaagaaagagaaagaaagagggggaggggagggaaggagggagggagggagggaaagaauaaaggaaauuccuucaguccagccuccaaaaauguuaacagaauacaagcacuucacaucaacucuaccagaacucuccaaaucaaaccacuaccaagucucguuggaaggacuuuaagaaucuuuacgagccucaucuuuugcuggaccccugauuguauauccuacucaggagccuaugaaaauguaagucagaucacaucccuauuuguucaagggcuaucaguacuuucccaugucauacauaguaaaaccucaaaaguuccuuuacagguaucuucagccaugccucaggcugccugcccuugucucuugguccaucagccucacaggccucuguacuucacacuuucaggcugguacuuucuauguccagauuuuuucacuucugcucccucuagcugggggaccucuucuucaaggagacauauggcugcuucuacucuauaaccucaugucugaugaaguccuagaucacggaagcucaggcccacuuccacaccucucugcucugccucacguugauaauuccuugugacauuagcucccugugacuuacucuuccauuucuccccuucaguguuuucuuccuuucuugcuccuucuuuucuuuccuuaaccauuauuggcagaauacguuggccaccagaaaauaacaucccaaaguauugcacuuuggcauacugaguacuucaaaguaaaagaaaaucaagauccaucugacuugcugacuauaacuccuuucuccucauaaacauagggaagggcuuucucaguuuuccuuaucugccugaaagcaguuccuacaguagaagguaauuuucauugacucucuuuccagagaaaauuaguucaugucacagaaaaggggaagaagaaucaaugcccaccucccucagagagaaccuggcacagccuauucccuaucccuuuaaaggcugaucugauuaucuguauaacaagucacuucacccuacauaaccuguggccaccauccuauaaauauccuaaccaccuauuucauucugcagcucagaacaauauauaaaauucaaauucuuucauuuccucaagcaauuauacuuuucaauguucccuaccauguagaugcauguuucauauuuguuuauauuuucuacuguuaaacugucuauugucuauuucaucgacuccaauuagugaaccuucagaguggagagggggauguuccuuuugucccuacaguauagaagcacccucugcuuacaggcauacucuguucugcuuguuccuaugccuagaauagugcccaguucaaaccaagcacaccaccugcucugauaaaaaugcagccaccaaugaaaccaggcaccacuccacagggggagaagccuuugcaucucaaaaugcagccacuucgcuugaguggguugggcucagccuccuguaacagcgggauaucaaggucuuaaacacagaaagauagugcuggaugauagaaaguaaaagucuuuugcucuaggaggaaaugcggauguuaucaaaugcugaauguguuugcugguaguuguguagcuauagaacuguauucuuacauuuuaaauuccugcuaggauggggguugggcugcaagcagcacugauuuccaaccuaaagcucuccaguagcuuuuagcuacggcuccugaaacaaucauuuuauagucagucugugacaacaugagguuuaaaaaaaaaaaaaaaaaaaaaagcaauuaucacauuacuauagaauaagcuauaacuauccaagcuuuccuuaucagaaacugauagcuacccuuaaggagagauuaccugaagcauaucauucguccacuuaaacuucagcaugauaugugaaaugaauggcuauaccaggcuaucucugacauuugucacaaacuccauauucagcaaggcaaaucauaggguccaguggcaagaauuugggguuugacauuugagacugguauucaccauuuaccacuaaugcuuuucauguaugauauauuuauuacucuuaauaccaaccuuacccaguccucucagaaccuuaagcuacaguuggaggagcaccugaggcaacauuguguacacagagcucugguuuacugggaagagcacaucaugaggaacauugcagguaccaguguguauuuguugauuauaugaagguaaagcuacaugaaaggcaauucaaacaauaaaauaaaacaaaacccaagcuuucccacccucccaacugccacaacaacuguagggaugaaagauggcaaugaugaaaauucuaaaaaugcucuaaagcaagacauguugaaagagcauuuuuaacucucaaagucuccauguugacagcuacuaccaaauaucugcuuaacauuugcccacuucagcaauggcugccuuaccagcacagaucuagaaagaaauuauuuauugaaaccuuaugauguccaaagaagaaaaauagaaucuuucccuuuauagucaaauuugagucauaugggaugucucaucuuaggaauaaguucuugccagaaaacgucagaaacugaguccacaaaacccacacaggauccagccaucacucaucauuuaacuccugccaguaucugcaugacauuuugcagacaauacagacucaaagaugcucuaagaucauaguuaguagguaguacaaucaagauucuacugccuucaaagaccauguccuucaccauauauaauacauaacuugagaauguauacugaguaaucucaguaguuuuguuaugaugcaacaauuuguuuaacacuguacuaacacuggcucaauguauuuuuuaccaucuaugcuugagaauaagaaaaagucaagcaaugggacaagcauaggaagacacauuuuuaauauccuguucugcaccuuggccccugcuuguguggcccaacucugguccuaaccuguaggguagcucuguagucaguaaugaggagacacacccccuaaacaaugcuccaguccugucucuguuacccaacaacucuuacaauauuuucauuuucuuuccuucuggggcaaacauguuugcuuuagucauuacggccauugguugacuugauuaggaagcagauccuaauuaagugggaccaucaaaugcugugagauaugaaaucucuugcugcuaaauugcacacaggcugaaagugaugaggacuuguuuagauaugcacagugcuuuauauuuggggacuagcaguuaccaagacacuuagaucaaucaucauuaggacgacccuaucucagcugcccggggaaugaagaucccugugcagagcuaccugcccagacuaauggucaagagguugaugaggcguuaaugagacuaugaaucaaaaccuaccaaauaaacaauccccaaaggcccaggcuucaaauugccucuguuucacuuuaucuuggcaccaauauaaaacaaaaugaccaugcuaaauaucugucuuacugaccaguuuuguaaauaauuauuuuuuuaauuguuugaagguaucauguauuuauacaauauauuuugaugauauccaguuaccauaaccuccuucuaauuccauguagugucuucuacaaauagccauccaaauucagguccuauuuuuuguuguuauuaauaaucgcaaugccaaccagugauguccuuguggccaucuagugugacaugaacaacuuauaaaucaacauuuaaaucuuuuuauugugcuuauauauuuugggaugagauuuccauagcuugaguguggaggucagaggacaauuuguauaacccacauugugggauggaacucuggucaucacacaaagcaguguaauacuugccuuuacaucuuggcacuuacuggcauauauuuaaacaauucuuucaauuaaccauaaugccuccauuucuaaguaaaauaaagaaggucaaagggauuaaaguauucauauaaaauccaaauacugaugagagucaacuuuauuaauuacuuucuacuaaguauauuugcaucuauaguucuuucaggaaucagacaucauaauaacaacagauaccaucacuaagcaauuaggauacacaaagcaccaugcugagugcauucacucauuaacuaauaaccauguagccugagucuuggucaauucccuuucuaugaucccacaacaccaauaccucucugucacuaaggucaucauaagcucauuuaucuuuugacaacuguaucucaagcugugagguucaugagcuguaagaaccagguccauguguacuuuacuguguugcuauaaccacagcuuuaacacacacaggauuguaggagcuguuuuaaaaacauuugauaaauuaaugaaucaaacauauaaaaguuaaacaauaacccuaguuauauuucagauaauuagcauauaccacauuugaccccagccuccugagcaugugucccuaacccagaggacaaguucuuuaggcuggauagucuucuauaucagaauaaccagagaacaagccagagaaaugauacuguagagauaugagaagacaaauaggacucuucuucacuacggcaauaaggacuuauugcagaguuaaugcuagugggcacaaagaaaagcuuugaguccaugagcagucuuuccaccugucucuuuccauucccuauacuguaucaacuuuauuauuauuguggugccugaauguuuagaacccaaaaaaugcuggucaagagauacacagauuucucaaccaauuaaagccuagcaacaaauguuuuaauaucuggcuuauagauaauggagaaaauaaauggacaauuuaaaauucugcuuaacauguacuaagauacuaucaauaacaacacuuacuaacagccuuugcccuagugugaccauugguagccacaagucuauacuuugagccugaucagaucuggguucuaauuccagguugacaauuucaauucuguuagucaugggccaaauuauguaaugucaacauccucauucacucauagagauuauaauuuauauaaguaucuggucuagaauuuggcauugacacgggaagaaaaccaucaguuagugguuccaucuccaucaccuuccuccuuaccauuaugcagucagcugugaaugucauauaccugcuuuggacacugguucccuucacaucgaugcaaagcugcuggauguggguuuuauuuacacuugagaguaaaaucaugaugcauacagaagagucuugccucucugcccugcuaguccuagcgaaaaauggaacacacccuguccuuugccccaucccugggaccuaugagcucugaaggggcugggaacuuugaccugcacuaaagccucaauauuuguaacacaguuuaaggucguaagcuuacaacuugaggcccaacaacaucuggucccaauggcuucccuucaauucaugguuuaaaaaguauuuccauuaagaauaagaauuuacuccaacaaacucauuauggguacaucaacauacuccauuuccaucuauuugugaacuucuuugguuuuacaucaacaaaucaccuauuuuuuuuuucagucagaacuauugagcucuuuuguucagugauaagauauagccaugagaaagauaugcuucaagcaugagagggugggcuuuaacuuugccaaacacaauuuuacucaauucaaauaauauucaugagcaugauggguauuguagguacauaaauucaaguguuaguaauuaaguaaaugagugauuuaguucuauucuugaugcuaaauacaaccccucagcaggcacucucaggaugagaguagcguuauccgggaagaugauaauagcucgaauacaacuuucugggcugaaaucauggcauugugagauguuggacuuuagucaccuugucugugcucucaucauuaaauugauaccuaccuuguuucacuacacccuauuggagccauagcaaccaccacucauguauaaauucaaagcccacuuuuaaauuuaauauuaacauuauuauuaauauuuggagaaauaaaaugugacuccuauaaguuaugacuccaguccccaaucugauuaacuuugugguuuucaugcaaauagauagauaagcuauuuacuaaucuuggucuuaacaaugcuuugagacauucaaacagugauggcaagaaaauggcuuccugugaguucacacagguuagagaacaggucuaucuggucuucaugccuacguaaaucauggaguccugaaaagaagugcauuaaacauauuuuguuguuuuguuuuaacuguucaagauuuacuuauuuauauguaugaauguuuuggcuauaugugugucuacacaauguauucaugccuaauaccauggaggucagaagaggacauaggauccccuggaacagcaguuacaaccacauauggcugcugugaauugaacacuaaucccuugccagagcaccaaguguucuuaguuucugggccaucucucuaggcccuguaucaacacauuuguaauaagauaaauaagaugcaaaaauaaugcaauaccuaaauucuaaacgcauccaugaggcauuuuucuucaagaccaauguaagcucauaaacaggcuaugaacgucugccaaacuuccuggcaucacaaaccugccccuucucgaaauucccagauuugaggugugacugaagaaaauccugcaauuuccuuacaggaacaagguaaaaggucaaugauccaucaguuuuccuaguguucucaaagauaucccugcaguaacaaaggagaaugagcauaguguccuggaguaggggagauauaagcuuaaauuuccuuuuauaaguuguaaauggguuuugaagucuagucuaaugcuuucauaaauucaugcaaauuuuguaagcugcugcauaauacaauuauguugcuuuuaguauuugcauguaguuuucuuucccucauauguugaagcaaaaacaaugugcugcaggaaagcuucugcuagccugcuacuuugugaaugcccucgcacacagcgccacaugaagggcugaacucauuagcugcauuggaaaccaugcaauuaaucagggugaguacuguagucaugacuauuggaagucacacuucauuucuucaacuauuaauaauagcauuaauacuaaaauuaaaaggugcauuuaaaauucaugcucucauaugggaggugguugcuauggcuccuguggggguaucagugaaacagaguagguaucaauuuaaagaugggaacacugaguaccucccacaaguccaacaggucaugaagcaggugccaugauuugaggccauaaaguugcauagcggccucugccauuuucccugauacauauuagcaacacacucaucauacugcccuugcuuaggggucauucuuagugucaagcaaggauuagaaacuagaagauuggccucaaacaugggagaagaagguuuauauccucaaauacaauuuuacuuaacagaaacaaucuccaugggcaaauugaauaucuuggguacaaaaugucagguguuacuaaauaaaugagugucaucaugaaucauugaacaaaaauugcauuuaaauuagauuuaccacauaauuuuuaaaaaaaauaagccaacuuuaaaggaaccucccaauaguuuguuguuuuuuucucuuucuuuuaaaaauuagguauuuucuucauuuacauuucaaaugcuaucccaaaagucccccauacccucccccccucacuccccuacacacccacucccacuucauggcccuggugugccccuguacugaggcauauaaaguuugcaagaccaaggggcauguaccauggaguagaaaacaggacacaucccuguccuggaauuuguccugcauuaauuaaagucaucuuacguuuguaacaaaugagccaugagacacaaugccagaaauuaauuuggaagaguaaauauacacuuagcaaagacugucucuauagucuauaguacaaagucccuggcugacccuagaaaccguagcgaggcugugaucuggaacaacacagaaagacucauguaucacuuuuccuccauaggcaugaacaucuguggaugcuuccuuuuauccuguguaaacacccaagguggucucagugcuaaaugaccauucagcuuuuccccauuguagcuagcauagguugcuacuucccaacaugacucccuacuacuuccuucauagugcuuuccaaaaacucccaguguauuuucuuugucuguacacuugcucacugaccagguucccucuagcuuguucucagcaucaugguacaagcuccgugccugucucuaguaaggagagaccacaaaauguuugcuggaugaagacacagcuaugacugucacacaggaugcaguguuucuuugaguucauuuuuacaaaucagauucuauuucauuucauuaaauaauuuuauuuacuagucaucauuugaaauuacccuggguucuuauuaauaaggagagauuaaguuuaucuucaagaaggauggggggggggggcggauuucagccacuuguuccgaaggucuuucaaaauaauguuguaguauaauuugguuggaaagcagggucugauguuuuauuaccuccaaaucuauucagcaaagcugaaggccugugauaaggcucauuaagucacugaaagaccuaucuuugcaugccuuucacacaaaaaggucucagcuuaaugccagguaauuacugcucauuuuccccugcuuauuucuauuuccugaagauucccaggaaaguuggccucaguggacagcaccugcaguuuaagaaauacucacagcaaggaaggcucuuauucccuuggaacugcagcuaagagagaugagccugguuugggggccuagaauuugaacucaaaccaucugcaggucacccucucucuggagccaaaagagggaaaaguuucugguccaugcugguuggcaucuguacgcagauauaucauuuguugguauaguccacuguacaccuuuaaaguuacagauagcucuuucagcuccagauuauauaggcucuguccuuagcucuaucacuuauaacucugagaaaaaaauuaauucccuauaucaauuaccacauuuauagaguucauugcaccuccuauaauggcaauucaaaaauuaaaugcaaaguacagaaauuuauaguuuuauauacuuaguucuccaugguacuguuugguuacuauucaguccuauuauuuacaccagcaucuuaaacaacccauuaacaagaagacuuuaaucuagaucauuaaugauaauuuuguucauaaucaugccagaccuauuaauauacgagaaauaaaaauuuaccaguuuugaaacaggcaaucaagaguaagaaacagugaucaggaaagacuucucacugggaagcuucauuccacccuuuggaggccauacaaguuggugcucccagauuuauaucuguuuuuacauuuaaucaaaugauggcuucaacuuaccaguauccacugcagugaugccccaacauacuuuuuuggaacuggcucuccucacugggucauggaugaucaacauggucacucaugagagcuuaacuucuuacaaguacugagaugacuacucauuaugugucaauaagagugaacugaaagauguacagagagcugggaaaacauuacuucugaggauaucuuggaaggugcuuauagaagauuuuggauuuauagaagugcuuauagaagguuuuggauuuggugcauucugacugaggaagcaucaucugagaacaaagggaccgagaaaaagagugugauaucuguucuguggcagaacacuggucuucucugacuuugggacuagaacuuagacuugucuuuuuaggcuuuguaccuggaugagaacucuugccccugcuauuccucauucucaagccuccagacuguggaaauuagacgccugguucccuuggaucuccaggaauucucagcauccauaauuacuuaaaucaacuucuccauauaaaucucuuugagcuguuuccagucucugaagaaggcugacuaaugaaguauggcuucuggcuuacaaaggacggcuaagaacucaaagcuucuagguuaaauguugggcucugucaccucuaaaaauaauaaaagcaaacuaaaaaaugucuuaaagauuucauagcacuaagaguuacuuauaaaacucauaggauguugaacuuucauagaaaagagucaauaaguauauaauauuauauucaaacauaucuuaaggauauaaacucucgaagucuuuuuuauauuagauggucauuuugaaaaggcaaucaacaagucacguccucaagcaaaguaaaaauuauauuugaaccacagacuacagaaaaauauucauccaacaacaaaucaauaauuguagaagagcuagugcauccucucuugacauuucuacaaagcuaacccuaccuucaauguugagacacauauuuaccaaaugucuuagaaaguuaucagcuauuuuacuaaaugguaaaucguuaacaugaaaauauuaagcuggugaauaacaggaggggagcguggcagcuauguaucauaguguacgccuguaacuccuagcauuuuagaggggaaagaggguggcugcugcaagugugaaguaucugggacagcagagggaagguucaacuagccugggguauggagcaaaacacuguuuccaaagucaucacaaaaaaagaaggaagggagaaaacaaacaaacaaacaacggaaggaagaagaggucaaaaaagguaggaucacaagcaagucuucauagacacagaaaauuaaaauaacucuuuguguuccaaugaccacugcuuauugaagcuggacauaaacaacaagaaaucuuauaaacccauguaaacugaagaacucauuauuaaaugaaaaauggaucaagacagaaauuaaagucuuucuggaauugaaugaaaaugaacacaacauuccaaaacuuaugggacacaaugaaggcaguucuaagagguaauuucauacccuaagauccuaccaaaaaaugcuggagagaucucauguuaguaacuuaacagcacaccugaacacucuagaauaaaaagaaaaaaaaaaaaaaaacauacacacaccgaaaagaaagagauggcaaagaacaaucaaacucagugcugaagucaauaaaauagaaaggacaaaaacaacaccacaaacaaucaaugaaacaaagaccuuauucuuugagaaaaucaacaagauugacaaaccuuaauccaaauuaacaaaggcagagggagaauauucagaugaauaaaaucagaaacaacaagggggacauacagacacugagaaaacagaaaaucauaaagacagaauuuaaaaacauguacucuaccaaauuagaaaaucuaaaauaacuggauacuuuggcugauacauaccacuaaccaaaguuaaaucaagaucagauaagcaauuuaagcagucuuauaaccccuaguaaaauagaaccagucauuaaaacucucaccaccaccaucaccaaaaaaagcccagggccaagugguuuuagcacagucuuucaaagaaaaguuaaugccaguacuccacaaauuauuucccaaaauaccaauucauauuacaaggucacaguuacuuugauacccaaaccacacaaagaccugacaaagagaauuacagacuaauuucccuuaugaacauagaugcaaaaacucaauaaauuacuugcaaaccaaaugcaagaacacaucaaaaaguucucucucuaugaucaaguaugcuucaucucagcaauguauagauuuuucaauaugcauaaauugacaaauauauuugaccauauuaacaaauugaacgacaaaaaccacaugaucaucucauuagauggagaaaagaucuuuaauaaacccaacacaccuccagaguaagucuugggcagauuauggauacaaaagauauaccucaacauaaaggcaguuuagaguaagcccauagcccacaugaacuuaaauugagggaaacucaaaacaauuccacuuaaaucagaaagacaagguuauucacucuaugccuaucuauucaauaguuuuagcuagagcaauaagguaaccuaagguaaaauggaaauuuaaagauucuuuguaaagucaguuguguuggauggugucuugcuggggcaaaaaugugaaagaguguuuucuuaaaguggacaugggugaacaaaugaggcacacuccugaaggaauguuucccagaagcagacacaagagagaagauguucugcuaaaguacaggaaaggacacaugaugaaggauuccgcacuaacaacacacauguauuguucuaccuuacacugcguagcugagcuccauuugucaggaccgaaaagcuucuggugaugugcuacauacaauaccuugcugcuuccucagacuugggcuaauuaacaaaaugaugucagcugagagaaacuugcauauaauauuuaaaaagauacaaauaagagucaacagacucaacagacaauuacaaagacugagcauggcuuauagaacuaacuauagaacacuuuuuggucucacaucuucgcagaucuuggcuucccugagagagacaacagaaaacuuuuccugacauuccugcugacucaugcccaggcagaggccugggucucucuacuagagaaugucaccauuacugauuccuguuuacuauccuaacucuaacaaacuauuuacaaauagauggagccacuacugacuuauaagcuaaacugcugauuuccagacaacauagacaagaauugcucccaagaaacuuucuaaccaagugcacuucucccacacccuuucuuuuccaauaccucugaugggugauaggcuucaaacauuuaaaaacuaucauuaaaaauaaauuuaaucccagcacuuggaggcagagacagguggauuucugaguuugaggccagccuagucuacaaagugaguuccaggacagccagaacuauacagagaaacugucucaaaaauaaauaaguaaguaaauaaauaaauaaauaaauaaauaaaaauaaauuucaaaaaauuaaaauaacacuaaggagaucaaagagauucaaauuggaaaggaagaagucaaaguuuguagaugacauaacaguauacauaugugauccuaaaaauuccacgagagaacuccuauagcugauaaacacuuuuagcaaaguaacuuauauacgagauugacucaaaaaauaaguagcccuccuauacacacaugacaaauggacaaagaagucaggaaaacaacaccuuuacaauaucuucaaaaaauauaaaauaucaacucuauccaaauaagugaaagauuuguguaauaaaaacuuuaagaaauugaagauauaagaagauagaaagaucuccgugcucauggacgagaagaauaaauaugguaaaaauggccagucuaccaaaaguaaucuaaagauucacugcaaucucuaucaaaauuucaacauaugucuuaacagaucuugaaaagacaauucaguuucauaugguaacacacacacacacaaaacagaauggcuaaaacaauccugaauaauaaacugcuaaagguauuaccaucccugauuuuaaguuguauuacagaccuauuguaauaaauccagcaugguauuggcacauaaauagacauguugaucaauggaaucaaauugaagaccuagcuauaaauccagacaccuaaggacaccugauuuugaauaaagaggccagcaaucacacuggggaaaagacuacaucuucaauaaauaagacuggucaaacuggcuaccugcaugcaaauagagccauacuugucauacuacacaguccaaguggaucaaaggacuuaaccuaaaaccugauauauucaacuugauagaagaaaaacuggggaauagcuuugaguauauugguauaggaagcagcuuucugaauaaaacuccaauagcacaggcauuaaaaucaacaauuaauaaaugggaccucaugaaacugaauagcuucuguaaggaaaaagauacuauccauuguucuaauaaagcaauagccuacagaacgagaaccuuuuuuuuaaccaacucuacaugugauagagagcuaauauucaaaauauacaaacaacuaagaaaacuagguagcaaaagaaaaaacaaacaaaacaaaagacccaauuaaaaauggaguacccaccugcaggcacaccauacaucacuggugguggguggaggacaugcagagaccagccaacugccaugccacgcagcccaggaggaaaaagacauccaaagaccuacaaaccacacaagcaggcuguagacacgaagaggccugcuugcaucuaugccaucugcagccaaugucacuacaaagugcaaguguguggugggcagaugggagagaaagagaaguggaaccccuugaauauuauagaaagagacagaacuggagaugugagggugcagaggaauagccuguggugaguagccagcacuaccacccaaggccacagugaagucccagcccaugcugccauugagggccaugucuggguccauggccgugcagcaacaggggucacugucuauguccauggcucauauuaucacuagagacuaugcagacauuccuagucugggaagcugccugaaaccacauugaagucacagugaagaucaaauauugaugguguggcaaaaaccagaggccuugaauaagacuaauaacucauuguaaagggcauuugcacaugaguguguuuagacagaggaguguguugugggacacacugugacacuacagcuucuacaacaagauguuuucugugcucuguuuuugguuuaauuuuguuuuguuuuuguuugauuuuauuuucuucuggggaggagaguugccagggggaggguggggauaaggggauagugagaugagugggacuaggguacacgaugugacacaaagaaucaauaaaaaguugaaaaaauaaauaauaaauauaaauaaauaaauaaauaaagaguucuuuaaagagaaaacaauucaaauagcugaaaaacaaacaaauguuuaauauccuuagcuaucauggaaaugcaaauuaaaaaucagaacuacuuugagauuucaucuuacauuauuagacugguggagaucaauaacacaaguaaaagcucaugcuguugaggauguggagaaaggacaacacuccuccacuguugaugggaguauagucuuauacagccauuauggaaaucauuguuguguuuccucaggaugaugagaauuaaucuaccucaagaaccagcuauacuacucuugggcauauccucaaaagaugcuucauccuaccacaaacaaacuuucucaacaaugucuuuaauuggaacaaccuaaaugucucucaacacagaagaauggauaaagaaaauguggccuuuauacaauggaauauuacuuggccauuaaaaagaaugaaaucauggaauuuccaaguaaaugaacaaaacuagaaaaaaaaaucauucugagugagauauccaagacccaggaagacaaauaagagucuuugcugacacguggauauuagcuguuaagucguugauaaccaagcuacaauacauagaaccaagggcuuagguauagagucaaggacuagggacaccuuguuaggaaagugaaacaaaauggacaguuauggauggaugaagagguuggaacaggaggaucaaguggcaaaaguggcaaaggggaggagagagaggcaugaggaggagaacacaaggagacagcuaaaauuaagggcuggggcaagaaaauggaugcucagccuggugaagaaggaauugacagggaacuguuguuccuggaguccuaacuaaauacuucacugcacauauccacugacaugcauuuuacuuuacaggugaacagagaaauuaucucauuguuuucuaaacuccucgaagauucuuagucccuaugcccuugucgacaaagcaccacagaacucacacauaacucucagaccaaagggccagauuacaucauugcaccugcguguguugccuguuuaaaauggggagggacuccuugggcaggagcagauccaagugcugcagugaacaggaaggcguggguucuaaaguagaaaaauccugaaaguuugaaccaacauccuguuuucucagagaaggcagacucucuugccggucacaugcagcaccucauucuuugacaacucucuucuuaguuuacuacuuuacaaaggagaggggaugaauuucauguucauguucgcucugaaugggguggcagcuucuaucgagcaucugugccaguugcucucgugacgaaugugaauuuugaagccuucuuuuuucucucagugccacaucugcuaguguuuucuauuugccagcucccaacauguccccaauuacgucuuuuuuauucccuagccgccaugcugauguuucaucagucugacugcugggcuccacugaguguuagcaaccagcagugccuuccaggggcugccggacucaauaaggacaccaaacccuucuuucucaaaagaaaucuguuuaauauaaacacaguaugaguuuaaugugauacaaaagagagggguuuucccccucggaguaaucaaaaaacugggaaaaaaaaaaaaaaacuauguuucagggaaaacagcuuuagacacgagaauaagaaauuacuucuauuuaauaaguauuauucuuuacugaacaaagagcaaaaaaaaaauacaucugaguacaugaacacauuuguauuuuaacccauucaaucaaaauauuuuuacuaugaggagacugaaucugccuuguuuucggcauagaacacuugaaaauguaagaaccaguaggccuacaaucaaaugcaaagugaaaggaaaaacuuguguuuuuaacucggauuuucuuauaaauacauagcaauucucaggaaagagcccucaguaacccaguggguagucagcacaucuauaagcaaucagcaugaacccagaucccaagaccccuuaacaguugaaaucaaaucauugaccuccaauaguuggcuccaauuggguacuauuuucuaaaguuuacaaaaauuucuuucuacaaacaauaccccuuucaaguaaaggugugagcaaugaaccugugagguuuagacuaauuaaaaguguguuaaauauuccauuuuagauuauggccguccaggugaagagcaggaaugcucaguuaguaagaagcuugccaagcaaacaugaggaccggagucugauuccacaagccuauguauccacgagccugccuuuguauccaugagccuauguauccaccagccuauguacccaccauccuauguacccaccagccuauguaccuaccagccuauguauccaggagccuauguacccaccagccuaugcauccaggagccuauguacccaccagccuaugcauccaggagccuauguacccaccagccuauauauucaggagccuaucuauccaccagccuauguauccaugagccuauguaucuaccagccuauauauucaggagccuaucuauccaccagccuauguauccaugagccuauguaucuaccagccuauauauucaggagccuaucuauccaccagccuauguauccaggagccuauguauccacgagccuauguauccacaagcauauauauccucgagcauauauaaaaagcuugucaugcugacugggguuuguaaucccagaguugugaggaagaagaaggccgagagcucugugacuuggcaagcucaggccuaucaaaaacccugcguaacaaaacuaacaaacaacagcaacaaaaugguagcuaucucaugaggaauaucaccugaggccaacuuccggccuccacaugaagguacauaaacacacauguaugcucauauacacacaccaacuacacacguacuacacuacauacaugcaguuauuuacaucaguuuguacauauacacacauacacacucauaccaacauguacauauacaugcagacauucacucccuccaucauguauacagagagagaaaaguaccauuucuguagaauaggcuuccaucuaaagaaauguuucccuauucuuagauuacuggagcuauguagcuguucaaauuccaaaguggcagaaugagagauuaaacccaguucuacgugacuccagaacaaaacuuuuagcaucgcaggccaaacagcugugguuucuugcagggaaaauaacaguaaugaacggauugagcuuucaucuuuggaugugucugugggguggauaagacauucucuccagcucccaugccuacccgagcuucccuucacauuugaagauggccuucuuuccugagaccaaagcccuucugggucccaugccccagaacaagcccucucuguuauucaaagugaugccacucacacaguaucccauugauucccaaacugugaccacugggccagcaacaucagcaucaguagcacagacacacggauguuagggccuaugccaagccuagcgaagcagagauucuacagauggagugaaaggaccuguucucauguuucuggaggugauccuaauauaagugugaaaaccacaggcucuucaaaguuauaugcagagccuuuggcucuauagaagcaguagugugcuggcugccuucaccuuuauuccuggucccacucauaacaauuccucugaggcagguucccuguugucucagcucacaggccaugagggaagcccuggaucauuauacacuuauuuauguuucaugguguaccacagucuaaccucuguugggucucuuaucugcagagaaagaguuucugguugcaggcaagcaagggucagugagaauugauagacagaugcggacaagagagagagagagagagagagagagagagacagagagagagagagagagcugaaucugaauguauuuuguccaaaugaacuccagacuuuuaauacagaagaaaaacaagaaaaccagaccaacauauccacuaaguuacauugacacaaagcaaaaagaaugcauacauaaaaagauggcaggagccaggccacauuuaucacuaagaauagaaacaacccuuaauuuaaaagaucagauaaacacaggagccaggugaaugcucugaugcaaugcuagucuauuguuaaacccaccaccagggguucuuuaguaaauaccacauuaugcuauuccucugggccuagugaagaaaccugcaccagaggaauucccuuccacuagcccuuuccacaauccaccuguuuccuaggccauuauguauuccuuuguuugggggugacucgguuaauuguccuaagugauuacuuugcagacuagccuugagcuuuucuagcucuguucuuuguaaugccuaauuaguuucauugucucuacuagaaguaaauuugaauguuacugaauagguagcauucuuacuaaauuccaagcuccaggucggcuucaaggauuuucuaggaaccauuggaacacugguggaggcuuagcuauaugucaaaaaucaauccuuaaaggcacuuauaacaaaacaauacugaaagagagcacauggauccauacaccagacuaaugcagggacagaguuugaguauacgggcuauuggaaugccaagguuccaggaggcauaguuuccuugaaacucuuugccucgggacugcuuucaggcuuucggucuguuaagcagacuucacucgaguggguguagcaauggcgguagucucucugucuaaacaguaaacuccagguggaccacuauacuugagggcacagcucauaauuugccguagagcaagcacucaagaaguaguuauugaaugaguaaaucauuaaaauccauauuguugcaagaguugaauguggcauuuaugguauacaugagucucacagcuacaucuucacuucaucuuuggucaaauauuuaucagacauugacuucagccaaacacuauuguaagcagugggagccagcagugaucaagacagaaaacaaaaacaaaggcuuaucuucacaucuucugugacuucucuuuaauugaggaagauacacaauaaaauaaaauuaacuagcgaaauauucagcaugugagaggaugaugggugcuguggcaagcagcagagucagggaaugggugagguguggggagacaggagggagcaagcucagcgaacucacauggugcaucagcuggcucucugguaaaagaucugaggaccuugaaggaaaaaacucuccuccaaguuccugggaacaagguuucugaacuaagagaaacaaagggaaaagcaugaaaaggggacagauagcagcgguaggccuggaagcaacuagccaacacagaguaggugaaggcagagcccuggacuggguggcagugggggugacauggagcccugauggagucucuacugggguuccuucucagggguaaaugaggggccuuggcuugugcguagacaacuaacugaggccagcaagacagaagcaggcaguccaaacacagcccucuacagugguguaaugacagacauuggagacauagccucaaaucacaugggaaacagugugccaugucagucaagacccugccugacaucaagcaggauauuuuguuuuucuacuuaacugagauaugauccaauauaacugccucagaaaaaguugacauagaagcuaaaauaaguaccucaaccuucuacauggcaauaaauagauagauaaguaaauaaguaaauaaauacuaugaaaaaguuaauaaauaaaauaccaugaaggguauaaauaaauaaauaaauaaauaaaaucaccaugaaggguaaaaauucucacugcucaagccugaugacuucaaguuguaucccugaaacccacuuaaaagccagcuacaguggcagcagugcgucuuaagggggauggaggugaagacaggagaaugucuacaaguccacagcuagcuacacuaguacaacagcuaagagagcauaacucaaagaggcugaaaggcaaagaccaaccccaaaacuugucuucugaccuccacacaugugcugagguaugaugcacccauaccuacagacaugaacaggcacaaaaauauaggaauacauacaccaaaauaaucaauuaauauacacauaaaaucguuuuuggaauaaucacaauaaacaagggauugguuauuuguaaaugaagacccuaaguguucagugagauuuuuuaaagaagaccucuuuaggagcuaaagggggguggggauggggugacugugagcgcaggcugcucuuugagaagacugggcuuuguuaccagcacacagcagcucacaguccagggaaucugauacgcucuucugguuucugcacuuacugaauguacaugguaugcagacugacacauaccuaaaauaccaauacacauacaaauaaaugaauacauuuuaaaauuaauuuuaaaaaauaucucuuuauauuuucagcuuugcccaacacauagcaggugaucuaaaaggcuguggucugaugauuguaaaaagcgcucgguuuuguucccauuuauaagaaaggguagaguguccacacuuuggucuucguucuucuugaauuucaugcguuuggcaaguuguaucuuauaucuucgguuuccuaaguuucugggcuaauauccacuuaucagugaguacauauugugcgaguuccuuugugauuggguuacuucacucaggaugauacccuccagguccauccauuugccuaggaauuucauaaauucauuuuuuaauagcugaguaguauuccauuguguaaauguaccacauuuuguguauccauuccucuuuugaggggcaucuggguucuuuccagcuucuggcuacuauaaacaaggcugcuaugaacauaguggagcauguguccuucuuaccgguuggggcaucuucuggauauaugcccaggagagguauugcgggauccuccgguaguacuauguccaacuuucugaggaaccuccagacugauuuccagagugguuguacaagcuugcaaucccaccaacaauggaggaguguuucccuuucuccacauccucgccagcaucugcugucaccugaguuuuugaucuuagccauucugacuggagugaaguggaaucucaguguuguuuugauuugcauuucccugaugauuaaggauguugaacauuuuuucaggugcuucucugccauucgguauuccucaggugagaauucuuuguucagcucugagccccauuuuuuaaugggguuauuugauuuucuggaguccaccuuccugaguucucuauauauauuggauauuaguccccuauccgauuugggauagguaaagauccuuucccaagauggaccaucuagugauugccauaugcagggauccaucccauaaucagcuuccaaaugcugacaccauugcauacacuagcaagauuuuacugaaaggacccagauauagcucucucuuaugagacuaugcuggggccuagcaaacacagaaguggaugaucacagucagcuauuggaugggucacacggcccccaauggaggagcuagagaaauuacccaaggagcuaaagggaacugcaacccuauagguggaacaacaauaugaacuaaccaguaccccggagcucuugauucuagcugcauauguaucaaaagauggccuaguuggccaucacugcaaagagaggcccauuggacuugcaaacuuuauaugccccaguacaggggaacaccagggccaaaaagggggaguggguguguaggggauuggggggguggguaugggggaccuuugggauagcauugaaaauguaaaggaggaaaauaccuaauuaaaaaaaaagcgcucaguuaagacaguaaagucugcaugggaagauacuacauaguacauuuaguuuuccaacaauuuauugggguuucuuuuucuguauuuugagacaggguuuugcuuuguagucuugguucuuggcuguccuggaauuuaccauuuauaccaaacuggccucaaacuuacagagaucugccugcaucugccucccaagugcuguggugaaaggcauaccacaccacacucaguuauaaguucaauucugaugagagaugaaaggaaaagucucucagacauucgagaagacuaaauuacacagucgaaaacaacucuaggcaaggggaagaaaucaugggaaguaggcaucgugcucuacacuguuuagcuuccaacuacguacaggccacagcaucuucagagccaaaauagacuuguaauuauucuacuagccacacaaaucucauggcacacaaacccucaaccugcauggcuuaauguaggcaugcacuaguugagugcucuuugagugugccaaagcaaugaacauccaaaacauagaggcugcuaccaugcaagucuucuuuggcuuguugauuucaaucccugcacugcugguauuuuaaccaaugucuuaagauuuaaacgaguaauacacuaugcaagcuggucaagaaggaaaugcuuaacuugaagagaaaagcacauuuuucuucccaaucaccagcguuuauucugggaauucaauguuaucagcuuccuguuuuccuucuucuccagugcucuacuucaaagucacuagaaagguuugcugugagggagaacuacagaccugauacauguucuaauagcuacagcccacauaaauuagaaggugggcaugagaggaggcccaagaaggcacugcagaauugugugcauccuaugcaucaugccauacaagaugaucucugguuuccucagaauaccacaucacucaguaacugugaauaaacaaugcccuugaauuaaaaaaacacugaggcauucaacaaucaaauauugaucuuggaaucucugcugcccuuguguuuuucaggucuguuguguggguuucuaugugacauguugugucaugugacaugacagucucaauccaggacaagcaaaugagcaagcagucauugcuaaauaagaggcugccaauguugaaacaauuaugguuaucaguaagugaggaaacugacaggugaugugguaucuaaacgcaauccgucuuuuuaagcuuguuugggcccuggcucugugugagcugagauagcaacacugcuucgaauagagagauugcauggggauaaaggaccaggacugcauggcagcugcacagugcacuugagcucagccacauuaaaagcucuugaugccuuugggaauagaugagcaagaccaaaagcaaguacauggaauaaggaggugacugccuuaagugauggauauccuggcuacucugcgccuaucuaugccuuuccauuucaucaagaugcuaagaagcaauuagagucguaaguaugagaaauguuauauuucuuggaaaaccagagauuugguuguucaguaaaugauaccuugcuucuuaauuuccuuagcaacacugaauucuuaaucacucaaucauccacuuagucauucaaaaacacuauaucuucaccuuuuucccuugauugcacaguaacacaagcuuacuguaaaauauucaaaugaaacaguauugcauaaagaggaaguacaagucucuggaaaucccagagaaccaguauuuauuaagcacuccaucccaaguuguaugcuagaggugccaugaauugccuuggucucaaaaguucccaguccagcaagagagaaaccaagaacaaaaacuaaaacacaggacagucaccauuaaaaaaaauaauaauaauaaugcaaagaaaugcuccaggaacccaggaaguggccaccucagaauaguaaggcaaaggggaggccugugugucaggcccuacacucgguggccccugcagacagaccaugcaaggcacaggcugucggguuuuuuucucuaucccugucuucuuccaacauuuuuucuauaaagucaacuuuccugcuuggcuuacccaaaugcucauucuauuuuauaaaaugacauguuacacaaaucuagaauugcaaauuaaauucuaguaagauuccccacccccacuuuuaaaagagaguuuuauuagaauauagucauuuuguauucaguauagaucagaaacaugauauuuuaaccauggagagccgaguauaugaccuguaaagucuacaacauuuauuaacuggucucucacaaaaagguuccugacuccuggcuugggugugaauccaaucuucauuacacacaucaccuucucacguuugucuccugcugccucccugacucacggcaacucacucuuuacuauaaggaaacguuggccuuuguggggcucacacuguguaagaacgugagaguuggauugaggacaucacacaugacaccuaguugaauucuggcuuggcuacuaauuggcuucgugguucugaggaagcuacugaacuuuucugucuuucaagcuccuucauauaaagcaucuaucuuguugcucuauuuaagaguggguaugauacacagagaaacccugucuugaaaaaccaacaacaacaaaaaagaaaacaaacaaagaguagauaugaaaauugaucuuuaagcuaagcuuguugucuuguguuuugaccuaaguauuuucuuaaaaacuguucuuuuauuucaaaaauuuuuuaaaacaaauuucucccauuugccgggucaggcaaccccugaccccuguguugucauucaugaguuccaugacuuaaaacauaaauuuaagugaauaaacacccucaacugaguuccaucugcuuuuguguccuuagcucaagaacugcuucccacugucucuccauccugagcacaugcacugcuucccacugucucuccauccugagcacaugcacugcuucccacugucucuccauccugagcuuaugcacugcuucccacugucucuccauccugagcacaugcacugcuucccacugucucuguauccugagcuuaugcacugcuucccacugucucuccauccugagcacaugcacugcuucccacugucucuccauccugagcuuaugcacugcuucccacugucucuccauccugagcacaugcacugcuucccacugucucuguauccugagcacaugcacugcuucccacugucucuguauccugagcacaugcacugcuucccacugucucuccauccugagcacaagcacugcuucccacugucucuccauccugagcacaagcacugcuucccacugucucuccauccugagcacaugcacugcuucucacugucucuguauccuuagcacaugcacugcuucccacugucuccccauccugagcacaagcacugcuucccacugucucuccauccugagcacaagcacugcuucccacugucucuccauccugagcacaagcacugcuucccacugucucuccauccugagcacaagcacugcuucccacugucucuccauccugagcgcaagcacugcuucccacugucucuccauccugagcgcaugcacugcuccccacugucucuccauccugagcacaugcacugcuucucacugucucuguauccuuagcacaugcacugcuucccacugucuccccauccugagcacaagcacugcuucccacugucucuccauccugagcacaugcacugcuucucacugucucuguauccuuagcacaugcacugcuucccacugucuccccauccugagcacaagcacugcuucccacugucucuccauccugagcacaagcacugcuucccacugucucuccauccugagcacaagcacugcuucccacugucucuccauccugagcacaagcacugcuucccauugucucuccauccugagcacaugcacugcuucccacugucucuccauccugagcacaagcacugcuucccacugucucuccauccugagcuuaugcacugcuucccacugucucuccauccugagcuuaugcacugcuucccacugucucuccauccugagcacaugcacugcuucccacugucucuguauccugagcacauacacugcuucucacugucucuccauccugagcacaugcacugcuucccacugucucuccauccugagcuuaugcacugcuucccacugucucuccauccugagcacaugcacugcuucccacugucucuccauccugagcuuaugcacugcuucccacugucucuccauccugagcacaugcacugcuucccacugucucuguauccugagcacaugcacugcuucccacugucucuguauccugagcacaugcacugcuucccacugucucuccauccugagcacaagcacugcuucccacugucucuccauccugagcacaagcacugcuucccacugucucuccauccugagcacaugcacugcuucucacugucucuguauccuuagcacaugcacugcuucccacugucuccccauccugagcacaagcacugcuucccacugucucuccauccugagcacaagcacugcuucccacugucucuccauccugagcacaagcacugcuucccacugucucuccauccugagcacaagcacugcuucccacugucucuccauccugagcgcaagcacugcuucccacugucucuccauccugagcgcaugcacugcuccccacugucucuccauccugagcacaugcacugcuucucacugucucuguauccuuagcacaugcacugcuucccacugucuccccauccugagcacaagcacugcuucccacugucucuccauccugagcacaugcacugcuucucacugucucuguauccuuagcacaugcacugcuucccacugucuccccauccugagcacaagcacugcuucccacugucucuccauccugagcacaagcacugcuucccacugucucuccauccugagcacaagcacugcuucccacugucucuccauccugagcacaagcacugcuucccacugucucuccauccugagcgcaagcacugcuucccacugucucuccauccugagcgcaugcacugcuccccacugucucuccauccugagcuuaugcacugcuucccacugucucuccauccugagcacaugcacugcuucccacugucucuccauccugaccacaugcacugcuucccacugucucuguauccugagcacaugcacugcuccccacugucucuccauccugagcuuaugcacugcuucccacugucucuguauccugagcacauacacugcuucucacugucucuccauccugagcuuaugcacugcuucccacugucucuccauccugaacacaugcacugcuucucacugucucuccauccugagcacaagcacuacuucccacugucucuccauccugaacauaugcacugcuucccacugucucucuauccugaacacaugcacugcuucccacugucucuguauccugagcacaugcacugcuucccacugucucuguauccugagcacaugcacugcuucccacugucucuccauccugagcuuaugcacugcuucccacugucucuccauccugagcacaugcacugcuucccacugucucuccauccugagcacaagcacugcuucccacugucucuccauccugagcacaugcacugcuucccacugucucuccauccugagcacaugcacugcuucccacugucucuccauccugagcacaagcacugcuucccacugucucuccauccugaccacaugcacugcuucccacugucucuguauccugagcacaugcacugcuccccacugucucuccauccugagcuuaugcacugcuucccacugucucuguauccugagcacauacacugcuucucacugucucuccauccugagcuuaugcacugcuucccacugucucuccauccugaacacaugcacugcuucucacugucucuccauccugagcacaagcacugcuucccacugucucuccauccugaacauaugcacugcuucccacugucucucuauccugaacacaugcacugcuucccacugucucuguauccugagcacaugcacugcuucccacugucucuguauccugagcacaugcacugcuucccacugucucuccauccugagcuuaugcacugcuucccacugucucuccauccugagcacaugcacugcuucccacugucucuguauccugagcacaugcacugcuucccacugucucuccauccugagcacaugcacugcuucccacugucucuccauccugagcuuaugcacugcuucccacugucucuccauccugagcacaugcacugcuucccacugucucuguauccugagcuuaugcacugcuucccacugucucuccauccugagcacaugcacugcuucccacugucucuccauccugagcacaugcacugcuucccaccauuucauccucagugaaaaugcugauucccacaaucccugucuauagaaacuggggagaauaauggugaggcucagaaacacaaauaguugugggccuguguaccagaggcuucccauggagaucucuacccagccugaugugagaguuccagugaagggaagccaguguaggcagggaggggaggucacuuccccagcuucugcgcugcaguuggcuccacuucugucucugccaugccuccugguuacucugugacucugcccagcccugcacuacacaacccugcacugggcagaccugcagugcucuuuagugggucuaacccaacccuaccaaaggccaacuagccagugaggaguguggcggagcuucaaguggcuaaucaggagagcagaccucuucccaaguguuacagcucuuuggacagaaggcucagaugacagaguaauucucacaugcuuuuaauccuucuggauaagauucuuauauacaguuuugugguggguagcaagcacuucucauugguuuggucugagagcuuuggggaaaacuuauuugcauguggggggcuuggugcugcuccuaugugauugauggccacauaacucucugugggggugggggcugugagaggcuguagcuauguugaagucaccacccaaggucacugggauuccaggccuuugccccaccagagacacuucucuaaguugguggaagggcaugacacagaggaguacaucacacacuuaacauuuaauacaugagagucagauaggagaagcagaaugaggccaauaaaauuucuucaucuuagauggcucuaacaaccugaaggcuuucuuugcuggguuugguguggaagccagaagagugccaccuuucacucugcuucuccacagcagcaacuguccaauauguuauuucacuugacaacuaaugaggcaacaaauuauuaguuugacugggucacccuuauaccuugaucaaacucuacugaucaacaacucacaucacuggaaaggaucuugauuuuuguuucuuucaguuccucugcaaucaggucuuaccucuuuuauccuauuugcacacagacacuauugccuaauaccugcuuuauuucaagcccugggaaagagaggugauaccaucuugguccugaauuuucuagauaaacuaaaaagcacaaugcaaacauaugggagcucggugaaaggagcaugcagauaaaaaucuauggagacacagauaaugggucaaggaaaguccuauggaggaugugacaauuaugcagagucuaagaggaucagugggaacuggccagauacaaaaggaagauagaggaauucaaagcugguaaaugaauaaagacaaagcauaaaagcuuucaagggcauaguaucuucagcuaaguacaaagaauccauaguggccagggaacaaacagcaugauguugagcgacaggagaugaaagccagauuucuaaagucuuuggcaccaugacagaggguuaaguuuugacucugaaaacauggggagcuccuaagaguuuuacguuauugguaggagaaaauauguuaugcaauuguguuccguugaauaacucuggcaucagcuuaaaguuaguaaauuaacauggaauuuuaggcuggaaauggaaauugcagugguccucagugagaacauagaguggaagaauagguggauuugaugccaucuggugacuagggugcaucgagauaaagaaggaaguacuucccucuccuaacucaaucaggucaguucucuccaucacauaucaaaugcaauuuacuaauggaagcugcucaaauccugaagauaggcuaguuccuucugugacagcucacagggcaucauuuucuuuucuuuauagcauuuguccugguucuaauauuuuugucauaagucaaauuaguaucaacuuugguuaccacauuauaaaucacuagaagguacaaugaugccuguuuuacucacuguacauucuuuccaucuaacacaguggcuaacucacaauaggaacucaacaauuauuucuugaaauacuuacauacuugaauagcaguuagauagaaauaccauugaguaggacaggguguagagggguucaagugggaguuggagguugauccuagcuugaacacauaaauuaucugcagacuuuccagacagggauuucuaagagcuugaaaaucaagagagucaaguaaaauauuguagauuugggaaacaucugugaaacuaaggagaugaaagucacuguuuuaaguauacagcucgaaaagagguguggaucaaagauggggccauagaaaaagccaaaugaagaauccaacccagcuagguaagccacaagagcauuaggagagaaaguuucugagucaagaaaagaacaaugagagagagagagagagagagagagagagagagagagagagagagauuuugagaaaucaaguaaggagaguucaaaacagcaagaguuggagucagaaaccaaggcaaugaucucuguucccaaggugaaaaaccucaguacuuaaaaaaaagauagauagauagauagauagauagauagauaguagauaggaaagaagaaagaaaggagaagaaagaaagagagagagagagagagaaagaaagaaagaaagaaagaaagaaagaaagaaagaaagaaagaaagaaagaaagaaagaaagaaagaaagaaagaaaggcaggcaggcaggcaggaaggaaggaaggaaggaaggcaagccaaaauggcaaccuaucagauaacuauugaacacaggaaggaaucaaaaggcaugcuggagaacugaaauaacucauucucuugcucacucaugaaaugguuuuucaacugcuacuaugagccaagcagucuacauuagaguuauaguguaaauagagacaguauaggaugaccugcacucaaagggcagagaggggauagggucaagaucaaaaggagccugguuucuucucucagccagagaggaaaugauccaggacaaggguuuacagauauccagaagacaaagaacuuuagaggugaaagcaaacauuagagugugauguccuaauguuccuaugggggacauaaauaaauauuuacuaaccucuaauaaaauaucaaugacagccccccccccccccguuuaaaaaaaaaaucuauucaaauguagcuuggugcuccaguuuaauuguggauaccuguaccuacaugggcaacuuacagcuacaccaccacuaccaagaaaagucucucacccacagcaacagucauuuguauauccccaggauggggagugaccuccggaaagcuuuuucauugccucaagaauccuccuuucaacauaggucaaguuaaugaacccagccuugugagggucaccuguggguaaucacaacugaguugauuucaagauagcaacaacaaugucgcaccaggaggauaaagcuccacauaagguacgauuaucaugucuacacagagaacuugauuugugcuagacuuccacagucccuugacuacgaaaggcuggaccauucauacacgaguuuacaugcuuaucuguugagaguuccuguugagaguuuuugucuccuacaauuccaagcuccccucuuuagcccugaccagguucucagcaagcaggaaagaaggcucugaguguauaaaguaagacaugauguaacacaagguaugacuuauagaaugugggggaguacagcuagaagcaucuggaagaguccagagcagggaagcaguagacuacacauggccuauagacuggaaguguggcucauggagggggagugcuaaggaauagaggaagagaagagagagggaacacagaccaagcguagggaggaaagaccaugagcuggagaaguucaggaucaggguagccugagaagaaaugagagagcuuggaggaccacaugugcuaauagucaccacaguuagacauuuguccugaacuucuuuuggaccugacaccaggaaagaaauaaagcaggaagaacuaguauuacaaaaaucacuucaacaaaauuaauguugcaguugcuuuugaaaucagaaauaauuucccagaggugugguagugauggccaucaaggaccucugccgcaugaguggcguugguaugaaucaggcagacaacuuagacuaaucugggugaggagguaaggaauguuagacaggcuugagaauuucuuuucuaaaucccaacugucuuucagugcuugggccucuuuguaaagacaugaacuugaggacuaaaguucaacucuaaaaccauaaggaaaguuucucugagccgugauuaaccacggggaguaacugagcauguacuagauaccaggcauuuggcagacacaaauaaaugcaauaucccugcaauuucauguguucagaaguacuagagcuccugcuccacagaggaggaaacugaggacucaaaagaucugucuuugauaacaacauauucuaagagugugucaauaacuuauacauuugcaucugagcauguacacacacagaguaaaaccagagaauauuccuguauuuaguuucccugucuauguguucauuacaugagcuguucuauuuauuuauuuuuaauaaaucaaauucuuuaauuauauguauguguguauacauauauaucaauuacucagucucuuuucaaaaaauaugcaaagaugagaaacagaaaaaaaauaagaccuuuuaaacagagaaucuagauaaaaacaacaacaacaaaaguccauaccacagaauuaaguuacguugacaaaaagcaucauaaggggaaaaacuaaggaauuuaaagaccuuaaauucauuacagaccaaaauguaaauccaauugcagaauuaucugcaucuuuaauuuagagacucauuaucaugcuggagauaggaggcaaaauuuaauuuaaggagcaauuuuggccaaucauccuauuuucuuuaacacaggagcagaaaggacagagaaugacgcagacagaacccacugaggagcagaggaaggaagagcagagaccugcuccuacuccaccacucacagacacucaggucaucauggcugcaccaugacaacacccugaaauggaacugauucauuauuaguuugggcuaaagaggucuguauuauuaaaauaaugauuauaggacacuggccacaaucaaaauaauguuuccuaaccaaauuaagucagcucaagagcucaguuugaaaaaccuguggauggccaucaaacuguuuugguaaguaguaccugaacacacuauguaaacaggaaggaggguguguuaccgcagaagcauuucugggggcugccagaaggaggacaaugaguucagaaaggacggauucaaagauggagccucaaaacucugaauacacacuuggaagggagagacugaagaucaggaguuaaagaucaucauggcuauauugugagugccaagguagccuggacugcaggauacucaucuaguucugaauauauauucuaaauccucacacuuuaaaauguguauuacuaaauaccuccacaaagaccauggcaagaggucugaguugcucaaaggcaggacucuccaguuugcauaguuuuguuucaccagaggugaaugcaucgcccggagccaugugaguuuccaaaagagcuucugucaaauguaagauuauccugcuguuaccauaauaagaggacaucaugcagacccagcaagccuuguugguccauuaggacgugcaaaugauauguagaugggcugugagcacggacaaacacaggcauguuugaggccaauggaaaaucaugugcaaaaauaauaacagugcuccuggauguugaaacacuguguguguuuguuugggucuguucuaaaacugucuuuaauguagucagaaugucaucuucucaguuucaaaguccguaaauucuuuccuguuggagggagggaaucaggcaacggcuaagccuccagcuuguaggaggaggcuccuuucuccucuguugcaaugaagacccuuuccuuaugguccacccaagggcucaguuacacagccucuccuaccaccucccucuuccucuagccuacagaauugaagcuuuucuaaguuauuguccucgccugucuucacagucuucucucugccugaacugccuuuucucccaguuauucuccuucaaccaaaugcaucugcucuuucuagacgaaccaguaugcccccuuucugcccccauucccaacacacuaccaaucacuuuuuuuuuuuugcuuguuuuacuuuugcuuuuagguguauguggguggagaggaggguauagcucacaccuccaaguuucuauagcaaccaaugauuauaacuuuaagagcuccuguuacucuaaguuccaaaaccaaguacuaguuuuucuugugcacuagccuagcuaccuuaagaugcagaguacugugaaugacccaucaucuuuuucuguaccaaacugcaguggaauuuggacacuuugucaagacccugcaaugcaguaauaggcuuucauuggaacuauacugagcagaaaaguagcauuuauucauaaugauguagaauugcuucucagaaccgaaggacaccacacaugguuggugaaguuggagaccuagagcuggaaagacuagaguaucaggauguuccucaguaaacaccauucacugucucuuggugcuccugcuccucacacagccugccgacuugcaucgcuguucaaucuguucuuuuucuucccuguuccugaccccuacucggcugaacaaauaagcucgaacugccuagauuugugucuauguuguuguguuccuacucuaagacuucacuuaaccuccugugacucaguauauaaaauggaaauaagacguucauuuacaugacuguucuaagaaugacugaauuaauggcacacauugcugcccucagcucccaaguuuaccagaaccaucuagcauguuuaaugugccuuugucccaggucuagcuucugaggaaaacaauccgugugacccaguugaaucaucuaugccccucuauacccuaacccuacacaucuaugcauucauaucaauagaaaaccaguagaaaaugaguccaacaggguguuccacaaagaugagaaaaaaaauagcaguuccuagagaaagcagcuauggacuaaacugauaucucaaaccuaccaaaaccuacuacaaccaccugcugcccucuccaaaacccaugcugccacacacagggccugcugugggcuacagcugggccuuuuucaccuggaagcccagcaaagccucuuacuuaaagcagagagcugccuaucagccugcaaugacacuaaagggagcaccccaggccagcucuuaauaaaggcuuaagaugaugauggugacagugacaagaaggacagguggcacaacaggccacaccaugggccacaauuguuucccaauguucacugcugggccccugagccugaagugaaauuaagcacaucuuuuaacucuguuaacacagcuuggcucugggguaaaccucuaaggcuccauccugcuccauaauuagguagauuuaugucccacuaagcacauugucacacagggcuuccucuucuuugccauggugucaggaacaguagccaaggcauaauauccaagagcuaaggagaguucuccaaagcaaguuaaccucuuccuucaagaugguuauguaacuguuuuagagucuccaagcacaugauagcaacugagggggaugcaucuuuaaaaguauacaaaaggaacggcaacagggcucagugaguaagggcacuugccacaaaagcuuacugacuugaguuuaauccccagaacccacagaaagguauaaggagagaacccacuccauaagcuugucauauuaucaugugcucuccacuguggcugcugcugcugaugaugaauaagaaggaaaaagaggaggaagaggaggaggaggauggcagggggaggaggaggagaaagaggaagaggaggagaaggagaacacauaauaauaaauuaauuuuuaaaaauacaugcuccucagcugugucuacuagucccuauauaaagugucaguugcaacuuaauaucaauguuuucguugcagugccaucaccuuaaaaaauaaacccaagauuuuguaaaucagcauauuauuaugaacuguuugugccucccaauuuauauuuaaaauuccuaccccuaauaugacaaaacuuggaugcagggcuuuggggacauaauuagguaagaaggguagauuuuaugccuuauaaaaaggaccucagaugguucuuuuucaccuugcugcccucacaagucaugaggaaugaaauuucaaucugcaaauaaggaaguugguccucaccaaacaccagacguccuaacgccucagucuugggcuuccagucuuccgaacuaagaaauaaguuuguguuuucuggccugcuggucuaggcugcuacaacagcccaaauaaguuagcuuuugaauuccauuaaaauccaugaaacaaccugauaagugaguauugcuaucaucauuuccaucaggggaggcugggucucaaaaaauguuaaggcuacuguguaagacaaugugaguuuagaguagcagaggauuugguuccaaaccaagaugccaaugucuuguccugaugcuugcucaacucuguugcucccugcugucacuugcucucuccaauuuuaaacauuuaaacucucacccuuuucccacagcuaacuaaucaaauuuauauauuuacaauccauguccaauuucacuucaggaaaugaagcagagugguaacuuacuucuucuaucaugacaagaaacuccaucagcaaucacuaucgucaacaucaucaucgucaucaucaccuccaucacuaccaccaccaccaccaccaccaccaccaccaccaccaccaccuccaccauuaucacauauguugaacaucuuuuugguaucaggcaccaggcuaagugcuauucaggauucagcucaggugacccuuacagcaaugaccaauuuuaucaucccuaguuuaaaaaucaagaaauuaaauucuaaaggcaguagccuuguccaaguuaugagugcagccauguagagauucaaagcuagaacuaucugauucuagacuuuaaaucacuaaugcugguuguuccaaucaaaaccagaaucaaggucucacaucacugucuuucauauaaauauucugccuuugaauauuuagcuuucagugauaaauaaaaauaguuauuucuaccucaaauccuuugaacaagaagucagaaaaggaaauaaauagcuaggaucucuuuuaggaauuugaaugcaggacacacauauaauagacacuuccauaaauuuugcugaagcauaaagagugauuuccuuuuuaaauggugaauacuggcucguguauacaugguaguauaaucuucuaaguuggcucuaugcuacacaucacuuuaagaaaugcugguacuuuaagcagauuugaauaagaagcacuauccaacaucagucauccucagacaaucacuugaaagccuggaguuugcuuuuagaaauuuaucuaaaaacagacuaagaaaauggcaguguuuacucacagaugaaugauaacccgaguacuuaacucauaaccacuuacaaggauaaagaccuggugugagaaagagcagaagcaaaaaaagacaaggagaggugguaguguguacaggucaaaaacaguucaggggcagccagcaacgcugguagcauguaaggaggcaagucuugacuguggcuuuuaccacuucuguguauuacgguaagcuauuuaaacacacugaacuuauuugaccauuuauacaauuuaaaugaugauggagccuaucuucagggauuucugugcuuaauaauaaacagcuaugagugugaugaugaugaugguggugguggugguggugacaaugacuacaacuacaacugugaucuaucugcuuuuaccacccagauauggauguguacaugguacauaggcaacaugaagacauaaucuacuuccugcuucuauuauaacacaaacuguucuccuaaaaauucugugcaguaugucuauuauaaaaccuucauuucccugucuaacccacccaauauaaugucuaaggaaguacuuaguauccuggccacaucucaggccaaaugucacuuugagguaauaaucuuuaaggaagaauacugucuucugagugcauuacugaagccaauaacaguuacaaacuacaaguucuaguagcauuugagaaaguagucccaauuucuaacuuaaguacuagacuuugggguuuggugcugcuguuacauaaaagaaggaguaaagugugugggaaggagggagagaauguccagaagguaucaacagcaugccuggaagagaacugggacaugagaaagagccccaggcuauaaacucauaacccaaauucagcuacaaagaugaaaauguaagaaaaaaauagaaaagagauaccuuaucaacuaagagcaucugaaaaugcaauauauauuggugaauauauauaaucaaaaaauauaaucagugauuauaauuuuagauauuccuaguugauaaggcaucucuuuucuacuucuauuuuccauauauaugaaauauaaauauauuucaaauauauaucuuucauauaugauauauauuuacaucuauaucuagauaucuauaucuuaaagugguccacugcuuucuuaauccaaagucccaaagucccaaaguccacacucuuccaaacaaaaacaugguccaaccuuucacagugauaucuuacuccugguaccaauuucugucuuaguuaggauucuauugcuguguagagacaucgugaccauagcaacuauuacaaagagaaacauuuuauugggacuagccuacaguucacagguuuaguccauuaucauuaugucagaaagcauggcagcaugcaggcagacauuggagagguagcugaaaauucuauaucuggaucagcaggcaacaggaaggaacggauauacgaggccuggcuugagcaucugagauggcaaagccugcccccaauuacacaguuccuacaacaaugccaugucuacuacaacaaggccacacuuccuaauagugucauucaguaugagccugaggccauuuucuuucaacccaccacaccauccaagagauacaggaucugagucucaaaagaaguaaguaagauggcuaaauuuuuauguaaagaacuauauagggauagggccuucggcuucagggaugaagagagaugauucacaaguacagaaguauaauuucucccaggucacaucacuuguggucaugucugggacagguguuaggcucucuaucucuucuuccuauagaaagauauuuucuaagguuagggaagaugauucaguggguaaagugcuuacuuugaaagaacaaggaguaugaauccauaaaaccuuuguaaagccagacuuaggaacaagcuuguguagucuaccaaggcaagagacagagacaggagaaugucuggaagcucacaggacagcuacaugguguucacuguuauuaauaacagcaaaaacaacaacaacaacaacaaaaaaaccuuuucucaaaguggaaagugaagaccaacauccaagguugucuucuaacuucuauguguaugcuuugguacaugaacacuugcacucauauacauauauguacaaauaucacacauacacaacauacaagaaacaagaaagcuauaugcacagaccacacacacacauaccacagacacacaucacacgcaagaaagauauaugcauaaacauuaugcauaacauaugcacacacauaagaaggaaggaaggaaggaaggaaggaaggaagggaggaaggaaggaaggaaggaaggaaagaaggaaggaaaaaaaggagggagggagggaggaaaagagggaggaaaggaggaagggaggaaaggaaauaucgaagacauuuccaaagcaagagggagcguaugagauagaaaaagucugugccuguaccuacuguuuacugacaugggcugaaagaaauuucucuuugcaaaagaauggcuuuuucaugcuacuccugugucuauagaggucaguaauuucucuggauaaccaacucaaaauaugacaaagaaauauauuuagggugggauaauuuacucuccaacaguucaaaagaagaaacagcaaaacagcuuugaucaaaugaaagaaagguaaggugcuggaggauaggaaccauuguguccuaguaaccagcacaccuggugaagaaauggaaaauaucaagcaugcugucaagugcugaaugaaagcaagaaaacaaagaugcaccccccgaugagauuacaaccuguggacaaugcauugacaggucucauugguuucuuauuugucuagaagaauguccugccucaguauccauuccccucacagaaaauaaugaaaacacaaauucaaaaaaaaauauuucaaacauacauaccccaccaguauuagaaauugacuauggaguguuuuacacugagaugcuggggagcuucauuacuuugaagugucacuuuuugcuuuaguuggugugcucuaaaugguaaguauaugccauucucaccuaagucuuaaugcauaugggaucugaguggaagcccucucugggaggaacaacagagaaugaauauguugaugucagcacacuugcuuacaaucugucuuggcuugcguuuuauugcugugaugagauaccaugacaugacaacacuuacagaagaaaacauuuaguuugggacugacauacaguucaaagguuuaguccauuauggucauggcaggaaacauggcaguauccaggcaggcauggcgcuggaaaaggagcuacaucuugaguuguaggcagcagaaggagacuugugccacuggacauagcuugagcauaggagaccucaaagccugccuccacaaugacacacuuccucuaacaaggccaugccuacuccaacaaggucacaccuccuuauagugccacucccuauagaccaagcauucacucauaugagucuauaggggccauuccuacacaaaccccacacuauuauuaauauaauugccaauuucaaggaaggucuaagauuugaaaguguauuugcucaacauaaccuccuacucagcaccacaaaccauccccuuucaaauuucucaggacagccuaaguuguuuuaaggucaacaugugaagucucuggugauuucuuucaagcugacuggagauagcacucacaauaggacuaccugcuuggaggcaucauuuuaauaaagacaacaauaggccagcaugcucacacaaaaauuuauaaggcugucuuugcuuccuucugccuauuguggcacuuuaucugacuagaaaggacucacuucagagcuucaaagacacucauaauggacuucuccuuucaaagggaagucuucauagaggguuccuuucauucaccagucagacuaugaaaagccaagagugauucagacaaacaccucagagagguuuuguuguggcaacaucagauaaagaaauucuguagcccagagagauauuugauacauucauuugaaugucaacgccaagcacacucucccagcuacucaacugaagcagggagaauuagucucagagacagaacacagaagcugucauaugagauguggcuuagugguccuuuuuauaguuucugcaaggauugaggguaggucagagggggcggucacaugcuucacuaauucagucugaaauagaggacacuuuuaguucuaucaguugacuuauggaagcuuucccccauuguccucacaauguuacuuccuaaaagcagcaaccagcuuuuuaucccacucccagcaacuggcaauggggccacauaguucucauuacuauucauguuucaggaagauuaucucagccacaggacccacauggucaguccaccuccuggagccugcucugucugcaucuucacaguugcuaagcaauuucucaggaagaauccaagcuucuaugcucuucacagaaguggcuugugggcacauuaucuuaaaaugcuuucuccuuaaaauaauaauaaaaauaaaauaauaauaauaauaaaaccuuuuuuuuuuuacugagaauuacaugcugugaugaaauaggaugguggugggcucugauuauaucuuuuucccauuuuguuuucacucuuaauuauagaaaauaucaaguugugucuccagcucccucuucucccagauacuaaguuucaucagccgggucaaaaguaaauuuuaugacuaaacuuccacuuuuuaucuuuuucuccccaccagcaaggacuauguaaucuugaaacauguguaauugcauguccuccugagaauguaugcaaaagaaucaggucaacaguaucucuagacaccuaagggauugcugacauggaguagggacaccucaggaccaugaugcugcugggaucucuguaaacacauggguggaagaugcucagaucagcccccaguucuucuguuguacuucugaugguaauagguagaaauuggcuagcugacauaggggaagaagaucccacaaagcagacagauucuuucuaagcuaaaagucagaaauguccuugggcccgugaguaggcucauccuugcuagagagcagagaugccagaaguguuuaagccaaaauggccucugguuacacuauggccacaggccugggaugccagaaaaaguggagagaaugguuuuuuccuucucucucucucuuccauuaauggguaccuuuccuggaaacuauacagaggacaggacuggacacugagaaugggaaauaagguaaagucuccccaauccauggaaaaccagcugggcuuauggugaauagaugaaaccacagcagcaaggaggcaaagcuaggcagacccuaggauuugguggcuagccaccguaacauaaucaucaaaguccagccaaugagagguccggucucaaaaaagaagguagacagcuccugaggaaccaccccacacccccgggcugucuuuuggccuccaaacacacaugcauagacauguaccuacacauaauacacacacacacacaaaaugcacaggagaaggaaaguaauguuuauguuauaaauuuuuaauauaguuaaaaugaaaaguaguucauguuuuuccuuaggacuuucucaaaccaugccauagcaaaagaaaugauccaaauauaccaguaguuucuguugacauuuaaaauuaggccauuggcuuuuaaagaucauauuugggaaaggggaaauuaaaucucucaaguaugauuuuaaaagauguuuuuagauaguaaaacuaaaccuccuuuuccacugucuuaucaaacacaaguaauuccaugccuuagaauguauuuuaaaauugcauuuaacucaacucagagaacuuuguugaacuucaguacauuucauauuuauuucuaagcuguacagucuguuucucuucacuucccacaaaacauuaaaaucaauaauaucuuuacuagauacaggccugauggaaaacacuccaacuuguuuuuuaaaauuauaauauauguggucaauucuuuuugauauauuuucauucucucucucucucucucucucucucucucuguauguguguauaugugugugaauucauuguuuuugacaaauauauugacuauauauauuauauauacauauauguacauauacauauauauacauauauauuuauauauuacaaaaaauuuaaucaaucaauacagaaaaaugagagaggccugguagucaugaaaccaaauuggcacaaauuucuaaaacuucauaccauguacaggcauugauauauuauguuuggaucuuaauuaucucucauguuacuacauugaagucucaguuccccagugggguuacaacucaguguuaguggaacuuacagaaggcagggccaaguuagaaguacuucaaacaucggcaguauguccuaaacuuuuaccuuagccccuuccucuuccuuuuuguaucuggguuacuaugaagcaagaaucucugcuccacugcaugcucccugccaagauauuccaucacaucacaccuccaagaugaaggaagcaaacugccagagcuuuagccucuaaacaucagguagaaacaagguuuuccucccuagaacuugaugugcucagcuguuuugucacaguggugagcagaucucuuagucaggguuucuauuccugcacaaacaacaugaccaagaagcaaguuggggaggaaaggguuuauucagcuuacacuuccauacugcuguucaucaccaaggaagucaggacuggaacucaaacaggucagaaagcaggagcugaugcagaggccauggagggauguuuuuuacuggcuugcuuccccuggcuugcucagccugcucucuuauagaaccaagauuaccagcccagagaugguccuacccacaaggguccauucccccuugaucacuaauuuagaaaaugccuuacaguuggauuucauggacgcauuuccucaacugaagcuccuuuucugugauaacuccagcugugucaaguugacacaaaacuagccaguacaauagauaacagcuuacaguguccuauaaguacacacugcauagaacacacagagugcaugcaugcuaugcaggugacauauacacugguugauuggggaucaaugguuacacaacagaaggccacuaguugguuggcauuucucuguaguugugaugcugcagaagagacaucucaccagcuuauaaguaucuuugcucuugacauuauuuuucacuucuauguaggaagaaaaccauuaucuaagaauaauuuuuauggaucuguuuuugugaguuuaaaaaaacagaaaccaaacugcuuucuaagugguagaguaucuauguagguaauuauuguaauguuaacaugauacauggaaaaugucuacuucuuuucuauuagcaauagaagagaaugugcuuuuaaauguuuuuaugaaacauacaccauaaaacucauccauuugaauuagaugcuucauuagguuuuaaguauacucaaaagaguucugcaauuuauaaaaaaugaaaaccaaguuuucuucccagccccuaaugccagaaugacagcucuaagacuauuuauuaauaaugccuaggccauaagcuuugcuuguucucugacuuucucaugccuuauccccucuguucuaaccugggcucagcuaugaagcugcuuuccucuccuugucuucuuacauccuucuacucagaguuccuagggcaaagcuuuccuuuauucuauacuguuuacuuccaccucaucagcaccccagggugaaucuccugccuuucuauuuuccagaauucucuaucccugcuggauguaccaacuccuguuuucugccucagcucauugguauaagcuuuuuuauugacaggugauacuuauaagagauucccucaauagcaauugaaugcacaaauauauaacauuuucuuuauuccaaaaggaaacccaugaccaucaauaucauuuucuaauuacccuagcccuauuaauccacuaaucuacaaugugcaugggucuguguguuuucuggacaugucacauaaagaaaaucacaccacauacacccauucauaauuggcauuucccacuuagcauaguauuuucaauguuuguucaugcugucagaguacuuuauucucuuugguaucugauguucuauuuuacacauccauucacugcagggagaaaucuguguuguuuucaguguuuacuuacuaugaguaauuccauuguagauauuuauguauacguuuuguguggaugcauccuuuuaacuuuuguggcaacguuucagaauguuuggugcuuugggguacugucaaaccauuuuucaaauugguuguaccauuuuauauucacaucgagauaaauaaagucucuaauuucuccugcucucaauaauacuuacuguuuuucauucuagcuauucuacuguauauaaauaucuggcugugguuuugauuugauuuaucuaaugagugauguuaagcaucuuucuguuacaucauuaagagucuguaucuucuucagaaaaagcagcagcucauauucuugcucacuuuuuauucaauuguguaaucucucuuguuauugaguuucaagauacguacauacccauacacacacacacacacacacacacacacuggauacaacauccucaucagaugcauguuucuuuucuaucuucaggucaucuuuucaacugucuugauggcaucauuugacauguaauuguuugcauuucugaugaaaucaacauuuucuuugauuguuaccuuugcacuuacaaauagaaugucaccuguguuuuguugcugacuccaaaguccuaacuuggugccauaaagaucaacuuuggcaaauuuucccauguguuuaauugugcugacuuuuacauuugagucuauauuucauuuuggccuaauaguugaaugguagagucccaaacuguuguuugggauaccagaaggaugacaagaaggaggagaggaggaagaggaagaagaggaagaaggaggaggaagaagaugaagaaggaggaggaagagaagaaagaguaggagcauguauuuaaaaauaauauuuucccaaauugagucauuuuggcauucuuuguuaaaaaucaaauaaccacaaaagugaggguuuauuucuggcgucugagucucucucucuuuguuucugucucucccccaacacucucucuauauaaauaucucuaccuuuguuucucccugugucuuccuugggucucccucucccucucccucuccccugucccccucccccucugcaagucacugucucaugucacugucucacucccuuucucucugacucugucucugucucucuugcucucucucucucucucucucucucucucucucucucucucuuuccuuuggaagguauuuguuuguuuuguuuuguuuuacguugauugauuuauuuguugggaaaaggggucagaagaaaauuugcaggagugaguucucccugcucaccaugugggccucagaacucaaugagccauuugacaagaccuauuucuggacucucaauuccauucugaugaucuauucuaauucuaauaccacacagucuugauacuauagccuauaucuuuguaguaaacuuuaaaaacagaaaaauggauccuucaauucugauauccaccuuuuguuugcuggacuauucuacauucuuuaauuuacaugugcaguuaagaucaacuugacaacaucuaagaaggauuaauuaagguuagagauuuuaugaguaaguuaaucauuuugaucauuauuacacuauuaauaauauuagauuuuucaauccaugaccauugaccuccuacuuucuacuuauguuuuuuauugucucuuauuguuuuauuuuuaaguguacaaguuuuauaauuuuuuguuaacuuuauuacuaagaauauuauucguuuguugcuuuuguaagugagguuguuuucuuaauuucauuuugaaacuguucauucuuuguauacauaaauaaaauugauuuuuauguauugaucuuauaucuugccacacugcugaaucucuuuauuaguucuaacaguuuuuagugaauuugccgaugugccuuuaacuuuuaaauuacuuuguccccuaccuaagcaucaguauauacuacuaccguaccauaauuagccagagcauugagcaaguaaauccugucugcuaauaacucucauuugguccuuucuacuaaccccuuaaugccgaugacaauucucuacaggagagcaaaaacaagaacauaaacaagaaaaauuacuuucucuaugauccuuuauacuucuaaucguaaguaaaacaauucaguuuagaaaaugaaacauaugcuaagccacuaaaacucuuaugcccaguauuaccuugcuaaaaugaagucgagcaaaauguaagcaaaaguggauccugacauuucauguuuuguuagauacuguuagggugcuggcaaucacucucuccuacguagaaauuaacagccuaccaucugucaaguguugggauaaucaaaggguuuagcacguaauauggcuauuaaaguaugaacuggcaaaaaaggaaagagcacaaccuaguuuggacuaugaaaucuaugaucucacuugcaagugacaguuugacaagcuauuauucugcauuuuggcuucuacaucaaaagcaguuuacacauauaugauucuauuaguuauacaggccacagccugaggaagacucuuucaaauaaauuacaaaaaauaauucugcuuggucauucaauauuuuuaaauuaauucuuaagacaaaugauuccaccaugaguaagugagaaugcaaugaucugagucuucacucaucgaaagaaagcaacaauuauugggcaaaaaugucucugugacaucgccaccagcaauucccaggauucuucaggguauaugcaaagaauggagcaugggagcuuauuaaaacuauccagguggacauacaucaaagucaaaaggcugacaguuuugagaaguguaauguaugaaaugcuuuggcauggaguugccuucauccccaacacugacgucuguuaaugagcaucauuaauauuaccuacuuuuauuuauccuaaugccuuguaggggcuaucuuaaugcacagacuucuauagcuccuuuuguuuucauccaagggaggaaaucccuuacugacagcuucuuaauaagggugacugcaacagaacucuccucuccuacucuuagacagagaaagaagugccaagcucucuuugcuguuuucugccucuugaaacacugcagaaaugugugguauuccugaagguuaucuaaggguauacucauugugucuugaacacauguuuaaaagaagaaugcauuaauuaagucucaaggcaaaauguuccauugagaugacaaaacaaaacagauucuuuaauacuggcaauuauguuaccuggggagcuuaagugagauuauaaauauuugacaauucacacuacaaauuacguugcuuuguuuuagacuauauauccuuuccauuacuuucaugacugcuucauuucaucuuaggaaaaaaugauguguuuuucugucauguuggcucaauauaaggugagucagauugucaagguuccuccaaaaacaaucucaugaucaaauuuuaauaugcauuaaaacaauguguagagcuauagaugguacaauacuccccacuuucucaauacugaacccuucauggaucgucucugaggagaagaaagggaucugauggagaucuggagaggccuagcaugcacaaggcccagguuaggccccaacacagacaggaaaagauaaugaaacaugaaaauacaaaauuauagaauauaguguuuacaucaaugaaucuagaaugaugucuccauggugucaucccagauaugaguaagauaugagacugaggggcagaaaaacauaaggacagucaugugaacaugucauuuauuugcaggggaguccauuccuguuuucacucuuggaaauuuuuauaaauaugucccuucuagagucuagcuauaucugugucuuugccuaucagauuuacauuaauuuuuaauucuuaaauuacauuuauuuacuauuuuaucaggguguggugagagcaagagaugacuugggggucaguucuaugcuucuaccuuauaagucucagacacaguucaggcauggcaacaaaaugcccugaugagccaucucaccagcccuccugaaaauguucucuuguugcuauuuugaguuuguuuuuguuuugcuuuugagauggccucaguauggagaauuagaugaaauaaaacuugcuauguaagccagacuggccuugaacucacagagaauagcuugccucugcaucccuagggcuggguuuagaagauugcaucaccacaacuggcuugugauaaguuuuuaaugugaagguccucaucaauacaacuucaugugugaacaaaagaaacuccuccaaaauuucuuuucuguagucagaauucuuuccagauuuaaaguucagugauguauaaauacuaaacaugcucuuacaaaauauaagagggaaaguaaacaaguaaaauuaaaacuauucaaaaccacccuucugguaggcgccaggcaccaggucaccuugggcguggagucggcagacacccccaaggucccuugaggacucuccaugugcucuuaggaccucugcugaguggaacacaacuucuguuccaauccaauugcacgggaccugagacagcauuagggaagcagaaaaccggccugaccaggguugcaagucccuucuuguuggcaccaguaccuggucaccuugugcgcagaguugguggacaccaccauggucccuagaggacucuccaugagaucuuaggaccacugaccagacagcuccaugcuccucaaaggagacuacacuuccaggcacuguaacacgcccaggaucauugacaacaggaucccaggauaaaaggagcuuggucaaaccaguauuuuaaggucucagaggaacuugacugcuaagaacucugacaaacccagaaucucagguucacaggagcccacaagcaaagaaucacagagaaugauggacucugaggaguuuugaaucaacugggauuauaggaaggacaggcuccaaucagauauauugaggacaacaaauacuugagauaaucagauggcaggaggcaagcauaagaaagaagcaacagaaaccaaggauacuuagcaucaucagaaccaaacucucccaccauaacaaguccuggagacaccaucacaccagaaaagcaagacauggaucuaaagucacuucuuauaaugaugauggaggacauuaacaaggaaauacaggaagacacagguaaacagcuagaagccuuuaaaaggaaacacaaauagaugugagcaucagcaacaaaauacaagagauggaagagagaaucucagguacagaauauuccauagggaccauggacacaacaaucaaagaaaauuaaaaaugcaaaaagauccuaacucaaaacauucaggaaauccaggacacaaugagaagaccaaaccuauggauaauaggagcagaugagaaggaagauuuucaacuuaaauggccagcaaauaucuucaacaaaauuauagaaguaaacuuuccauaccuaaaggaagaguugcccaugaacauacaagaagccuacaagacuccaaauagacuggaccagaaaagaaauuacucccgacacauaauaaucaaaacaacaaaugcacuaaauaaagacaaaauauuaaaaacagcaagggaaaaaggucaaguaauauauaaaggcaggacuauuaaaauuacuccagacuucucaccagagacuaugaaagccagaagauccuggacagauguaauauagacacuaagugaacacaaaugccagcccaggcuacuguaccuagcaaaacucucaauuaccauagauggagaaaccaaaguauuccaugacaaaacgaaauucacucaauaucuuuccacaaauccagcucuucaaagaauuaaaaaaaaaaaaaauacaaggacagaaacuacguccuagaaaaagcaagaaaguuauccuuaaacaaaccuaaaagaagacagccagaagaacagaaugccaacucaggaagcaacaauuacuuuuccuuaauaucucuuaauaucaacagacucaauuccccaauaaaaaaacauagacuaacauacuggcuacacaaacagaacccaacauuaugcugcuuacaagaaacccaucucagagaaaaagacagacacuaccucagaaagacuugaaaacaauuuuccaagcaaaugguuugaagaaacaagcuagaguagccauucuaauauugaauaaauucgacuuucaaccuaaaguuaucaaaaaagacaagaaggggcacuucauacauaucacagguaaaaucuuccaaguggaacucucaauucugaauaucuaugcuccaaaugcaagggcagucacauucauuaaggaaaccauaguaaagcccaaagcacacauugcaucacacacaauaauagugggagacuauaacaccccacucucaccaauggacagauccuagaaaagaaaauaaacagagacucagggaaacuaacagaacuuaugaaacaaauagauuuaacagauaucuacagaacauuuuauccuaaaacaaaaggauauaccuucuucucagcgccucaugguaccuucucaaaaacugaccauauaauuggucacaaaacaggccucaacagauacaaaaauauugaaauugucccaugcauccaacagaucaccaugaacuaaggcugaucuucaauaacaacauaaauuauaaaaagccaacauucacguggaaacugagcaacacucuccucaauuauaccuuggucauggaaggaauaaagaaagaaauuaaagacuuuuuagaguucaaugaaaaugaagccacaacauacccaaacuuaugggacacaaugaaagcauuucuaagaggaaagcucauagcucugagugccuccaaaaagaaacuagagaaagcaugcacuagcagcuugacaacacaccuaaaagcucuagaacaaaaggaagcaaauucacauacaaggaguagaugucaggaaauaaucaaacucaggggcgaaaucaaccaaguggaaacaagaagaacuauucaaagaaucaaccaaaugaggagcugguucuuugagaaaaucaacaagauagauaaacccuuagccagacucacucgaaggcacagggacagcacccuaauuaacaaaaucagaaaugaaaagggagacauaacaacagaaccugaggaaauccaaaacaccuucagaccuuacuacaaaaggcuauacucaacaaaacuggaaaaccuggauauaguggacaauguuuuaaacagauacaggguaccaaacuuaaaacaggaucagauuaaugaucuaaacagucucacaucaccuaaagauauagaagcagucauuaauagucucucaaccaaggggaaaaaaaaaaaaaaaaaaaaagguccaugacuagauggguuuagugcaaaguucuaucagaccuucaaaaaagaccuaauuccaauucuccucaaauuauuccucaaaauagaaacagaagguacuguacucaauucauucuaugaagccacaauuacucugauaccuaauccacagaaagacccaacaaagauagagaaauucagaucaauuucccuuaugaauaucuaucuaugcaaaaauauucaauaaaauucuugcuaaccaaauccaagaacacaucaaaacaaucauccauccugaccaaguagguuuuauuccaggggugcagggaugguuuaauauauggaaauccaucaacguaauccacuauauaaacaaacucaaagacaaaaaccacaugaucaucuuguuagaugcggagaaagcauuugacaaaauccaacaccccuucaugauaaaagucuuggaaagaucaggaauucaaggcccauaccuagacaagauauaagcaaucuacagcaaaccaguagccaacaucaaaguaaauggugagaagcuugaagcaaucccacuaaaaucagggacuagacaaggcugaccacuuucuccauaccuauucaauauaguacuugaaguccuaccuacaguaauuugacaacaaaaggagaucaagaggauacaaauuggaaaggaagaagucaaaauaucacuauuuguggaugauaugauaguauauauaagugacacuaaaaauuccaccagaguacuccuaaaccuuauaaacagcuucagugaaguagcuggauauaaaauuaauucaaacaagucaauggccuuucucuacacaaaggauaaacaggcugagaaagaaauuagggaaacaacacccuucacuauagucacaaauaauauaaaaugccuuggugugacucuaacuaaugaagugaacgaucuguaugauaagaacuucaagucucugaagaaagggaucaaagaagaucucagaagauggaaagaucucccaugcucauggauugacaggaucaauauaguaaaaauggcuaucuugccaaaagcaaucuacagauucaaugcaauccccaucaaaauuccaacucaauucuucaacaaauuagaaagggaaauuugcaaauucauguggaauaacaaaaaaccuaagauagcaaaaacucuucucaaugacaaaagaaccucugguggaaucaccaugccugaccuaaagcuguacuacagagcaauuguaauaaaaacugcaugguacuggcauagcaacagacaaguagaccaauggaauagaauugaagacccagaaauaaacccacacaccuaucgucacuugaucuuugacaagggagcuaaaaccauccaguggaaaaaaaagacagcauuuucaacaaaugauacuggcacaacuggcaguuaucuuguagaagaaugugaauugauccauucuuaucuccuuguacuaaggucaaaucuaaguggauuaaggaacuccacauaaaaccagagacacugaaacuuauagaggagaaagugggggaaagccucaaagauaugggcacaggggaaaaauuccugaauagaacagcaauggcuugugcuguaagauugagaaucgacaaaauggaccucauaaaauugcaaagcuucuguaagagaaaagauaccgucaauaagacaaaaaggccaccaacauauugggaaaggaucuuaaccuauccuaaaucagauaggggacuaauauccaauauauauaaagaacucuagaagcuggacuccagaaaaucaaauaacuccauuaaaaaugggguacugagcuaaacaaagaauucucaucugaggaauacugaauggcugagaagcaccugaaaaaauguucaacauccuuaaucaucagggaaaugcaaaucaaaacaacccugagauuccaccucacaccagucagaauggcuauaaucaaaaauucaggugauagcagaugcuggugaggauguggagaaagaggaacauuccuccauugcuggugggauugcaagguuguacaaccacucuggaaaucagucuggcgauuccucagaaaauuggacaauguacuaccgguggauccugcaguaccucuccugggcauauaaccagaagaugucccaacggguaaggaggacacacgcuccacuauguucauagcagccuuauuuauaacagccagaagcugggaagaacucagaugccccugaacaggggaauggauacagaaaaugugguacauuuacacaauggaguacuacgcagcuauuaaaaauaaugaauuuaugaaauucccuggcaaauggauagaccuggaguguauuaucgagugagguaacgcaaucacaaaagaacucacaugauuugcacucacugauaaguggauauuagcccagaaacuuagaaucccaagauacaaguugcaaaacacaugaaacucaagaagagcaaagaccaaaguuugaucacuuugccccuucuaagaauugggaacaaaacacccauggaaggaguuacagagacaaaguuuggagcugagacgaaaggauggaccaccuagagacugccacacccagggauccaucccauaaucagccuccaaaggcugacaccauugcauaagccagcaagauuuugcugauaggacccugauauagcugucucuagugagacuaugccggggccuaacgaacacagaaguggaugcucacagucagcuauuggauggaacacagggcccccaauggaggagcuagagaaaguacccaaggagcuaaaggggucugcaacccuauugguagaacaacaauaugaacuaaccaguagcccagagcucaugucucuaacugcauauguagcagaagauggccuaguuggccaucauugggaagagaggccccuuggucuuucagacuuuauaugccucaguacaagggaauaccauggccaagaagugggagugguuggguaggggaguguggggguaggguauagggaacuuuugggauagcauuugaaauguaauacguaauuaaaaaauaaauaaaauuuuaaaaaauauucaaagcuuauucacgagcaaaaaugaagaaaacuaaccaaaaauguauguaguaagacauaauuauugccccucauuuguguuaauuuuuaaaugaacacaugguacuuuuuaauggaaauguagccucuuuugcacuacauuucugaugguuuaaagacaucaauuauauauaguaacguaugcagaauacaagagugaugacacagauaugugcaugcaucuggauuguguugccacugcauauaauuccugccacugguacgguacauaaaugguaccaggaaguguagcuaggccccggccuagucucacaagagacagcuauaucaggguccuuucagccaaggcuugcuaguguauacaauguugucaucguuuggaggcuaauuacgggauggaucccuggauauggcagucucuauaugguccauccuuuugucucagcuccaaacuuugucucuguaacuccuuccaugggugauuguuuccaauucuaagaaggggcaaaguguccacacuuuggucuuccuucuucuucaguuucauguguuaugcaauuuguaucuuauaucucggguauacuaaguuucugggcuaacacauaaguguuaaacacauaaguggaugcuaacagucagcuauuggauggagcacagggcccccaauggaggagcuagagaauguauccaaggagcuaaagagaucugcaacccugugggugcaacaacauuaugaacuaaccaguaccccagagcucuugacucuagcugcauauguaucaaaagauggccuagucggccaucacuggaaagagaggcccauuggacaugcaaacuuuauaugccccagaacaggggaaugccagggccaaaaaaugggaauggguggguagggaaguggggggggguaugggggacuuuugggauaguauuguaaauguaauugaggaaaauacauaaucauaaaaagauauuuuaaaaaauaauaauaauaaaguggggagagucugcaaacaugcuguuuagcagagggaugcuugccuugcacaguaagguccuagguucaguuaucaguacaagaccaaaaacaaugaaaaaaaagaagaacaaaauuaugucauuugcaaguaaauuaguagaauuuggaaccaucguuucaagugaugaauaccaucaucucaagugauggauaccaucaucucaagugauggauaccaucauaucaagugauggauaccaucauaucaagugauagauaccauuauaucaagugauggauaccauuauaucaagugauggauaccauuauaucaagugauggauaccaucaucucaaguguaaugagacauaaccagaaggacaaacacucaguguuaugcuauacaugggcaugaacauguacauauaugugaaaauguauguauauguuuguauauauguguauauuucaugaaauuaaaagaacuauuuaagaaaaggaagaaggcucucgggugugggaagaaggaauuagagaggcuaaugggagugaauauggacaaagaauagauuaccacuugaacaaaaaugucauuauaaaacccaucauuuuguucaaugaacaaacacuaauagaaauugugagaaauuaaaaacaaagguagccuagacaagauacaagugcauaaccaaggcccauccuaagaaaacugagaacuuacauaugugccaucccugguugauucaauggauuaccaaguagcagcaagacagccugauauguucucccugaccuuguguuauuugauaaauguuuuaaaaggugcuccuuauguuuaacauucccacauucaagccauaauacaauagcggagucagacauccccugaaugccauggaaccuucaauuucucagaaauuagaaacaaagaacaaauuucuacaaccauccuaaauguauggagggaaagggagaggcucucuccauaauagggcucaacuagagugacacuguauuugagguuauaauuugggagagaugaggggcugucucgcuaauggggaauaaaacuaguauuuucugaagggcagcugggaugcagggugcuguguaaugugcaggacaggccuacauaaugaaaaaugagccuuugccuccuaugacuuucaaauguuccaccagacagucaugaaagaaaaaaaaaaaaaaaaagacugugaucauguuauacauaacagcccaaaguauuuuuacacauuuuaaauucucacugaauuucucaaaaaauguaacuagcauguaagcugaaggaauaauguacuuuguuuuguucaacacuuuaggagcugcucacuuucagaaaaucacuucacugacaacaauggggcuuuugguacccagucuacaauaacucaaauguacuaguuuucauuccuaucugucacaugcaaauauguaggccagaaauaaguuuagcauacaauauuagcauauauguguaccaguuauauauaauuauauauguuauauauccauaauucaaaauauauauuuuuaacugucuguaaugcaaugaugagaaaucuauacaguaaaaauuacugauuagaguuccuuacuuuucaggacuugcuucuuguuuaucaaucguacaccgaggcuguccugagaggccccucccauacaacuucuuuacggcuguuucuuccuccaauccauccccuauucccugugggccacugagggcuuuugaagagcuggagagcaaaugcaugccucaaccugagggaggauuucaagauuaaaugcauucuucuguguuuuuuccauaccacucagcccuuaugguaacacagggaguuauucuguagcucccuuuguaaguaaguccaauuagcuuccaggaaugggacacuuucuaacacuguccacuucuaaugaugggauucuuuuuagcacgagaucccaucuucuaagaguuugccauuuuuccuuaucacauaugcuacucuuugucaccuuuagucagugcccuuuaucccucuucuuccauuucuuauauuguguacauggacuagcuucugauguucuuaucuuaaacccacuuuuguucauaacaagcaguuauaaguaucugacuggucacuccaucuucaagcaaaguugaacuaaggauucacauuagaguacuuaaauucuuaauaaaucacuuuccuuaacuuuuuaaaauuauaauucuauuauacaauuuucuuaaauuaugugucuagcagauaccaccuacaaagaacauuuuaugauaauaaaugggguaguaaauacauuuuaguaaaaauaaggucacuaaucugguaguauagacacuugauucaguuugaagcacagacuguuuccccugaaacuuaaagaccaguagagacagcgaagugaagggaaggucagggggaugaagaaaggccggagggagcaucaucuuagaagaaagugugaaaggaagagagaacagagagcugcaccuagggaaccagcugucacacacguggcaguaacuggcgaaagcacauggcuaguucacacugauuuucaaaugugugguuuauguauccaugcaauggaaugcuuugcagucauaaagaggaaguaaauuauuuagcuugucaacugagguaucaauaugaaguacauucagugucagaaagacaaauauugcauguuuucccucacucaucaugccuagauuacacauaaaacaugugugugugugugugugugugugugugugugugugugucuauggcacaaaaguagaagcaaaauugccuagaauaaccaaugagacucccugaaagagaaggguaagagagcagguauaaaggaggcagaggaaaggguacucucaaggcacauuagauuuguaugguaaaggaguugagucugagcggagcuggaaaccaguuacauuggagcugcauguugaagggcaguaggcauaucuaaaggaaugacaagaagucuguuuuauuuuauaaagucagaugacaucacucuggaaaauagacuagaaauacagaagucuuggggugaccaguuagucagccauuccaaugcccagugggacagacagugcagucccugccauuggugacaacagcuggccuagugagaagcagaaugugagcaauaaugucaccuaaaaucuaccaugcuaugaacuuaucaacaacugucuaauguuaacauguccaagcauacacggaaacccuaggcaagcacgugagcaguaagcgauuaugugagaagcuguaaaauacagauaauauaugcuuuuuacaauaagaaaaauacaauuuugugaaguagaaaauaauacauuuaaauuaaugagaucacugaaagggaacauuugauuugagaaagguuguaauuauggguuucugugucuccaaacuucuaaacagcuaaucauuuggguaauauuuccuuuuugacuuugauggaucuaaugggugauuuuuuauguagauauauaaucuuagauauagauauauaaauaaaauuuaaaguaucuccucaggaaaagcuauauuaaauaggaaauucuaaaauucuaauaucagagccucaacuagcaaguugaaguuauuucuagaaaacaauguuuguagcacucuguaaggccagcauugguguugcuaugaagaugaugauugcaagggcugggagaugucucaguggguaaaguucuugcuaugcaauccuggagagcugaggucagguccccagcacccaaaacaugggcaugucuacccagguuggcugcagcagcuaucucuagauucagugagacccugccuaccucaaaaaacuaagguguccggcagcagcagagaauacuugacaucaucaacugcuggccuccauacacacacacacacacacacacacacacacgcacgcauauauauauauauauauauguaugugugugugugugugugugcguguguguguguguguguguguguguguguguguguguguguguguguguauacacacacaaaaguauuuuuugagaugcaggggcauguuguuauucggcucacccugccuacagcagccugucaccaccaguccugcaaugcacucacuuccccacacuauucuccacacuaacaagaucagaggaaaugauuuauuccacccccuugccugcuacuucugaaaggcagcggguguccuuggggauacgggauuucugaauugcuugcggccaucugauauugcagcuuugcagccuucucucgaaugagccagaaaaaaaaucaaaauaauuacauuaaugcugagaaucaaaguuuauugacucucccuagaggugaaaaccaaaaaagcugguuacaaaaguugccagcuuauuuaaugauaccacugccuccuccccauucuugucaaaacagcuuuugaaagcauuuucaaauaaagccaacuucaagcuccaauucagugguucaucuauucccuuuuaaauaaaagcccauugcccagccuuccacaugcagaucuccucaaagggaggacccaauaggccuucuucuccugccaggucacugccaaaggcaauccucccaggcacugucccugucaucauuuccgcucucuccaggaagcucugccucauugaauauucuucuaagccaaugaggcaaucacgugccucccugugauggcagacugcacuuauugcagcauucauggccgcugaaaaaagcaccagcugguuccuuucauuuccuagcaaaucuuuucaacauccaagugaggagacacuuaggagaccaacagccauuucaugggugauccugcccagaggucuacccaccuaucccagaacuuucagcaauguuccaaaguaccacaccccgcugucucuguuugauaaaagaucucucacaaagacugaaagucgugggccuccacuguccagacccucaagucuaacaacaaacaagguccucccacauucaugucacucaauuagcuccuguuuuucucuguugaaguguuugaaagcaaggcugcuucaucagcccaugugcccuggagaagauaacacagcauccucagcuugccgucuuuagcaagccugcuugugacuuggggcuagcaucugagaccccugaauuauagaagggcuccagucauuccuacaacuauuaaggguggcucugugccuaaucuaauuguucagauagcagaguucaugcuaagagguuguguucuggcugugacccuacauuugugaucauauuaggcauaggauagcuuuguggccagccuacuacaaaaaccucugugcggagccucuaaugagcuucccugucagcacucaaggaguuaggugcauccuccuagguccacugggagacgacucuuguaaccuugcaccuggcauccucugagcuuuaccacauacaacuuucccacugcugauuuugcuguguauccuucagcugcaauaaaucaugaccaaucauauaacugaaugcaaguccucugagcucuccuagcauauaaacuuuaaaaacugaauuuugguacagucucagagacccaugauccacauaucuacugacauuccuuaagucuacuuaaagucacguucucacucaaauaccugacuuuggagaaaugcccaccuggaagaggccacaauccacucccacggcacucugagcugcuucuuagcauuuaucaaaacuauccauaaauagcauuuccaucauuugucugcggccaaugcucugcugagguucugaguucugagucaggaaucaugucuuuuuggcucaccauauguccuuuaggaacaaguacugaaggcaggaguuuuaaacagaucugauaaaauaacacacacccuucuccaacagcuauuuaagaaguaugucuguaucauuucccuucugcuucacucauuugccaaauuccauacacaaugucaucuauacuauagcucauucaacaauaaucaauugauaguuuguaaucaccaaugacaugccaauguuuccucucacaaaacaacauauaaaucugcuuuggggauuuccuugauacgcugaggacuaauacacguguuugcagcucuuuccaccuuacuauucuugggaacuuccagacgaggcaauucucauuugucacuauagcuugggggacacacaaaauggaaggacaacugagaaauucacaaggcugugauucuucagcuacauuucacaggcaagaaauguaaaagaaauuaugcuaagcacauucaacugucgaaacaccauaugacaacagauaaaauaaacauauauccguuaaagaaaagaaacaaacuguccauaugcuauaaaggauacaucuauauauacacagacugucuuaugcauuuaauuugucugcaaaaaugggucaaguagaccaguuuuuccacaguggaugaaaauaaaaugugaagggacacacuuggaugagaagugacaagauuuuuuaagauuaugaaaguaacuacucacaaacccaaacauucuuggugucuuuuaauauucaaaaaaaaaaagaccuugugugucaaaguccacaggugacaagucaccagaaacauacucagaggagauauuaggugacaccauuacacuuggaagcaucuuagagaugggaauuacuaggaauuuuucuagggccuaggauauugagacaggcaaugacuggcccacacgcagcacucacuccaagaaguggagucaggagagaagggcuuuuccuugucuguagaggcacuguguggccuuguguacccccuauugugucuguagaggcacuguguggccuuguguacccccuauugugucuguagaggcacuguguggccuuguguaaccccuauugugucuguagaggcaauguguggccuuguguacccccuauuguguuuauguucugguuaccaacauggccucguuuugccuucucauguaugugccaaggaaauguguuuaggaacugcccuaguaacgccugucagacccaggaaggacaaaaggaaagcuaaggcagcccagcaaauggucaucuagcauaugucacaucucggugacaguguggcacagacaaagaacgacagcuauucuagcucugagacaagauuugaauuguuuaagcacaaaauauaauaauuguccuucccuaugugcccucaaugaaacccucucuucauuuugcauucucaacuguggcacacuaggugcucgcugugauuauauagaaaugacgguaaacgugacuuuauuaaaugcaaaugucacagugaaguagaaucaacuguugacuuugugcagccucuuaucaacagaaccaucaaugugucuagcaaggcacagguuuuauugugaugcucacaucgccuggacuucccaagacacacacuuccagaauuggguauuagaaaccaacagcaaccugaagaacacacaucuguuucaagcaacuaugaauagauggaaaugucuaacaaaacaugccacugcauuugcuggggcacuuuaucucuugcucuuuaauggagucaacccuugcuuaccuacuccacacuucaaacaggguuucuucucuaauggaaagacuagagccucugacacaaaccuuaaaugcucucuccuuuuucaugucauuaacugcuuuagaagugucuuuauagucaaugacauaaguguguguguguguguguguguguguguguguguguguguguguguauuucaaaauagcaccauucgguacgaguucagagcaucaguaggauccacaagaaacaaaggaaugagugcuucucagcaaaugagaagagagacagaugaagcuuauuuguaaagaucucuguagcuaugucagggaugggaauugcccugccagacaccauaaaacaacauguaauuaaacccuagcaguccauuagaagacccagggacaagcccuucucagaagcugcaaucaagguuggaugauuuacaagaagucagcuggggaaacuccuacuauaccagacaaagauccaaccaacauugcuacuuuauuuuuuccuuuagacaaagaacaauuguccaguacuaucaccauaaagagggaaggggagguucuuuagcucagucccaacgugugguuuaguuuaauuaaugauucaaaaauaauugugccucuccucauguggucagagguaaugauaauuugcaauaaauagaacuaaucucucccauuugguuuggguggaguuuuugauccacugaaugcacaccgaggaaguuggccugcaucauggaugaagaaauguggaguagaucagguagcuugugucuagaaacuucuauacacagaaagaaguuugugaaaaugcuuauuucuuuugcugcagagacaaagucccacaacugacugcacacaguggcaguagcauacaaucucuaugcccccaacauuugagggaauaucauguucggugcacagggggccaacagcaagcuggcauggauacaaaugcuuuuuugccauccuuucucagugggguuucuaccucccauuucccuuuuaagauauucucaacaagugaagggauccugggaaaaaugaaacauccaacaauguccacagauggacuucaagggaugccccaagcucuuagaaugauauaaaaaaaauuugacauguauggacccacaaccucucugugaguagaggcucccaaagauuuuguugucaagaugagaacaacugggggggaggguaugggggacuuuugggauagcauucuaaauguaauugaggaaaauacguaauaauaaaaaaaauauugaaaaaaaaaaugagaacaacugugucuuggguguuucccagugaggaacagaggacuaacaacacauaccugccaugauuauugcaucuuuuuuuccuaacucuguucccacuuuuuaguccacacaucaggcuuuuacauuaaaaugauguucagauauuaaauguaucaauuauccaauuuaaggaagcugcgcauuccacauccuacccaucuuggcuccaagauccuccugucuucauugcaggaaggaagccaggaaucuguacuuuuucauacaucauucccagaaaaacguucagaaacuggugcuuuaagaaacaugccauaaucaagcaucaacuaagaaugccacauauggaccuaugaauuuagaugaacaaagacguguuuauuucuuuguacagauacugcuuugggauuuucaucuugauuauucucuuagucacaagaagacuagaauguuccuuuucuucuuugcuuuaaucacuguuacuuggcaauuuggguucauaauaaaauaucuguaaugguuggcacagaauauacagugaaagacacaguauguuuuugaacaauagagguagucauguccucacacugcuuguguagacugacugccguggagaagagugagauaccuuuucaaaacuuaugcuguagucuuaaaguggguuaacucagcaagaggagcaaugaaacaaggggcugcaaggauguaagggauggggucuuucucuacauuucucuuuugccuuuuauuuucccuaggucuuuaaugcuugucucuuuggaauggaugaaguuauaaaguugccuuacauaaaagcugggcuugaaagauugguaaucaugcagaucacuacucaacuguccagucuauucauucuaaaaaaggcuccuauuuuguugagccaggauuaucucugcuguagagugaaacagaaauaucuggguauaaaacugagaaacuguucauaaauauuauggaaggcuuucugagcuguuuacuauuagaggccugauuuagcaaacaguaaaccugcuuuuucaggcuuggggauuauuuuacgucuuucuuuuaaauaaauuuccaaauaaaagucuaaaaauuauacaggauucagagguuuuucacauaggaugaaagcagaaggaaacaaacugagacuuuuaagagaugguuuuaacaucuguagaagaacauucguagaagaaaaaaugccagugacacuguucccugcagguagcuuacuuacauuguaaguacucacugucuaucuaaaguauuuaugcacugucccaccagccaaaggcuucucacagaaauaucgcuagagacggcauucuugagaucuuagaugaguuuauacuaauuuaaaaaaaaagaaagaaagagaaucuguaagugggggauaauaacacaacacaaucaaaacuaguuaauuuuuuuaaucaaacauuugugaugcuguagcuuuaaauuuuggucagcugcaacuaccuuaccuucuauucuaauucugucuccacguacagaauggcaucgauacagaaaagggagucuauacucaacaguuuacaacagaagacaagggugaguccuucuauuuaacaguaggaauauuuuaaacacaugacuccugagugggaaugccaauuaaagaguuguaguaccugucaaagcuguuuuaacaucucaccaaagcaaaucaucaauucaaaugccucagcacgaggcacucugcaaauugaccaaaugauuaucauucucuguucaaagugacugacaacuugaaauucuucuuugccaacccucucuauagacugggccagcccucuucuuggcaaggccacuuuugguuuggagaaaucacuggaaagauaucccccuuuguucucacaggggcuccagaagaaaagucaaguucucucguuuuucuauguaccuucucucaaaggugggauugucuuguuuucugcugugacaaggaagaagccuguuaucagagaucccuuagacugcuauaaaggggcuauauagggaauuacuggcucgauauucuguucaacauagugagacauauucaagguuggguaggaauuguccagcuuuguauuauacccauuuaaaaucaaaugcaacuagcugcaaacuucaaaaauguauucaugacugaaguuucuguaggagaagaaaaugaaugugguucugugagaaagcaugcauuguauauaaaggagaccaccuccugguuuucaaguauuguguccugauucauuuuauaacuguaaacucugccuaagugauagacauguaagguaagucuuguuuguaaacaggcaaagucuagcuuguccguuggggaaacuaguuuugccuccauauucccuucaaauauauaaucucucucugucucugucucugucucugucucucucucucucucucccuuucucucucucucucucucucucucucucucucucucucucucucgcucuguauuugaauucucuuuauacuggucuuacuauuugucucagugucucaugcguugguaucaucuuaaacaugcuauucuauaccaguaugaauuaugauuuuaccuuuuugaauauuauuguuuaaagcacauauagaucuuaagcuaggaauauccaguuuagagucacaugcuguaagaucaugucauugucuuuccuuucaugaccucugcacacagcuuuucucuuccuccgauauguuuccuucccucuaccccagcuacuugacccacuuaauuuucaaauuuccuucagauuuuggcucaaucauuauucccaaccaucuuuccuccauagcaauauacucaggucucuuucugugcacuuauacuguacagguucaucuccuuuuuagcagguuaccaccguugauauuuauguaucacauuuuucugacgugcuuuccucaguagagcaaaaauuccuugguggcagggacgauacccaguugugcauaucacuguguccuagcuauaaccaagcaaguaccuaguacagagaaaacucaaauaauauuuguguguuauguuucaagacauacuucaucaaaguacaauuccuuggcauuugauaaaaacacaagcaggaaauucuuuccaauguucccccuagagugggccuuagaggaauucucuacaauagguaagaagacuuguuccagagggucccuuccugugccuguggaagaggaauauucuuaucugaaugggcaaauacugauucccagagauuguaacuacugacuccauuuuacucugcaccacuacccacuauucaugaagcagaauaaaaacauggauguuucucaguuucucuugguuuguaaagacuuacauguaauauuuuccaaaaaucauauauuuuucucuuguuaaucuauacuuuugugcagaauguagggaccugagagggaaaguggaucgaggguaguggcgaggggucagggaggagcagaaccugaucugguacugggugaagaaaaaggacugaagcccugagggccaacagaaagaauggaaacaugcaaccucgggacauaggagguugggaggacccuccagagugcaccagagaccugggaggugagagacucaggaugauauuuucuaguucugucgauuucccugcaaagcucaggauagccuucuucuuaauagcugaguaguauuucguuguauaaaggaaucacauuuuccguauccauucuuccaucauggaaaaacuggguuguuuccagcuucuggcuaucacaaauagggccgcuaugaacauaguggaacaagugccucuguggcaugguggggcaucuuuuggguauauucccaagaauggucuagcugggucuucagguagaucuguuuccaguuuucuggaacaccagcaauggaggaguguuccucuuucucuacauccucuccaacauauguugucaccugagguuuugaucucagccauucugguuggugucagguggaaucucagggucauuuugauuugccuuucucugaucaauaaggacuuggaacauuucuuuaggugcuucucagccauuugagauuccucaguugugaauucucaguuuaguucuaaaccccauuuuuguuuggauuguuuauuuuuuaguuauuagcuucuugaguucuuuauauauuuuggauauuagcucucuaucagauguggggucagugaagauuuuuccccaauugauugguuguugauuuguuuuauugacaauguccuuugccuuacggaagcuuuccaguuuuaugaggucccauuuaucaauucuugaucuuagggcaugagccauuugaguucuguuuaggaaauuucccccucugccaaugaguucaaggcucuuucccacuuucucuucuauucgauucaguguaucugguuuuaugcugagcuccuugaucugcuuggacuugagcuuugugcaaggugaaaaauaugggucuauuuucauuuuucuacauacagacagccuguuagaccaccaccauuuauugaagaugcuuucuuuuuuccauuguauauguuuggcuucuuugucaaagaucaagggucuauaaguguaugguuuuauuucuaggucuucaauucuauuccauugaucaaugugucugucucuguaccaguaccaugccauuuuuaucaguauugcucuguagugaagcuugaggucaggaauggugauucccccagcuguucuuuuauuguuaaguauuguuuucucuuucucuaacuccuacauugggggcccuguguuccauccuauagaugacugugagcaucuacuucuguauuugccaggcacuggcaaagccucacaggagacagcuauaucaggguccuuucagcaaaaucuugcugguguaugcaauagugucugcguuugguggcugauuaugggauggaccccuggguggggcagucucugaaugguccauccuuucaucuuagcuccaaacuuugucucugcaacucauuccauggguauuuuacucccuauucuagggaggaaugaaguauccacacauugcucuuccuucuucuugauuuucuuguguuuuacaaauuguaucuuggguauucuagguuucugggcuaauauccacuuaucagugagugcauaucaagugacuucuuuugggguuggauuaccucacucaggaugauauccucaagauacauccauuugcccaagaauuucauaaauucauuguuuuuaauaaaugaguaguacuccauuguguaaauguaccacauuuucuguauccauuccucugcugagggacaucuggguucuuuccagcuucugguuauuauaaauagggcugcuaugaacauaguggagcauguguccuugaucugcaauccuauagguggaacaacaauaugaacuaaucaguacccccagaacucaugucucuagcugcauauguaggagaagaugcccuacucggccaucacuggaaagagaggcccuguggucuagcaaacuuuauaugcgcaguacaggggaaagccagggccaagaagugggagucaguggguaggggagcaggucggggauggggggagagaguauaggggaauuuugggauagcauuugaaauguaaaugaaaaaaguaucuuaaaaaaaaaaaagaauuguuuucucuauucuggguuuuuugccuuuccagaagaauuugagaauugcuuuuuccaugucuuugaagaacuguguugggauuuugauggggauugcauuuaaucuauaaauugccuuugguacgauggccauuuuuacuauguuaauucugccaauccaugagcauagagaucucuccauuucugagaucuucuuucauuucuugcuugagagacuugaauuuauugucauacaggucuuucacuuguuugguuagaguuacuccacgauauuuuauauuauuuguggcuauugugaaggaguugucugccuaauuucuuucucagccuguuuaucauuuauauaagagaaggcuacugauuuauuugaguuaauuuaauauccggccucuuugcugaaguuguuuaucagcuagagaaguucucugguagaauuuuugggguugcuuauguauacuaucauaucaucugcaaauaguaauaccuuuauuucuucuuuaccaauuuguuuccccuugaacucuuuuauuuuagcuagcacuuugaggaccauauugaauagauauggggagugugggcauccuugucuuguccaagauuuuagugggauugcuucaaguauaugucucuauuucauuugauauuggcuguugacuuguaguaaauugcuuuuauuauguuuagguaugggccuugaauuccugaucucuccaauacuuuuaacaugaagggguguuguauuuugugcuuaauuuuuaauauagacuucuuucauuacaaucgaagguuugauaccaauauaucuaacaaauaauuugucaaauaccuacuuugauguagaauucuuugagcaauuuccucuguaucccaaagauagugacuuccacacagacuucccauuauuuugcuaccaugcacucauaaagcacccagccuuuuccugccauuguauguaguauggaguguaaaacaugaaaagaacagacugaugugugcaacacugaauagguggagucauccaauuguaacaaaauuagaagacugaguuaacuaccaccauagaguaauaucaacaggcgacaugaugaaggcaaaguuacugaaacaucccauaaaggcuggaaaagcccagcacagccucugcaguuuggucaugggucuaccucauucauuuuaguaaaagcacaugcaaggcuaccuugacacagaaaauagaaucugaaaauucaguacaaaccuugucggcugaccaaauaaaugaggaaaagaagguuucucuucacaugaagauuaaauccaaagcuuuuuaugacauucuuuuaauacauuuuguuucuguuccuauuaagcauuauauauguguaugauuuaauacaaauuaagaaguugaaugcuuucuauaaaaauugaauucauaaaaaaguaaaacugauacugccccaaaccugcauauauagaaaucaaaauaaauaaaaaucccaagugguggaaaggcccagaggacuuuaccugugaauuuuuuuaugggucagguaggaaacuucguguuugaguacaauucauuuagcucacaaaccaacuccaauuuuguaucaucuacauuuuacaacaaaaauaacaaagcuuuagugaacaagguuucuuugcccuagauauaucauauggaaacugagagaccucagcauaaaaccuaaucaagauccagcaguccuauucuguuuauucuguacaacaaaaguauacacacaaaggcacaugggcuacaccuagacagcugccuccuagcagccaaucuaaaauggaucauuauacuuuuaaagguuuuugaaaacuuuuacagcgaaguauuaguuuacaaaaugguaaaaguuacaaaauucauauaugaaccuucauaaauaaaguaucauagagauacaaguauuauuuaccuguugucaauaccugcuuucauuuagcaacucagaauuaagcaaaugcaaaggacuccuuaggaccacagaaccuguaauaguuacugucucgucuuuugucagagaaaguuugcuaaguaaaaguguucacagaaauaaaacagcaggcacucuugggaacgagugacaaaaacaaaagauaauacaaaggagagcuguccaaucccaggaggucuucuugggagggggauuugcauguguugugcaugugaaccuucccugucaggucugaguauuacuaugucccucaggagccauccacacauguuguuuugugggacaaaguaucucacugggaccuggugaccagggauucuucuugucuguaccuccacagugcuuuuauuaaucggcauacaccuaccccuagcuuuuccuuuuuucuucuuccuuucuuucuuucuuucuuucuuucuuuuuuucuuucuuucuuucuuuuuuuuuuuuuuuuuuuuuuuugguuugguuuugguuguuugguuuuuuguuuuuuguuuuuauauagauccugaaaauugaaucuuaauugucagcaguccagcccauuaccaaaacaucaaacacaaaucaggagcaauggcuugauccagaaaaaaacugcuagucucugcugaugugcaugaguccaaagaagcagcaagaaguagcccgaauaccaccagacauuuuuuuuuuugguaaguuucucucuaugaagucaggacaggcaaugagcagcuaagaaagcaaggugaaacaaugcaagaguguuugucagcaaagaccagccucagcaaagcccagugaagaccagcaaagaauugcaaggugagccaaugcaaaugcauaguccacugucugguguguuaugcuuauucuucucccaagcaucacgagccucucaagcaucugcuccagcaaaccaucccauguccuuucacaaggcaucuuccaggaaaaaugccccaagucuggucucaguaaaacauccucucccaugccugcuucagcuaaagauccucuuagacagcuucaaaaaaaaaucauaugauacaacugagucuucagugaaaccagaaauuccuguuucauagaccagccuaaccuugaacucccacagaccugaaucucugcuuuccaagugcuggguuuaccuaggcuuacacugaauacuucgucuccggugaugcuguuugaagauaauguaacuggaaccuuguacggcuguggaguccgauaucugcuucaccacaaggcacagccacucagggaggcaggaugcaggaaguuuugaggagguacaaaacaaguggagcuagcucaaggguccccaggccugugaugaggucagggucuucucguucucaggcccuuggacauccagaugccacuggaauccacagaagagcuaacaacagaguggaggcccacuggcuggauguggcccaggccccggggcaagggagggacuaaggagggaacuucggcuagucccucagggaguccuuggcuugaugguagugggcuuggcuuguuggcaauugugacugggagcacagagaagccuucuacgggagacuaaauggcagcucuauagucaaagaccuuucccaugguucccuauggcagaucaugaugaaaacaggcaguccaugguuuuaaagcauuuauugucaugguggaaaguagauacauaaaacuauaccuuucuucucaaggugggccugagauuaaauaucuuuugugucuaggaaguaaaguuuauuggcuaaggccuggccuuuagguaccucauuaaaauggagaucugucuugagccuaugugaccacaggucacauccucuacauuuggagggacuugggucauugcucuuaugugaaggauggccacaaaucuaugggggcuguggcuaaugacagaggccugguacccaggaacaggcaaagcuccuaccaucccuucagaaucuccagggcuucaagccuuagcucaaccggguccacacuaccuuucauggucccacagaaccuuuaggagguggggcccugauggagcaauuacaucacuagggugucacuccacuuccuguucucccaccucccuuugcuuucuguauauggacaaaaugaagaagaucucucucugcuuuccaauccuacugccaugugccaugccuccccacuguuaugaacucuggcaucucuuaccauagcccaaacaaaccaucaagccauguguauuuugucacagcaacagaaaaguaaccaaaacaacccucuccacaaaauggaggauuaauaagaauggcagaagcuaaggcacuaugccauauacuuaaugcuccauuuagcugacccuacuuccuaggaaggaagacuuaaggaaaucagauaacugcauaccaagaauuugucagaucucaaccaagggauucugaguuccaacucucauucucagaaugcaggcaacacaauaucuccaucccaccaucuguugacugaacuuggcuccugaacaauauggauuuacuuccagguaugguuucaaacuguuuuuguucaaccaacuuagacuguacuguccucucuaaauguacuuugguucaaaugaacaugcucaauuaugaaaaugaaugcuugaaaacaaccuauucuggguggguuguugccucacaccaggaaguuaaauuuuccagggaaaaacagaucuuuuucuuuauauucugacuacaagguugaaggugagaaacuacaagauagauauaaaaacaucuuuuauuucucuacagcuaagaacaauuuaugacaauguauaauguuuagcucaucuucuauauuauuuauuuguauauaauuacuguucuggcuagcuuuaugucaauuugccauagacuagcgucaacagagaggaggaggccucaaucaagaaaaugccuccauaagaucaggcuguaggcaagccuuuaaggcauuuuaucaauuaaugauugaugguggaugacccagaacauuauggguggggccacucugaggauaguuacuaguacuggguucuagaggaaagcaggcugaacaagcuauggggagcaagccagcaaacauuccuugauggccucuguauuggcaccugccuccagauuccugcccuguuugaguuccuguccugauuuccuucagugguagauuacaguguaaaaguauaagaugaauaaauccuuuccuccccaaguuguuuuuggucacgguguuucaucacggcaauaguaacccugacugaaacaauaaucuacaaucauuggggcauuuuauauuuuucacaagugaauaauggcaagucaauacuuggggcacacaucuaggugaaagguggccaucaucuuguugggaaaaaaaaauccuuuuaauagaaaauagcauaugaccucuaaugcaccuuccccagccaucagaccucucuacuguucacugucuuugauguauuuugcacacugauaacuugcauccaacugauguaaauagauaaauucuucccugacauguaguaacuuuaacugacucugcaguuuagucaugggucuaccucauucacuucaguaaaagcacacgcaaggcuaccuugacacagaaaacagaaucugaaaauucccacuguggcaaagccaguuucaucucaacuugcaccucaccccagccuucuuuuccuucauagauguuugugcuguuucacuuuuccugugagcuagcuauuacaauuacuuaguucuuucccaucacauaaaucaaauuaaaucuucaguguguguucuuaugagacaugauuuaauucuuccuaaaaaacuauauuuuaaugaccccaaaguucaguaauaauucauauuucuuuccagugcuacuuuuuucaaacugaauuuugaguaauauuuauauuucaagugaguuuaauuauaacucuaaauucaauaaaaaaauuaaggugaugagaauauguuuugcuucuauuuuaacguuuuucaaauaucacaaaaugauaguuuuacagaaggacaagaaacagauauuaaacaguacuuauucugacauuuguucaagagguaagaaggaguuuaucaaaggguacuagcacaggagagaauagauuuaacguacaauacagcaaggcagucaggauuuaugggcaauauuaaagaagguaaaggggucagggaaugggaaauugcuaaaggaaguagaggaaaucuuguuggauuaauccuaacaggacuccugugaaaagcagacaaaaagcuggagagcaagggcgugguaaagagccugaucaaauauccagguacccaaaugucacuuaacagcuuuguuacaaacaccagacuaggcacagcaaaggcuacaacagggguaccaagaccuaauuagaaaccugguggagaagaaagcucagagauuaaggguugagauauaauuuagucacagagcacuugacuagcauguaugauguccuagguuugauuccuaguacugggaaaauauuuaaaguuugguuaaagagacagucuuugucauaguacgcagcaaaauuuauaaagggauaaacuauucaauuuaacaauuaccuuuucauaaauuuauucuuuuuuaauacuuagauuuauuuauuuucauuuuuugugcgagaguguuuugcccccaaguauguuggugaaccacacguauaucuggugaccauggagacaagacaagaggaggaaauagaauccucuggaacuggaguuauguaaggauaugggugcugggaaucaaaccugggucuucuggaaagcuagccaaugcucuuaauguuaccccagacauuaagaauucaacaauucuucauuuccaauaaccuacauuuuaagaagagauuaaacugucacaaugaggccugaccaccuugaucucaauuuuuaguagaaaucuuauuuccaggaaccauaagcagauaucaucuccaaagguagcaacagaaggaaaauguaagcuguucauucuauaaucccauuuuuaccaacuuaaggcuacugugaccuuaaaucagguauuuuacacaagauacucaaagcuaagcaugugugacuuaaccaauuuuuaaauagguacuaccugccaccauuggccaucaaauucaccacccagccagcagaacagcagaaacugucaccauuuguaaaauauaaacaacaccauaauuucaaaaucgaaauaccaccacaacucauuccacaaagugaaaagcuaauuuguuucuacaaaccuuauuuuuaaaaguguguucugcugaaagcauccugggcaucacuuggaaacuuguuagcaauguggacucucgggcuccuccugcuguggcugagcccagacucucaagccgcccuggugauacuugugugagauaaagcgcaggauaagcaccuaccugugcaacuggugcuaagcucauucccucaaucaucucccucuugaauaacaacacagugguuucugccgugacaaauaauacagguggggagagaacuuacugucaccaaaguggcaacaguuccuggagacagagaaaaugugccacauuuaucauuguguuuugccaguaagaucagugugcagauccugaaagacuauggagacauggcauuuuacugccugagguuuuaaaaacagucucaguuauaguuauaguaucuguacuaguaccaguuaaguaaacuaugauacaacucugcaagagaacacauugaaggcauuaaaaacaaggucgucuuucauacuccacaugugcuguuuucucauacaaucuuaacuucaaguaugcagaggaaaaacauacagguggcacaggagcuacugugaguuauuucuucucuaaggaaaaauagugugugugugugccuggaacaccucuggaauggcacagaaaaaaaaaaauaggaaggaaguauuucauuccaaggauacacugccacagacaugagugggcuaaauguugcucuaucuuuccagggaugucagaaacugaccaacauauuggaaacaccucaguuuuaacacaguggcuuuaaaauuaaucacuuaaagaaacaaugcagagugaacaagaugcacaagagcuggauguacauguaugacuauccugccaccuuucaaaacuucgaggagucagacaaguuguuuuuaacucucaaucguuuaugcuuguauuucauuugcaauuuacaaauucuucuacuaugcugaaaggugcuauauagcucauuuacugauguuugggcuagcauuuaaaacuaaaaccaaccucaaagaccccaaccucauucccacacaaguguuugcaugccguguauaugugugcacacaugugugugccugugugugugugugugugugugugugugaacuguuauugucauuguuguuucuaaagaccuuugauaucuauuguuagaauuacuuuauuccuuugaugguagauucuauaauggguuguaauucauggaauauauaugcguacuaacccauuacaucucugggacuuauuugcaaaacacaguugucguuuuccaacaagcuuucaggggaagaaaauuucaucggaaaaaaacacaaaugucuuaccacuccauccuguaagaaccuaaagagacuauuaggccauaaaaaaggaaauugagggauaaauuuaauacuucaaagugacuguguuagcaggaggcuugggcaccuugccagguuaaggagaaguaguuuuauacccacaucuuaacagcauccuuaaucugcaaucuucacuccuccucguuuaaagcccagugcucacagucaucacagccacagugucccuugcagcuugucuuaggauuugaugucacucgggcucugaacucugugugauuucuucauuaaagcaaacagcaauuggaaaagcccucuugugauuguaguuugaagaccccacaguacuuaacguaauguugauggggaugugaggguuccauuuuucuggggcuggaugcagaauagcaucaaaggcaauugccagaaaauauacgauuuugguuugaguguggaauguuuuuucagacuuaggugugugaacaccaggaagugguggaaccauugagauauacggccuaccuaaggugggucuccagacacaagccuuugaaugcuacauguacuccugccucuagauuagucucucugcccauggucugacucuuaaggugaggucugcugcaugccucugacaccauguggcuguuuuaccacggcuuccccaccacuaugggacaaggccucgagaaccaugagcuacaauaacccuccccccugggguucugacgaguauuucugucucagauuuuaucaaaguaacuaauaaagguaucaguuuacaccuucaucuucuaauauacagaauugaucuuuacaacuauauauguucucuauuuugcuuaguaaaauuaaagacaaauuagaaaucucaagagcuuguuguacacaaaaaacacauaucccaagguuaugguaucuccaaagugaauauuaucuacaaggcuuacagaaucucaaaauccgagccaccaugauaaacaguuauacuaugauguccaggaaggagacacugaaucacugauauaauuuaugugagcaaauuuaaucauuuaaaaugauuucuacauaaauaggcaugccauuaaacauaaagugucagaaaaggauuaccaaacuuguaagauccaucuucacugguaaauuugaguuaaucaguguuuacucuuggggaaagguaccuuccaauuccagcuuugacagcccaaugucaguuaacuuccacaggaaaacacaguauugcuuugacagguaucuccugcaggaaaugaaucuuucacaugcaguaauugugcaaaacuuuguuuucaguuguuuagaacacuggugcaucuuuaaaucuuucuacuugcuaauugcaggauguuguuugcauacauuucucaggcuauucugacauuuuaaacaccuuuaagacauuauaucuauauaaaauaaauaagcuauuaaaaugucacgaagcggucugugugccuccuugcuacaggagacuugugagggcaucguuuuuuuuuagaacauuaaagcuggaaucgggcgcuuaguuucaguccuaguggaaagcaccuugggagcuugggaaaugacaaaacugugcuacguuugcauuugcuaaaugaggagacucccugaauuugaauggggcugguaugaacucauaggaaaggcugggaagagaagagacugucacaaagcucgggcuuauucaugggauguugugcggagaugaaggaauaucaaagccacaauucauagaaaacccuuggagaaguagggaugaagcucucagcaguaaagcaguuaccuagcaugggcaaggcccaguaaaucuggaucugauacugcaaaggcugagggagacacacacacacacacacacacacacacacacucacacacacacacacacacacucacacacacucacacacaaacacacacacacacucacacacacacacacaaacacacacacacacacucacacacacacacacacacucacacacacaaacacacacacacucacacacacacacucacacacacacacacacucacacacacucacacacacaaacacacacacacucacacacucacacacucacacacacacacucacacacucacacacacaaacacacacacacucacacacacucacacacacucacacacaaacacacacacaaacacacacacacucacacacacucacacacaaacacacacacacucucacacacacacacucacacacacacacucacacacacacacacacacacaccauacacacacacacacacacacacacaccagucuugagaaauaaaacugacaaguauagggccugagacaccucugauggauccaucaguaaaggauuugccacaaaagcaucaggaucuaaguuccagaaaacaaaucaggaagccaggcuggcacuguuccuugugcucucagcagugagaggugaagaugggcagacccuuagcugaccaagccagcgagccucgugucagagagagacacacaaaauaagguggacagcaccugagaaaugauacccaagauugacauccggugugcacacacgcacgcacgcacacacacacacacacacacacacacacacacacaaacacacacacacacacacacacacgcaugcacuuuuuguaguauggcucacaaaacuugaauugaaaaggaaacuauaaauaagcagauaaugcuaacugaacauaauucaaguuguuugguuaagaacucucucuagagaaguaucugauagggagaaacgcauucucagguuaccacaaauacucccugaaucccuuugugcaucucugcauacccuuccccaagauagcaauuugacaucuugcacaaguuugguuucucuguuggcaugacaaacaguacaaaugaaaacaaaguaggcauuuguuaauuuuccauuuuacaguucaucauggagaaaggggagggcagaaacucaagagguagcgacugaagcagacagagaccugguuugcuuucaggcucacaaucagcuaccuuucuuaugcagcccauuucuagaugcccaggcauggcaaugcucacaaugguguaggcccucuuccaucaguuaauagucuagaaaacacccucacagauuugcccauaggccggauggaagcauuuccucaguuaagauucccucuucccaggugcaucaaguugacaacugaagcuaacuaugacaccccuucaucaaagucacuuaguagaaauuuagaaaaguuuuuauuaaauaaagaaucuaugacagguacuaucaacuuagaucuucuaacauaagcacagugucucacccaguauucauguuacaacuuaauccucaaagcaccugcauuaaaagcuguuaccucugggaccuaaugaugucaugggaguagagcaucaccccuccccuccaccaaaaacauuucucacugauucucacuacaguuacuugcucauagaagcaaauaucacaaauccucgugcuucuguagaacugucuucagaacgucauacuucuaacagcuucuuuuccuaguucucuuaaaaaccuguaccuugaggucaacgugaaacuacauuccauggguuaguccaccugcgugcccaccuucugcuuccuagaugugaucuaagcaguuacauccuugcuaccucagcagcagagucaugugguuggaaaagauuuaugggacaauggugaaccucagggcccauagcacccuugggauuggugauuuaucugcaaggacauaauaacaagcacuucucuacuucucugcggguauuuaaccccaccugguuugccuguuuguuguuuugaugcagucuacgcagcuuaggcuggccuggaacgguaauguaguccaggaggaucuuaaacucagaauccuucuggcuuggccuuccaaacgcugggauuacagguauagaccaugccauucaaaacaaguuuuguuugcuuccuugggauuaaacucagagucuugugcaugcuagcuaaaauaguaugcuaccacagagaaucauccuuagcccuuucuuaugaagaaauugucaaagaaagaaaaccuaaucaugcagccaugcuaucagaaugcauuucaguguuaugucugucuuuauauaaauacauuuuuaauuuugccaauauuaaaugauuaugauguuacaaaaccugaaccaaccucaauaaaaagaagaguauauaaaagacuccuuuguguacuccaguacuuagguauugaaucugaaagaaaaugucagcucuuuaaauaaaaauauaaauuagguagaugguaauaaaacuaaauuuuuaaaugugcaucccuaagacuucugauuucauuguguauuuuucagugaaaugaaagaacaccugcagaaagucuugguucuuucaaauuucuccccagugacuuaaaacuuucagauggaugggccaucuggacucugagcaauguguauuauuccuauccccucaagagcaggccuaaguggaguuucuuuguuuagucuaguaaacauaaacagcaaacauuuaucacaugacugauacguuugccuuuuacaaaaccacccuggccaaaaaucauuaggaaacagauugcuggccccauuggacugaagcaauggaauuagguaguccaacacuacauuuugucacaaauuucugacaaccuaauaaccagauugucaucacauaggcauugaaaaaugauccuggguuuguuccagcaugaaaaugccacugguuuucuguugugcuuuuuuuaaauguaaaauuaaacaaaaaucuaugaagaaugauacaggaugcagccagugguuggugguauuuaaguggguguaugccauuuaaaggaugaaggaggcaguuuaaaguuuaaagacucuuuccaggaacaccugugugauuucaauaauuuggcaucuacacauuaaaagauaaauuauaaagaacauguuagguaccuguccacuggcauugcugggcauuugcucuggcccuggcacuuuguucuaucuuguguguugugagauucuaagcaaucaucagccguauguguuuuugugauccucauuucugugggacagagggaggcuucuccaggcauuacuugcacauccaacagagccucaagacuccacaugcauaguggcuguaaggugcuggcaaaaaaaugggguuuaauauugucuggcuaaauugggagugucccuuucaagaaaacuacuauguguuugggccccaaaagaugaugauacaguaaauagucuggccuguaagucaaauucuauguacauuacguaucaaugaaaggagaggguacuguggucauggauuauucucacaguuauacaguuaaauauuaaaagaaauauuaagaauggccuuagguaaaagaaaaaaaccucuaguuuccacuuaauuagucaauuaugagaaaaauccacuaaccuguacaaggaaaaaaaucucaggguguagacuucuaagaugaccuuugaaauacuaauaucccaaaacuuugccauuuggucauuggaaucuaagugaaggaccuacuguaaaccacuguccagguugcacaugcaaaguuuguggcugaacuaguaaggaaaauaaauaaauauaaaaauugggaaaaaaauucccagauaccugaaaauaccgcugaguauuuaaauacacaacugaccaauugauucuugugucuucagggcacucuugaaauuucagagcaucucauugaacagccacaagucuacaucauuucuuaaaagcaaaagagaaagauuccaaaugucacaaauauaauguugaaccaaagauaccacauacaaaggacccugcuucugcuuucaaaaaccuauuaucugggcuuagaucuaggucucagcaacauggcuacauauaccaguuaggaaagaguugacaguauacagggagcugcaauggugcuucccucugggaaauguugaccugaaaucaaucugcuagcgaaggagacuugugccucuguggcauaaucaagaugagaccagagugguaguaaaugcuugaaauccuaguaccuagggagcagaugcagaagaacugugaguucaaagccagccuggcuacaugagaagacuuugucucaaaaacuaauaaacccauacaacacaauuaaguuucaauuggcugaagagaaccuagauccguccacaccaucaccugucacagaaucacaggugauaugaccagaagacaagaggaagugcgagaccaguagaugucccaccagcucuaccauuccacguacaucauaagcccaugauacauagcaacaauugcuucacugucagguauauuuacugggugauuuuguguuuauguauuaauaugauuuuauucagaagauaccuggaaguugaaaucuuccuuaauguauucugaaaaacaugcugaagugaauuguccaggggguuugggggcuuggguugcuuuugugagguaagucaaaugauaugccauggcaugagaaaguagagcucauagaucauggauuucaacuucuaaaauccuuuucuuugacagguugagauuugugugaaacauuagaaccaaaugugcaaacuucaacuuuuagaugaugauccauauuuuuaaaaguuucugaaagugugggcuaugcugcaggguaaaauaaggaacauguauauauuuuugaaaauuucaagacuauaacagaaaagauaugugauuucgagucgugauggugacuggaaaacaguccaggaagguccacacuuggugcuuuauagaguagccccuuaggcacggucacuauagaguuuaccucugcagcacacaaaucaugaacguguacuggggauuguacuucuguacaaaauggauguagagcaucauucucuugcuuuguucauucacuagcuagaccaagaacaaaauguguacugugcaagagaacaggcaguauaaaaacauguagaaguuugacugugcaaaccguugagcugcugacagucugauuagaaucacugagcaguccuuucucgcacaguaacacacaauuuacacagcaauucuucucuaguaguucuuguaaugaaaguauaagcauugcagucaaucauaauugggcucuacaaaccccagacaauaucuucugggaagcaggccucugaagacucaaugaaugguuuagagcuacgugggaaacacuuuaacccacuguuuguuugcaauucuccuuacgauacaaaaccacuucuuagaauaucauggcucauagcuagaauccuagguuauaucuauuucugauuacuuccuuaaaugagaaauacagagaaaauagaaguccugcuucauuuugccuggucuagucuguuugcagaacuuuggagcaaaauucugaauuauguuuuucaugcuagucaagaauaaauaccaagguugaaacuguuggugugacaugaccuuaaauauuucccaaaagccaugaaagcuaggucaccagcuguugguacuagugggaggggcugaacuuuaggaggugaggacuacagagaggaaguuaggucauugguuggcaugcucauuuggggaauagagaaaccugaaguccuccuucugcuucuuuuuauuucuuaggcaucagcaagugagcaguuuucuccaccaaacucuauccacugaugacccaaaagcagcaugguccaaaugacuucaaauucucaaaacaucagucaaaagaaggguguauuuuaguggauuuucucagcaguguuaccacagcaauagaaaguugacuaacacaugguuaaaaaaaaucauuguuucaagacauaaauugacuugauuauagaaaguaucaaaugacguauuaugaugcauuaauugucuuaauuuuauuucuuagacucacagaacucaaacgcaaagagaauaucaaugaugccaacaauuguugcccaauugagcaguaggcacagcaacuugaauaauuuucuuuccuagacaaucaggauguauacaaggaaaaauuaaugauagcugccacuuuaggccugaucuggccaaguuaucauauaacacauuuuauaagauggauaccuuucaagagagcuuauccuccacugguuuuucuaaaagaaaaaagaaaagaagagaagagaagagaagagaagagaagagaagagaagagaagagaagagaagagaaaagaaauucaaagguuuaaaugguuuucuuucauacauauacaagauagaaaagcaaauauucuuaaauuuauuaagcuuggcaaaucaccuacuguguggacaaaguagucaaacucaugcgaaagaaaagaacuucucuuuguaacaaaagaacuagacaaaaaucccaacaaguacagcuauaaauggaacauuagucuuucuugcaauuuucucauaaauuauuaagagacuauaauaaauaaggaaaugcauauuguggaaauacugcugccugccugucuaucucaauggaggauggaaacuuacuuuuguagcaguaaucuugguaagaauguaugaccuuagagacaugacagaacaguuggauggaugauccuuuccaaaguugaaggaaauacaguuucauugugggacucuggaagaaaucaucuagaagccagggccauuaggaguccaggcugucaccuaauccccaugugccaauuuccaaguuucauuuacuuccaccaucuuagauugcuccuauagucucuggguucuuucuccuggcucuuccuaaaggcauacccacuccaaaacaacucugccaauuuguccaagaacuccaaugcugacaaagccccagaauccagucacaguagacuugacacuaccuuuccauucucuuuccaagcuuaauaaauacucugaagaaaaaaaaccucucccucuuguuuugacaauuuuucuuguucuucacacaaauggcucaggaauagaaucaucaaaaguaguaucuuagaacauggaauaaauauucuacuuauccuauuacaucucuuuccuauaauuacauggcuaaaugaucaguguuacucguuguagcagcugcuaacuguaccauggcuauuuacacggacauacuaguccaugcucaggggagcauuuaaugcaguagaaccuguggcuaccugcuuuacagcuauaaaagacuggaugcuuucucugagguguaaccuaugaugagaagagaaaaaggacugacaagaugacuuaaaagguaagggcacuaaccaccaagcuuaagggccugaguucaguuucagggacacacaugguggaaagggagaaccaacuccagcagguugcccuccgacguccacaucugugccauagugcauucgugagcacacacacacacacacacacacacacacacacacuuaaguaauugaguaauuuacguaaaagaaaagagaagaagcuggugacagaugguaucagcagcacaagugcaccguaagucuucagaggggcuuccaaagcacagcgcuuuacaggaaaggauggaauucaaaauucacacacacccagauaaaaugacaccacuggcccaagccuucacgugucccuuccauggucuuuauaucugugcauauucuaucacuaauauaggauuuuuaaaucaguucaauucuuaauacaaaugaaauuuugaaaauaauuguauguacccauuguaaauauccaauacuguagauguaauauauggguguauacauaugugugaacaucgucuacauauaguauauaguguacaucauuuaccauuaauagaaagaaauugaaagacuugaagacucuaacgugacuaaccaaagaugaguucuugucucauguauugcaucaguuacugugaagaacuguuuaucuaagugcauagaagagaacaaaugaauuaugcauacauauauuaucacaucacccauaaacaugcccaauuacuaugugccaaguaaucuuauggacauaagaaauucccaaaaccccucuacauaaucugucccuucaacaaaauugaagagugaguggucuucaaaaaagcuacaugggaccucaaggaaaaagggugggugcuagaggcaaauuauagugagauaaauuggaugucacacacuuagaauaaggguacgaaagagcaggcugugggccacuucacaauuauuuauucccagaauugaauugucucuaaauaugugucacaaaguagauccuucguacuguuugauuugaacgcccuucaucuccucugccccauuuuuuuagacauacauaucugagcucacgaauuacccaucacaaagaaauggcaugcugcuaauaggacucuucacuguggcugacagugcagaacaaaugccggucccugagcugagaccaaauuucuggaauacuaacugagguucccaacggggaaugacacauuaccuagaggucaccccaagaacucgggaacaaacuugcauucuacugccucucgccacacucacuacagcaugccauaugcuccaacucucuuagggcauccuacucuacagauucacaaugcuguagcuuucuacugcucuaaacaccuaccuuucaaacaauagguaucuaguauacaagccgagugaugggcuggcaagauggcuuagcaaggaagggcauuugcuggccagcaaaacagccugaaucagugacuucccuguaauauagagugccugccaaccgaagucaugcccucccucaagugccauagcagauccuguuuuguuagcaaggcucaccacaugaauccaucaaaacccccauccuuuaaugcagaaaugacaggucugaacaaagauucacagcacucugucaaagcaccuucuuggucaccuuggcugugccaucuuugucagguuacuugaguuuuccaagacacuuuacccacuaagcaugcaaggauaguacaugcccuaaaaacugugaaaaggguuaaaugaugauugcuuuuuuaaaaugacccauugccugauugcaccaaguuaucaaaagccugggaugcuggcaacaguuugggaugagcaccugcagccucaggaagggaaagucuggaccugaugccuguaauguuuuucaggaagugcucccacaaugccucuaccuaggagaugguaaacuacuucgacaggcuguugccccuccaagcagaucccaacaccucuccacuaacaccucccccaggcaucucuguguuuacaguuauucaucaugacuggcucuacucacacagagucuaugguguuaaacuaaaaggccccacagaccucuaguccaagacagcuggaagacugccguguguuccuugagauagacccuacuagagaguucuccagagcucuagugcaggaggcuguaggucagaaaguuuuccaaucagcuucugagguugggugccugcaagccaacaugccagcagagaauaacagcggcuguggugccuacaagccaaaacgccagcaaggaauaacaucauugcagcaaguuccugagucugagcucaugagcaauucugauuccaaaaacacagugggagaaacggccuucucugccugccaucguguaaauguagucauggggguugguggcagggacauuaucuuccugagaccucacacuaucuuacaauaagcacccuauguuuaaacaagaggcucagguucccucaaaagguggucaucacagucacagaacuggaagagaauggaagaacucaggaaggcucagcagaucucucaccaacacagguguauuaaagagcaacccauggcuccaagggaaaugagaaagcacagauggugaugucuagcccggcaaccaaucuucaccuuugugguccuuuaguucucagcucaaguauaaacagacuuuucgcacuggaaugggaggaggauuaaguaggcaggacauuuucuggguucuacauagcaaauguucaugugcuuuccuucuguagcauuuauagacucauucugaaggaggggcaagccggagcaaagcaauuuggcaugcuugcauuugcuuuaucaggaccagcaagcacagacugcaggggcugcuccgaccugugcugcaaagaugcucccagauccuugagggagcugcugauucuuuuccuuacagggauacucaggcuuagcauccuccuugcaaaacaccaaaugagcucacucaaauuauccucagcaaaguggucaccaagaggacaagcaugaucauuaucauagaaaguuaauuucuuaccaacuuccuaaucacccugucuucuagaagccaguuaggcaguauguagucagucacacugaccuuagguugcguuccggcagcucagccugaggaccacuuugaaaagcagaugaauuuuucuauuuuucuacaggcaagcucccuaugccagaauacugugcagaccuagaugaugaugguuugggggagcauuuaacauguacaauauaaugcuuagcagaaaaagcaggauguaccucuuucuaaaagaaguauaucaacauagagaacuaacuggaaaaaguguccaacgaugacacaguugaucaucucuggaaaguaggauuaagaacaacuuuuauuuucucuucuuuuacugacauggcuuccaaauauuauaaaaugcaaaugcacuaguuacauaauaaaaguaauuauaagagauuuaaagaugcagaaugucauuuacaaaaaguuuuuccauuuacaaagcaaauaagcauuuccacuaagauaaaacgacugauggacaccauuggagaagaacucgggauaucucaggcagcuucaucaccuccaucacuauuuaagugcacacuguaugugguagccuucaguuggaauaaguaauuagguaaauagcucaguugguaacuaagucauuuacaucaugcccucuaccaggguuaucaacaauugaaaaccugaaaaccaacagggguguugauccaucugccuccccuguauuaaccuuccuuggaaagucucuuucaagcuugccaaguaggguuaaguauaauuaagcaggcagccagucaaguguacucugucuguguccugggucacaacugacucaaaacaaagggaaaugccucaccuaacccgaaacauucaaggaaggagauuagguacauacaaaaaggaaagaaaaauccacauaggagacacagaggacauacaucuauguagauauaacaguagcaacuucccccuugcucuccuucugcauaguaggcaaaguccuguccugauggauucccuguaucaucaugaaugcaccaagggugcccuaaguaaacacuauguguaggugugucauuguuuuggaaugagauuaguguuucagagggugaacucagcaaaucaggcuggcuuccccaaugcaccugagcaacauccaaacccuaaaagucccaaauagacuaaagggaagguuauugcugcuucuucuauccugcugucugagcugggacacauauacugacccucuuuugcccacggacuaggauuugccccucuagcuacagcccaagcuauugagcuggaauuuaauggagccgcuagcuuuccuggguuuacaguuuguagaugacacagcaugagauuucucagcuuuccuaaucaugugaaucaacucaucaucacaaauaagcaaacagguuaucuacugguucuguuuuucuugauaauccugaagaacaaaagcccuauuuuuauugagugcccuaccuccucaaagauauugaggcuuugaggcugcauuuucauguaggaaggaaggguagugcauuuaucucacaucaggaauaaaucauuauugcuuuaaaacagagaaagggucucugcugcucuaauagcuacccuuuugguuccuaggacagcuugaccagguucugcuaaagcaggagucuucuauucauccaaacacaugcacauguacacacacacacacacacacacacauaugcacacacacacauuugugugugugccaccuccaacuguggguagccuuucuccuuaucuuguaugcuacaaacuuuauuuucuacagaucucaacaaaaagaaaguugguaagguccucgguaaucugucccacaugcccuugguaaucucauuauacgugccaauaccugauccaggaaggaauauguggcacugcugagugauuaaagaaucuuugcuuuuaaagugagacugguugagaauagucucuuuggucaauguaugcugucauaucugcaugacgcucaccauaaaaaaaaaaaaaaaaaaaaagaaaaaaagaaaagaaaaaaaaacaacaaagaaaaaaaaaaaaaaacaagacagccaguucaagaaagaaucaacacaguaaaggaggaagaggagaaagggcaagacaggaacugugaugacaucacugaaccagggaacuaacaaaacuuauagggacacccuucaggaaguaagucuugucugcuuguagacuucauuuuuucuuaggcuaauggauuuuguuuugagaaauuucaaaugcaaguugguagaacaauucacaaaauacuugucagugcuuugcauucugauccucucucucccugcagcaccgucaaaggcacccugguggguccccacuugccuaacaggagggaaaagugaauuucaguugaguccuaccuuucagagccaggguucuggagcagcuucccaucaaucaugacaaccaggagacucagcagguagacaugggaggugggacgcuuuuucaucuuaauucccuuauuuuuuaaaaaccauuucaaguugacuuuuugauuauuugcagccaaaagcaucuucaaugauaaaucuaucuuugcauaauuagcaggaaauuuauguauccuccuugaagcaaagacuccagagaaaaugguacagagauccauaauucugccaacauccucccaaauccuuacaugauggaucuuaagugauuauuuucccaaaaagaaagacggcugagaagccaggaaaaaagaaaaaagaugaauuaugcaaccagcugacacucaucugaggacuauaaagugccccaggaugguaaagccucaccuuuucucaaugguaaaucaggacugcaucuuuuagaaacaccaaucagugcuguagguccuccugggcauaaucuccuuccuccuuuccagagcuuuaacacacucggccuuaggggaguggcuaaagaaaaguuaucacagcuccaaacuuugucucuguaacuccuuccauggguguuuuguucccacuucuaaggagggcauaaucagcauccaaacgcugacaccauugcauacacuagcaagauuuuaucgaaaggacccagauguaacugucucuugugagacuaugccggggccuagcaaacacagaaguggaugcucacagucagcuaauggauggaucacagggcccccaauggaggagcuagagaaaguacccaaggagcuaaagggaucugcaacccuauagguggaacaacauuaugaacuaaccaguaccccggagcucuugacucuagcugcauauguaucaaaagauggccuagucggccaucacuggaaagagaggcccauuggacacgcaaacuuuauaugccccaguacaggagaacgccagggccaaaaaagggggaguggguggguaggggaguggggguggguggguaugggggacuuuugguauagcauuggaaauguaaaugagcuaaauaccuaauaaaaaauggaaaaaaaaaaguuaaaaaaaaaaaagagaaaccuuuucacccaaaagugaaaaaaaaaaagaaaaguuaucacaggcaauucggaccaucaaauccugucaccaguaaggauuuuuuuucucucucucuaaggcuuaaauacauugaaaggaaugugucagaccccacaaaggacaaugaauaaacguaagcauagccugguuuugcuuugcuuaaaacuguucuuuuuccucugauguugucuagguagacaacugcaggagaguggggaauggguuuuccuggcuuugcagguaaacuggaagugucucuuaugugaguagagaccagcaccauccucccggcaggacgcuggauggagauggugaccaugaagaguuugaccuugaagugacacuaaagaacacaaccucuuuugacuagacacagcaaagcuuucuaccacugcaugggcaagaagccccaggguggaugcuguaagaucgagcccauugucccuggaugguuugugcuacagcaggccugcuguacuuuugcaccauuggcccauaaggaaguagaaagcucagauagaccaagucggcuuuuuuuuuaaaggaaaaauagaaccaaguaugugcccaugcauuauuaaaauuguauaacucuuccuuccagaaugaaauagucccuccuggaggagggaggaagagagggggguaugaucaugugagucacaaagcucagugaccuucaaaacucacggggccccuucccaagguuauaugagcaguaaacaauugcuucuaaagaggagcuuuuuggggacagccagugacccaguuucugaguaaucuccgugcagccguaggauuuucuauaucaccggugcuccccaaaauguucccuugauauucacugguucaccaagacgauguggcuggacuagguucuugguacucugucugggaaguauagaugguuguuaacaucuccccaggaaaaguuacaccacaaaagcuacacauuaaaauuuaaaacaguuuuucagaaugacacuuuuaaaucaggauucaaauucaauuuguauuuucaguugcuuuggcauguccugagcuucugaaggacacuggacucccaggacaagcucuuccgagucauucaguauauucacugcuacacaaucagcugcuguacaaaagaaaggcuagcugugaaagcagaggcucacuugcugaugaacaauuuuaaauauuuuuaaacugucacacaaaaggcgauugcaaacuucuuuuauuuuaauucacuuacaaaaugucaaacacacuuauaagaaacuacuugauuccccucaauguaguggggauuaaugaggccugaauguaaaggaagcacccaacaugcauggcccuucagacuguagagauucccaaacaacaaaagcauuucaagucacacaugggaugugaagcgaaaauguucuuagagggaauagucucuaauaauacuuaccuacuucagagagugcugcgaagcucuauuaacaccagcagaacacuuugagaucuucaaauaaaaucaugauagaaaugcaaaguauuauuacuauagcucugaaauaauuucacaccuagggaugagaaaaccccaggccaaguuuuaccacuucucuucuugccugauaaacaaguuccgagcauggagguggugacaggcagaacgaagacaucaggguuccucugucaccacaguuuuggauuuuccuccaagucauuuuagggaacuugaaggggaaauugaguccuuuaaagggaauguuuaaaaugaggacuaaauuuucacccuuuuuauaccagaccaaacaacaaacaguaaguguguuaacggauucaggacugcugcucaacugagggcaccaagcaacacagucauaccucacaucacggaugaugguaguaacugauaaugagcacaccaacauagcuaugcaaaaggaaugacaagauagagacaaaccuccucagauccugucugcaaucaguacuguggggcaaaccacauacccugugcuaggaauucaaugaugaccuugagcaugcaacacaagcacgcucuugauuuccauaucagaccuacugauuagcauaacaaccagagugagaguguucaucacaacuguccugauuaaggcuacuaucucuacagagaucugauaguaguugugucuggacaaacuacuugauuuaagccuuacuuccauuucaauaaaauggaaacaucugucugaugcgccuacugccaucuucuucacaugguauuaguagacacuggggaaaauaguauuugaaaccacauauuaauuauagaguacaucaaaauuuacauacuaaaagaaauaacuaggcuauaccuucuggcucaauguggaaacaauuacaucauuguaauaaugugauaauuaccuguagguuuaggcuauauuacaugauaugacuauauuagaagguugugggaaauagaagagguaggaauaggaaauguuagagucaggacaauugcccagagucacaaagcuuacaagcugcagaagcaaccuugaaggcauucuuucuuccuaacauuuuagcugaagcucuccccagcauacagugcaaccauguuacuuagacacauaggagagggaucaaauguaaugucucuaggacagccauuaaacaccuuguucuaggaccugcacagaacaggagucaauacagaaggcauaaaaggaaauuugcuuguuccauucucagcauauugaccauacacagcuaaaaaggcccauuucccugauauccggaccuguuuuugguuuaauuuggguugguuugguuuggguuuuguuauuguuguuguuuguuuuguuugcuucugaaagcauuauuucucuuuuuuaauacauuuauugauauucucuccucuccuuuccccucccacgcccccauuucccuauucucucucuguauguguaaggaaauuugcuuguuccauucucaggaaaacauaaaaaugccagaggcccaaggaacggucacaaacacauuuuauacauuaacaaaaaggaguucaguggaacaaaaaaaaaaaaaaaaaaaaaaauacugcaaagagaaauuaaaauucagagaaaagaaaaaaaaaaaaacaaagaauacaauuguuuuuguuuugagauguugggauaaaagaaagagaauugcagcaucuucucaggucugaaccacagggagccccugacaguagacagaugacuuuccugccucucuuuucaguaugcaagcauccugaguuguuuagggaagccacuggaagggaacuucuuuggacccaggacugaagucauggggaacucaccaaaaaaugugccuuuuagggaucuguuuuggugaucuacugucaaccauucagcucuuauacagaauggaagaagguaauggugucuucauuguaaagcuccaaccauaaccauuuacucuaaaucuagggcacugauguauaaguuauuaguuaggguucucaaaucauaaucaagguaaacaaacuggcuaacuuuagauugcugaagagcaacuggaggcuaaauaaggcauggagaccaucagcagccaagacagacaugguggccugcuaacagaaaucacuagucuuggucucauagauauggucaggacagaaugccuaccugcaacgagggagaaugcuuuagauaaaggucugaaauccagagaaccagcguguacuuuggcucccuugcagccaccuuaaaugcagggcugccagagucuacuauagcaugcacccaaaggcaauacaagcacugugaagagaaaagggauagacagcugagggaaaagagggaagggugcucgucuacacccaccaaggcucucuuuaaaacuuccuaacaaucuacuuagcagaauaucacuaauucucuaagaauauaacuuaacauuauagcaauuaguaacugaguaacugaccauacacagcaaaaaggcccauuucccugauguccggaccugguuuugguuugauuuggguugguuugguuuggguuggguuuuguuguuguuguugguugguugguugguuugcuucugaaagucuuauuucucuuuuuuauuacauuuauugauauucucuccucucccuuccccucccacacccccauuucccucuucucucucuguaugugugucuguaaauuugcacaggacacaggacacaaguggaagucagaaaucucauaguaguucguacucuccuucugccaugugaggccuggugauggaauguccgucaucaguguagauagcagcaucuuuaucugcugaacccuccucuuaccagacucaugccuaugucuauuaaaaguaaccuucucacuuaaugccugaggauagaucaagaauuccucucuuuuugguaauaguaauguguuccuuuugaaaacauuaucaggaaacaacuuagaaauaaaaaauaaaauaaaauaaaauaaaauaaaauaaaauaaaauaaaauaaaaaagguagcccagcauggugguacaugccuuuaaacucaauauucaguaagcagaggcagguagaucucugugaguucaaggccagcuuacuccaggacauccaggguuguuacacagagaaguccugucucaaacaaacaaacaaaagagaaggaacuugggaccuggcccuggcucugugcuuagcagugcuuggggcuuuuacugaagauccagcagcucccacuccccggaucaaaucaugcaaguaaagccgaccuguaacuccauuucagggggauaugacacuuuuggcuucgaaagguaccuguacucaaauaggcaaauccacacacaggcgcccccagacagacauacuuaaaaacaacuuaaaauguagucauuaaaauguaaaagaacagacaaugcuggggagguggcucaaccuuuaaggagcuugcuauacaagcaggggacccaagcucgauccuagcaucuacauaaaagaggcugccauaagcaaaccccucgcuagagaggcagaaacaggagggcaccugcuacuggcugacuaaccaauuggagugcuccagguuaagugagaaagucucaaaaaguaagucagaaaacagugguggaagacacucgaugucaaccuuuauccuccacacauacacacaaacacuuaugcaauuaugugacaugcacacccacacaugcauacacauauacaaauacacaaauaaaaauguguuuuucaaaauaucuaauauauucauaaggcggcuacugcuuaugaugauagugaggaggaagaggaggaagaggaggacgaggacaggaagaggaugaugaagauaaggggcauuaacagcagcagcagcaccaggugacagcugcuuaacauggagcaggacaugcuuuugcacaacauccauaugaggcagaauaugccuucucaucuccauuuuacagacagggaagagaauaaacacacaaagagaaugaaucauuuguucaugguccacuaacuaaagcaggacaaaacccaagucugacuccagacuacuaacucaacaaagacuucucacuaaaacaacaaacagugugaaaaugccccuuucucuaaaggaaugugagcaccaagccacacugucuaauugcaaagucccugagauggcuauaucaucuauaacaccaguaacuugugaacacauaggauuaaaugcuaucaagugcuuccagguucccagaaauggcucaaggcugcaaggcagugaccagucuaugagaaugagaaucaucugcgucuuuauaaggcauuuucuucacuauggccacguacuauaucaaaacuccaagacagccaggauccacgcgugcaccagaacuuggucaccugaaaguaaauccuccgaacaguuuuuauggguaaugcuuuaaugauucaaaagagauuuuucuccaguuucuuugcaagacuauacuuuacucucaaaaugaacauuaaaaacucgaguuugucauaaaguuagaaauaacuuaaaauagaaaguaaaucaaauuggcuuuucaacuuuuaccaaacuggucacagccauaauuacuauaauaaaaaugacagaaaaaaaaacccuaaaauugucaaaaacauaauugaugaugaaaacaaauguaaaauuauggcauauuuuaccuuggccuccaaagacucuugaugaaagcacagcccuauaauuccucagagugaauucucuaaauuaaaauacuucaugcagaacagaaauuaaacaaugaaucaaagaacacugcuguacagagguacacuuauaaauauaccuacaaaaugaaacaauuacauuuuuuccauguaaaaaaccaacucaaccguaauguuucacaggagacugagcugcuauuucucccuauugcuuggagcuuagaaguucccuuccuuucacuugcuuagggaggaugcagugugacuggggggaagccccaccaaacuggaaggcgguugccauaagacaaucccagucccuccacccaaccgcacaacucacugccgagauaaaucccauccagcccgauugaaaugccgcucgcucugcguuuuauuuuaaaugcuuuguuuggccagcugguuuuauuuaaauauugaccaggagugguagcagagcauucuuucuccacccagcauuaaucuuaguaaacuucgcucuauuggaacaucuuaacugcuggagagaaagcaaaagucagcaaacacgcaaucgcauuuggccacccucagcacaucacuguauuugugccugcucuccgcuaacuauugcucagcacuuuugcccaugagaggggaugagcaggugguuaaggaaguuguccugucagcuguaucuuuaauccaaguguuuaaaucucugaauaacggaaaaaaucaaugugguaaaggcaauguuugucaaggccauguaauaaauacacuuaccuuuccugacucuucucaguggauuucccuucuuugcugggcuucaaagcugcaaggagacaaaaaaacaaaagaccaagauauuugaaaguaaagcaccaugguuccuuuccaaguuguucaacagaauuuccaaugcugugguaagugaugcuagcuagacacacacugacgaaacuugugccucagagcugcccaaaaggccaaccagagacacagacagauaugguuuuaaugucuuccaaggcuuugugugucaaaauuuaguuucuaccaugaggcaugaagaggaugaaaauuuaaucugaaucugguucgagaggaggacacugagcaaucacuagggaugaauaagguuacuaggcugaaggcuucaggauuggauuuugaagcccaauggcuuuauagagagaaugaaagcgaucacauagccaugacaaaaggcagaguguaaguguguguguguguguguguguguguguguguguguguguuuuacaagaggaguaugaucuguuaaaacauuugugaaauacaugcaaucguguauguccacgcacaucugcacucccugucuccugguaugugauggucuguaaaacagccuugguguucugccaugaggaugccauugccagaugcugccucuagaucuuguacuuucagaaccacuauccaaauaaaccuuuuagauuuuuauaacugaucuaucugcuauauuguauuauuaccaauggaagagaggcuaacacaguuacaaaacaaaaacagcacacugcaucauacaaaccucaucaaaucuauauauagucaaaccuucuagaaugugaacaccucagcagugaauggauuauaaacuguggguuuggaaggcauauuaaacgucagcacagcacauguaaccugaacaagcauuuauguucuuaguccuguuaucaucuuuuucauacagcugauuuccacuugccacaagauauuucaguucaggaauauuauuccauucauacaggguacaugggcuuggaguucugcuuagcauugcuguccacaagaggggauggcagaugccuaggugugcacaaccucccuuucucuggcaagaacgcagccuucuuuuaggaaaaaaccacaggagagcagaagcuacaacuucacauugcaaaucaagucuuuacuuguuaacuuccugcucaccaagauacacuacccacgugucacagucuagucaauggaauccacaagaacacugcaaaaugacagcuguugagaacugauaguggcugaagguucuggaggcugauguggagcauccaccauuauucacagaguuguucuaugaaaguauuguacucugucucuucucauauucguagcuggguucucauucuccuaaaguuguaggaguugagaauuauuaacuacuacaguuauuuuucuccuuaaauuuucuaagugaugacuuuaggucuuccuauuucucucugcuuccuuaacuccaacaaagaauccuuuaccacucacagaugaccaccaaagaauaggucauagucauagguaaugguauaacccuagaauauuaacacagccuccuccauagaaaaguaucacaauuguuucauguucuuccuaguuccauaguacauaaucggguugggaaagcauaauuuagguuagaauaaaugcaauauauuuucuucugugaaaugugagagauuuauggucugaaauccuuucuauuucaaauauauagagaugcuaagcaaaauagagaauuguaagugaaaagagaaagacccauauuuaaaaaaaaaaugcauauaaauuuucuagaaugaaagcuaugaguccucuucaaaagcacaucaaaaucauaugauaaagaauaaaaacucaaaacuuagaugcacucaaaugacacugcagaacauccgaggcagaaaggcauuccugcgcucacucagaaacgggaaacaaagacagccacaaaaggacacguuacccauccauaagauaaacgcaaggcagugacccaggaauguggucacaguuuacuaaauuuaacaauccaauaaauuauacuuaugcuauuauucaaaaacaguagagaaauaaggacauuagucagauuuuuaaaaagauugucuguuuaaaggaguucacuuuggaaaaaauacauaagauguaguuuaauacagagaaauucauauaaggaaagaaugaccagagaaaguccauggagcuaccuaauaaugaauacugaucauaacucaaauuuaaagaaguaaucauaauccugguuauaaagaagaaggaaacaacaguggugucaccuuaggacuacuguugcugugaugaaaacugugaccaaaacaaaccugggggcaaagggguuuuccagcuuauacuucauuacugaaggaagucaggacaggaacucaaacagggcaggaaccaggaggcagaagcugaugcagagaccauggcggagugcugcuuccuggcuugcucaccaugucuugcuuacccugcuuuccuauagaagcuaggagcggcaacaccauuaugggcuggucacucccccaucaaccacuaauuaagaaagugcccuccagugggaucuuaugaggcccuuuacaauuaagggucccuccuuucagaugacuccagccugugucaaguugagauaaagcaaccaaugcuuaagguucucaaaucaaaugaagcugagaacaugagaagcaagauacguaguuaaggaguguuaacccgagggugagcauuguauaucugaugaaccuguuaaaguuagcuaacauuuccuacguaaccacaaacucucauaccuugcucacaacauucauacaaaaacugcuuaagaacaaacacccuggauaaaauggcaaaaugcaacauacaacccauaucaaagcagcacaauaaaacauuuauagucuuccaauaaaauaauguacaagucggaaaagccaauggaacugucaucaauauuaacaaggauggugugaaagcaaagcgccaaaggucuuucuuacuauuguuccauuugcacacauuucuaaaggacaaaaauaaauacuagguugcuugggaauauguuaguagaaagaaaaucuaaaacuaaaagcaaagaaaugucuuacacagaagucagguucucugacuuggguggugguagauauaacagggaaaacguggaggaauuagucugagaaaaggguaguuuaugaucauuuuauuauugucuuccauacauuuggacauuuucaugaaacugugcaucucaaaaagcauuuguauguauucccugccucccuuuggcuuguuuggcuuucuccugaaaaggggaccucacuggucccagagcuggccccaaccccccaguacuucuuucucagccuccuaagugcuaggaguaaaacaugccuaccauauccagguuuccauuuuacauuuuaaaaacauaagauacugaugaucaacugaauagaaauuuccaaaccaguggacaaaacaauauaaagaagcuuaaugaauccucuggagaagaugggaagagaaggcaaaagaagcgagagcagccuggugaacagagaacacgagagacgucacuucccaacaguuagccacgccaguagcuguccuaacuggagcagaaacaccuagucaaauaguuuuuccagauaauagucuuuaaaucuuguaauuugauuuuuauaagaaauacauucagaagguuugaaaauuaagcgugggggaaacuaagugaacaggaaccacaacagagccaacaaaaaugacuuagucaaacuugaaguuaguauuaauuggagaaguauauauuauuugucuauugcuacauaacaaagcacucaaaaaugcuuaacuugcaaaaaaaauaauuauuuauuauaucccuaguuuccacaguucaggaauucugagaguacaggggaauugcuuugcagaaugcuccaaugccuugucucacuugaagacuugaaagcuagagcccagaaucauauguggcccuuuagccacauaauugucaacagucucuaagauuagcuaagacuuuugcuauaacacauguggccucucccuguggcuugaagcuucucaaaauauaaagauuccaaagccauguguccccgacagagccaggcaaaaguuauacuucuuaggaagaaggaucaaauuucacacaauucuauuggcacuauacaccccucucucaacaaagacaugcacaccucuuaggggauugaugguccaucacacugcacaaucacauggacugaguaccugggcuggggcaagcuuggggaaaugaaugauccucagcauccaguagcaaccaagcagugugcacucuuuucucgaagucuuacaauggggaaagauguguaaaaugggacuguaaaacuauguuggaaggagcuggaaaacgaacuuagcagguaaaggcacuagcugccgaacaaaacaaccugaguuugaucugugaaccuccacaauggaaagaccuccacaaccaauaccuguaggucauccucugacuucuacaagcaugacauaauacauaugacccuacagacauacccacacauuacacaugcauacacaaauaaauaaacaaaagcuuuuuugugaaauaggauuuaaaauuugucuucauggcagcuucucuuuagggacuaguggcgggaaggagcuuuggccaucccugcagugucuugucaugacaauguguuguguucagugugcuuauauucucugaccuuaaucagacauucuguuauuuaaaaccuagaccuauuauuguacaaaccugccugccuugugcuuuguaagccccagauuuuaugccaacauccaaaaucauucgauaaaauauuugcugaauacacaaacacagagcacccuaaguauagccuuuauaacauuuuuaguuccugaaaaugugcguguguguguguguguguguguguguguguguguguguguguguguguguaccaaacaggagcaagucagaauccaaaaguucuuguucccauaauccaaauaccaaccucuaggcaaaagucaggaaucaccucucaaaauacgccucguccuucuuuugacucccaaaugcaaagaccuacaccugugccaucagguaaacauucuccccuccaacuguaaggugcucuauccaccacucaccacuagucuaaccucaccacacucuguuccagagcagacagugucuauacccuucagaugaccuucugcaagacauaaauuagauuuaaaugaauccaaauagguuugggcuucagcugcuccucaaagaaauaagcauggaaccaaaguagaacaagccaauaacagacugauuuaucucgguguuuucucccagcuuuuaaaaaaaaaaaaaauccaaaccccucaguccguggcccagcccacagaucccuuacugaucggaauguaaaggacuagccuuccccaguacacagacaggcuuacuugaaagcuauuucuaagacccauccagcugcacccuacauaaggcaagguucccuggaacugagacuuuugcucugcugucaaauucugcagccuucacccgacuuaacugccauguugagggauugguuauugaccuuuaagucuguaacaauuaucuacauagcuaggaaagaggcugugcauucagguacaacagugaagacacugaauaaauucagugcucauuuucauuuuuaugcugcauucagugagcuguuacugcagacaaauuacugcaacagucuuucaaaugauagccaauuuucaacuaagagaagauucuuaaaccacuuucuaaaaccuuuugcuacauaucgguaaaaaccaggcaguuggaaaacaggucugguuaaaccaccugaugauaaaugaauauuuuuaaaugcauggaguuauuugacaaucugcauagugacuuaacacucacaagaaauaacagcaaagcccccaaaccuaacauuuucuccuauguagucuuagaaauugugucugaauuuauaucucuauauucuauacacaaaccuuggacguacuuuaggguucagaauagccuuuaccuucaugauuuaccuuacguuguaaaaaacaaacagaagcccuuccucaaauccauaacuuuaagagugacuugcucuguggugcagcuagaagaguguguagaagagugucuagccaggaacaggcacacugcaaagcuugcuuaauguccgaguauguuuucacuauugcuagcauacaaugauuuggaauucuaaagcugugguugcuuuagggauuuguccuuugauuucaaccacuccuuacuuucuccuauuuuuuuuuuuuuugagaauuucauaaaacagaaaucucccugcucaagcccauccuccauggccugaggcauauaucagugcaccuccaccaccaccaccaccacccccacacacacauacacacacacauagcacacuuucgucauaccuguucaauacugucauauuugcuagacauugcaaaaguaaauuugccaagcagcaugagauguggaagucauuaggugacaucugaggaguagaaugccaggcggucaauaauuaccuccucaagauucacagaauuccaggcaaaucaaauuccaugaaaucucugggagugugaccugaucugggcugggucccugaaaauggggggucaaugagucugugaccaccagacaggacuaggacauacuggacucaucuccaggggacacccuguggcaauaugacauuugcacaggggugcccuaacaugcucccgguauguuuucuuggaacgggaugacauuucaagucaaauagcucuguucacaguagcaacagcccucccccaaauucugcuagucugaauucgagaaaaagagguucaucuuuaggaaaaacugagaguauguaugcagauacgugcuuaaaagaaucuguuuuuaaagguguccaaauagacagucaguguuuaccucaagucuuauuguaaauacuugcucucaauugaacaaauucuuccucucagaucccaauacuggacacuuuuuaaugcauauggaaauuauuuagaaaacuguguaacugagaggcagagagagugacugucagugcuauggucucagcaagccccugcugcccagaaccgcaguucguguugcaccuccaccagagagcuuguauguaacccauugaaccagcacccacccagagcuucugaugccuguucugccagauccugcuccacuucaggacuaggaaacagucugugcaacaccuguuuccuggccaagggcucaaauggcccagcuacgucaucaagaaaaggagucugguugugcccuccucugaacucuccaucuggaagauucucuggccuccuucccucucauuuuuaaucugacagacacuguuggacagggacccucaaagcagaccaaaguucauuuuuccuccucugcuucuugcccugcauaucagaagggcagagggaggcuggcauggaacaggaugccaggaacuaaaugagggucccugacuacuggaccacaucaguccugccuuccaaagucuuaauuagcccuucuccuccuggcacacccauuugcuucuggaacccauggagguggcaggguaagaugccacacucacagcaagcauucaacaaaauauugauugcggauggcagucagagccuguuggcucauggcuuggcaauaacaucaguuuggaagucugggcaccgguagcaagauuucugcuccccgguucugaugcaggcaauucuaccagcauuauucugggugauaaucagccuccagcucaauuuggaagcaaaaugaucuuaacaaacagaggcagacuugacagacaggcugcugagccuggggaccaaaacacgggaugaaaaagcagaagagaggaaugauauacagcaacggaagagagggaaaugccauacaggagcacagggcuaguugcacaggguugcccccauucuaccuaugacucugaaguaagcuucaaacauaacaacagauggggcagggccgaugagaggggacgaaaggaaaggggacagagaaggaccccuuuggcauucugacacgaagacauacaguagaagcagugagcagucucaacaguaacacggaagagguuuccaaagaccaugagucuuaauucuguccugcuuggcaccucuugaacuucggugacacacugaaauuugccauuuuucuaagaggacauugauaaauacaauggaaagucugaauacauuuccccucugcauucauuaucucuggcccauauccacaggccuauugcagacuaaauuggauuuuggaucacugguacuaaggcacugcaauuaauuaacaauagaaacauaauauuuauauccaggccuaacaacaucugacauuuaaacuauucugccagucgggcaaauuccauucgacaaauuuucauuuuaaugaacaugacagaccacagcuuacaugauaggccaagaugcagaagcaagcugauuucuuggcaugugcuuccaaggacuggccaugccgcaggagaaagaagcugggcaaccgucagaauaacagaaagaccugcuccacagcuccauuuagacagaucaaggacaugccacuccucugacucuucuaaaaaagacccugggacgagauuguccuuauuuccuacacgagcucaagguuaacggcugcaucuuaucauccacuggguaauaguucuaccuuugggcuucugauauuuucuuuggggcacugaaaucccuuaguccuuuguaauuaaaaagugauaaacguuuuccaaggcaucugauaauauucgaaaugcacaagaguuggaucugacacagcuuuuucaauuggcacaaaacuggccuuccauauuuugccagauggugugucucaguaaguccucaauuuccgacucagugagggcacugucacuaugauguugaugcagagacgguauuaaaugcuaucuuauuuugcauuauacuaacaccauagaccuauuuauucuugcuaaacuuugauagcuuaaggaaguuuuccuucugugacucauuagucuagguaacagaaagauggcacagaugaagaaaaauuauuccacaauauaagagccaugcaaguguccugaccccacagugaccucuccaagacagaugaagggcauaucaaugucaaggacaaugucagcaaacagaucucccaacacagaguacuauuguuccuuucaccgcuacaggacuaaagguaacugggugaaaaugguguagauuuaccuacagccaucuccacuacucauaaaacauguauguaaauuuuaaucacacauuacaacauggauagaaguuucacagacauggaagguaacaaugagugguccacaacaucccuuuuuaauggacguguaauauauuucuagcuccuauaucuaaaacacccauuaucucaguuuuaaaugucacuguaaaugaagcaacacuccuuggagguauggaucuugcucaugagcuaugaucagcaucugaaacccacuuucaugccagugacucauccucaagcuauauauguggucagaugcaaaauaguaacuaugugccaugucacuuuuaguuauggucaagauaccagacuaucaauuccuggaaagauaaaagcauuucuuuuacacaaccuacuuuggaaccaauaaaguauuguucaaaucaacaaaauuuugcauagggacaaguacaaaugcuuauuuuaaugacaauaucugaugugcauacuguaaguacuauuaugaagucuauugcacaacaaggaacuacagaaagguaguuacaguuaacaguuaaugggccuuccuaaauguagguccaaggucuggugugaauggaaguuuagggaaaaauccaagucagucucucuccucagucugugagcuccaaacccgguggcauaugacaacauccacuagcgaaacggcauggaggaaucgauuccuuuuuggcaauagucaaauaucuuuuaaauaucagguaugaaacauuuucagaccaccagaugcuuauauaauuuugaaaaaaucaauuuuauggagcugcuacaaguaguuuuauguuuguuaaugucuuguuauauucuugaaaaaaauagaggacuuacaaaccuaaaaaugucuuuuugaaagcugggaagcaaaacaggacccagacaggaaugacugggaaauguuuggcggaacacaaaugaauagucuaaaacuuuauugugccauugugggugacaugcucuaagauggccauaucaaauucugaacacaaaagacuuaacgugcuucuuguuguaaacaagggcauuugguuaaaugagaguuccaucaaagauuaaugacugaauucaagugagcacaaaguaaaggguuauauacguucugugguuucagaaauagcuaaucuaauaauggcaaauggaggguuauuguugauuccuuugccucugguucauaaauuagauaaagcaaccuggcaguuacaguacuuuagaauuuuauucgacuaagugauuuuaaagcuaucucgaacuauaacaaagucauggcuugaauaacugcugaauuguaccacuuccugucaucacguuaaaacuuuugccaguguaaaguaaaacccuuccuguuaacuaaaaggacuccaggaagcacaguuuccaucuacaggaccaaaccauuuagacagcaagugucuuugauacaguagugugugauacucuaagucaccagggccaagcuuguaaaauauaaacuguaagagaaguccaguguuaauuauuuccucugaaucaaaacccagaaacaagauggaauuucucugcuuaaugauuuuuuauagcacauuuccaauuucucuccaaauuuuauugaucuggaauacaaaagcaguuucuuucccaacugaagaggguacagagcccaugcccaaggcuccuuagaauaugucuccugaggacaauaagaguggcagcugggguguggugaugccagccaaggcacauugaaaggaugugcuaucucagucucaaaccuuuugauagcagcaagcauccugagccugugagcuuggagaggaggcucaccuccugauuuguugccuuucuuaaaggucucucuucccauguuuuccccugggucugugauaugguuacuuucaauuaucaugauagcccaacaagaacaccaucccucucuccauauuucauucacauaauaagaaucugcaaaguguuuuauaugacagaugaggacugugcacugaagcaacuuguuccgccugucagccuucaagaaagcacagcaaugagauacaaucgagaugacauuacuagagaagaagugggucaaagcauggucacuugaaaacagaaugucagcuagucuuucuacuucaguaauucgauauggugauacucaaaacacacucagagagaaagaagagaagagaagagaagagaagagaagagaagagaagagaagagaagagaagagaagagaagagaagagaagcgaagcgaagcgaagcgaagcgaagcgaagcgaagcgaagagaagagaagcgaagcgaagcgaagcgaagcgaagcgaagagaagagaagagaagagaagcgaagcgaagagaagagaagagaagagaagcgaagcgaagcgaagcgaagcgaagcgaagcgaagcgaagcgaagagaagagaagagaagagaagagaagagaagagaagagaagagaagagaagagagcuuauaccaagagauaaaaacacggcucccacaugucccugagcagccuuucuggccucuuuaaguaucuggugugagccagacacugaaccaauaagagaauguugaagacagacacagccucugcauuagcuuaguucacaguccaaggaaaaagccaaauauuaacaugaagcugagauuaauguaaaauaacucaggauguaaagacuugaauaaaaggcgaaaaaccaaguaagucacaugggucagaaaagguuuccccauggaagggacauuuaagccaagagcugauguguacagaggcagccagguaagcaaugaagggaaagagcgucaggaagcuugguccuuaggaugcugccuuucagagaaaccacugggauaaaaggcagagagaugaggaaaugaaaaugugcagucaaucacugggcguaauuaucauuuccuaccauuacacccuagauuaaaaaauuaauuaaacaauuuaaaugucaguauaacuguccugucuuaccacauaaaagcaaaaguuaaucauaaacauaauuccucauugaucuauauauuagguagauuuuucuuuuuaaaaaucuaauuuaucuugacuauacugauuaaaacccacagguuauuuuuaaaaacauguuuugacagcagcaaaacuugaagcacauauaguaccaagaguggaaaaugugcucagagaacaaguccaugaaaauuaacacaagcaguugguaaauauaauucacuaaaaaagagacacugggcuagauauucaaauuuuauguaauauauauuuauaucaaaacaucacauggcacccuaugaaauacaaagucuuaaguguuaauuaaaaauuugaagcuaaauaaguaaaagaacaaacuaacuguaaccaucuacaugccccaauggguggaaaugaagaagaaauggguucuuuggucuaagguuugggccuaaaaauucugacuuccucuugcagaaaauuguuuuggauuauaauccaugucuuucacagcacacaauuuuuucccaugggaucaacaaauuggaauggagaggggaaccaaauauauucaugagugugccugcccuuucugcuaaaccccagagugugccauuugaauuguuuucuuuccaaacucaaaauccauccucagaauccaaaaucaauuuuaaaacuuguauuagcauaaccagggguugagucuggcucuaaaaguccaaugucugaguugggcugcuaacaugggagaguuuuguguuaaguguagcuauaagcuaccagcaaucccuucagcagcugcuuuaacacaaucuauagcgacugcauugaaagauaaugugucaaccauuauaccacuuuccaccuuugaaggauagcaaaauaucccacccuaacuaugcugcuuuaacacaaggaaaggaacuuaaaaaccagcaggagcaacaagcauguuugggcuucccuucuucuggaagauaggaacugacauguuuauaccaaagacauuuuuccauacaagaaaguaacaccaugggccagauguugaaauuugugugauuauggacaaauagaauuacacuaauccuagucacuuuucuacccaguaaauuuccugagcccaagugucuuugcccugucacauuaucacaauuuacugcucuuaucccaaguacaccucuguguuugaguuuccuuauaaagaccccuaguucauagaaauauuaaauaaaauuguaugcuuucuccuauucuuuuuugcaucaauuugucccccagcuaggaaaguucuauuccagcauuagcauucucuguuucuaaggaauuuaagaagugugacaauuggucaucacagaaguguucaugauaaaaauacccaccagcaaaaguagauacaaccaaacauacaaagucuagaaagcuucaugucacuuuccugacuauggaugcuaaacuacaguuuugcaaaguguuauaauuagaagaaaauguguaaagugugcccagaaaucuaucuauccaagucuuacaaauucauggaaauuugucaucugaagggaaauuuuacuuaaaaaaaaaaaaaccugaaagucucuagcuuuguuuccuaaucuggucagauuugaauaaguaccagaaauugccuuuucuauguaguauguuaacagacauuacuaguuuagcaaauacuuccuaagcauuuaugugccaggucccauaguaggcaguauaauccaauguccaaccuaguccuuaccuuuauggacagcagacucuagaccagugguucucaaccuaugggucauaacccccuuuggggucccauaucagauauccugcauaucaaauuuuuacauuaugaguauaacaguagcaaaaucaaagguuuaauauagugaugagauaauuucauguuugggggucaccacaacauaaggaacugaauuagagaguugcagccucaggaagguugagaagcacugcucuagaaagagaaaugggaacaaaugacaucugcacuguguaaaaggagcagagggagaaacuaccagggggcucacugaguauaaucuggaagggcucacaaagaaaguagugcuugggcauuuuacaugggauggauucuagucauguagauuuaccuccaagggacuacugcgcagagacauggcaagcuagauaccuuuaccuccucgcccaucaucugguauaauucugaauaauggaagaauauauuuugggauaggguugugguguccccuuugggugaggcuccacucuucugccccuuuaaaagaaccaggaagaaaauccauuguuuacauuugccuuuagugaugcaagaugaugcagaugucaaaacacacaguucacuaaaccgggagaugaacuuccucaaaaggcacaaggcacaaaaacuaauauucugaauaacuuccaugauuccuaggaugagaacaaagggauuaguucaugacccaauccagaacaugaaacugucugauaauggaagagacuaacaccaagccaaggggucuccaaugagcauaaaaccaccagaaauucuucucuucuugggagauacagaauauuuuagacauuuccaacuacacacuggaggcaaaguucaaguguacgggagccaaggcagucagauaagaaauuaagauacagcugccuacuccuguuagugggauagcugcagggcuagaguauuaugguucacuugggcccagucugguuggaaagacacagauuucaaauaaggcuagacaggagaacagauaaauaaaacuaugaaaaauucacauaauggaacauuauacaaauaauguauaaacuaaucaaagcaaauaaacuaaugcacaaaacaauguauauugcacauuacucuuuguaaaaggaagagaaauaaugucuauacuuuuuuccacugucuauuaaaaaaaaaaacugagaugaaauaaaagaaaggaagccauuuuagggucucccuaagagaugagaacauagacuagguuguaggaagaggaacagaaaagaaauuucacuuccaaauguuuaagucaauaaguagguacauacacacacacacacacacacacaccacaauguuauucuccuuaauuccauuaagaauuaaagaacccaaagaaagcuauaacaacaugcagauggugggggugcaaagcagcucagggaaucgccaccugccagguucuaggcauggaccugggugcugaucacacaaaggccaguaacaaggcaacaugaguaaucuuagcuuucugugcacauggacauuuaugacuagaccagaaaaacagacaucggaacaugagcaaggauucccuacaagugucaagacugcaggugagaucacuucuacagcgaacacauugacugcggugagauauuguuagagcucaucaaaagacccucacucacaaaaaccacagagaucaugaucgcugcaaacugcaagaggauuuuuauugauccaacauguuggggacccccucucagcaagcaggccagaggagagacccagaacaaauaaagaacacacuuuuuauaacuuguaaggggcagauuuaggcaacaggguagauggcuuauucuaauugguguagcaaguaaccuuuucaggcacugguugguuuguauagggugacuaaguaacccuuuggccuagucccucacucuaucugcccuuguguuuguuuuuguuuuuuguuuguuuguuuguuuguuugcagagcaacaguauguuuuaaacuuaugggucagcuauuaacgucacaucuauuaaugucacagcuauugacaaggucauggcaguuucacacagaauucaguguggggcgggguaggagguuuuuuuuuuuuguuuuuuuuuuuuuuuuuuuuuuuuugagaacuacuaucuuguuaugguuauuuuucugagaacagcucauuuuguuuuggcagcugcagacuuagucauuuugacagcuauguuucugaaagucccuuaggaggggaaggggcuagguggucuugaacuuauuuuggauucuacaagauaaagccacugcugccuuuguuccacaucaggcuaacaacucccaggauggauagaacgugacacaccucacucuccucugucaccucucccuggcuccuggaauacaacugcuauccuaagaccaccagaaaaggacaggagcacccacaucucugacaggcugagcagacacucauuuuuuauuuuuuccuuauguacgagccauucccccuauuuguuucacacaaccuaaauuagguuuucuguaacuugcagcugaaggcauucugucauaccuaaugauauuuauuauggugcaauuugauuagcaauauccacuaaugcaucauuaauaaauaaacugagguaacagauuaacauauugaauaauauaugguugcuuuaggcugaaaagccaauccagaguguuuguuuuauucuaagagugaagccuaaagaacgauguggcuaagugucccaccagcuucaggcuuuauaguucucuuccgaaguuccugcaaagcauggccaaggagaagcagcuaaaugaaucccaagucuauagaugaggccugccugcaauguggaaaaaaaugaggcacauaauccugacugaagcuuaugauauagcgcagaaucucuaaucauggguaugaugauauuuacaugcaaagagccuucauuaguauguaccagaaagagagagggagagagagagagagagagagagagagagagagagagagagagagagagagagagagaggugaucagagaccagucugcacaggaaagcacuugagcugcagaaacaacauagauucuccgacagggucccugcgagccuucaucuucagccaggaagcagagcugagacccagaucuaugugcauagucccuacaagaggaaagcuugucuguagagagugcuuugaacacugagacucaggagagaucccaagugcugacagggccuaacagaaucacaagaggaacaagcuccagccagagacagcuauaaaaacuaacaccagagauuaccagauggcuaaaggcaacguaagaaucuuacuaacagaaaccaagaccacucagcaucaucagaacccagcacucccaccacagcaaguccuggauaaccaaacacaaccaaaaagcaagauucagauuuaaaucauaucucaugaugcugguagaggauuuuaagaaugacauuaauaacucacuuaaagaaauacaggagaacacugcaaaacagguagaaguccuuaaagaggaagcacaaaaauaccuuaaagaauuacagguaaacacugcuaaacagguagaaguccuuaaagaagaaacacaaaaaucgcuuaaagaauuacaggaaaacacaaucaggugauggaauugaacaaaaccauccaagaucuaaaaaugaaacuagaaacaauaaagaaaacccaaagucagacaacucugaagauagaaacccuaggaaagaaauuaggauccauagaugugagcaucagaaacagaauacaagagauggaagagacaaucucagguacagcagauuccauagagaacauggacacaacaaucaaagaaaacgcaaaaugcaaaaagauccuaacucaaaacauccaggaaguccaggacacaauaagaagaccaaaccuaaggauaauagguauagaugagaaugaagauuuucaacuuaaaaggccaguaaauaucauuaacaaaauuauagaagaaaacuucccuaaccuaaagaaagagaugcccaugaacauacaagaagccuacagaacuccaaauagacuggaccagaaaauaaauucauucuaucacauaauaaucagaacaucaaaugcacuaaauaaagacagaauguuaaaaucaguaagggaaaaaggucaaguaacauauaaaggcagaccuauuagaauuacaccagacuucucaccagagacuaugaaagccagaagauccuggacagauguuauacagacacuaagagaacacaaaugccagcccaggcuacuauacccagccaaacucucaauaaccauagauggagaaaccaaaauauuccaugauaaaaccaaauucacacauuaucuuuccaugaauccagcccuucaaaguauaauaaagggaaagcaccaacacaaggauggaaauuaugcccuagaaaaagcaagaaaguaauccuucaagaaaccgaaaagaagacagccagaagaacugaaucccaacucuaacaacaaaaauaacaagaagcaacaauuauuuuuccuuaauaucucuuaauaucaauggacucaauuccucaauaaacuaacaauagacuaacagacuggcuauagaaacaagauccaacuuuuugcugcuuaugggaaacccaccucagggaaaaagacagacacuaccucagaauaauaggcuggaaaacaauuuuccaagcaaauggccugaagaaauaagcuggaguagccauucuaauauugaguaaaaucgauuuccaacccaaaguaaucaaaauaauaauaauaauaauaauaauaauaauaauaauaauaauaauaaggagggguacuucauacucaucaaagguaaaaucuuccaagaugaacucucaauucugaauaucuauacuacaaaugcaagggcaccacauucauuaaagaaacuuuaguaaagcucaaagcacacauugcaccuuacacaauaauagugggagacuucaacaccccacucucaccaauggaaagauccuagaaacagaaacuaaacagagacacagugaaacuaacagaaguuaugaaaaaaauggauuuaacagauauuuacagaacauuauuucagccugucccaauaauauucaaaagacuuaagacuuauucucuauguaacauaucucugcaaaauaaauguuaacuuuauauaacuuuuucaauaaucucuguaguuuugcccuauuaacaguuaaauuuggcaauaaaugaucuacuaagaaaacuuaaaaaaaaaagauggaggaacccuaaaguuuaacuauuggaaaagguuaagguauaauaauguauucuaacagaugaguauauuggcaacaauaaggacauaucaaaauacacccaguacauugauucaugaaagggaccugucuccauuugaagcauaaaggacaaacaagcauagauggguggucuccauccaaaugugcuuacugaagacaucagugagacguggcaauggccauuuuauuuagagaauauuccugcacuuaaaauaaauaaauaaauaaauaaauaaagccaggcagugguggcgcacaccuuuaaucccaacgcgugggaggcagaggcaggcagauuucugaguuugaggccagccuggucuacagagugaguuccaggacagccaggacugcacagagaaacccugacucgaaaaaaacaaacaaacaaaaaaaaaaaaccuaaaauaaauuuacuucuuaugcauuaaguaagauaagcuaguuagcaaguugaauagcaucgucuuauagaauguugaccucauagauuccaacuaauguaauaucugccucaagggaguuagcaagaaacaauuuauuuuuguguuuuaaaaauagacugaugccaacagcugcaagcuauguuaugaagaacgauacagaaauuugauauuuucaagugaguuugcauuauacaaaugcagaauguuuucuuuaaucccauaaauacaguuuugauguugccaauuuuagaaaaaauauugacauuuccuuaaauuagucuuuucuccauugaaagucacccccuuacuugaaacugaaugaucuugaaaacaauaaaauugaguguuaauuugcugugucacugaggaaaagaggguuccucuccaucagaccccaucagacagggaaaaagcagcuaccaaacaagucagccuuuugauggcauauuccaggagagauccugccccuaauggaagaccugggccauaugcagacccaacacuugccagcuguguaugccugaacauucauuaccccucugggcuuucacugucucucugguaaagcagagguaaccagcaccucugacucagagcugcuaucaggaagagcugagaacaugcacgacaggaccacaccaaucugaucuaaggaaggcauccuaauuuguuuucuacaccaauguggagacacagguguaaaccuaugucugaggaccuggaauauuagauuuuaagaagaccucaacauuuugccuaagaauuaauguuggaucuugauuccccaguaccaugugucucuuuugucuaguucuuucauuaauaauaaaaauuaaccccccaaaagauuacugcuguauaucaggaaauaugauuuuauauauuuccuuauuuaauacucacacucaccaaugagguauaaugucuuacuaucgucauuuucagaugaagaaauugagguauaaagagacagaaaagugcuaucaaaauacaaacauaguaugcuucagcagucugcauaacuuggcauaaucuauauucauauuuucucauacaauaacgacagcaauugaaaugccaccacaucaucaaucauuaucaacauuaucaauaaauccuauguuaugccaaacacaguacuugaugcuuuugaaaacagcuuuccuggguuuacaaugccugcccuuauacucuuuucauguaaugaauaagacagccaaggaccuacaugacuuaucuaaaaaacacagaucuauccagcauacagucaucuaucuacaguuacccuucugcagauauuaagaaaaggguucguucaagcccacgccacuggaugcugcagagugcuaggauuucaggaugaccugcuccaagcucuggcaucacugaagaggaaagugagucucgacauacaugucaguuggagccagagcuggaccccgaggucucccuacugccagcacucugcuucuugguaacagaacaaugcaaugcucuccuaaagugaguuuccuuacuuagacacuaggaaagcaaaacaggccuggccacagucaagugagggcugcaggguguauguguucucuaccccugagacugugguaugucauaugcuuccaggcaccuuuagagcuggccagggaggagagaaccugcgacuaagacaagccggccaugacuuuucaugcccuaucugaagcccacuaccagugacauucauuugcaacgcaauccaagaucaaggaagaagugugugcucagacacauggaucucuuucagacuuaagacacagcacaccuagcuccugcaaacauuauucgaaucaacaaaacacccgaauuuuuagauuaaaugcauaucuuucuuacuuaaguacuagauaaaaauagcuugccucauauagaauuaaaaaaaaaaauagagguuugaggcuacugaauuaaaaaugcacccagaauuauguaaucugugaaagauaacuguuguuuacucugcuuugguuuuuaagcuuucucuuugaugaugaauauuaauauuuaucacuuuucugguguuggacuaaugagaaucuuaaguguuuaugagaagguauuuaaauauuacaguacugcagauguguuuguuuucugauuuauauuccugucuucagcaucagccagcauuuauuuuuuaugcugaauccuagguggugugguguucauugacauuuuuaguaaacucuaccugcccagaacugauggucuuuuuauuuguuggaugauaaaguaaauauaaaauuuuaccaaauaacauaugaacacgguugaccugugauuuucaauguuaaaccugacagacauguaacuguuagcugcgacuguaggcagauaggucuacuaccccacauucugucuuagguagaauuuugugagugaugcaccaggcacuuccuaugauauuacuuacagccacucuacuugcuacucacgacaacaccucuaagcuuagcgguguuaucaucucugcuuacaaauaccauguggcagcgagggguugcauccuuugcucaaaauggcacauuacaugagaaacaaagucacaagucagucuacaaagcaggauaacagagaaguuucuugugagucccucauugaugguucagcauuguaaauuccugcuaucuguucaacauaaacaauccauguaccaagauaaacaaacaucaggacaauccugacuuucagaucuuggcgguaauaguguggcuuaaauggaaugguaaguaacagauugaugaacaggacugcaaugcccccuucccucguggagcuagagaagaaagacagacaauauugcuaucacaccauuuaugagcccuaaccuuagagggaaaguggcuaugcaaguucagaagaugucacggaugacuccuuaccucuacucuacagcagguaaaaaucgauagaccagagaaauaauucauugcagcaugaacaguacagacauaaacuggggcaguguaaagccuaacaaugaacuaaugaaguuuagggaccaacaaugaggaaauggccacaguugaauaggcacuacacuucuguccuuuuguaggaaauacacuguggagcaaauauagguucucaucaagacauuguagggaaaaauaaagguuggaguuuugguugguugcuuuuugguuuucuuauuguugauuuuaagucuagaagucaaggaaacaaaauacacaggacccaguuucaaggaaacuacagucaauaccaugauacugacuccauccaugacacauguugagucacuucuccaccuuagaagcaguuuuccaauuuucaaauaaggaagugcuagugaaugaaacuggugguauccauaagcucuuuuucaaugagucuuggagcccugaucaaaacauaguacaucacuucuuacuucagucaacaguucuuuuuauuauuggguaauuuauuuauuuacauuucaaauguuauccccuuucccaguuuccccuccaaaagcccccuccuugauacccccucccccugcuucuaugaggguguucccccacccacccacccacucccaccucacugcccuggaauuccccuacuguggcaucaagccuucacaggaccaagggucucuccucccauugauaccugacuagucaauccucugcuacauaugcagauggagccauggguccuuccaucuguacuuuuugguuggugguuuaaucccugggagcucugggggaucugguuggcugauauuguuguuuuuccuauggaguugcaaacccuuuaaguuccuucaguccuuucccuagcucccccauuggggucccccugcucaguccaaugguuggcugcaagcauccaccucuguaugugccaggcucuggcagagccucuuaggagacagucauaucaggcuccugucagcaagcacuucuugacaucugcaauagugucuggguuuggugacaccagauauaugggauguaucaccagguggggcagacucuggauagccuuuccuucagucucugcucagcacuuugucccuguaccuccuccugugaguauuuuguuccucuuucuaagaaggaccgaagcauccaaacuugggucuuuugucuuuuugagcuucauauggucugugaguuguaucauggguguuccgaguuuuugggcuaguauccaguuaucaaugaguacauaccaugugugguuuuguaugacuagguuaccucauucaggaugauauuuucuaguuccauccacuugccugugaauuucaugaagucguuguuuuuaauagcugaguaguaguccauuguauaaauguaccauauuuuucuguauccauuccucuguugagguacaucuggguuguuuucagcuucuggcuauuauaaauaaggcugcuaugaacaugguggagcauguauccuuauuacaaguuggagcaucuuuuugguauagcuggguccucagguaguacuaugucaaauuuucuguggaaccaccagaaugauuuccagagcacaggcagguuaaagaaaugagaauucccuggcaacacacauagaacucaguguucaaugagugcauucauaggaaacaguagccuaaggagauaggagguaucagcuagaaagaaaacucauguuccagcaacaaggaagaaguccaggguaagaugcuaggugauaugucugaugaagaucucagacaucgagaagcaagcuucagcucuagcacugaggcccagugcuauagcugaacucuaugcuucagugucaggcccuagagagcuuauccuuauggccaaccucaucuagucauccugucaaucuccacuaaccacagaagccuccuuuaaucauggcaaauucuuuuccaucuuaacaucuaccaauguauauggccagauccauuucauccuuuauguuagugucugcucaguaucccuggcuacuuuaucagaauaggauaccaaauccccuuuaaucacaguauucgaccuucuuggacuugagguuuuacauaacagucucugccuguuuauuucccaucuauuccacaacucuauaauggugauauccauaccuagcacaguauuccacacagauaagauguacaacauuaaguggcuaucacuucagcccccuccuuguuguuguuguuguuguuguuggagacagaguucucuguguagcccucgauauccugaaauucucucuuguagagcaagcuggccucaaacucagagaugacucccaagcgcugagauuaaagguguccaugaccauucaugccacaauccccauuuuaaagaugagaacauuuuauuucuaugagcccaagaaaccaguucaaacucaaguagcuagugauuaguaagaccugugguuuggguuuaauuguaccuggauaucugagcucaaaauaauaaaaauguaaaauauuuuaaaaauaauuacacuuaucaggugcucacuacacauaaaagauaucaugguaauaucuuauuaguuguauuuguguccguagugaaacaccugacagaaacaacuuaagagaggaaggaucgaucauucuggcucacaccuugagaccauuauguuagggaaagcagaacauguaucuccagucacagcagcaagaggaugugugaagccuguuuacaucacagcaggcaggacggaaagggugaucucagaaccacuggcuggguauuccuagcagcaagagccuuccuccuaaagguuccacacccgcccaaacuagggcaaccagcugcuaaacaagcauucagaacauaaccccaugcaaauguuuuagauucagaccaccauuaucaccaaauccagaccuacuaauaaaguguguaccaccucacagagacuaaagaccugcacauuguaacaacuuguucaaaacaguccuugaccaacaaugaagaagacaacaaugaagacagguagauacacagaaagacagacaaauaaauggccagauaaauggauuggugaauucuaaacauuuucuuuuuucucauuccauugcacaaaaccuaaacucacagauaccaugaagauccagaacuuagcuauuucaagugaggcccauggacuucaccaugagcaacaacuuagagugugcugaaaacacagaugcuccuggccucccugggacccaugcaugucgcuccagccagcccuugacccacaggauuggacccagcuguucaauccgcccuagaaaccaagcccaggcaauugcuccaagccagggaaaccuuggccuacugccgccuggaaguucaggaggccaaagaaagccuaagcuuagaggccgcucuauccccugcuccacagagccaagcggggaccucagcugcagauuugucuguggcugauacagcugccuggccuuucuuucacccccuaagccagaagaacucgggaacuaggauuucaaacugcaguggccaccuguugguuuuauacccccaggaucauuuucccuuuguuugaauuauccccaucuccauguaaucagaccaucucuguacucagacacucaagcugugcacauaaggugugcccacucccuuuggacaaaguucucgucucagagcuaggaaugugcucccagccugaccagucacagcauacuucacucuggguacugggauaauucuaagcgguggcucauaacccaagcuggaacgccuucaaucuauguuaauuauuuggagaguaugcucaaguggauauguuucagcuaauagaacugaguuucuaaauuuggugauaaaaaucuaaaaacuuuaaaauauguuauauuugguaugucuuguauuaagguuacaacuugaagcuagccugauuacaguugccacauucuuucaguaauguaacccaugugggcugcuuucuaaggaacagguccagugcuagauccaaauaagaaucaccuagacccuaagugauucaagagaagaaucgguaccucucucugcucccgucaaccaccuuucuguugcuauuuaucaaccaugcacgugucucucuuccuucuacccucugcuucagcacuguuauuaauagcugagagacacuauuuuugagaagaaauuuguaguuuggcucacaguuucugagauuuuaguagaaugacacuugccucuguauuucugggccucuagugagacaguagagcacaagaggaaggcagaggaagcugggugggcagaggaagcuggucacauaauggcaacaaggaagcaaaaacagagacuuggagagggagcuagggagcagacaagcccuuuaaaggcacauccucugcauccuuguuccucuagcuaggcaaguucccacuaccucucaguaauguuaucgaaugaagucuaucaagaaauaaaccccuguugauuaggucggaacccucaugaggucacuucccuagacccugucaauugguaaccaaucugugagcacaggagucuuuggggaaaauguaucacaccucauuuccacuguccuagaauauaaccauucauuucucuaacauguccccacuugauuaagugugccgggaucuauaucuuaaaucagaccauccaaacaaugggccaaauucagugaaaaugugaucuccucucaugugauauaguaaccagcacgccaacuucauuuuauuuauacagaugacuguuccccucaaccaccuuuguguugcuagucaucaaccauucacaugucuuucuuccuuccguucucugcuuccucccgcagccucuccuuucugcaggcucagcccugagaauguuacauaggacuugucaggacuccaagguugacacagccuuuuuuuaaaaguaggauuuaauucuuuccuccaucuguccuaaggcuuuuguucuguguacaaaauccuguugcugguuguucagacagcuccugguacaauggggauaccuuccuuuguuuaauacagacucuaaagacaaagacaauauuuuauuuuuguuauuugauuugggugaggguuuuuuuuuuuguuuuuuuguuuuuuuuuuuuuuuuuugguuugguuugguuugguuuuauucaucugaagacgugggaaggagaccucaagccuugaagaaaaugaaaauuuuguucuuaccacauaccacaaacuucacugauuaaaugacuacaggcuguaaucuccuccaacuaaaauacacaugcauuaaaccucauagggaguacugacaccucaacauuaucuaugaugguucuuaacuccgguaacugggagucugagaaacugccaaauacacugaauuuuaauagaauucugauugcuaaaagaaauaggcaaaccugaaagaaagaaaaggggggguugcuaauaaccacacagacuuagaacuuguccuuacuuuccagaauacaacaacuguaccuuccuccucucuuucuuaauuuucuccuuuauuccuacuuaauuaaugcuuaauuaaucauuaacaggaaacauaggccauaacucuaaaaaugccaugacucuuacaaauaugauauuuaacuauaucaagcccaaggcaaccacacuccucuuccugaguuuuccuuuucucucuauggagucagcacaccaggcaaauaaagcuacuguauuguaaaauagcccccuacugaggagagacucagcaaaugcuggcaaauaaaauuacaaugucgguuaauauauauucaggccaagaguacucccaggcgcuugauaagguuuuaaauauaaauauucaaacauaaguuugcacacuuucuauggagaaggaaaugcuuuuauaaagaaagaguucuggcaguaucagaaucugccuccccuaaacauaccaccuuggaauagaggcuaucuugugugauggcaguuaaacagcauccuggggagagagaacucuccugcaagaugaacgcugggcauaaauucccuuugugaaguagauguguuuguaaaaggguuuccucuccuuaugaaaaagagagcaacugugugcacaguaaaccuuacaaaacagccuucauuucucaucucuuuccucaggcaucuucuccucacucgcccucacaucuguguccacuccagaagacagacccccaucaccucuuccuuccucuacucuaacuccagaagcuaugcgagccacagcacuacccuccucuuucaagugcucuuucucuaaagcccuccacaugcacauacaauaaaaaagcuccccuucuucaauuccccccuuuguacauuuaauuuuuagggccccagaagcaggacuaaguggguagacaaaguuuucuuccuccccauucucuacaauauaaaugauugagaaaauaaaaggaauuuaaucaaauuaucuuaauuaaucugccaauggaaaauggggguaauuauuuaagaaaaggaaccagacuuucaaacagcagcuccaaggaagucaugcauuccagacgacuacaccagaaacaaagaaugucauuagaaagagcagcuugcacuuuuuucugaacaguccuuuaguccacugugcagcgcucucguggcuucagaaaauuuuuaacauggcuuuaaugaauguauugauuguuuuaaacuuccaguuaugaacaaugaaauaaacuaaauaccagaaagagaacccaaccugagagcccccaugaggaggaucaugacugguaagaaaagcuagggacacaacauggaucagggaggcauaaaaucuagaaaggauuuucaaucuucccaugaaacaggucauaaaacccucaugagaaaugaucucccugugccuggaggaaagacgcauccuugucuuuauagacaaggggucagggggaagaaugugaacuaacaggccuucuacugccuccaggcuaucagcauuacaucccacuguuuuaucugauccuacuggccaugacucaaucuacuucagcaguccuagcacaaagagauacaucuacccauuuucaaguugucauugcuucauaaggacuccauguaaucuaaaacuuacaguacauaaauuugcaugcuuuucaaaaguuguucaccucuuuuguugugggggagggagaguugcgaggaaggggaaucccuuggccacaagccuagggugaaugaggaagauauuucacuucuacaccaaucauguuuaaguaaauacaaaugauugaagaacuuccagacacugcuugugacauguaggcuaaaacaguagauuuggagauaguguauccuguucaauauucaaaauaugacgacaaggaagcaugaaagagaaugcacaacguugugauuuuauuuauuuauuuuugguuaguugacuuuuuucagacaguaucauaccagguuggcuuacaacuaaguauguggcccagacuugccuugaacacucacaguccucuuaccucucuaugcugaggacugaaacuacaggugcgugccaccaugcuuuguuuaugauuuuuuauuacuaugaauaauaagagcaaaaugaaaggcuucuuauacugaagacaguuacugaguuaaacauuuucuauguguuuuguaaaacuuuagauugaaugagacuauaauacuuugcccauagucacacagagagcaggaccaauauuaaaaaucaaucccuuuguucugggcgggauugggagguauggcuuguuggagaugcgucccugugagugagguuucaaagggcccacucacaacauugccaguguucuuucucugccucuugauugcagaucaagaugugagcucuuagcuguuucugccgccaugccuuugcuccacucucauggacuaacccuaugaacuuauuauacacacauacauauuauauauauauauauauauauauauauauauauauauauauauauacacacacacacauauaauucauuguacauauauauaauucauuauacacaaacacacacauacaauucacuuuacauacacacacauauguauaauucauuauauaccuacauacauauauguaauucauaucuacaugcacauacacacauccaucaagguuagguauauucucauccucuuaccuacucuuaucuugacucucacaaagacagacuaagaacugcuuaaaugcuugcuauucaaguaguccaggaagcagcaucaagagccuauuaauuaaaccaggaaggcuggucuucuggaccauuccagaucaaacaaaucagaagcuccauucuuaaaucagcaggacacaugggugcacacuaauauccaagaaacacagauugucuaucacuccuucauggcucaaggaacaucucaguagaggggguauggagagaauggguccuacagacagaugccuucuagauaagacauggaugcuacacuaacgaauucaugugaucuccagacagaugucuuuuagauacguuguggaugcuacacuaacugacucaugggauuaccugcacaugaucugcacaaggcugcauccaucaacauuucaacauaaacacaugaggggcucaagaagccucagaaaacuuuuggaaaugaauguuugcugugggguaaaguucauucuccucaggcguaaagccacagauagaucuggaguaaaccagaaaaucugucuccuuaauaggaagcuucuccuuugugugugugugugugaugaauuaaauauauuuuauguguauaaugaauuauauauauaaguguauaaugacauauguguguaucauaaguuauauauauguguauguauaauaaauguguguaaugaauuguauaugugugcauaugugcauauaauaaauuguguguauaaugaauuauacauauguguguauaaugaauuguauauguguauauguauauuauaauaaauuguguaccauguguuuuguguguguagacagcaagcacaguugcagguauguguuccaauuugacuaaugcuuaucacuaauuuauuaugcacauugguucuauacuuuaaaaaauaugcaaacauuuuauuuccccacuuuagacugcuaagugguuucccaaauucccuuggaagaaaguucaagacucuuguagaugcaggacuguguauaacaucacagaaggcucuuauagaugcuagacuguguauaacaucacugucuuauuuucucucuauuacugugauaagcaccauggggaagaaaaguuuacuuuaucauaaggcuuacaguccuucaugaaggacaucagggcaggaaccaaggcagagacauuaguugaacuaugcuuacuggccugcuucuuauggcuuguucagccuucuuuaugcauccagggcuggcaaagcccguggugggcugggccuucccacaucaaucauuaaucuggaaaaugccccacagacagcccggcaggccaaucugauggaggcaauuccuuaguuaagguuccaucuucccagacagcacuaguugugucauguugacagaaauuagcacaguccuccgcugcucuguguaaucucacuuuguuacccucucagucacugaaugucaugccugggugcccagacuuccauucuacucaucaaaucuuacacucccuccuucccuuucuuccuuuccuuaucuguacguagacuaugccaccacucaguaccaugaucaccuccuggucaaucacuucauugcucucuaugccugguacauaguugaggcccuagagaagccaggagcaaccuguauggcuguguucaauguuuaggacugaccuccacuucuuuaccuccugacccuaccuccucccuuuggcugggaccuccauuuguuuuuccuucccuaucugucacugaguaauaaaaacggauaccuuuaucacuacuaucaaccuuagaaauaagucacuggcuaucgccccuaaaucauucaugagcugggggacaauugccugaacuuaaccugaggaucuugggccagguucucuuccauucuacagguaaacaaaaagcgucacugacauaagccagcugcuuuccagucuacauggagccaugggucagagacuucucagucuuuaccauaucccugaucauaagaaugugucacuaggcugacaagauguguuuuuaagagugacaaaacuuuuaaauauuauggcccaccuuucuuacucuaagaggacaaauuuuaaaaaaucauuuuauuuucacauaccaaguuuacguaacaaugacaaaauaaggcauaucauuuaucuaucugcuacagacuauugugagcugacagaagccucaaacugcugggauuugaaucccaggaugccacaugacugauauguauuaccuuuaucuggguuguuguuucaucugagaagucaaagacauaggcacauccauauauauggcucuuggaagauaaccucagagaccggaauuucucucugccauguucuuguugaaguaacauaaccuugcaucuuacauuucaaagcugcauuuccacauuaaaagagugaagugaguuugaaggacaagcuaugggagcagagcucuggggugcuaaugaaugcaaguccaugaaugugcucucagggagcacuggaggucacagaggucgauggggagaacgucaugcauagugauuuguucugaauguuuagccaauaauuuacaaaguuuggccaacaauuuagaaagcuguuaugccauuaccuaauuauccagaaaucgucucucacacggggaaaggugagcgguguuugcuuacauaucugugaauauauaacugaaggucuccgugucuuuucaaaccaaagguuuguguaacacacaugucacguguacauuuccaauaccuuauaucaaaguguuagauugugcuaucugugaauguaaaaacagcauccaaaccucauuuucucaucucuggaggaacaaaaaaaaaaaaaaaaaaaaaaaaaggauugggaaccaaaacacaacuaaugccaaaaauagaaguggaacauauugacgcugaacauacaaauuaagauaagaacacaaaagcaaaagcauccguagcgcaugccaccagauauuuacaggaaugacgugggguaaggacacgcacugcccugagguaacaagcaacucgaggaagccucgggaaacccacuucccuuugacccaaaggcaugagagaaagacugcuggcuggcuugauucuaaaaugaaacagagaggaucccuaagaccugccagcucuggcacacugcgcacuucucauguaaugacccucacaccugaagagacgagcacagaacgaugcucaggagaacauuugcugaauuaauggaauaggaaaacuuuucuaacuaaaaaagagacuuuacaacaacuggcccucguguguggucuauaaagaacaaaucuugggaacgggggaggauaacauuaccuaaauggcaacccaucugccguuccugguagcguauugcuauuggaaguaagaugcuggagagucguuuccuuucugauauaaaccaacgguaugaccucagacaaacuagucugccuuacagggaccaguuuccucaucgcugaaauuaaggugcauucaagcuauauguagcuaacauuuuugaaaccuuuacucccaguaauucuuccgagagaucuuugaacuggacuuaaguaaucucaaaagguuuuguagcauuagcauuuagugccuaauuacagaagcaccacugugcaacugaaagguuuuguacucuauaguucugugacguaggguccuuuucuagaaaaaaagcucucaaacagaaggcgcuacaauuccauuacuucuguuacccagggggcuuaacuugaaaaguuacuuaacuuucuuaacuuucguccccuaaucaguucgaugaauagaaaaaaugauuaucucuaccauauugcuuuaaaaaagauuaaauuauaacugaaucuaauaugcuaaaauagcccaauuuuaauacggcugugaaaccuuggacagccuucuuuucaagguuuuuugguaggguagggaacuacagagugauuuggagaccaugugaacaugcuuuagcagaaaaaaaaaaucauauacaauacuuugaguaccauuugcaaucaggagagagagagggagagggggagggagaaggagauuggggaaaucuuuacuaaacauuuucucuuacuccuugcauaauuaagcauguggacaaagaaggcagccaagaaggcagggcaugugggagucguaguucuaagggaaagggcuaccucccgggggacacuuguagugagacuucaguucccagaagacaucucguccggccaaauggcacauugguaucugaaguaccuggcaggaugggugcaauuaagcaggacuacaagucccagaacccuccgcagccaagggcuugagccauaaaauggagccugaaaaaggagcuuucagguacaaucagcuuaagcacggaugcucuuagggcugcccuuggcagaacaagccuagcccugauuaguguuucucuaaaacaaccgcuggguauuuucagcauauuucggagaccgauaauaaacaguuuucaaccgacaaacuuucggaagccuggcuucagugcugauuacauuugcaaacagcuucucugguccacuagagcagggaacauuaggcugguuuuuauccacaugaggaccgcugggcuggccguccaaggucguaugacagaggcaaagguggccgaaguuccagcaaccuggcuccuuccuucuacaaucuguuucagcuuucaauuccugaguguaaaacuaaaauuaaaaaccacaaaggcagaggguccaaccagugacgaguucucgagccacagugaauugauguggguuuguuuuucuuuauuguauguuuuaaacuuaucaaaaugcaaagucuuucccaaaauauuguucuccgugaacccuguucugcagcugcccuagaaccuguucaaaccuuuuggggcacuuaagcuaggugucuguuuaacacagaccuguuugggcuuccugacacuugucuauggaacggaagaacuauucaaaaguagccacaaugacaccucguggaccugcuaucgcgacccggugccucaguuuaccccaggggaggguugaggcuaggacaugugcucgagagcuggggcgccugaguccaucccgagacgucucaucaggugagcgaguucuccugucagauggccacuaucaggcaagcggugcuggccuguccccgccccgcgggccgcagggauacugaccagacgcgcacagaaacccagcccgcgccccacauucuguuccacuugggcuuggcucccgcgccccuaccuuccaagaucuugguggcuggaaugaaaggcaagagggcgggagcacgggacaggagugccgccugagcguguccccacugggguggaccugggagcu

SEQ ID NO: 12506 - RNA, 144372 nt, Mus musculus
uuuaaaauaaauauauuuauucuuugccaggagacuccauggaaaaagguaaacaguauaugaacauagaaagcacuguuaaaccaucucaauguacaaacagagcuagugguacaucacagacuuuugcuaauauaucaaaaacgaacaaacaaaaauuccacuagugcuuacaugagaacucagaagccgacacuugagucugucaaccacucauucucccagagcugucagucugcaucauggugauugaacaaggccagaggaggccacuugcccauaccuucaagcaucaagacugggggaaaucccaggaucaggccugagucagcaaggacacugggcuacuagaguccagacggcagacuaacuugcugauuauccugugauauuucuccaauggcuugugaacagguaaacaaacuuauuaacacuggacaguguuuuugccuuggaggcuaucaugacuguaaaaaugcuucauuuuuuuuuucauucgguaguugugucauuaaggaacaaaccacuuuuaauuuaaagugacaucauuaacaauugaacaaugauguuggauuaacugaacuggcaguuucagugauacagaauucugcuagugcagugaagugguguacucuaucugggcaacauaagggaaagaaugaagcuugagagcaucaaaaagcaaggagaagcuuccacacuacuuaaaccagagugucuuuagugucaucuuguacuguacagaggcccugguuccuuaccgugaggccugguuauucaugaaagcaggacguacaguggauguacagugguuuacuccacaaccucggugucuugguuauugaguaugcaagacaaaagaaagcaccaacauacaguauagaaagaacagagccguacuucuauauguacaaagucuucagaaacuuaaccagggcuaaaucaucucaacugggucuuugccaugcaucuugacuauucagagaggaaaguagaagcuuuaaacuagauucugguggcaugaaauggcugauuuucagaauuugaaaaguuuguauuucuagggaaguuauacaguaaggaauauauauugauacauaugaaaacuucuugguccuuuuugaguuuaacauauuucaguucaaaaacuaagcagcaguaaaaauguuuuccuugcauuuucaaucuggaacugaagguccuggggaaugucugcaacagcuggaaaugucucacugcagcaguggugacugacugacuccacuguucuccacugagcugggggacacgcugggacugugcucugcuauauucccacuugaacuuggggucaaggguucauguccuucagaauucuccagcauuuccugaaugagagguggcauugauccaggaauuuccauuuucaagguaauuacacguucggcaccuuuuucaagagauaauagaacaccugucagauaagggcucagcuagauacuaagaaaccaacauucaccuucagguguguaaaaguuguguaauacauguaucaagucacaugugucuuuguugagaagaaccaacuuauuggaagaaaaaacuauaagguguuuacugugggaaugucagccaccagaaugucaagugugcuucgagaucccaguuagauugguucucaggcacaggcugauccaccacugccuuugaaaacagaauaaguacuaauagggcacacuagagguucucagucuuuaagaaaaagaaguggagaugugugaugugcauauuugauaguugcagugcuucaaucaaauucggaauauaaaauuuacaaagagaagucacugaugaaagaucaggaaaauaaaggugaaaggaugggcaguuuccacaauggaaagauugacuugagucacaguaugugaugguuuucugcaacccaguccagcaccaggugguuucaugccaccacaccucacacacccccaacaugcagcugguuagguggaaauaugucaauaacaaaacuaccucagaaccauguggcuagcguugcuggacuuacugcuaguauggggcuugggacauuucuguauguggcugcuaguccucaggucacuggcguggauauauauagggugauaggaacacacuuucucucucucucucucccucucucccucucucucccucccucucccucucucucccucucucucccucucucucccucccucccucccuccuccucucccucuccucucucucucuccccacuucauucaauuacauccauucaaguacuagugucuuuuugcuucucuuaauccugugguggaaaugaacuuagaauguuccccucggcucccucaaaccaaacuaccaaaugaauaaaaaaagaaaaacaaaaccaacccacaaaaaaacuaaaaaacaagaacugagguuucuugucaagcaaguucauugugcauuuaagcacuuuugugucuuggcuugccaagauccugagguguagaaucugcuaaugggagggaacaugauauguaauagcguggcuggcugagucaucucgauagaaaaguccucugcacucagcuaugagaugccucuaggcauuucuguaauugccugaguugccacauagacugagaaucaugaggcaagaguauuuauaucucucagccaggcaagaauuccuguacucagaagaagugccuacaccagagcugcagccacagugaccuucauuugccuaggguuguuagggugccauggaaaaauaggcugaguguauagaagccuaaguuauuugaaaagcuggaaugaaauguacggaaucaaaaauaaaaccuggaaaaagggagcgggggugagggcucagagcuugcucugaaaguugcuugacugaguuggugcccuagaaaggucacagagauugagggagagaagugacuccauguaauuguccuuuaaccuccaagggcaugcauaugagccccagcaauaauaacagucuuaaaaaacacaucaucucugaagaguugcucuucuacccagccauccauucuaaaacaauuaucucuuaauaucacuggguagugguaucugcuuucugcuuuuacuaucucccaccagagacaccaucaaaaugucuuccuuaggaaaccugaggugcucuuaacuacacacacaugagugcucagacaaggcuaauuccuuuugauuucuaugagauagacaucccaacuuaagcaauaaugggacuccugauauuaaaauaugggcuuuaaaaagcaaaaguuggccaagcucuguucugcuuuccaccuuugaagacauaccuuucgcgcugaugcugcggagaucugugauuuucauuaagaucuuuggaaacaugugaggcuugcugggucgucguuuucuaauguaaaucuuuagugcuuccagcagugguucuuggagcuugucuacuuuuguugguuccucaagguccuggcggucuggauagcaggagaaaguauucaguguuuagugaucagacaggcucagagacugcuggcuaucuuuccuugucuccuauuccuccuguaaaguggcuuuauuuggugacucaguuguacacuaaauugaguaaaugcaauugcuuuaagcagugacacuugaagaugcccccuuaguaagcucauuugauguccacuugcucaggcccagaggcaagaauuaccucucauggccagauggugucaguauugagcugaacaaaagaacccugggcagccuguaaaagccagguagauaaccuuuccccuucauuacaaccauuacuuuugaacuaaaguuggcuucugguuagccagcaggggucacuacaaagaaggggccauacuuuauuccagcccaccagguaggcaccuguaugguggggaagaccaagaggugauuugaauucaaauaacaugugauuuguguaggucaucacuaaaauguccuuaggcacacagcaguacaauccugcuuuuacaaaagcaccuguuucccacaagagaaacagaacaaacucauuuuggcauuucuuuuguuuuggcagaaggagcucaaacaccaguacuuaguuugcaacagaaagaaguacaacgccuuucucaugccaaagaaccccaguggagaucucuucugugccuuuguaauugcucuguuggggucuggugacgguuucuaaggagucaguaccuccacagauuaaacagauggcacugagaaggccuguuucugugucauccauuuccaaaggcaggagcugguuggcaaaggugaacacaaggucagucagaggaccgaagccagcauugugcaucugaguucgauuuaguguaaggccaucagagaaagucauggugucuugcucugggguauaccugguacaaauucugagaaucuggaagaaaaaaaaguaugcauguacacuugcugcaucauuuaugacggccugcccugacagcacugaccagaucuaugguagaagaaaaaggagccugggucaucuggacaguaugccccacuguugagguugauaggaauaauauguaggacucacauuuugagaaauaacuuuuuacuaaaauaaaucaucauuugauugaaauaucuauuucuugaguacuuaccucucaggcacuaagccagguacuagugcaaagaagauuaacaagauucuauuuucaaaaguuuagucaaccaaaaauaaguaaggaugauccuuaccaacugugauagcuaaucuucaugucgacuuuaugggaucuaaacuugcuaugggaacacacauacuucuaggcaugucugagugaugguauuucacaagggcuaaacuaaucagacaagauguacccuggauguguguggcacacacuccagagacuaggagcuuucagacugaaaacaacaacaacaacaacaacaacaaaaagcuggcauuuucuugacucuggguacaauguggccaguugccucacaguccuacauacauggcuuucuuaucauuguggcuucuauucucaaaccaugagcucaaauagaacucccuuaacuugugucuuucagauauuugguuguauccacaggaagguaacuauaagaagucuuuauuagauacuuagcaugcccuauacccagucuuucagaugaacauccuauaguuuaagcugagggguaaugaaucugacucaaggaaagcccucuuauaauacaguguguuuguagcuacacagccaucaugccauagacaggaacagaggcagcagacugcagggguuaggaggaagucagggucagaguuggggagaggguguuugcacccuaccauggaacgcaaguagauucucuacucuagaagguacucccuccuugugcuuauuguuacuguccagaccuacaugugcuccauacccucugccacaucaucccacagaacgccugccuucucucaccguaaaggccuuaggccuggugagcuccagcagucuccaguccuucccuagggccuaccuggucuacaaaaggguauacagauacuagguagcaggccaucacugaaggccagugaggagucacucuccugaucauaauggagagggauacaaggaaggaaaguccuaucaaaucccagagaccucugaauuuuugucaauucagugaaauuccaacaucuggaaaggauucuccagaucuagaaaguaacugagaaguggucuccucagaagauccuagaagccuccaacucccucuuccuuccuuccuuccuuccuuccuuccuuccuuccuuccuuccuuccuuccuuccuuccuuccuuccuuccgucuucuccuuccuccuauccccuccuuccuccuagaguucagaaaagauccuaccaagauauccaagcaggcggcuuugagcagggugaucuggucugcgauggucagaccugugaagcccggcagacgcuuggcgaacuccacgaucuuaauaaugcacuugguggccagcucacugaauuugucccagaggcccaaguccaaucggacccgguggucagcgcuggaauucugagaaggugggagaagaagaaagggaagaggaaagugaaugacagcauggugucaggacauagggacgagggggcucauauuugcuuucucggagugaccucggauuccugcuuucaacuccacaagcuguuuacagcagccucaagacagccagggaaugaaugagggcaaguuucccugugugcuuauccacacguaaugaaggaaugacagaccuacugugguauaugugcugccucuagacauggaucaucacugcucacuaccgccauguggguauccuaaggagaacauaccaccgggcuucagucuggccuacaucaaacuugagccagaugaaaccucugcaucugcucauaggacacacaggaacauggugagcagcgcaacagccaugcugagccccagauacuauguaaagccaaggagccacucuugacagugcacaggagcagcugcggagaggaagccaauguucaauaauguuacggugcucaauaaugacuauguagugagugggaaggugccaucaacaaaaggaggcaggcacacaucuguggccgccaauagcauuguacuaaagggaggagacagauacacaggaccagaucauuguagaaaaggugauaccgcacugguggaaggauagggcaaugccuucaggggacuguggguggggcaggcugucacaggugaggagggagccuuucuauaauguugagaagagucugcaacaugccaauucauaccuucuuagaagaugacacauuauaucaugaaaauuauacuccagaagcuaaacuuagauaaaacaagauagcuacaagacguuuauuggaggagguggaaaccuucucugagcuccauuucaaacaaauaaagaagagagacuaauaaacaggagaaagugcaaaguaugaacaguaaaguguucaggaggcuuguuuuauuuaaugguggcacugugguuugcaagccaugcuuagaaaacaccuugagucacacaaggguaggaugcuggcugcuugguauaugcaacagaauaaggagaauauuaaccacugagucaggggucuaaggaaccaggacauagccuacaguggccacagacaccauuacagggacaugauggaacagaagguagcuugcagugaccauagcaacaguauacuauucagccuccaugaugcacugaaaugucuccuaagaaaaacaaaggucaaaaagugacacucaaccauguaugaugucacaucuaaaggccugggccuaucaggcuuccagagcaacagaaguauuagguauggcauccauaaggugaguguaacagauaccuccugcccaggucuagucucugaccaucuccuccuucuguaauuaucucucucagaauuuucucccucaucucugccaucaucucccucauuuccaugaaacuagaagcccaaaucacuuuggugaugggaggggagacaaggggauaauggagagggauacaaggaaggaaaguccuaucaaaucccagagaccucugaacuuuugucaauucagugaaauuccaacaucuggaaaggguucuccagaucuagaaaguaacugagaaguggucuccucagaagauccuagaagccuucaacucccucuuccuuccuuccugcagucuucuccuuccuccuauccccuccuuccuccuagaguucaccccugcucacacuguccccaccaacucucagcucuagccucucaugucucuccuugcuuuaccugaagguugaccaaggacuagccucaggccucuacaccgugagucucccuuucuagauagcugccucuuaucccugcaucauguacucccuugagucuguggucaguuuaaccuucuguuguuauaccuuccuuggccuucuaugaaaacugaccaccuucccgcuccccugcacagcccguggcugcuuuuacagcuugccucuaaaucccuauguggcuuccccaucuacauauaguccuuggcuccuuugcuuggcuugucacugccuaucauacagaggauacaaugagcacugaguagagcuuaguuaaguuuagugacagucucacaagcuugucugagaugacacagaacaacugucauuguguggaagagacgcgaagaggcuaaacacaagagcuauuccucugguaaguagccuagaccucuucaugaacucuagaacuccaaggcaaacugaagcacacaaggagagauuaggcucccuaggccugcugugcaacccucuuuacaaaugccccuagcucugcaaaggcaaccaugcauuguaaaccaauggcuucacuguccuauuucagucaaguugguccauagaaguucaaaaaguuaucuuugcuucucacaucagaaggaauccagaggaagaguuugaagaugggagucuagagaaggccucagcauaguggugguauugcggcuuccauagugucccuguggaaacaagcuauccuccagauuaauuuuaugucucccucaaggaucacaguacacucggagguaugugugugcaagaucaaggcaugcagccagucaggcuauaauuaaauuuaauaggcaguuuauccaguucacagaaauaugccauggaagagaaggacagucgagcuuggugggaaaucacauuacaauggaguauccaucuggaaaaaaugacauugcuggaugcagccagugugaaggaaauauucaucagcuuugcauggacugcuccaucaugcaagacuaggagugggaggugagcuauggccccuucuauuaaaacagugaacaacucaguaagggccugucacuccagcuugugauuaugcaaacggaaggcaaaaggcacuuaauaaaaaaccacaaaguaacccccuguuuuauuauccugacugcgggauucauaugcacgaggcuuuaaaugacuccuauauuaucuuccagcugcgguagguggagaguguggccugcuaggccuggugaugaaagcagcuacugcaagcacugaguggggugagggagaagaugcucagagcaggugaggaugugugaagaggaugaggagggaggaggaagagaaaggacacaggcugagucaggccuugcuguguauggcaagauuguugccugcuugggaaguccccugggagcauguaaauuucccaaaaugcugagcccuggagugcccugucaauccagcuaaaugauaccuucugccauggcacagccccuucuguuguuucucugacugacaucacuuucagaaaaauacuaaccaacagaagcaagauuuccauugucuagaaacccaaugauggucaauuggagcuccuggaugagugaaguaaaaagaaaauuuccuuuucuuuguggaguuguagaaagagcccagggccauauacauguccucgaaguacucuauaccaagcaacaucccagcccugcuccccugagucagggucacagugcagcccagucuagcaaucaucuuuucucugaaucccaagggcugggauuuuggguauuggcuacagaauuucuucagaaaaacugaguugaaggucugugggaaugucgugagucucuccugaacagucucccuuguccuggagucauuugcacaucccaagagugcccuccaaguccucucagugaaguaguucugucuucuguuuuucaguucuccaucaugcacauacauaugugcccugcaguacauuccugaacacucccaagagcuaggcaccauuacagccguauuuggcugaaaaggaggcuaagacccagaaaagggcagugaccuguaccaggucccuggguaagcaaaggagacaguagucacccauccagaugagcuguggcagggacauuuuuuucuugguguuuugucucuuuuauuuccuagugagaacucaauuucccuuaaacuuuacauuguguuugugacuuccuucaugguuggaaaugcucaugagauagcuacagagucccagcuccaucaugcugaggaugccguaagugaggcuagccucuuucuggcugcuaaacauaacccuagacaccacaugaugccaugugcauugucaggaaacagcuaggcauucaugacagugggagaacaaagguaaauagcaaaagagccaaauuagauggugcucagggagucagcaaugcuuucuaaaucaagcaaagguaaagacagucaccaaaggcagaaggcauggguggggaacccuagcauugucagagggcccucuugagugaauacuuucacucuuuuggccuuagagacaaaaguaaugcuacuucaaguuucccagguagugaacuuuucugagguaacucuacaaguuauugaguacugagagcugaguacaucuggcugggaaaaagcaggcagaauaagaaaauggcaggcagguaugugcaauacagaggacuaugagggaggaaguuaugggcugguucaaggugacagagcuuugaggcaacagaggguaucagaauucuggucucaugguaccccaagugucuuaccccaaccuggguaguacaauucucuuaaggagccagaguuucugaguucuagguuuucuccuuccuggccaaacaugugauuucucuacaaagcaagccaugccuagaauugcuuacaaucuugcuauuuuaaugcuugucucucagagccuauugguaaguucaugacucugucuguggccaauauucugggcuuuaaagcuccgugaaucuucaugguucaaguuuccaaaccuuucccaggucagcuuaugucccaugaaaccccaugauagggugaagagcagcaaauggcaaagaugccugugcuccucggaaacuagacucauaguugccaacuuuucugugacucuaaaugaugucaagcuacucacaggauccaggcaggggacaacccuccacucuacauacucuuucugccagaaacugcaaagacucgcugagacccuuuucucacagaaccaaccaucuggcuacacaugaauaccaccaauaucaucauuauagagacgaggagcccaggcuuacgggaugauuaagugccaccuaagcagcaucagagauagcagagugccugguaguggucuuccugcuuaggucugggguagacgguaguagguguguaucuguguccuugucucauccauucuggcuucuucccaggaucugcuaaugugucccuaauugacuauaauuaaaggaauaaaagcuacagugaaagauuggcagaagcgguugucugcugucugguucuucccugcccacuuaugccacaggcaccugacacgugugcuguccugggagagggaugggacgguucuugccuuugaaacauugccucccuauaaaaagcuuuuaacacaugcugaauucagaucugggagcucgcuugcagaggaugugcaguggcugcuauugcuuauguguauuccagaaaggguuugaaguuccuuacacugaaaacaaagccaggucuaggcagagaugguaaaaauaaagggacuccagucugcugcaggcagcucggagugcugaaggacagggguacacuagccugaagauuguccugcagcccagcagggagagucugaccgcugaugaacuuauuaugucucucucacucccuucgagagguccccaaccagagcauuugagaugaugguugccaggagucaggagggcuggauuaugguaucugagcacuuggucucaggcagaugcuauugcaggagaguauggaaccauucagauauguggucuaguuagagaagggccagggccacuagagguuaaacuuugcaggucauauccagccacuguacaaagugaguucuaggagagccagggcuauacagagaaacccugucucgaaaaaccaaaacaaacaaacaaacaaacaaaaaaccaaacaaacaaaaaggaaaagaaaagaaaagaaaagaaaagaaaagaaaagaaagagaucauguuuuugaauguccauuaauucauuucucaaguaucuacugaguguccagugugugcaacaaacuaagaguguauguuacugauacaaugcaugcuaaccuugaaaaauccaaggucacaugaaaccaccuggagcauccuccaaccaaagaugcccacaaacucuucucucucucucucugccucuuccuugacuuacagccauaguaaaagccacuucuaacuaaagaguggaacacauggagcuaccuaucuauugggcccagaucaccccuguccuguccccuuccagauuuucuugagauuauucacauuccuccugcaagccagaccgugacccagaggaugggugaccccauaauccuuccugggaucuguagcuggauugauauuuaaaagaugaaccccagaccuccuccagguuagauaucugccauaaccuacgcaauaaauuucugacuugagcagaccaaaauccccaagaggagacaccaucauaaauaaauugugccgucacugcccagcaugcacgccaccuacaguagguacucauggaugaacagcugcuguaguugcugucccagugauacauaugggggaaggggcagcagguguccugacuggcugacaggccacugagcauaucugccaggcacaagaaacuguaugggaacuaugugugugcacaagggccagugcccacagcccuggcaucuugggcaguggcucuuaccgugguguauuuacccagcuggcagagugagggaaagguuuccuggugggcuuuccggaucuucucagugaggucgucuagcuccgcugucaucucauagcucucugugcauuccugcuuugaaggcuccuucuuuuucuuguuccugucauuccuaacagcuggaaaagagagaugagaggauaaagagggucagguuaugcaucugugcaauaaauccccaaccccagcucugacucuuggaauaagagcagcaagaaaagagggagcacuucacagcuaggaaaggaaccaugccugccuuuccuagugugcagugugcacacacuucagucuguguaagcuugaccuggaagucguucccaugcaagcagcaugccuugagugggaagggucauaaggguggucuugagugacuggacuacauggucccuguccuggcuaguuuuugcuuguuuguuuuguuuuguuuuuuguuuuuuuuuuuaccuugccacaaacuaauuuuggaagagaaaauucaauggggaaaugcuuccaucagauugccuguagacaagcuaguagggcauaucuugauuaaugacagauggauggguggggcccaguuaccccuggcggguaguguuguacauuauaacaaagcaugcugagcaagcuacaaaagcaggccaguaaguagcauuccucuauggccuucacuuccauucuugguuccaggauccugccuugauuaaguuccuuacaugacuuccaucacugauguacuauuacuuggaagaugaaauaacugaacccacaaguugcuauuauuuaugauauuaaccacaacaaagaaaaucugacaaggacaggucccucgaaagguugcuucauagcaaguauagccuaucugaauagucucauuuauuuacuuauuuacuuuucuggcugcuaccuggaaagauucugcuugaggaugauaagacaauuguuugugacccuugauguguuagucuuagauuucucauguuaaccauacaauaucccauuacucagguuauuugaaacauuaugaaacccucagccaggacaacuguucaugcacgucuacauucacagacacccaguuccaagucacuuuaugggcuaccugucucuguacauccuagcccaacaagacacuagcacacaauauucaggccucagagcuauaggacagccuccuccuccaagggccagaucucuuucuggcugugagugagugcauguaaagcucuuggcuagggucacuuggaaggaaccugaaacccagggagguagauaagugauaccagaucacacagacccuccagggugucaggaccgaggcugcccggauauguaugaugccaacaugaccugggcaugugugaugcaagaugacccacggcauaaucugaucugccuaggaggauuuggcuuggauguuucccuaagggcacagaggacaacaggacaugcacuguccauacuaguucucaggcccugugcgggcaggagaugagggcagagacagggagacaugaaaguggaggcagagugaggagagaggagaauuguuggaagugagggcagcaauggcaggggguaagucagcacccguguaagcagugcacuggggccacugcugggaagaagagcacguuguagugucuugauaccugagccugaagguuugaccacagaacucauauaauccuccuucaaggagguagagcugacaagcucucucuuuacuggauguagcggggucuuuguguuggucccuuguagcucuguggccagacagaccuuccuuggagcucugaggggugggugaaaggccucccauuguaaagugugcaugugcauguguaacguugcagaagcagcaugcaauaaggugggcagcucaguggcaaauugugguuucuaggcucucccaugggguggcauugugccagggagaggauaguguaucgcaaaggcuuguguguagauauccugggcucuuguacuagacauuacaccccuccuuugaccucugcuuugccaacagagguaaaaacuaacuaagcaacaagucuuuuccaaacagcuuugaggaaggucuauuguuucucagaguuaccauaugacccaggaccuccugcucugucacacaguucagagcuaaccuaacagcaacauguaugaaaaaugcaagcgugauucucaucacucccagcaccaccugccccagugaggagcaguccacaagcucaucuguggguugcauauaaaccaaagguucaucaaaugcuggacuauggcuugcuaucaaaagaaggacauacugaugcaaucuauacuguggaugaacucugaaacugugcugagcgaagaggccauuugcuaaaggccuuguaacauaccuuuucuuuuguauacaauauccauagucagacaguguggcugcgaaggguuuggguugggggaaggaggcuggaaguguuucuccuugaagaacagaaggugucuggaguccauaguggugcagaagcaauaacuccaugaaaauagcacauuucacaugacuagugccacacuacaugccuuuuggagacuuucucaggacaguucugaggccacaagucucuaaacaccucugagcagaggcagaggacaaauuucaccuuugacccucaaacacacagcauaucaguuccaaugaggggcaaccagugcuguaaguucaggaaucguaggucauaaaaccccacaggagcuggggcaggaguuccuucugucucuagggcucagaacccccucucugcaagcaguagaggaagauuucaguggaauauucagaaaaucagaggaagggagugacuucaaaaggaucaagcaggcuuggagccuucucucuaguaguuuuucccagaaggagaugugcuguguucccaaagucucuaccucugaauggagcuguucuagauccuagagaaaugaaaucuccugugguaguggugcuguguauuauauguguggguaguggugcuguguauuauauguguggguaguagugcuguuuauuauauguguacuauauguguggguaguggugcuguguauuauauguguacuauauguguggguaguagugcuguguauuauauguguggguaguggugcuguguauuauauguauggguaguggugcuauguauuauaugcguauuauaugugugcguaguaguguuguuuauuauauguguauuaaauauguggguaguggugcugugaauuauauguguacuauauguguggauaguggugcuguguauuauauguguauuauauauguggguaguggugcuauguauuauauguauaucauaaccuguaccuuggauugcuuguuguaacaugacgguauccuccacuccucacagcaaccuaaauggaugggauggauggagauucuguggaggcccugcaucuugcagguaacuuggcugguucugaauguuauguaggcuacacugugugucaccugucacacaaaaugauaaugaagcccugugaaggaugccauggagagcuuagcaugcucgaugcugugugaagguccucacugugucugcaggcauucgagugagagcaauggucacagagcccaagauccuucucccuguggccucagacuuaucucucccccaaagccccuggcuguugcacgaagccaccuauccacuauggcccugggguuugacaagcugcuuucuccuucuggagaagacagugggcauacauggucaguuugcaucagagccugcuccaugccccauugcucugaggaacacaggaagggaaaggcuuuauucuacuaccuccauauucccaaaguuugacacagccccacccacagugggcuuucagggacuguccugugaguggcauggagauugggugacuuaauauggggugccauccauuuugggggcauguauguggccaggcagaggucaucugagcugucccuucucaaaauuaacaaccuugcugucaccuaguggucugcggaggaaucacugccugccucuucggcaguggccuagagggugauguaagggugggaguggccaggagggugauguaaaggugggaguggccaggagggugauguaagggugggaaugugauuuaugcaccugucauaggaccuggccccauguuugcaaagugcuucuuggaguaaaggugcuucauaaauaucaggcauucuacccgugaggggcaaagugcuacaaaucagauuugguggcaugaaaguaacauauuuaugauccacuaucauauugcaaaugaaaugaauguaauaaaaaugccacuuauacaaauaccucugauguacagaucccgaccuaugaauaugaaaacagacacccaagcacuuuuauuugaaugucuaaucauggaaauaaaugaagccauguucauuuuaaugugugcacuugugcauguaucuggaauauugauuuucaugcacaugauaaaaauuuaaugcaggaaacacaagaaagcugugagcuccacauggacccaggaaggagacagcagcccuuuccugaaauuuccuuuucaucaacaagaaaaggcaaaaagacuuuuucauauuuaguuuagcaaagggagcauaauggucuauuuauucuugcuugaaaauuaaagucugaagcucacacauccucagcucccugcuaacugcaagaauaaugggucacaguuggugagugaagcuauccuguaacuacuguacugggaugcucaagagaggaacaugaaagugcgguuuaaucugaguuuaaagacuguuuucuggacuaauuauguaaaugaacugccauggacgugacggcagguggauguaucacuaauuguugagagacuacuuuucccauaacuuaaggaucgaguggcuggugcucaagcacuuuaacacagacagucccagugugaaguugggcugugcugugcugugcugggcugggcugggcugggcugagcugggcugggcugggcugagcugggcugggcugugcugugcugggcugugcugugcugggcugggcugggcugggcugggcugggcugggcugggcugggcuuggcugaguugggcugggcugggcugggcugggcugggcuggguugugcugugcugggcuuggcugaguugggcugggcugaggugggcugagcuagacugagcugagcugggcugacuuguuaugagcuggacugagcucaacugaucugggcugaacugcaagguuucuucuacugcacaguguccuuacaguggaggcugccuuuugccuaaucacuaguuggaauucucacauacacuaguuggaauucagacacacagaaaggugaguggugacaggguggaugguuggcuuucuuucuguucaguauguagguacuguugaaccagccugaggccagagcaccccaaguguacauggaauggaauaauccuuucauuccuuggaaggaaccuugauuucagcaacucaagguuccagcugugcuuguagaaggacuugcagacuugcagaggugacuccauaccuugccaaguuugaggcagcaguggguguccaguguuccagggagcaggcagggggaacugucaaaauucuguagauaauuagucaacugcagagcagucuggagguauuucaaaaguuuaacuaggaccuucuagcauggaccagcuuuccaaagcaacagagugggcacagaagagccccaaauaccagaauauccagaggccaaaugguucucaaacuauuuuauacuaaugagaccaucaagccaguuccaacaugcucuugcccuugugacuuuuaggcucugagaccuuaucuuugcacaugaacuugguuccaucccacuucaauccuccaucccaguagguguaggcaaccuuguuggggcugcaggugguuuuuguuuguuugucguuguuaucaugcuuacaagcuaaugguguaggguacugagaaucucuuucagugacacaugaacuucaagaaugguuuucaguuuaacucuagagaagagggcagagaagcggguuugucuucccagacacggcagaagcuuaaguaggagagucaaaagcuuaaggcuagccugagcaauagugagaccuugugucagcaagagcaaaaauuaaaaaagaagccuggugcuacagcauugugagaaagugcuccuugcaugagaggcacugggguuacuccucaggacuguaagguaaacacacacaaaucagucaccaacaacuccccuacccacuccugccugccgccgagggccgagacaacauucuacugugcugugcuguguguguaagggcacuggacacgugucauggggugauuguggggacacuuuccacaaucuuucccucucacuugguguuccuuugcucuguccucuggcagcaaggggcuacuucagugacgguuuugcaucucugaccuugugcuuguaauaguugucuuuuguagaugggagcugagccauggccauaacacauggcaagggacauggaagacauugaccgugucuguggucuagccaucugacucugaacaaaggcucacucaauacucaguuugcuuuaaaaauuaauuaauuaauuaauuauuaucacuuccaauuuuuuaauuagcuauuuucuucauuuacauuucaaaugcuaacccaaaagucccccauacccucucccugccaccucuacccacccacucccacaucuuggcccuggcacuccccuguacugaggcauauaaaguugggucucucuucccaaugauggccgaguaggccauccucugcuacauaugcagcuagagacacagcucuggggcuacugguuaguucacauuguuguuccaccuauaggguugcaaaccccuuuagcuccuaggguacuuucucuagcuccuccauugggggcccuguguuccauccaauagcugacugugagcauccacuuuaguguuugcuaggcacugacauagccucaaaagaaacagcuauaucaggguccuuucagcaaaaucuugcuagcauaugcaauggugucaacguuuggagggugauuaugggauggaucccuggguguggaagucucaagaugguccauccuuucgucucagcuccaaacuuugucucuguaacuccuuccauggguguuuuguucccaauucuaagaaggggcaaaguguccacacuuuggucuuuauucuucuugaguuucauauauuuuacaaauugcaucuuguaucuuguguauucuaaguuucugggcuaauauccacuuaucagugaguacauaucaugugaguucuuuuguaauuggguuaccucacucaggaugaugcccuccagguccauccacuugccuaggaauuucauaaauucauucuuuaauagcugaguaguacuccauuguauaaauguaccacauuuucuguauccauuccucuguugagggacaucuguguucuuuccugcuucuggauauuauaaauaaugcuucuaugaacauaguggagcauguguccuucuuaccaauuggaacaucuucuggauauaugcccaggagauguauugugggauccucugguaguacuauguccuauuuucugaggaaccgccagaccgauuuccagagugauuauacaagcuugcaaucccaccaacaauggaggaguguuccucuuucuccacaucuucaccagcaucugcugucacuugaauuuuugaucuuagccauucugacuggugugagguagaaucucaggguuguuuugauuugcauuucccugaugauuaaggaugcugaacauuuuuucaggugcuucucagccauucgguauuucucagcugagaauucuuuguuuagcucugagccccauuuuuuucuuuuauggugaaaaaaauaguguauauuuagaaugagccaucuggacucaguuuagaugaucccaaucuuguuggcaacaucuagggcaucauaaucaggagccaagcgaccauacgccaccuucucuccgucgggccuuaucaggguauugacuuuggccacaucaaugucacagaguuucuucauggccucuuugaucugaugcuugauggccuugacauccacaaugaacacaagaguguuguuguccucuauuuucuucauggcugacucaguggucagugggaauuuaaugauagcauaguggucaagcuugcuucuccugggcccacucuuccgaggauauuuuggcugccuccagagcugcagggucuugggccgccggaaggugugugacguucggaucuucuucuuuuuguggcuguggacgccuuucagcaccgccuucuuagcuuucaaggccuucgcuuuggcuucggcuuugggaggggcaggagcuuccuucuucgcuuucggugcgaucuuggugaaaagccugagcuccauuuuuuaaugggguuauuugauuuucuggaauccaccuucuugaguucuuuauauauauuggauauuaguccucuaucugauuuaggauugguaaagauccuuucccaaucuguugguggucuuuuugucuuauugauggugucuuuugccuugcagaagcuuugcaguuucaugaggucccauuugucaauucucgaucauauagcacaagcuauugcuguucuauucaggaauauuuccccugugcccauaucuuugaggcuuuuccccacuuucucuucuauaaguuucacugucucugguuuuauguggaguuccuugauccacuuagauuugaccuuaguacaaggagauaggaauggaucaauuuguauucuucuacaugauaaccgccaguugugccagcaccauuuguugaaaaugcugccuuuuuuccacuggaugguuuuagcucccuugucaacucagucugcuuuuuauaguguucccccccccccccaagacaggguuucucuguauaguccuggcuguccuggaacucacuuuguagaccaggaugcccucaaacucagaaaucugccugccucugccucccgagugcugggauuaaaggcaugugccaccacaccuggcucauauuauuuauucauuuauuagucacucauuuuggggacagagucuucuuauguagcuguagcuggccugaaucuugcuauguaagccaggcugguauccaguucauggagaucuaccugucucugucuucaaaguguuaggauuaaaggaaugcaccuccauacccaguccuuugccugucuuuaaaaagauuccuaugugaggaucagaguucaaugcccaccucacagcacacacucacagcacaagcuucuugaaguucacagcugcuguugcugcccugccugucucuugcauguuugaaacacucacuggugaguccaccaacuuuuuuuuuuaaauguggucauccuagcagcaggagugagcuaccuagacuagucagccguguaaauugucuagaggaacauauaaacaccuuuuguauuucuuuguggagcaggcaugggcugccuugcaauagucucugagggagggauggaggcauggagggaaggaggggaggaggggaggaggaaaggaggaaaggaggaaaggagggaaggagggaaggagggaaggagggaaggagggaaggaaggaaggagggaaggagggaaggagggaaggaggaaaggagggaaggagggaaggagggaaggaaaagauucugguagaugguuucagauaaauacguuccuuguccuaugcaauuacucuagucuucauaggaaacaaugguuguucaaauaucaaacacuaucaugaugaacugcaauggcaaagcuuccauuucacaguacucuccaacccaguccacauucagcaaguggacuaaaaccucccuuggccuucucacuguacuuuaccucucaggguauuuuugaaacucaaagugaagugaggucuucacagcugggaauguucuuaguuucagaaauucugacagauagcgaagaggcaaacucuggugguuuaaaagaucacccgcacaggcucagcacgaggacccuuggccugcagaugcucuggguggcuuuaggcggugccacuuugcugaaggaggauauaacuugcaguggccuuugagaguaaacagaccuugcuuaucugcaauguauguugccugcuugauacuccuggaugagcucucagcuuuggccacagucgccaugccugcugauugcugcugugccuuguugccauuuugggcucaucccucuacaaccauacuuccaaacuuaacucuuuauucuauaaguuuccuugauaauggugauuuauuacagccaugaaaaaguaacuaauacacaagcuagucauuccagccaugauuauccuagaccaaacuggagccagaaucacugggacugggaacagagcacagccagcagugguggggaacagcagcuacuggccaugcacccagauagccugguaaagcucacucaguacaaugucucacuuuuggucacaaauguuuacugcuccaagccuugaaugauggagaauuuguuacacaaccccaguucacugacacauaacaguagcacauaccauauaggguauuugaacaaaugauuauguccuuaguccugcucucuuacuucaaaacccauagacaucauagagcucuuuauguagauaccaaacaaaugaaaguaauguugaguuaaauuuuaaaggucuguguuuuuuuagguguucauuugcuagcugaggaaauucaacccuuaaaaucccugauccugaguuuguacaacggaauaagaaaaauggugacaacugcccaucaaacacagucuuuuccuacuccuuagacuaaaaaugccaauucauguauuuaacaaagaguccaggagaugcugaagacuuugagacaaaugaaacacaccugacauacgauauggacagugaaguaauacucagagauugagugacaggugaugucaucagggcagcaguggaaggagaagguggaaauaaacagcacaaggaggaaaaaagaaaggggaaggaagagaauggaagagaugaaaauggggaagcagggaauuggaaagcagaggaagccaagccaagcacuacaugaauagagccuacagagaaagcauguuaaggcaagcugacagcucugugcugcccacuggggcucaucuuuuagaaggaaugcuguaucuaacuuuggcuuuaaaaguggccacuuuuuaagcagcaugaccuugggaccaugcugcucagaugcugcuugacaccccagugcccauaucaacaagucauaugagggguggaaaauuggccacuggcuuucuggacguuugcuaacauuuggaacauuaaugucccaccuagaaugucaauguggaggagcucuugcauaaauuuuagaaacccgagccauuagaaggaugguauacauguggguguucauauuguguauuucauuuagaugauaaagaucccuguaugccugcaguggacacacacacacucacucaaauaaaaacuaaaaauagaaaaaaaguuauauggaaaucuguuacuuucuaagcucauuuuagaaaugaaaaagaaaauauuuuaaaaucucaugaaaaaaauaagacagauuugaaaacaaggcuuucugcaauaaggcuguugaagcugcauuuacagggggaaaagacuauacaaucucccaaauaacaucaaaaagucuuucauagaggcccauggugcuccuucuaagagaucuuggaaguacuugcuuacagaggugacuggagcaagcaaugggguagagcaauugcaucagguuagauguaggacuacacucaggguuccccucuuuccucccccaacccucaccagucuuggaagucuugccaaggagacugugauuuaaguucacuggguuguuccuggcagccaagacaccagaagaauucaucuguucaaggugaagaggcaucugggcuugaggcaguaguuggaagcugcgauggaaacauggaacuucugaaucagggagagaucauggggcagagucagaguacagcacgccaggcauggcugugauaauucucaccuuggucagggacaagauuaagaguguggaaguccaggugccuaugcugucccauggagucauucagugugcuacuagauagccugacauaagcgauagugacuggugauggcuagagccugggagacaggcacuucuaauuagaacaguacaacauuaagugccagccaauccucugcccucagugcuccucuucccgugugcccauucuagaaauuaauauggauuaaacucaguuuugggacuaacauucucguugcuucuguauauuggguacaauggggcuauggcaaggaacuagaaugaaagugauuauguguuuguguguguguguguguguguguguguguguguguguaugugaguguguuuucagcauagaggauggagggagggcuaccuacaagaacuacuaagaacuuagaccauucauugcccuugaguuuaaaaccaaagauuggaaacauucuaaccuacugauagaugguuaccucaggucuccuucuuaggaucggcacacuuauuucuuccuagacuucuggccuggagucacagcagaaaguacaguuugucccaacagcacuauaaugcccaucucaccacuaccuccaucccuucagggcugagggaugcucaacuccccccuaaguguuuaccacacaugcauugucauuuaauuguccagugacucccuaugaugggaggaggcauuugacuccuguauuagucagguuucucuagagccauggaacuuauucuauauauauuaagagaaauuauuguaaugauuuagaguccuuaguccaacuaacccaaccauggacagcugcgaaugggaaguucaagaaucuaguaguugcucagucccacaaggcuaguuguuucagcugcauaagcuggaauccugaaacagaugugcugguaaguaagcgcaagcaggcgggaagaacgaaccuuccuucuuccauuguccuuguguaggccuccagcagcccagauuaaaggugugugccaccacgcauggaccuaaacuguucuuuuuuggaauaugcuuugucccaggcuggccuagaauucaaagaucugcuugccucacucuccugggauuaaaggaguauacuaccuugccugagcauaagguuuucauggcuacuacaacucaagaucuggaucacagacaugcccuucauuucuggguuguaguucauuccagaugcagucaaguugacaaccaggaauggccacgauaccucucaaguuugcacaugaagaaacugaguccaagggccucagaggcaacaagccacuggccuacagaaguaagacuccagcuuccuaguucuuuucuuuugcccuuccuguagcaaacaaacccacauucagcagaauguuaacuuccuguuuaaccagagugagaucugcugagaccuuguaagguagaaacucccuggaaacugcaaagagacguacauuacaaaaacaaacaaacaaacaaacaacaaacaccaagcagugacaacuaacuuucuguggcugccauccacagcuggguccacuguauggugcaaaaucagggccaaaccuuuagagugggcaaaauaaggagcacaucuaagauaugacugcuguaccccauauuaaacaugcugcaccccuguacucugggcauguuguaucuacacucuagacaugcugcaccccaauacugugggcaugcuacaccucacauuucaggaacuacuccauacugugagcauguuacaccccacacuucacucucacugugacucuuuaguaagccgcauugucuggauauccacaaugguccacgcuggggacuaauugaaaaaauaaaggaaugaacucagccugucaagacuguggcuggagguggguagggagcaaacaaacuggcccagaucuggccuaucuggccauggcagaucuuguggggaaagucagaggaggagagaaggaaggaacaauagacagguggcuguauuaagauugugaaggcagagaagaacucucauguugcauaucacagagacacgggcacaucguguucacugcugcagaauucacaauagccacaaacggggccaucccucaaguuuaaaaccagcacuuacugaaauagcaagugucucccagugaaccucaugugauuuggagcacuauaagacagcauggccucaaugugcucagaacaucucuaaguaucaggugccauucugagcgcauguucugaccacagauauauagaauuccacauuggagacacauuagaguugucuagaaccucagcucugggacaaucauaagaacugaguacaagagagggcugggcuguaauguggaccuuugguuugagugguugccuaagccugagcucagugcuggucaccaugaguuugagcuuagagagguucugagccaauauggccgcagaaggacugagcacacuguagccuuucuucuccccacaguccccuaagauuaaaguagucacuuuccacuuugcuuggcuuucuucacccuauauauuuccaauuacacugaaaagaaaacaaguuugugaauacauuucacggucagcuucccuggaagauguuccguccuagaaaauguucauuuuaaaaauguaucacuuggaacuaaagacucauccucaagguucuugggucagcuccaaaugcagaggacuauggucuuuaaaggucagauuugucaagaugggacuuguuauuaguacauggggcaaguaugcaggucagcucccaggcuuaucuuccccaaccucugugcccacagcuguguucauugugucugagccaggauuugugagacauuuuauaaacauuuucacugcucugccauuuuguuuugcuuacaccuucuggaaacucuguagcucauguagcucucauaugccaggacuaucucccugccagcuguacagugcaccugcuguacagucgccuuccucugggcuccagaugcccgaaggcuugguaccaugucaucccacuuaaaucuuuucaccaacagcaaagcguaaaaggagccauuccuuuaggguuguuaguauaacugccaagaucugauuccauaucauaccaggagggcaaucacaucaaacuuauaccuuagaucuggacucaggggaucaguuccaagucacaaauauaaaaagcacaucuggcuucuccaaaaugacucagaucucuagagaaauacacaguaaacacaacccaaaguauuugguucuaaaaacagaggcuagccuugucauacaauaggacagaggcuagccuugucauacaauaggacagaggcuagccuugucauacaauaggacagaggcuagccuugucauacaauaggacagaggcuagccuugucauacaauaggacagaggcuagccuugucauacaauaggacagaggcuagccuugucauacaauaggacagaggcuagccuugucauacaauaggacagaggcuagccuugucauacaauaagacagagguuagccuugucauacaauaagacagaggcuagccuugucauacaauaagauagaggcuagccuugucauacaauaagacagaggcuagccuugucauacaauaagauagaggcuagccuugucauacaauaagacagaggcuagccuugucauacaauaagacagaggcuagccuugucauacaauaagacagaggcuagccuugucauacaauaagacagaggcuagccuugucauacaauaagacagaggcuagccuugucauacaauaagacagaggcuagccuugucauacaauaagauagaggcuagccucugugcccucaacauccacaagcucuacagcugcugugagagauaucagaggaaucuucagaaugaaaacagagccuuucuguagaccaugagucacagaaggaagaaugguugcaggacgucaguaaggcuuccagcaaucuguucauuuguccagguguaccaacaacgugcaggggaaguuugagucuuguuguuucuucugauguuugcgugggggaagcuuucagggaaagccucaucugaccaucagcaaggaaaagaaaacucuacccaaugacagcaaagcucugggaugcaugccauauuuaaagggauugucuuucuaagacuuuucucuaggcauggccuuaaaagugagggaaugugaauacuggcucuccuguauuauucauuacauaauugcugugcuuugcuagaaauaugaucuauuauaaccuugaauagaguacauuaaaugacauugaaaauuagauuauucugauuauuagagaagugagaaacgugcuaaacauuuauaaggcugauaaucaaucaggguauccauuugagugcaauaaaaauaaaucuggagcuaguguauuuaaaucuaauuuuuuaagcaugacauuuucuucagaguuucuaucuaaaaugucaccaucuucuagaacagcuaucgauucugucucuagggacaagcacucacuccaauuacuucaaccacugcacacaaacccuaguccaccucacagaagccaaaugaaucaugguaaaacaacaugcuuuauggggggggcacaguuacaucacuucagcuagaaggcugcccuucuuucucugccagacuuaaauggacagggcaugcuuuuaaaucagacuguggcucuauacguucucuaaacaaaaauggcuauuuucauauugaguuuuuacucuacugagaaaaaaaagauggauuuauacugccuugcccacagucauugucauuagauauuuucagagaaaauaaaugaugcauugacugccuuaguuuauccaucugccuuccaucugcugacccauuauccuugcacuacaagugugccuagcaugauggacagacaaaaggccccuuguccagacuaaggaacaggaaggcaggaugugcuggggcucauaguugcagggguuagaguuguugggagggaugcaguggugaaaggaccuucuggucagcaaagcccucagagaaggcagcuuuacuucucuaccugcugucagaacaaugcaagcuuugggcacacggguucugaaagacuccugggcacuuuacugcaagcuaggccugaggagaauggccugcucucaggcaauucccauuuucuuuacaaggaaggaacaaagacauagugaaugggcuagcagaacaacaacaacaacaacaacaacaacacaacaacaauaacacaacaacaacacaacaacaacaacaaagaggcucacagaacaaauggccugaacuucuauuugguugaagcauuggaauagcacuuagggucuugaauguacuagacacucuauacuugagcugcaccgcaaccucuucuguucccuuucuucuaucccauuucuccuuccagucuuuuccuccaguccuaggaguugaacuuauguccuugugcacacaaggcaaauauucuaccacuacaccccaguccuugccuaccuuuccaucucuuuccaucuuucuuuucuuuuucccuuuucucuucccuuuccucuucuccuuccccaucuuuucuuuucccaguuaccaaggauuaaacccagaacuauguggauguuggauaaauguuccaucugccagcucuguucccugcauuucuucuauccuauuaaaaucagcaauuccagugaauugaaagaagcuaugacaaucaccaacucugucacaggcugcuguuugauaagccaaccaaagaguacagacaaaaauguacccauugcugugugaggcaaaguaaagguauuuggagguagauauucagggaagcuaagugucucuugggaacacucugggcuaaagaaaggacuuacuggauagcuccuggggagagauggagauuaugacaaacaggcuauacaauagcuucacccccccccccccccaugcucauucaugaaaucuaccagcagagagaagcugguccuaggucaacuuggcguggucugccagggaacacaggucugagaccagcugcuuuaggugagcuuccagguaggaggaguugagggucccuaucucaaaugacuguggcaaaauugugcuucagguuuuguuucuuuuuagacuuuggaagcauugaccuaaccaugagauuuuggaggaaagaacucagguuuaaaugggaaacucauguauguuuucuaugcuuuacacucccagccgaaaaguaauuucaaguuagcuuuugugaaauaaugguuuucuuugaaaagaaaauuaucauuuaacaaaauagagucauacacugggugaguuggucuauguguaauucuagccuuccagauuugaggcaagaggaucaugaguucaagguuagucuaggcuacuuaacuagauugugcaccccaaagcaaacaaacagaccaaauccucaauaaaccaauaaauaaaaauagcaacauaaucucacugaagacugggaaaguacugaaauuuacaaagaaagaaacagaaaucaugaucuauccauguucauauuugauuuauucuuuuucuuuugauucauuccuuucuuuaaacauaaaucauauaguauuccagaucucggaucuuguuuuccccaccuuagcaccaugaacacuucccaugucauuguacggccuuugagcacuccuugcaaugauacacagcauggcacucucuucacugcguguggacugauuuguacaggcuuuccccucugucaguccuuuaugauaucaucuguucugugcuuauauaaaaacuguuccaauggguaucuuugacaucauacugggcauuuuaauggucuccccuucucccucucucccucccucccuccaaccuuucuucuuccuuuguuuccucucgcuucuucuccccuuucccugucucuuccucucuuuuuauuuucagauaguucuuacuauaauccaggaaauuccuauguagccuagucuggccuugaacucaaaaccuucugucugccucagcucccugaguacugggauuacauugugcacuucaugccugggucugauguuuucugugaaguguuucuaggaaagagguuacugaagcuuccaaaaggcaugagcacagcacaguguccaguguccaguguccagcuagaauccagguguuucagcuugcugcuuaccuuucuuugcaaacuguggcauugcuuaucuacaaagaaagcuugcuugugucuuuccaugguagucuugccauagcagguucccugcuaaccacacugacagggcauuacuuaugagccccuuuggucaugccaccauuccaucauucuguuauccaugauuguaagccccauugcuggcuuacaaguucgcccauugggccacagauggccaugacaauguaaucugauuauacgacaauccauggacccuuuggcuaaccucagcccuguugcauaaacagcccaacuagggaguggacauccaggacuacagugauccugacagucagaagaggacauauugggauguaugcuugacuaguuugucagacuuagggagcuguccucacaagccagaaagucuuuacaaaccauuucuuucucauaagaacuaaucaggaaacucucagaaaccuauucccacacuucaugagcuucauucuuuagaguuugcuguuuuacuuguucagacucaaagccuuauggauuccuuaucuaucugccaaccauaucucuauauguguacccaugacugacaguugggcagacaauucuugguuugggggagaauauauccuguacaugcaagauguuugguauuuuccuggaucaagcuaccagaagccaagagcuggagcuggaauaaguuaugaggaaugcaaagaccuggagauuacauggaagcccaggcauggagcaauacuuuuauuccaauuguuugaaaauuccucuaugaacauucacaauaucauagccuucugugcugugagaguuccaaggcaaguggguguaaagcucuuguaguucucuguaaggucucugcaagagagaguuaggauacuggguaaauggacacagaugcagaagcagaggaggagcugacuguuugcagggugcuugcacguggagauauuacauuggaucuuauacuguggcuaaauuccagcugucucaagucauuguccaauuaaccaggaucaaacgaaugaaacagcuguuucccagcagugaggaagugagcucagugucugcccuucguccaguaucaugaugccccuaggucaagggcacuguuacccacacucagcagcagaaccauuguacguccucuguccccucuuuacauuccauucuuguagccuugggauugcaucccuuccugccuucuaggauccauuuugaaccaguuacccagugccuugcuauaucaggcaagucuccacucaggagcucugcccugcuauuucuucuccacuuugagaaacugcuggggauguuuuugugcaccguguacuugaaugcugauuucuguaccccagagauacagacuuugcuaugacucaguauuuuauaaaacaugguucuccauuuuauucuaguuaauaaagaguugauaagccuauaauugggaagaagaguuaagucagggcuuccaaucccagugaggggguaccaugugggugaagagagaguggaguggccagaagagagucaccaggagaccauggauggaguagccagggcagccagagcaagaccaagauggcagguaaugccauauggcugggaaguacaccaggacagcauaauucaguuagaauagcucagaaucuucccagguauagcacaugaaacguauacaauaaauauaaaggucuccaugucaauauucagguucaggaaacuuuccugaagacauugguaccauuugcucucucaucucuaggucuuuagucaaauauggcuuccuugagggcuucacuguccaccuacuaaguaaguaauggccaucucccuccagcacuugugcagcaaguauuucugguuaacuuuagugauaccuuacccacauacucugucucccuccacacaggugccacuuccacaguaucaggguuuguggucuguuuuguucucuucuguauucccagagucuagagcacugcucaggauauauguaaacaugcaacauguguaucuagaguaagugagugagugaaugagugagugagugagugagugagugagugagcgagugagugagugacaaacaagcccagcugaagguggauggcaguuguuuucaccuugaugauaagcagauggcugcacagaaaaggccuuuugaauucauggugcauguuucagcucugcucacacugaacugaguguaggcuccuaguucaaggcagcccagcacuggcuuucuguugcaaagacccucagguuuuuuguucaugccucuguggccagagauggggucugaucagucaugauuccuauaaauaggcacaguagacaucuugggccuuuaugaaaaucccaacagugcuuucaaagagagagagagagagaguaggcuccaaauagacagcaaaggcuagagccucaacccugcccaccaugauccaguacugagguguuccauggauguuauuucaugauccuuaaauggaauggugagacacagcuuuuuaaguaagcugaccuuucuuauuaacugcaauuccugagcuggaguccaauuuagaaaguugcuugacacaggacccaggcagccaccagcagccaccaccacuuucucugcaugaaagcaacgaagcagcaucugaggcagccuggccucugcaguccugguuaugcacacuuacucauuccccaccuucuccuccuacucucuuuagauggcaggcuacuugacagguauagacaaagacaucaauggcccugugcacgcaguacaagguauaagccuuaccuaguuuauggugugguccaagguuggcugaaguguuaugccuguuacaaggagguauuacagagguagucucuccagaaugaagggaaagaauuccuuccacuauccucgauuucaaauaacgcacgagaacccaaucccuaaucuagccagcagccauuauaguggugucugaaguaagaugggugcuaaguaauuuugauaggaaauuuuucauuaguuaggcacuguauuuauuuacuucagccccaagcacccagguggcccugcaguagaagucuaaaaucucgauuccuaacccucuaagcuacuucaacaaacguucacgauaguuucaucuggagccucagccacauaucagagcacagugaagucacuaacuaaacuccagccagcagaacucucugggacucauacucuucagagacuucugauggguccugcacugucuuaaacaccucacacuccuucugucuaguuuuaagcacacuggcauucagggucaugcugcaugugggucugcccucucccaucgccaccucugaccuuuuucuccucuucugucucuuuccauguuuauccugaacuuuaucuucuguaagacacagaacccagauuuuguucccuuugguuuacaucugucccucaguaccucaugcaccacugacaguaaguagaugagcaaccccagcagccugucaaggguauggucaggguuucuccuuucacacccuuauauaaaaguuuuauuaauuaauuugaggccagaugaggcugcauagcaagaucuuuguucaaaaaaaaaaaaaaaaaaaaaaaaaaacaaaguucuauuguggguuuagaaauaggugggucccaccaaaagccaaaagacuuuagccugaagccauuggcauuccccuuauacaaucaaggucuggccauuuaaggccuguauuuguucccgugcccauccucagcuucagagaaaggccuuccucagauuuacaaugcacauugccugaaaaagguggccaggugcuaagacuaacguuggggcauuuuugaaaccaugcuaacagaaagcuauagaagaaacuagagacacuugauuuggaggagauuucaguggugucugcgccaaguucuggaacuuacuuucagcaucuuaaaaaaggugaaucuaggaccacugaugggugagugugcugugagaauggaccuaaucaucccugcuaaacucagcuaacacuguaauauauuccuccccagauacccagcugccugcuggacggauuuacaccaggggcugcagggugccccccaggccucugcugauccuuaugcuuugguguaguuagaaccuucagcugccuuugcacaggcuucugguaucuaaaugucuucauacaucaggggaacucagagucaccauaggcuccuuguuuguuguacuuuccaaguuugugauggcagacuacaguugcugggacaaacgccugaccaaccgcugaagugaagggagggugcauuuggacucaaagcucaguacaccauagaggggaaggcauggagaagcagaagucaggaugcagagaaaaaucaugucugcucucucagguuuccuuuuucuuuauuauacuugggcccacacccacauaugagguggcaauacccacauucaaggugggucuuccucccuuauuuagcccucauugacauagaauguguuuuauaaauucugucaaucaaguugacaagaguaaccaugacaacuguauucaaaggcaucugcuuaauugaaaaaaaagguuaggucgguugagugugacaauguauaacugcauucccaaggccugggagacaguggcaggaauaugaggguucaaggccagacuggguuacauuagcaagaccuuguccgagaaaccaaacccaauguugguagcuaaagcuagacuguucacaagugauuuuuuuccucugauucuccuaugauuagcauugguaaauuucuggaaacagccaucacaugcuaucaacugcuuugaacucucugaguccaauaguauagggcuggaugcucagucucucucucucucucucucucucucucucuuccucucucucucaaaacacacacaaaacaaacaaacaaacaaacaaacaaacaaacaaacaaacugaguaggaccaagugagcagaggguugcuguauuauuuguuuuccuacaaccauggaaaugaaagaccagacuuuccuguucaguucuaaucugcauagacaaacaccuucauaaacaguaaaggcagacuggagcaaacaaauugguucuugauucuuggaacaaaauaaagaguccagugcuaaaaaaugucugcugcuagcagcugucucuagcucaucuucuguguacagcacuauuucuguaucaccaaguauuucuccucccaagcagcauggccauaaaguaaagugaucuaaaaagucacagcuguacagucaagcgccugaugagaauucaaacugaagucuuguaccccagaguccucauccucuucugauaaugaaauggauucaguggaauuggcugggucaaauuauacaauaauggcaauuuuaaaaugcugagaugagccuugucuuuugugcugauagguguguuggaacugcaaucacaauuuuacccaaaguccuugaacaaucaaaaacuugcagaaacacaaaaguugacucuauacuugcuaaauucuccagggagauaugcacaguccuggaaaaucccauauaugaaggguuuucacuacucauuugauuuccuuuuauauucauuuauuuauguuuuuucauuauuaacuuauauagagguaauuucuuuuuuauuuagauuuacuuaauuauuuuguuuuuuccuuucuuuuucuuucuuuuuuuauugguuauuuuuuuuauuuacauuucaaauguuuuccccuuuccugguucuccccaccccccacccccaaaaaccccuaucccauccuaccucccccuugagaguguuccuccacccacccacccacucccaccucccugcugccucaauuacccuacacuggggcaucuaucaagccuuaauaggaccaaggaccucuccuuccauugaugcaugacaaggccauccuuugcuacauauguaccuggagccauguguacuccuuuguugauagcuuagucccuggaaucucuugggggacugguugguugauauuguuguccuuccugugggguugcaaucccauucaauuccuucagaucuuucucuaacuccucuauuggagaccccuagcucaguccaaucguuggcugcaaucauccaucucuguauuuauaaggcucuggcaggacuucucaggagacagccauaugaggcuccuuccagcaugcaauucuuagcauccaaaguagugucugggcuugguaauuguauaugggauggauuccccaggugagacagucucuagauggccuuuccaacagucucuggucuacacuuuaucuccauauuugcuccugugaguauuuuguucuccuucuaagagggaccaagcacacacacuuuggucuuccuucuugaucuucauguggucugugaauuguaucuugguuauuuggagcuuuugggcucuuauccacuuaucagugagugcauaccauguguguucuuuugggauuggauuaccucacuuaggauauuuucuaguuucauccauuugcucaagaauuucaugaaugcauuguuuuuaauagcugaggaguacuccauuguguaaaugcaccacauuuucuguauccauuccucuguugagggacaucuggguucuuuccagcuccuggcuauuauaaauaaggcugcuaugaacauaucgaagcauguguccuuguauaucuuggagcaucuuuuggguauaugccuaggaguguuauagguggguccucagguaauacuauguacaauuuucugaggaacugccaaacugauuuucagaaugguuguaccagucugcaaucccaccagcaauggaggaguguuccucuuucuccacauccuugccagcauauccugucaccccaguuuuugaucuuagccauugugacuggugugagguagaaucucaugguuguuuugauuugcauuucccugaagacuaaggauguugaacauuucuuuaggugcuucuugacuauuugauauucuucaguugaaaaaucuuucuuuagcucuguaccccaauuuuaauaggguaugugauuuucuggagucuaacuucuugaguucuuuguauauauuggauauuagcccuccauuagauguaaaauugguaaagauauuuucccaaucucuugguugccuuuuuguucuauugacaguguccuuugccuuauagaagcuuugcaauuuuuugaggucccgucugucuauuguugauuuuagagcauaagccauuggaguucuguucaggaauuuuuccccugugcccauguguucgaggcucucccccacuuucuccuuuauaaguuucaguguaacugguauuaugaguaugguauuaagagguccuugauccacuuggacuugagcuuuguacaaggagauaagaauggguugacugccucuugaaccagcaccauuuguuaaaaaugcagucuuggaucuguuguuaugucucccuuuucaguucugauuuuguugauuaggauuuugucccuuugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuucuucauggaggcacucagagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccacgugaguguuggcuuucuguuauuuuuuuuguuauugaagaucagccuuagugcauggugaucagauaggauacaugggacaauuucaauauuuuugaaucuguugaggccuguuuugugaccuauuauguggucaauuuuggagaagguaccaugaggugcugagaagaagguauauccuuuuguuuuaggauaaaauguucuguagauaucugucagauccauuuguuucaucacuucuguuaguuucagugugucccuguuuaguuucuguuuccaugaucuguccauuggugaaagugguguguugaagucucccacuauuauugugugaggugcaaugugugcuuugagcuuuacuaaaguuuacuaccggaggauccagcaauaccucuccugggcauauauccagaagaugccccaacugguaagaaggacacaugcuccacuauguucauagcagccuuauuuauaauagccagaagcuggaaagaacccagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagcccaaaaccuaggauacccaagauauaagauacaauuuccuaaacacaugaaacucaagaaaaaugaagacuaaaguguggacacuaugccccuccuuagaagugggaacaaaacacccuuggaaggaguuacagagacaaaguuuggagcugagaugaaaggauggaccauguagagucugccuuauccagggaaccaccccauaaucagcauccaaacgcugacaccauugcauacacuagcaagauuuuauugaaaggacccagauguagcugucucuugugagacuaugccggggccuagcaaacacagaaguggaugcccacagucagcuaauggauggaucacagggcucccaauggaggagcuagagaaaguacccaaggagcuaaagggaucugcaacccuauagguggaucaacauuaugaacuaaccaguaccccggagcucuugacucuagcugcauauguaucaaaagauggccuagucggccaucacuggaaagagaggcccauuggacacacaaacuuuauaugccccagaacaggggaaccccagggccaaaaagggggagugggcagguaggggaguggggguggguggguaugggggacuuuugguauagcauuggaaauguaaaugagcuaaauaccuaauaaauaauggaaagaaaaaaaaaaaaaagaaagugacccuaaaaaaaaaaaaaaaugcagucuuccccccccccccccacuggaugguuuuaguuccuuugucaaauaucaaguaccauaugugugugggucauuucugggucuucaguucuacuccauucaacuuccugccugucucugcaccaauaucauauaguuuuuaucacuauugcucuguaauauagcuugaggucagggauacugauucccccaaaaguucuuuuauuguugagaauauuuuuuuuuuuuuuugcuacuuuggguauuuuguuauuccaaaugaauuugcaaauugcucuuucuaacucuaugaagaauugauuuggaauuuugaaaaaauugcauugaaucuguagauugcuuuuggcaagauggucauuuuuacuauauuauuccugcccaucugugagcaugggagaccuuucuaucuucugaggucuucuuugauuucuuuuuuuuuucccagagaguugaaguucuuguaauacagauauuuuacuugcugguuagagucacaccaagguauguaauauuauuugugacuauugugaaagguauuauuucccuaagguuuuucucagccuguuuaucauuugaguagaggaaggcuacuaauuuguuugaguuaauuuuauauccagcaacuuuucugaaguuguuuaucagcuuuaggaguucucuaguggaauuuuuggggucacuuaaguauacuaucauaucaucugcaaauagugguauuuugacuucuuccuuuucaaauuguaucccuaugaccuccuuuuguugucuaauugcucuggcuagaaagucauguacuauauugaaaauauagggagacagugggcagccuugucuagucccugauuuuggugggauugcuucaaguuucucuccauucaguuugauguuggcuacuaguuugcuguauauugcuuuuacuauauuuaguaugguucuugaauuccugaucuuucuaagacuuuuaucaugaaugggugcuggauuuugucaaaugcuuccucagcaucuaaggagaugaucaugugggguuuuuuuuuuucuuuaaguuuguuuauuuaguggauuaaguugauggguuuccauauauugaaccaucccuguaucccugguccgaagccuacuugaucauggugaaugaucauuuugauguguucuuggauucaguugucaagaauuuuauugaguauuucugcaucaauauucauaagggagauuggucugaaguucucuuucuuuguuaggucuuuguguaauuuagguauaaucauaauuguggcaucauagaacgcauuggguaguguucuuucuguuuguauuuuguggaacuguuuggagaguauuggugucagguauucuuuaaaggucugauagaauucuccacuaaacccaucugguccugggcuuuuuaauguuugggagacuaucaauggcugcuucuauuucuuuagggguuaugggacuguuuagaugccuuaucugauccuauuuuaacuuuggcaucuaguaucugucuagaaaauugcccauuucauccagauuuucaaauuuaguugaguauagucuuuuguaguaggaucagauuuuuuuuuuuuuuuuugggauuuccaugguuucuguuguuauguuucccuuuucauuccuuauuuuaucaguuuggauacugucccuacgcccucugguuagucuggguaaggguuuaucuauuuucucaaagaaccagcucuugguuuuguugauucuuuguauaguuuuuuuuguuguuguuguuauuguuuuuauuugguugaugucagcccugaauuugauuauuuccugccaucuacuccucuuagauguauuugcuucuuuuucuucuagagcuuucaggugugcugucaagcugcuaguauaugcucucuccaguuucuuuuuggaggcacuuagagcuauauguuuuccuguuaccacugcuuuuauuguguuccauagguuuugguaugauguguccucaucuucauuaaauucuaaaaagucuuuaauuucuuucuuuauuucuucccugaccaaguaaguuaucauugaguagagcauuguucagcuuccauguguaugugugucuucuguuguucuuguuggaauuuaagaccagcuuuagucaagggugaucugauaggguguaugggauuauuucagucuucuuguaucuguugaggccugguuugugaccaauuauauggucagucuuggagaagguaccaugaggugcugagaagaagguauauucuuuuacuuuaggaugaaaugcucuauacauauuuguuaaauccauuugguucauaacuucuguuaauuucacugugucucuguuuaguuucucuuuucaugaucuguccauugaugagagucggcuguugaagucucccacuauuauuuugugggcugugcugugugcuuugaacauuaguaaaguuuuuuaaaugaaggugggugcuguugcauuuggagcauagauguuuagaauugagagcucaucuugguagauuuuuuuccuuugaccaguauggaguauccuugcucauucuuuuugauaacuuuugguugaaagucgauuuuuuugugugauauuagcauggcuacuccagcuuguuucuugggaccauuugcuuggaaauuuuuuuccagccuuuuacuucgagguagugucugucuuugucacuguggugcauuuccuguaugcagcaaaauguuggguccuguuuacuuaugcagucuaugccguuuuuuugggggggaaauugagucaauucauguuaagauauauuaaggaaaagugauuguuacuuccuguuauuuuuguuguuagagauggaguuauguuuguguggcuaucuacuuuuggguuuguuggaaaauuacuuucuugcuuuuucuagaguguagucucccuacuucuguuguuauuuuccauuuauuauccuuugaagggcuggauuuguggaaagauauuguguaaauuugguuuugucauggaauaucuugguuucuccaucuaugcuaauugagaguuuugcucgauacaguagucugggcuggcauuuauguucucuuagggucuauaugauaucugcccaggaucuucuagcuuucauagucucucgugagaagucugguguaauucugauagguuugccuucauauguuacuugaccuuuuucccuuacugcuuuuaauauucuuucuguguuuugugcauuugguguuuugauuaucaugugacaggaggaauuucuuuuuuggucuagucuauuuggaguucuguaugguucuuuuauguucaugggcaucucuuuguuuagguuagggaaguuuucuucuauaauuuuguugaagauauuuacugacccuuuaaguugggaaucuuugcucucuucuaagccuauuauccuuagguuugguuuuuucauugugagcuggauuuccuggauguuuugggcuaggaucuuuuugcauuuuguauuuucuuugauuuuugugucaauguuuucuauguauuuucugaaccugagauucucucuucuaucucuuguauucuguuggugauaccugcaucuaugauuccuggucucuuuccuggcuuuucuaccuccaggcuucucucccuuugugauuucuguauuguuuuuauuucccuuuuucagaucuuuuccagguuuuguucauuuccuuugccuguuugauuguguuucccuguaauucuuuaagggauuuuugaguuucuucuuuaaggguuucuaccuguuuaccuguguucuccuguauuucucuaagggaguuauuuauguccuuuuuaaaguccucuauuauugucaugaaaaguaauuugagauccgagucuugcuuuuccagugugauaguguauccaggacuuguuauagugggagaauuggguucugaugaugccaaguaaccuugguuucuguugcuuauguuaugcuugcuuccugucaucugaauaucucuagugcuaccugcccuggccaucugacuggagcuucuccugccugugauccuccuugugucagaucuccucauaguccagcugucucugggauccugugauucugggauccuguguucuugggauccaggauuuaucagaguuccugggagucaagcugccucugggacccugagauccuggugugaccaaguucuugugauccugggauccuggcuguuuuagaauaccugggauuugaguuuccucuuagugcucugggccuggcugcauaguuugugcucaagguaaacuagugcaggcaggaaggaaccugagccacuguucaggagggcuuccugcaucccuggauccuaccuaucccaguuauacucaaugguguuggaacagauguuguguccuacucaccccuaauccuaagauccugggcgugcuagagcaccugggaguggagcuucuucuggguucugugggacuggcuucagaguuugaacccaaaguaaacagguguagaccagaaggcuagaggugauuucuuaaaggccuaugaaaacuuccagagagcauuccagggacacagggguuuuuuuuuuccccauaaaacaaggcaguuaacucacuaaaauagcacuuucuacuugggcaaacugaccuagauuuccugacauucacaaaguguccagagacagggcaugagagggguaaagagggauagaggggcaugaggcugggcugccaggcagcaggauucuuccuuuuguaauaggcaaacugugucuuaggcuuuuaagaagaggguugauggacaaauggcagugugauucagaguugggcucagagaaagggcugccucaucaauggagucacagcaaugcucacuagacagcaugucuccuccacacccauugucaagacaugggugggguagcaccuucauagccagacagcacagggucaccagagccucuuuaucacagugaggacgguccaggcagugagaaagauacugucauuugugcuaaugcucccacugcaaagcugaaggagcugcucacggcaucaggaauguacacuucacucaacagaugguucauacaugugcacauaaugcagugagcucaugcaugggugcacacacacacacacacacacacacucacacacacacacuuacccauauggcccacucaggucauauucaaacacacaacccauacugaacugcagaguaaugcaaucucaaggguagacuauauacacuugaaauaauuuaccagaacauaagcucacauuacucaauuagcuuggcauaaauuuaaagcauuaaauggcccucuccauaggcuccucacauugcuucuucuguccaaccuccuucucuuugacuacaccaagcuguccuuucaacccucucuauccucauggacuuggagucucuuguugauacaucucaaacaccucuggcuucuagggugguagugcccuguggcauccauccugccuagagaccaaacuuggcuuucugauuggaaggcaacuuaggaaaggccuuugacucacuuuucuccugauucugggaauuucauuucuuauucaauuucucugaucugugucuccaucuugguuagcacacugugaguuuugucuuccuuuuucagcccaaacugucacuggacagucgugucgucccguuccccucccccccuccccccccugcgugcagcuuccuuguccaagguuuccuaaaguucucacgccauaaggacauaccccaccuagaucacccauccaccuccccuuuaaccucaccugccucacccuuagaccuccaaaagggucucagaagcaucauuucuucuagaaguuuccaaugcauuuggucaguagagcaacaucuaucugcgccuugacuuuuaagacuaaauuuuaacuuuuuuagcuauaacaaaccuguuuuuuuuuuaauuauuuauuuguuuuauguaugugagcacacuguuguccucagacacaccagaagagggcauuggauccuauuacagauguucugaaccaacaugucguugcuggaaauugaacucaggaccucuaagaagagcagucagugcucuuaaugucugagccauuuguccagcccguaacaaacuuauugaaacaacgacuuugcacuugccuuucugggugguagccugacugugugggaugcagugaugaaugcaaucuaaggucccuguaggccucagggaaacuggaccugcucaguccucucaacauuuacacuuaaaauucucugugcagugggaggugagccuggcagguguugucaggguugagccaggacucuguacacuguggcuccagguuuggcuuaguguucuaaacagcuguguuugguaacuguguagccagucuuggcuucugugcuuguccuuaaaaugagguuagaugccucuacuucugccugguuuguuuccuacuauccacacaggcuuauaggucuuguuguuacagugucauacaugucacaacacaugucacauacauguauacaaugcacucacaaucacauccauccugccucucaagcuuugcuccugcucugcacccuaugcagucuuuccuucugucuugcauguccuuguccuccaaacaguuuuccuuucacuuucauguaguucuguaaaaguuagagaccacacugcagaggaaacaggccauuuguuucuaugugucuggcuuuauuucacuuuacauaacacuguccaguuguauaaguuuuucugaaaaugacagaacuuuacucuuuauggcuggaugaaacuacuauuaguacuacuacuacuacuacuacuacuacuacuacuacuacuacuaccacaccacacacacacacacacacaucuuuguucacuugucuguguacugcugugaacguagcugcagugaagaggacaaagauucacuuugugcuucuaacugaagacauuuuaaggugaaacagcagaugaggugaggcuugcagaaugaggcaagggugaggauggaugugggucacugcugugaccuuucaccuacuuauucccugccccuuagcugaguccagucagcuugcucuggguccugcugucuucuaugugcugaugcauuuuuccuuuacaucaaccaaaugaagaagggguuuguucucccgcuagagaggccaaaacaaaagaugcuaagcuaugcagccaccugccuggaguuuguccugagagcaaacacagaggauaauuuuaggcuguguaccucaucaccaggugagaccaucagcuggacauugccccagucacgugaccugacucaacagagagauuucuacuuuggaacucuuccacagucaucagugaagaaacagaagaccagagaaauagguucuaaaaugacugacccagagcccugagagauugaguaacccagagucaccgagccuagcuaacagccagguggguugcaaaccagccuauccuuagggaaaauugagcccagagagugcucccgucucucucccucuaucacuaaugugguaaauccaaucugcuguauuugguuucuccccaagccccacacauauccuuaucauucucauuugcucucuuggcaagcacagggaguaugauuucagcuucugggggacaccucugcauccucuuucaaaagagccucugggggaugccaggagacacagaaaagcagggaccuuuuucaguauucagcucuggucugccccuuuccucaaaaaagaccagauauugaguguuauucccaaauugaacacauagaacucuucaaaaaccacaacguuugaaaugugguugcauguguuuuauaaaguuucauuaauaaugaaugucaccucuguugagaauucaguauguaucuacgcagguaauacuaccagagaacaccuaaugaauaaaggagccaaucauugggcaaguaggugggacuuccggguuggauggaggaagagaggaacaggagagaguuagguccuuuuuggaaaaggaacagcagagggaaaagaugucugcugcucauuuuaacccacuauauaagcuaacagccuugugucuugguuagagucuccagugcuguuaauagcauggcuugaugaaaagacaguuggggagggaaagauuuuuugaaacuuacagcuuguagucauccagggaagucaggguaggaacugacagggaggugaucgaggagugccacuaacggacucaagcucccugccuugcuaagcuuguuuucuuauacaacucaggcccuagggguagcaccccuggaccuccaacaucaaugauuaaucaaggagaugccugccagauuugccuggaggccagucuuauuuuaauugagucccucuucccagauacacgagcuucugucaaguugacaacaagaaccccacgagaucaggacgccguucuaacacacauuuugcuuuaugugcuuacuuuuguuucugagacagggucuugcugccucuugcucucaacugcugagagugccaccaugcccagccugaaaagccacuauguguuggcagccuucacugcccugucacuaucuccuuccauaccaguauuucuaaggauucuaugaaacaaaucucaaaguaugcauaccagauccuugccuuaaagucuccuucuggaaacaggaagugccaucugauuguggucuccuuaucuucagcucacauggaugauuucauccguccuuuaacauauucccaauagggggagugauggccucuccucaaggauguuacagucuaaucuccagaauguaugaucacauuaugucacuggaaugugggaaaugaaguugcagaugugguaaggguuuucaugaacugcuccuaacauacgacucuccugguccauccaggugggaucagugaugucacacauccuuuacauugaagggggaggcaagagugcuugagucugagugauagagaaggcaagacuggacuagcuaugcuggccucacagauagacaggcacaacaagucagagaacuuggaaacagagaagaacaaggacuguagggccuccuggaaggaacacaguccugccagcugcuacuccagauccaugagcccugcuucaaccucaguaauaagcuugcauugguucacaucauuaaauugugguaauuguuaccauagcagugagaaucuaauaauccauacaaacugcagaaguagcaaguuugaaauaauuauugccgugcacacucuucaccuucuauccacuuccuucuaucaucucuccuccagcagaucacaugaguauguuaacaagcccacacagccuuugcugaguccugauuacacacuagacaacucuagaaaacacaagguuggugacacucucgggacauucccuacccagagaaacacugaaaaggccaucagcagccagaucacaccuagaacaggaaaaggagaguaucccuggcaucuuggauagcccaggguaagacacagcacaccuugaugccccaggguaagacacagcacaccuugaugccccaggguaagacacagcacaccuugaugccccaggguaagacacagcacaccuugaugccccaguguaccauuuuaauguuacccucugacagcauccucugcuguagaagggggcccaucuacauaugcuugcuauuuccucaguuuccuuuuuagaauguuucuacucacagagaaaagguugacuuaggcuugaaaucuaugcgagggaaaagauuuacuuucugugagcuccuucuaugaggaugacagcccaguuucacucaugguuuuuaccaaacaaucuccuuucagugucucaucuacagccuggcaccaccaaaaucggagguucugccuguccuucuguuuuguauagcauugcuagagacagucuuacacaaaacacaugcacacauaaacaccuaggacacacacacucaccuuuccccugaguuacuagacauguguguucuuuaccuugucaaauaauacuggcaaauuauaugucacacuuuguaucaauucacccuuugacuagugacaauaagauggcuauugcucauugaauuguaccauuggccaguuuaaaggggcaguguuuucuucugaaaaaccugucucacaaagaggggaugucaagcaaaguucagcuugaggaucagaucagauuugcaagagguuuccccugccuguuucuauuugaggacugagacuuuaaaaauuguggccggcccaccucugcaauggacacauagucugauuguauaaaguguagcauguaaaugcccagaaaugagauuuuccccucuaagccccacugccucccaaccuuccacaugguaggugagugccuuggaaggaaugugacucugacccggacccuuucugcaaggggaaguagcugacuuugaggcucagacugauugauacuaucugguagacugaagggcuggauguuacuggaguaacuggauggguugagagcucccccacuuuccccuauauuaguuacuuuauuacuuuucuuaucacugggaaagaagaaacuugagggaugacagguuuauuuuggcauacaguuuuuuugggggguuggggguggguacagccgugcaucauagugagaaagcaugaugacagaaguguagccuggcuggucacauuguaccaacugugaaaagccuagaugaagcuggauuggggcugguauacuaaaccucacagacccucaucacaucuucuccagaggaaacugagccugaaaggggaccauuaggagaaagugacauuucagcucaauugguauggcuagugcuggaagguccugccuacuuggaucccccugcugugccccaauuuucuguaacacaccccuauguucccagcccugcuuagucuuucuggagguuccaggaagagacugaaacagagguucaggccaacuguggccccaagucauccacacacugacuugagucucuugaaguccaaacccgaugaccuuugggaaucugggcgugauguccuuuggggguauaacugauaguuuuaaaauguuccucccccccccacacacacacuuuuauguucucagaguugggcagguucuuucagagaccucagcaguagguucugagcuuucuuuccaacgcccgcagacauucucuuuucucuggaccagcucccaagacauugccaauuagucacacaucacuguuuggcaagaacguccccaggcuucuggcacagccaacagagcaccuugucaaggccuccugccugacuuuuugugaaguccccacugcugaguaaaucagcacuccuuagcuuauagcugaggaggcugagcaggggugggggugaggcgugggagggggaacaucuaagaauuggagggaaguauuucuccugaggcuuguuucucuuaugguaugugggagaaaagauaauggccuacuguuaauuuucaucccuucacauucagcuuugccagaggaaugaaugccuggaacaucuacuuaccaagaugaacaaaacaaaauaaaacaaguuugucuuaagucacagggcaccacagaugcucucugugccacuuucucugugccuuuaaggcuguagacuacauuccucguggaugacauaauccccuuggcacacaucagucagccuggcccuggcuuaugugugaggaagguuuguucacacuuggagguugaacgugaauacagaguuuuacuaauccuguucuaaagcgaucagcuccauggaaaggguagugucuuguccauucuacucgggcuucucaagacaccccucuaaggacaaagccuccccacaguuucacuggauuucaccucugcuaggaaugaggcuacacccaggaaguagucacuuaaaaugcuauggaagccacguguggcaaugcuaaucccaacucucgggaggccaaggcaggaaacuaaugaguuuaaggccauccugggcuacaacgugagauugucugucaaaggauaaaaugaaacacaacaagaacagcaagaccacacagcaaaaccaguuuuauggaaugaauacacccuggaggccuccuaagcacucugauguugguaaggggauuguuugugcauggccagggguagcacucacuauccaugagcuuccucaucucuacaaggcacacucacuucucagggcuagucuggccaggaacugaagaaagugcuuggucuuuuggagccucuacuucuucucaugacccaggaacagugaauacagugaugugagacagaagguugcaggagagcccgugaucuugacaucagacauugaaagaugguggaaacaccauccagugccaaucuacccauccauacaguccacagcaauguaccuuuacaucucuuuuaaaauuuaagcuacauuuuuacuuuuacugcuacuacuucagucuaugcuagagucaugucaugcucucuagcugcaaaugugaucauuucuuucagaguucaucaugaucaauggcaugcuaaguauaaaaucagacccaucaagggggcugcacaauguccagccucugcacuucucuuuauaccuucuaacaacucuguaaucaauuucaucugggcuccagggagaguccagacuuacuccaaccccagccccucuucuggcugucccaucucugaccuuccacaugcugagucacaagcuuccucccuccuuucuccacuggccaaucccaaagcuuucccuauucucagcauaacccauuuaagaacuauuuuaugugcaugaauguuuugcuuguguguauacaaguucaccucgugcgugcagcacccacagaggucagaagaggguguuagaccccuguaacugggguuacaggugguuguaagcccaugugugggugaugggaauaaccugacuuguaacuaugacaaagucugcuguugucuaguuuagcccaucuucacuuuagaaugauuuugccaggcacaugggaccagauugugugugauuucauugcuacuugagccuagcacacagcacagagcuugcucugcaccgugcugucccucugccuggaauacauccucuaacacagugguucucaaccuuccuaaugcuuccuagcccuuuaauauaguuccucauggugaugaccccaacccugaaaucauuuuuguugcuauuucacaacuguaauuuugcuacuauuauuaaguaugauguaaauaucugauaugaagcaggauaucugauaugcaacccuugugaaaggguccuacgauccucaaaggcgucacgaccaaacagauugagaaccacugcucuaaugccucuguuucacccauauuucaagguccaccuucgcagacacccuuuugugacugccuugaguuagucaauugaucacuaauguucuacucuguauuucccuguguccuccaugacagcuguauuguacagcagugaugguaccagaccuacugcugucaucagcccaccagcuuuacugccuugaguuccaagaucacagagacucuucuuucuacauucacucucagcagaaacguugucucggauagaguucucauaacagauacugguugccuggaaaaacucaaacaugugaguguggaaaacugagucuugagagcuugaggaggauaagguacauuuucucucuauccugaagcaggggaggaagaaguaagcucucucaugucugggagcuugcuacugaggacagcaggucuaaggcugguagcaucuuccugcagaauaauuuuaugucaauuugacacaaguuaaggucaucuaagaggaaggaaccucaacuaaccaguaccccgagagcucccagaaacuaaaucaccaaccaaaggguacacaugaugggacucauggcucaagcugcauauguagcagaggauggccuaguuggucaucaaugggaggagaggcccuugguccugugaaggcucuaugccccaguauaggggaaugccagggccaggaaauggguguggauggguugguaagcagggggaggaaggaggggguaggguuuuuuuuuuagaggggaaaccaggaaagaggacaacauuugaaauguaaauauaguaaauaucuaauaaaaaaagaaaaaugccucuauaaggcuauauauauauauguguguguguguauauauauauauauauauauauauauauauauauauacacacauauauauguacauauauauguguguguauguauauauguguguauauauauguauguauguaugcauguauguauguguauauauauaugaaacacaaaccuauaaggcauuuucuucuuaauuagugauugaugggagagggcccaguccauggguaaugcuguccugggcuggugguccugaguucuauaagaaagcaggcugagcaagccauggugaggauaucaguaagaagugacccucuaugcucuauggcuucuacaucaguuccugacuccaggaucucaccaugcuugaguuccugcccucacugcuuuuaaugaugaaggauuuucuaaaacuuugagugaacaaaaccuuuuccucucuaguuggucaugauguuucaucucagcaauagcaacccugauuaagacaaccuucuuacauaauccucuucuuucuucucauaaucaguuuccuacugaguggagaggacccagacuuccacucugucuauccccuacgaggcacaguacaccuuugcauucuuuguguuggcugaccugugcuguagaaagacaauccaguauccagggcuugaucuuucuacaaugggaagaucucggugugcugcucugugcuguuuucauccacuuaucauuacacaugcauggacuuuuuugaagacuuuuuuucagauuauguuaugauguuauggaauaaacuaaaaaugaaaagaauucacauaaaguaugaauuggauuuugacccacagagucauaaagaaagccuauuuaagauguacacaggagaggagcaggaggaugcugggcaagagagcuggcuucuuauguuugguagucuucggggaaggccucugagccucuuaagugcgaaaggccuacuuuuucagcguaaccucagugccucaucucuuuucuagcaggguggagauggggcuuaucaaggcuuacuguaauuccucauggaguaagggucuggucaggguggugagauggcucugcaggcaaaagcacuucuugccaagccuggagacuugcauuuaaucagacccacguggcaugucaggagaagaacuggcuccccaggugguccugugaccccccacccccaggcugaucucugacuuccagcccagcacuaugacaugcauauugacucccaacauacacacauuaauaaaugugacuuaaauuguuguucuagaaaaagaaagguccugaucaaaucaucuuucagauuguacuuuucuaaccuucacuuugaaagugccuguuuccucagggugauuuuuuuagguaggugaaagugaacauuuaugcuaggugcuguacuaacagcacauuucuccaagaccauuggaacuuuuccugauggcuaacaccccaacucucuggaaguauguucuuaucagccacacuaugugggggugggggagaggcccuguuccuuaguccuguuagcaaaaugcggcuugaauacacugagaguucuccucacauuuuaaacaaugcuccuccuacuuacaauaaugcuccuccuacugaggacagggcagcaaagcaccacagauacagcacuaaccagcccugggcauagccaggacaugaugcagaauacuggagaggcaauuuucaaauugugcuuuauaaaggaaggggaaggagaaauuuuccuucuccaguuguuaaaaaugguccauucaacaaacaaacaaacaaacaaacaaacaaacagaaaaacaaagccaugugggaaugugaggacagaggggccaccacacucauugcucaggcuuucugcuugggccucucuggauucucccuccucacagggacguaagcagcaaggcguuuuaacaucaugucuagaaaauuucuaacgccuucugcaggaccucauagaauacacagaacaguuuuagcucuccuggagguugcugauuguuuauuuuauagcucagcugguaagaaaaguucuccuaagagcaggauucuuguaacaaagagaccuuccccaccucgacuggaaucaauaugaucaggaugaacuuaagccauaacuguggggaagaugguggcacugaccaagucauuuuagauccuguauuccagauguacuagauaggaauuucagccuuuccuaccacacuggcaaaggcagcugcuucugccaugaaggaaccccacuguggcaaagcuuaccuugcaccaccauggaacuuuggguuugaaaaacaaaaaucuauuuguagagauuuuauucaccugaacaucaacuagaaacagagacagaaagcuaaucacguucuuggcuaucccuggcagcucuuacugggaaccaguaacauucucaacauguagguccaugcagguccugauuccaccauauaucgaauauugguuuucugaagaaaguuuugacaaacucaaauguuucuguguguacaauacaagcccugcugaccacaggagcuuuuuaggcagugccauaaaauugugggcucuuuacacuggauucuaaugagcuguucaccaguuccuuacccagggcccgggaucagccagaucuuaccacuuaucaauacuccaacaugccucaagaugugcucaggugcaggaggaucacauaccccaguaaaagagguccccuaagaucccaagaggagcagugcauguaugaauaugagaagaaagugcaauuucucauggaagguuuuacugacugcaauacaagauguuauccucuuauuugagauuucaaagucuggaggagaucucccaggcauggggccaacaaccucgguguucacaugugcagucgugacaugguaaugugaccaccaauggucaccccaguugaugguuaaucuucacuguuauuguuauugggcuuaaaauucauuguggaaacauaccucugggcuugucuuuaagaauguggguuggacccuccuauaugcuggaguuuaagauggacuaaaaaagaggagguaaacugagaagcagcauccaauaucuccgugcuuccugaccagcugccucuaguuccuauggaugccuucccucugugauguauuagauccaaacugggagccaaaaugaagaguauuucucguuagauguuuguucacagcgaugaacaaaguaacuaacauacauccuagguauaggcacagcaaaacccugagugucacauucugaacuuugaucagaaugcuuguuaacacacuagacauguguggguauguccaugcccggugcacagaucucuucuuugcauuaacaaucugcugcucugcaaagccaaagcucaauaaaaucucauuucacauuucauccauccucccuaggaacugucagagcagcaggaauagcagaaggcagcuaucugcagguagagcucacacaccaguuugcuauggacucaugagucgcuugcucacacugguaaguuuggacaggaguugaugauuggggcacccucuaguuucauggaaucuuaucuaguagagaacuccaagacagcuggcugggccuuuggauaaguuugaaacugaaaaggguagggaaaguuccacaguaagaguaaccacauggcucauccucugcaagcagcccuucuguccugagcacucaagacaagaguucugcacuguccaggugaggcaacccagugcuugaacuuuagaagagccacauccuauccuccuugccagacagacaucagaaagaugcuuucucugcagccucaguacugacaaaauugaggcacgucuuugcuucuaaggcauuuuaagcuuaauaccuguuugcaguucuugaugguucugcugcuuuguuuccacaaaugcuccugaucaagaaaagagggugaugaguauauguguaguaagggugaugaguauauguguaguaagggugaugaguauguguguaguaagggugaugaguauauguguaguaaggguaaugaguauauguguaguaagggugaugaguauauguguaguaagggugaugaguauauguguaguaagggugaugaguauauguguaguaagggugaugaguauauguguaguaagggugaugaguauauguguaguaagggugaugauuauauguguaguaagggugaugaguauauguguaguaagggugaugaguauauguguaguaagggaggcuguggcugcacagugucaggaaccaugcagacuggccuaaguagacuuguuccaaauaacuucauguaguuuguuaaaggaaaugaugacagguaauugaagggauuugucaugagcuggagguuagugcuaaggccuguacaguuauacauaaguagccaccagaguaaggcaagccaaagugucauccugacgccuaccugcucuaacucuaccaggauuuccaccuacaagacgucucuucucucucuuauagaauuguuucagagccaacuucucucauugcccuuuuucuuucuaccuaucccuauccucuugggccuugagcaugauaggugaguggccuuucacuaaacuauucccagaaccaauuucuaacaaugcaagcuguugccaagacuauagguugcucccuacaaacugaaagcauucucuauuauugaacauggguaaauugagauggugccuuuuaagagccuuuacccccaugugccagagucuuugguagaaagguacuuugcacacuagaaaaagaggaaagaaauguaaacagcaauccagccacaaacccuuugaucuacaaugcugcccuaccuguaggauauucuagggcaauggcccaaagcuugugggaauaaccaaccaauaucuuauuugacuuaagguucacuuaacaagauggaaccucuaccaguacugcuugggugaccaagaauuugagacuagauagcucagagaccuagggggaaaccaaauucuacugguuuaaaaaauauauaguaaaacaugauuccuauggacaccgaggcaucacgaagcaaaugagagcaaauugcucccuguuucuguuucccagggcugccauagcaaggugucacaaacuuuuccacucacaggaacagauauucugcuauauucauaggucugugcuuucaucagccaucaugagagaagcuuccuucugcagcagaugggaagaaauacagagauccacauucaaacaauaugcagaaaguuagagaccucagagcaaccaauccuaaaugggaggucucaauguaauuuuuaccucagagcucagggaacuccauggaagaagaaagaaugcaaaagccagaggaaauaaaggacaccaagaacacaagcucucuaaauaaccaugaccaaagcucaugagaagucuggagacucaggcagcaugcauagggccuguacaggucuguuccacaugcacuccuugacuaaaaggagaaguggacacauguccccauccuuaaccagaagaaaucuccaauugauaaccacuugcaaaugaaauuuuaguuugcuccaagggagucucacuguggaaacaaacuacucuuaagggcaggcugcaugccuagaagcagauggccagcaagaguggacucagaggcaguuuuggagguucauugucucauaaugccaggucagaaauuuuccuuuuuaaaaaagaguuaauauuuaguuuauuauaaauaauauauuauuuauauauuaaugauaauauguuauuauauaguuauacaauacacagauuuuucuuuucucuuuuuggccugcugguccuuugcauauauauuauggcuuccagcucaguguuuuaaugugauuccugaguuuguguacagugugucuguguuucuugugccuuuucuugggcucuuuuuccuucuguuugucuguuuguuuuaugguaucaugauauguuaguuugguuuuaucauauuauauuuuauuuuuaucccuuagaaaaaauaagggauuuuuguuuguuuucagugagagacagaaagggguagauccggaugggaggcaagauagggaggagcugggaggagcagaaggaagggaacucauaaucaggcuauauuacgugagaaaaacaagauuaagcucauuuagucaaagucacucuuauuuuggucugcaaaagaccuaauacuccugagccuauagucucaucuauguuaaaaagcaacacaaguccagggugagcuacauuuuagacaaaacaaauuucuuguuuuuccugcaccgaaaaugacugggguauggcuaggagagaauuauguuuaaaacaucuaguccaaaguugaaaucauaaggucucuguuaaauuaucacaugucaagacauguaagccaguguuacuauguacaaacugggcauagaggacagcuucaguagugagcuguaaauacaucuggcacagaaccaaauucucauagccaggguuuaaauuauaaaagaaaaaaaaaaacuuaaggagagugaauugagugcagcagggguuggcaaacuucuuuuauguagagccaaauaguaaaugcuuuaguccuuugcagacuaacagcuuuagcacaaauccucagucucaccucacaaaagggaaauaucaguagaggauacaaaaaggagcaugcaugguugugucccagugaugauuauggccaaaaccuggugggucugcuuaggucagccuauugaagccacugccauggcuugcuacagugagaucagugugaacaauacuauagaucacacaugguuuggaugcauccccaaggguccauguagugagagucaguggggcaacaugggaaauuucaggccguauggugauuauucaggauccuggagaucugacauagcucuugugagccuucauuacauuucauaacacaguuguuaugauagcaagucuggcuuguucuggcuccuggucuugcaugguugaucccuauuuuaaagccaccaugacgagacaaugccagcugucauaaagccuuuacugcaacuaagcucuaggaacuaaacccacagaacugugagcuagacaaacuucuucuuccuuccuuucuuucuucuucccuuuuauauaguaucuauuuauuauagcauuuauuuauuauaguauacaugugugugcaugguuuacuguguggguuugugugccauugugcacaucugaaggagaucagaagacaacuuuguggagucuguucuucuuuucugccuuuacacaggcucuggggaucaaacucaggucaccagacuugcccagcaaacaccuuuacccaugggcucaucuugagcauccaaaccuauguucuuuauaaaaccuugccacauucuacccuuacacuaauggaugacagaggcauacacaggcuacccacagauaucgagauaugaaggaauggacagaguccauguuauaggaacaaagaaucaaggcagaaagagaucugcagagcuuuccagccaaaucacugccaaaagauuacuugaaguguuagaaaaucaggaaaacugaaauucuacuuuagauuagccugaacucaccucaguuccuaagacugguguucauacagcauaacuaagaagauuuagcauuuugagauacguuuucuaagcccuauucauuuuuacaaaugugggaauaauuuguaugugcuuucuauuuaccuuuucuaugacaacagggugagcuuuucuuagaugaaaaacaaacauuucuuuuaucaucagucuuaggaaaaugcaaaugaaaaccacaauugcugcacaccuaauauugucuaagauuaagaaaccaaauuccaagcuuggcaagguguggagaaacuggaauacucccacucuuggugggaugcaaaauggaaaugacauuauauauagucuaguugaucaccuuuuauucaaauuaacaugucucuucuaugacugaguaauucuauucuuggguaaacuuacaagaaauaaguaccuauacucccuucccccaaaauauaucagauacaaagauggcagcuuuauucaugauaaauccaaauggaaccccccccccaguaucaauuaaagugaaaagcacaaagauguuaaguagacuauuacugaguacuguauacaaaaaguaguauacaaagaguuuauacaaggguuggagggaugguaugggguuuagagcaugcaccacacuuguagaggacuugacuuuguucuaacaccuauguuagaugucucacaaccaccuauaaguccagaucccaagggauccaacacuuucuucuggcuucccuccauaccugcacucaauguguauacagaacaaaucaaggacuauaguaugguccacaccggaagcauucaaaacugcaagugaaauggagccuuaaaccauagacaaggacacaagacagggagacaaaaauuccuccugaguagggugcagugcuccagccaauaaucucugugauuuggaggcugaggcagaggauugaaaaugcaaagccagucuuagcaguguguuagguauuagucuccguuacgcagugagacuuggucucagaagagcagaggggagagggcgaguacuugcuuugcacaugaacaggucuaaguuccaucccaaccauaaacagcaccugaagaaacuauuuaaggggagaagcucuagagacaugacgccauguucuuggagacagcuacuacccuacaggacaaggagguguggcuccccuggccccuuuguggcuguagugggagguguggcuccccuggcccccuuuguggcuguacugggagcugagacugacaguguacagcuccccacaaggcuccuagguguuucuuuaaaggcaagauccucuuucucaggguaacaccauucucagcuccaucauagggauuaguuuuucuuuuuaaucuucaugaaaaugcuaucccagaguuccacagaauauuuauccuccuuucugaacuugugcauucaguacaauguaucuuuuuuuuuuuuuuuuuuuuuuuuuuuuuuuaauauuuuuuauuagguauuuuccucauuuacauuuccaaugcuaucccaaaauucccccauacccuuccccccacucucuuuuuuuuuuuuuuuuucauuuuuuuuuaauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggaguacaauguaucuuauccauaaaguugguucuuuuccacugcugugugcaucacaacauuugacaugucacagugugugaauaucucuguguguguguguauaugugugugugugugucugucugucugugugugugugcaugcauguguugguauauuaggcuauucauuucuuuuguauagauagcuaggaguagcauucugucauauuugacuuuagagaacaaagccaaaugguuucguuugauuuauauuuccuccagccacaaauaagguuucuguugaugucaccucucaccaacucuccccuuguaggucucuauaggguaguuucaacugaugacauaauguuauuauaaggaacacauagccaccgagaagauacuauuaaugccuucuaaagaccauccugaggacuguggagaaggccauuuccaagugucuguugguccaggaucccagcaggagcccugacaguccucucccuaagcuaaccaccagcagcaugaguuacuggggacacguacacaugaggcagugauguuuuugucuucagggaguucaaaguucacaggcuccacagccaaguuuccacucaguugaaaauuguuccuacacacaggcaacaaaugggaaccucaacauugcacacuugauucuccaucaaaccuggaccuucccggucuauuggucuucucugagaaaguaugcuacuaaaucacuccauuuugaacaggcagugaaauuucucaguacuguuuuaauauuuacuguugcaaaaucaaaauacaguuagaaaucagauugagugaugggguaugucuuguccccacaaauaaaaauggacaauggugauauaguccuauaauguaauauuucuguccuacaaucaccuugaaaauaaaacuuucugcuuuauuaaaccaugaagggaggguacacagguaaaaugcauuauggggcauucaggaggaaaguucucgugaacaaaugcagugcuugcuuucccugguuccaauauugaacaugcccaccgcugcuccaccagcucuucagguaauugcucaauucugcacucuggcaggaaaggcagaguauaggagaagcgagcugagauaaucaauauuuuacaguggcaggaggaagggcuaaggcugaguguggugugcuucaagaggagacacucuagacugcucugugcauggcuuuauugagcaauuaaguugccacccuccagagagcugcugucaucugaggagguacuucugggcuucuuucaccccccucccccagaacccaggggccaaaggagaacuccugguugcuacuuucauggagguguuuguuuccaaacacaggccaucugccagcuauuuuugaagcacuugcauauuugcccagccagcucucugugcugagaauuauauuuggucacagggguuuuuaucaacgucuauuuagagcagaaugaaaaauagcucaagaugaaaucaguguuuccagccaagauuaugagcugcuccuuccuuccuacagggugggcauuuggucuccuucucuuuucccucuccuauuccaaaacugccugcugccuuucuuuagaguguccaaguuuaacugguacuacuuccuuagcagaaguauacaaaauauucguguaccuaaacaaauuauagauuuaacaaugugcuggguuggcaugcagguuuaaguggaggcaaguguguccugugggaaccaacugaauggugcucucuguugcuacccaccauggaaugaguaccaagacaucauuuccuacgggagcuucuggaggaacaggagagacaaaaguggcucaauguaucagugaaguuuaauauuuucuugaacucacauuuuauuugaaaucugugugauuuaaaucuccagcuuuugggaagaugagugaaaaccuccuaagugagaaucucuaguuuggaagcuugcuuucuuaccaaccuauuccauguucugcuaagugcaagguccugggcccagacuccccagguuuagagccagcauaguggcaacaaugggagggugucacuugccugucugacuguuucucugggguuugaaugccaucucaauagaggugucacuaguuuucauugcaucacagagaggaggcaguaacccaugcaugcccccuguugccugcaguuggaucuacuuggacccuuguucacaacacaggguggaggcagcccagagagaaagcaggggaaaacacugcaagaagaaaacacagcacagacuuugaggcuauaguaaauacgggacgcauugaguugugguguaugucaugaggcaagaggguggcagggugucaagauuagcuucuucuggacaccccucagcggccgcacugggaucuccucauguagagauacuugugacugaucugugagucacgaggaguuaucaguccugauacagcaucaguugguuucggguggaagcucugucauggcuuaggaguaccuacuaccucucuuugugaguauagagcuaaaccuuugggggcaaauuucagauucaagagaagcuuuuccuuugaguacauggccugugggguagcccagagcauuugcugcucuguguagucacagcacugcugauggcacgugcuacucagugguggccagguacaccagcaccauggcaggaagaauagaagauggcauugaugcuuagcuuaguucuguuuuuagcaucugccucguuucacugucuaccccuccucacaacagccacaaaucugaucuuaucuucaggcuauaaaugccccaaagccugaggcccaagauauuauggaauuuggcaagguuacauagaucuggguuuugagugugaccugaacccagucugcccaagagucugcuguaugaugucacacugccagguugcuccugggaagguagaggcaugcugcaacuggauguccccuacaggucucacauugcaucaucuguucacuugauguuguuccugcacugauguucagccccuguacauaugcaccuacucuguuccuugcuuauauuaacuaucaugugaccaaauccugaagguccaaaaaagguaagaccugggccagagagauacagagagauaucucagaagauuggguauuagaugugcaaguauaaggaacugagcuugauccccagcaucccuuaaaagguggcacugaauuguguauggcaucccaaugcugcauauaugucaucacaaucccaaagcugcauguauggaaucccagugaugcaucuaugucaucaucaucccaaugcugcauguaugucaucaucaucccaaugcugcauguaugucaucaucaucccaaugcugcauguauggcaucaucaucccaaugcugcauguauggaaucccaaugcugcauguauggaaucccagugaugcaucuaugucaucaucaucccaaugcugcauguaugguaucaucaucccaaugcugcauguauggaaucccaaugcugcauguauggaaucccagugaugcaucuaugucaucaucaucccaaugcugcauguaugucaucaucaucccaaugcugcauguaugucaucaucaucccaaugcugcauguaugucaucaucaucccaaugcugcaucuauggcaucaucaucccaaugcugcauguauggcaucaucaucccaaugcugcauguaugccaggagcaucccuggggcucacugccuaauuagucaagcuaaauuguaagcucuuaguucagugauggaucuuaucucaaaaauaagauggagagcaauugaggaagacaaucaacauacaccuauggccuucacaugcauguucacauguaccccauacacauguguacauacauauacgaacacacagaaauucaugcucagauaccauucauucucaaguuugcaauugcucugaagaugaagaaggcucuguaagacaaaggcagcccugugaggaaauagccaaggagugagaacuacagauucuagcccugggaccucucaguacauacaccaggacuccucaaacacuaauacuucuaggaccaucuuccugguauuucacagaguaacacuucuuacaguuuugucuccaagugacuuuauuuacuaguuacuuaaaaugcagaggaugugugugcauggccacuguagggaagacaguauuaucauuugccauaaguagaaaaaaucagguuuuucagaucagauuaauuguuuaguuuugcaaguaaaauuuuauuggaagaaaaccacacucaagauacaagagacuccaaggguucugccaagccuaaaauacuuacucugucacacuuaagaaaguuugcaggcuucugaaguagauccaaccagucucuguuaggcuuugauacccuccucuguguguuacugagaucaggagagaccagggagguauuaauuaagguuguccaagcauuguugagacugaaagcuuaaaugaggacugcacagggaauaaggcucucuaugggacccgaagcucuuccaggcaagucagagccuucaguuacuauguaauuuugugcagagacugugguuagagaaacacuguagcaguuucuuagcuucaagacaccauagugguaaccuggugauuucaggaauggauucccacaggaagaugagagacaggagaagaacaagccagaacugcaucaccugagaagugaaguguggcuaaaagaaucuugaacauuggaaaccaccaguguggcuucaggaagugugacugcuaacuuuccugugguggugccuggauguggaaucaucucagaggcaccccucuggguauaagggugugucuagugggguuugccugaggugcaagugggcaguaccgccgucugaagggaaguaaauaccaaucuaaagaggaaaagagacgcuaucugaaggccagcacuccugccccugccuucugauuggccgggaugugagcagucagccuuacacuuccaccaucccaggggaaagcagcucccuucacacuggcuucccugccugaugaauucuauucucuuagacugaaaaccaaaauaaacccucuuccacugaguugcuucuugucaugcauuuaguuauagcaaaaagaaagguaauacagucuggccucuggaccucagaauacagaaucccucuuccuguccguugucccacccuggaugacccacaguucccagaguugcauuuuagauacacguuuuaguaaggacacucagugcccuuucugggcagcaggcugcauuaauauccuccccuagugcuuucucaugcagcugacugcaugagcaguccuggggaggagaaccaaguguggauaacagguuccugcagagggagagggaagguaccaauccagccaagagaggaugguggcagaagggaugauagcucagcauucacagucaggugguagguuucacacuaccugagagacugaugacagaccacacuucauucuaacugaccuaggaagagauacuuggagcuggguucuaggacacucagauacugucccaucaucugguuauacauuuugguaacucuaggcaaaugagccuuggugagcaggagccagggaaggcaggcauucccuuuagaaaugaggcucauaaguuuugcuuuuggcacuuuagcaaaauauuuuuggggccgugcaucuacccaguuuuucaaagaucucccacaaagagaggcucucacuuugaucuccuaaugccucauccagguugugguuauauccaccagcaugaagcugucaucucccaacaaauggaaagaaaauggcuguuucacaccuauuguacagcaagcacaacauuaaaugcucacaccugugcuccacagggcccuguaauguggcagaagaguccucaugucagagcaucuggggcagaaggacagcuaaagagcugccugcucugaacaacucaaaucccaggggcuuucucacgcucuggccugcugugugguacgagugcccauuccccuaagguggagcugaagcaagugcccgcucucaggagagaccagcaguggugagacucuuguagguagaguuacaggaacuuggaugcuuccuuuagucugagagucaccugcucaugaccuaguguguggggauggaacccugcucagacagaaugugcaguuguacuuccagggcagucguaagcuggcaucacauccgucuuccagccugucacuuacuuuuagguuaugaguggggaucaaugggucauggagcaaaaugugagggauaguuauggcaccucugcugagugcaaaaucugcaaaggcaguuaagcuggggugaacgaggaaauagaggaaaauuagaaagacauuaucacccugaugaugaucuucauggaaauuccugaguacacagggaaacuuacccuaugauuuuccuuguuaugaagucugugagaccgaguaggugggcacccauaaaauuuguagagcagccgaggcgauugugcuugggguagaggcccuggguccaaaggguuuguuauaaugaauuagcacagacucucaacaaagaugcuuggagaagcucuugguggaagcagugucugagguaaacauuuuuauuccaucagccugccuuggggaugguuauaccuacuacacaugcauguuggcauuuagagacuuuguaagggaccuuuuaaaaguucaacauaccucaaaugagaaggugucaaugaguguuuagggacuguuaaaugugaagaucauuugcuuguucuuuuauaaauucacucaaacugccacauaaagaggaggaggaagaagaggaagaggaagaggaggagggggagaaggggaggaggaggaggaggaggagaaggagaaggaggaggagaaggagaagaagaagacccaacaauaauacuaugacauagacacuaaacaccauuuuuuuuuuugugaacaaaaucaaagauguuuugcccccuacucaagagcacagcuaccuaaucauaaacaggcaaccaagggguagccuucaucaagcugcaggggaggggaggggaggggaguggggggaaagaaaaggggaggggaggggaggggaggggaagggagggaaagggaaggggaggggaggagaagggaagggaaagagaaggggaggggaggggaggggagggaaggaggggaggggaggggaagggaaggaggggaggggaggggaagggaagggaagggaggggaggggaggggaggggaagggaagggaagggaggagaagggaggggaggggaguggagagaaagggaggggaggggaguggaggggaggggaagggaagggaggggaggggaagggaagggaagggaggggaagggaagggaggagaagggagggaggggaggggaagggaagggaggggaggggaagggaagggaagggaggggaagggaagggaggagaagggagggaagggaggggaggggaagggaagggaagggaggggaagggaaaaggggaggggaggggaggggaggggaagggagggaaagggaaggggaggggaggagaagggaagggaaagagaaggggaggggaggggaggggagggaagggaaagagaagggaagggaagggaagggaagggaagggaagggaagggaagggaaggaaagggaagggaagggaaaggaaggaaaaaagaaaaaaucagaaagaagaaaugaaguacagucugggaucagcacuauaggauuugcugucuacagaagacaugaugucacauguauuuuuggcaguuuuggagaugaaaccagugucucaggcauacuagacagagcuuuucuccugagccacacacuucuauuuuuuuuuuuuugauauaugcuaaaagauacuuuuccaugcuuuggcucucuuauuugggcaaauuaaaucucagucuuaaucugaaggggcuggcauaagacauacaccagugacaacagacaacuguguucacagaggggcauaugacacaaaucagaccaacggaccacagccuggacuaugaucaugaucugagucugucucucugucccucugucucucuaucacuguuucacucauucacuacuuccccccucugucccuccuccaggaagacaaaccuggagcugcuuguggccaucuuugucagccacaggaaagagcuuucuaacuaggaaggcaacagcagcacacagcauugaugaagauaaaggcacacaagcccuuuaggccauaacucacauggacuuucugugauauaugcugauuuucagcuaagcuacucugaguuucugucacuuucagucaagggcucucuuuucugucagaugucucccagggcucuauuuucuacauaccaaauccaagaucucuugguucauaauagcuucugcaucucacaauuauggaugcaaugacuguacuuaucucaggcacuucugggaucacuggguaguaucucgcccagugacucuaacaaaucaauaaguuccaugguugggucugaguaggaguaucaaaguugaaaaaaaugggugaggagaagagcuaugcuugaguuggagacgugguucuucuugcauaggaagagauggcaggcaugagcuguucgccuuucugaguugaugugcuuaugugucaggcaagugaaaccaaucucuaagauccuuuuucaguucuaacauuccagaagugucuauuacuccaggcuccucuccaguauuauggugugguguaauugguuacaauucucauauuugucugcuuccuuuuguuucaacuuaaaaaauacucuauuagacuaauuucugcauuucaaguacuuauuuccucuccaauuuccuucuaagaaaaacauuuauuuuuguguaguuggacauaacaaucccauuuucuucccauuucuauauuuuuaaaucuaauuaaggugauaaguuccuugagaguugaaguugggauuuuccuguguguguaaacauuauuauuuuuuuuaauuaccaauuaagcugccaauuuugacagagaaacaggauauggguuuuaaguaauauaagcaggaaauggaucuccagcucacacaaaauaaauacaaaacuacugauuuuucuccuaguucacaucugauuuacucauuuauaaccuuaauccgaguugaaguucucccacacaaauacaaaggaccuccauguugauaggaucagaaaaggagcaucaggugaucugccaagugucauccauguaaaugucauggcaugggugucaaaccaaaagaccagaacaucaggugacucuccugguaucacuuauguaacuaucauggucauuucaggucagcaggccuuucucggcagggaagaagggucgguccuaagauaauugaacaucagcuucccagcuccacaguucuugcucacuaguaacucacuccauuuggagagaucaaguaguugaauaauaaguggccacaugaucuuuccuguacaaauagagcuucccagggggaauggucugcacagaaccuuucugacuggccgccuagcccaggauuucuccuggggacucuauguaugaacaggacuuuagcuccaaaguccauaauggguaucucuugguaaacauaauugaaugauguggagguaguggccauaggguuggcuggcacugcaauacagggcugcuguuaaagcuuguuuuugaucauuggucaccugcuuuuccauuagaaggccugccuuguccuguauaugacuccacauugugcuugcuugcuuucuguccacaugcuuuggaaaggagagcacaucugucccagcaaucuuaguuuugaauucucuuuccuuuuuuuuuccaauuuuuuauuagauauuuucuucauuuacauuucaaaugcuaucccgaaaguccccacccucccccacccugcucuccuacccacucacucccacuucuuggcccuggcauuccccuguacuggggcauauaaaguuugcaagaccaaggggccucucuucccaaugauggcugacuaggccaucuucugcuacauaugaagcuagagacacaagcucuggggguauugguugguucauauuguuguuccaucuauagugcugcagaccccuucagcuccuuggguacuuucucuagcuccuccacugggggcccuguguuccauccaauagcugacugugaccauccacuuuuguauuugccaggcacuggccagccuggcagcacaccuagaagcucuagaacaaaaggaagcaaauucaccgaagaggagcagauagcaggaaacaaucaaacuuagggcagaaaucaaccaaguggaaacaaaaagaauuauucaaagaaucaaccaaaccaggagcugguucuuugagaaaaucaacaagauagauaaacccuuagccagacuaacuagagggcacagggaugguauccuaauuaacaaaaucagaaaugaaaaaggagacauaacaacagaaccugaggaaauccaaaacauuaucagauccuacuacaaaagacuauacucaacaaaacuggaaaaccggaaugaaauggacaacuuccuagacagauacuagguaccaaaguuaaaucaggaucagauuaaugaucuuaacagucccauuuccccuaaagaaagagaagcagcggggcaugccuuuaaucccagcacuugggaggcagaggcaggcagauuucugaguucaaggccagccuggucuacagagugaguuccaggacaagccaggacuacacggagaaaccuucucgaaaaaaacaaaaacaaaagcaaaaacagaaaaaaaaaaaagaaagaaagaaagaaagaaaggaagaaagaaaacaaaagaaauagaagcagucauuaauagucucccaaccaaaaaaagcccaggaccagauggguuuagggcagaguucuaucagaccuucaaagaagaccuaauuccaacucuccucaaacuauuccacaaaauagaaacagaagguacucuacccaauucauucuaugaagccacaauuacuaugauaccuaagccacacaaagauccaacaaggaaagagaacuucagaccaauuuccuuaaugaauaucgaugcaaaaauacucaauaaaauguucucaaaccaaauccaagaacacaucaaaaugaccauccaaguaggcuucaucccagagaugcaaggaugguuugauauacggaaauccaucaacguaaucuacuauauaaacaaacucaaagacaaaaaucacaugaucaucucauaagaugcugagaaaccauuugacaaaauccaacaccccuucaugauaaaaaucuuggaaagagcaggaauucaaggcccauaccuaaacauaauaaaagcaauauacagcaauccaguagccaacaucaaacugaauucucuuucuugagacuagccuagguacauuuagugaacugaguauuguggucaaaauggacagccuaauauuaaccauguuaauccuauuccugaagaguagaaacccaagcaaugaggucagggaaaguuacaggaaacagugcuaagaaguguaugugugucuucugaaaaauagcuaucacaguaccugggcugcuugguagcagaagaagccaggcaccacuagagcagugucacuagguguggggcucucuuucuuuaguccaggcuccuuccuaagguuacaaaacaguccuugguucacgcauagcucuucuaauguacaguaaaaucaugaauggguaucugacuucuugccccaugcucuugauggacaaaggcaucucuagguuccccucguagcagcuugccuagugacucaucugcaaugagccuucaacauccccugagggauggaaugaaggagaaguagcagugccuuccaugucucaacugggacgcaucucugagauaucuuagggcugcugucugggucauucaccuggaacucaucccgauguugcuuuaggccugauggcugaacgauuugccaucacauucuuuucuauguagaagcaucaaggagaaaaugcaaacaauggaaaauauguaucuauaacauacaucuacacuaaugcagcuacagucaacucccuaguaucagauguuuaugguccaauaggcaacuuuuaacucauuuaaguauuuuugucauucccacuuuuguugggaaggaauaguuuagaagagaaaagcuaauucaacuuaagaaaaauuucagugugccccgugcccaaaucccucuauaauaagugugcagcaugccucccaucuacaaauaggcaaucuguacuucugcaaguauuauggcuuuucguuuccuucauucucaugcuacaguauguccacugccaggaugaggauacagaggagccauggccucacugucugucagcuagggagccccacuaaguaaagaacccuucuggaauuuauaaucacaacaccuaugacuugguuuucaccaacaaccacucaaguucgucagagagacuuuaugguucuuucaucaugucaucucuuuuuauaccuggccaugguagcgugccauuccugucacaucugaauguccuauguuaacacucuugaugauugaaucuuagaaacugcacacauagauguagaaauaaguaaagagaaaucccacucacacucuuuggacaugcccacuucaaagcacuucugcaggcggcaguacuggcaucgguuccuagugaccuuguuaaugacgcaguucuuaucucgauggcaaguguagaucauguucuucugaauacuucugcggaaaaagcccugcaagcaagaagaugagcagauaaauagcuagcuucaugagagaccagaacccaccuugggaugcacccugggcucagucugcugauagaggaauggcuacaaaaacuaaaguuaaaacccuagcccccagguuuagaaacacaguucaguggcuaagagcacuuuuguucuugcagaggauacagguucuguaccuggcacucacaccuggcagcuuacaacugccuauaguuccaaggggcugggacacucucuucucaccuccuuagccccaaagacucuuccacucaaaacuagagauggcugcuagugucucacuaaaacaaauaucaaguuaauuugcuuggaaaacaucagacagagcuggaauccaugccagcuuaguuaaaguaccuaccuaccuaccuaccuaccuaccuauuaucuauuugaauuucucucauauuauccuuugagccagcuuugcaguuagucuccucauuaagaaauuaaauacaguuuuuauuuuacuuuauuuacaugugugugcugaguguguugccauuguuuuaaacuucccgagaaugcuuugauaaacucagcaacauauucugaaacugugccaaacaguaaugaaaugggcaaacuuuauguucaaaaguaggggccguauauccucucuguccccucuguuaccaugguuaauagagugcugcuuguucaaaucaacaugaggauguagcaggugauaaaugcucuucuguuaucuucacucucuucuuuuugcaugacagagaauugcugcccugaguauuaaaagugugggucucuaccugagcaguugcagugggauuaacaaccacucuacaaaccauucucucaaaggcaggaaauaugcugaacagucuucucgugugggcaaaaccuugccugcaguugauuaccacggcagaagccugacuaacucccaccaaugcucacugacugugagccaagaacucucacggagugcgugcugcucaugauuuucacacaggugcccuaggauuugaaaagucuaaauaaacauaugguuguuggcaagguuuuacuguaagggccugggaaucugguuuaagacuaaaccagagcugucagaagccccuauacacacauuauuucaagaaaacauggcuuauuuuucuaccuucgguguuauaagaaugaucagaauagaaaacaacaggucaccaguguucuagaaucugagaaguguguacuuuuguggcaggacaccuuucucagaauacuacauggcaccucugguucucagagguaccaacucgacauuaaaagaaaaaucauuauuccuugaccaagaacacgguagagacaauagucuuugugugugugaggaacaaaagaggcaggaacucaggcaccuuuuucauuuauuaaaacccaaauauucaguuuggcaauguuuuagaggcuagggagcacagaaaaagaacaccaugauauucagggaaauaagagagaacuggagaacuuuauccaucacuaauugcccaucaguauggcucagaaacaaugaccgaaaccaaauacgacuucuuaguuuuccagaucagacuuuggcugggugucagcacgucucaguuucaggaaaucauuuccagcacggcagaacccuugcugacuaugauacaugcugggagguauuuugaucuguguguuggguaaacagagacugucugugauucauguggaguuuuaugucaaccacaucuuugccuuccuucacugccauccuacacaaaccucaccccugcuagagaccucagcuuccaggacuguguguggaugaggaggggcacagagccccaggccacugacaauuuaaugguuuuuuauaugaugcuuuaagaucaagauggaauuguuuuagcucuggcuugcuugaggauccagcaccauaaacauaacccagugagccaaugcucagaugaaaucucaugcccuguugauaguaaguuuauggaugguucagaacccugggaugcccauuccuugcugagacagaauaugaguuaauaucaggggcauaucagcauuuaauaagaguuuucuuuuuugagaaauucugagggaacucauauuucuugugauuuaaagccacauauaugucuaacucaaaaucaaaggccucauacgauuggccuucgguauuaaaaaugggcuuuagagauucacuuauaauauuucuugaagcaaguugauaguaaacacucauagggcaaagaccaaaagguugauuaugagaagaugaagagcugcuuguaucugggacaaagucagaagagggcaggcccagcagagagcgugccuugcccugggagucaagacccugccaagagccuucucacugucccugggacauaaguuugucacaaccuuguacagcugagcucucauagccucaaucaggaacuggaggacacacugauguggucuucugcucuucuccagcugcccauacuggguuacaaauucaacacuuuaccagacaguggaaagcaagauggcuaagaaaguaguacugucaggagaccaaggagagagacaucuuccaccagaaugagcaggaguggaaguuuucuauacuaucuagaaucuuaaaggacaguaaggacuccaguggcacuuauggucaccucagagucauaacauggccuauagggaaagccuucaggugaauaucuauggcagccgugaagcugggacccuuuuguugugauccagggcuagcggcucagacuuuagaaugcaguuuuuugaccccaagucucauacuuuuaaccuuacuuuacccagauaucccaggaagcugccaugaauaccucaccaacaaagauuuuuauacugagaugcauaaacaugcuaagaugcuucuucuccuagcagcuuugguauuccuucuugaaagcuucagucauucaagaaaaguugaaguauuaagcaacaguacugucugcuuucaagguuucauggauaacaugaggagugccaauggugggccuagucaaagccuacagaguccaaagacaugaugaauuuuccuuuauggggcaguaggaccaccgucaucucugguacccaagucuuuaugcuauugacaaaggccuggcagggaggcuggcuucuguaacugcagcaaacacacuagugucaucacaguguucacuacagcuuccuggaaugauggcagguaauuggaugaggugagagagaaugucaagaaaauggcuauuugaucccuggaagguuaguguaugcuaggguuaugacagaauuugacacauaguagauguucaauaaauaauuauugauugaaugaaugaugauguucaaguuauaaccagaguauauaggauaguuuuguauucauaccucaguucauuuaagauaugcauuaacauuaaaugcauuccuuaggaugguauuguuugaauuuaagaagguaaaucacaauguuucucucagugaaauaaggaaagaguugcugaucaaugaguggccaucaacuuggucaguggagauuucuguuggagaacacugacuuguaucaacuaugauucuguuggucucucccaauauuuuaaaaucaaucaugacuucuguugaguguuuaacacuuuuaguggauaauuacagcuucuauugauuaaucaugauuuuucugccuguggauucuguaguuuuaauagucaaagcugacaacacuaagaacaauuauucccacaucaagaaggcauaccagcauuuucaacaaaacucuaguauuuucuuucugugaaguucucaacuguucuuaugucauaucuguuaaaucuugccaggaucucuagcuauggaggagaaggccagggauucauguuagagccauguagcuccuuuauuaaccacaacaggagcgcucacaaccagcucagaauauuuuuuucucaccuggaagauaugaaagauaauugcugugacucacucccuauuauaaucaggaaacaaacuaucuuaaaacgaaugauacgcaaauaucauucuguaccuaaauacacaaacuuccaauuucucucaguagacuaauagcuugacccugcuuguucauaaaguacacagaaagaagugguccagcucucucccaucauauuuugucauguaaauaaguugggccaccuucucuccucuaacacuuccaaaccauggcucuagagccucccaauucacuggccuugucugguuuuguagcuuccagagagugucauguguaacaguaacaguacucauuaucuucuacagaggcugacuuuuuaaauugagacacuaguguacaguuaagagcuagguuuuaauucaggccuguguggauuuuaauucugauccuaccacuuagcugccucuguggccuuaggcuaaggccucaguuucaucuccaagaaagauugggcaaguuccuacccacucggaugaguaagcaucagccacaacacagugccugccagggaacaagagcuuggcgaguggucauucucuuuauuagaaaaaccugauuccuuacaaguuccuuauaggaaaauucccacacacguucugugauuaaaauaacaauucuccaauuguaaagaacagugcugccagucucugcauucuucugggccaacccccccccucccccgccuucccaguuccauuagcguguucucacuuagccacuccuucauuacuaacuuaaugucaauuggcugcuguggauggcaaggcuuugucauggcauccucagucugagcuguggguugaauauaagauguuuucuaugcauuuguauauuuaaacacuuggcucccauuuggugaugcuauuuccaaggguucuggaaucuuuaguuaguggagccuuggugaaagaaguaugucugucacuggggcaggcuugggguuuuacagccuagccccguguggucuucuuugcaugcuuuuuguagcauacaugcagugugaccagcguccuccugcuucugcugccauggcuucccugccugaagccaugcccuccccacuaaaucccucuggagcuauauaccauaacaaacccuuucuuccuuauuuuugucuuucauaguaagagaaaagaaacuaaugcaaucuaugagaaauuauaucaaggaagcucugcuaaugaugccacagagcauuguggucagaacacuacacuugaccucagcuaaaagacagagaagcaaugugggaagaacauuauggaaaucagccauggaaaagauuggugugguauuuagcacauaguaggucauaauaaaaucuucauugaguaaaugaaagcaacaggaguucaaaugaguugacucugugucaacagcacugaguggcucccauggugaaugacaggacugcauaggagacagcagaaaaagggacaguguucauacuucaaaaggucuugaaggaauuccaaguacagacuaaggagacacuguacucuucuaugcaaaagaggccagggucagaauuaugucuagcuaaaacugcagagggaguuaggaguucuugacuugaccaaaaaguuucuucuucuucuuucauacuuucuucuucuucuucuucuucuucuucuucuucuucuucuucuucuucuucuucuucuucuucuucuucuucuucuucuucuucuucuuccucuuccucuuccucuuccucuuccucuuccucuuccucuuccucuuccucuuccucuuccucuuccucuuccucuuccucuuccucuuccucccccucccucucccccuccuccuccuguaucaucgucgucgucgucgucgucgucgucgucaucaucaucaucacuguuagcuguugggaacuggacaccauuauaagcauauaauaccugagcugaccuuugcugggcaagagcauagcccagaaauccuuacucugagacaguguugcuaucagcuccuucaguuuaauuauuacacacagcuacuugugaggaguuaugaugugcuauucugacagugggcugugucuaacuuuacagcugucuaaucaggcuuagauguguagcauacauuacagugguuuaagguuaggcacuaaguaaaaacuuuuuuuccagaaaaguauuuuugcaucauuuuuagucacaaaaaugucaggagaaugucacucaaaaagcagugugggacacugugugauuuauuuuaauuguuaauucaauacacccuagacuguccugggaagagagucuggaugagggauugucuagaucaggcaugucuggaggggguuguuuugauugauaacugaugugggaagacucaggccacuguggguagcaccauuuccuaccaagaaguccugcacugaggcuugggaauguggugagcaugcaaucguuucccuguucuuaacuauggaugugaaacugugauacgacuagcuguuuugacuucccugaaaugaugaacugucacuugaaaaugacaguggaaauaaagccuuuaucuccuaaguucgguuuuuuuuaauugcuaugauauuuuaucacagcaacagaaaugggguagaacaaacauaugagugagcugagcuguaaccgaguuaauuucuguaccaugugaaguucaaagggaaagagauccaggaaccuuaugugcucuaucucaacauuaaaagggaaagauuccaggucuuucucaauccaagaguaguagggugaccacccaggucauaggcugcugaggacaacaggcaacaguucacauucccauaccugccagcagcagggcuggggguuggaagacuguggaauaauucccaggccacucugggaagcaagguugcaagaccaggaaacaugcugccuuaaacaaacagaaacacccucgguggcuggaagcccauucgugacagaucugugaaguuuuuauuugcaggcuugaggugggcaaacaggcgaagacccuguccacccagcagaaaagacaaagggcaagagagagggaaagagaggaaacacaguggccccugugaugauggaggguuuccuuccaagguggugggcacggaccuaaggcaaagaaaacccaacuccagccagcugcuguuagguuggaguugccuguugccuggaaacccugcugccccagagggaggggcugaagaaugcuuguuuguuuuguuuuuaaauaaguaaauagaucccuaccaggacuuggucccaggauggaaauucaguaaagaaaaaugaacagcaauauaaggugaaucaaaagcucuauggcaauucagacagaauacugcuucuacauguagacuaaucuuucuggaagaccacauaacagcauuuucauggacucuguaaggugagggcccccugagagaucaacuucccuuaguuccaggaaccauugcucucagucccuuuaaucugagaguuaauuaaaacucccugugauuggcuaugagaaauggccucugcucuuggucaaggucuacacuuacauacucugagcaucccaagaagggcauagagcuaaugccuaggcuaacagugaaauuuacuauaaugcaacaggagcccaugaagaaagucugcuggguaauucauacaaaacaaucagacuacgaaacaagucaaauaaacaaaaaaacuaugguuagaagaaaugacacauuuggaucaaauauuuuaauuuaggugaauuuuuuuucucacaaaauauaacauugggugaaauaaugguuauaaaugaugaagccucaugaaugcuuaguuaucacaauccuauucuaguagacagguaaugauccucuaaauuugggacuagucaaaaccccuugccuacuagucaaaauagcccuuuuaauggaugagucgugaacauguggucuuacagggcccgcacagguucaugauacagaaugucuuuggagagacaagcguuuccaguagagucugggccuuucucuuuucugagcucuuggagucugagagucuccagauucuucuucuuguccuuacagcuguugagaggcuauggaucagacagacuuaaguagucaccacagucauugacuccccuggacuccccugagaugccucugagaaaucucacuaccucagcaaaagccagaaaggcaaagcuuggagagguuguuugauaucugacuauggucuuuacuuccugccuaggggacucugggaggccagggcaggggaggagcaggcacacuaagaacuguuucauaguugcauaaaauuuucuugccaagauugaaaucaugaggugaaacuccagcaggacccagaagcuuaacuggugaccucugggugucccugaccauacuagagauccacccaaauuuagaacaaucuaaaaagucaagaaaacaggguugggacagcaaauggauuaucccaagauuucuagugcagaaggguacaugcauaaagaugaccccugggagcacauucauugcaucuugagagucugaagaugcagaacaaaaucuacagcccugagggcaaaucggcuucuaaaauaugaaggaauuaacucgauucccagagcauucuuuagcucgagaccauuuccuuuaaaccaaucaaagacaucugcuuucuagauuaugugggucaguucuuugcugcccuuccauaguauauuccauaguuaccaauuuacuuuuagggauacacuagauagaacagggcaagaagccagugaguuugaagcuuuuaacuucucaguuguuuuauggacaaaauguaccagaauagcuccuuagcuaaaguucaggagugagugaguggccccauugcucugagcaucggacauaaagauuaucugcacuuaaauuauagauucucaucuggacugggaaggagggaagaauguuagcagaaggaaacaaagucaaaaggcacuucaauacaccccaaaacacuuugccacagagcaugaaucuuaaagucuguaagucugguguucaguauucaccauggaaacaggcaggcaggacccugcucugucauaacacuccugaugauaccuaacauugccaugguaaccccacacagcauguaauucaaagcccuuucacagaugcuaauaauaaugauggaucuacaguguuuuagggcauuaaagaccuaaauuaguagagaaaaaaaaugacaauccacaauuugaugggucuuuuucucucaucucaaguggguugaauuuucaaggccaguuuguaguccgccugguagaauuuuucccaaugacuuuauacaugguuccaugcuaacgcugaaggagaaaggaacaaaguccaaagugguauaaaggccagaaaugugaggcaauguagacacucacauuugucccuucaaaaaccuagcaaaugaaaauaacagggagagagaccucagcuugcugcagcagacacuucucugggggagcugagagaucaaaaucucaucacaguuaucuggaauauacugccggagaucaagcuuccaaaauagaacccguccuuguguggaaaagcuagguugacaccacguggcagucugacaagagaagguaucaucccaaguuacagccccacagacagacguggucagugagagggugcauuuccugucucccgcagcugaagcuuccaguggccuugggcagugacacuucucacccaggacauucucucuacacugcaucuuugugcucugucgacuccacaaaguccuucuccuucuccuguacauuaugcaugcucaugcuccaggagagaggagaggcagacccucaggaaaccaugaucuuguuugcagccaucaacacagccuauuagaaauuuuacaacaggaugcugcccuguguauguacaagacaguucaccuugguaggaacggcuguaucucacucucuuuggggagaaagcauugggagcucuaacauuauuauaggaagggcuagaccaaacaaaaaccuaagccuaaugaaugaauaaccaccaaaacccuuuucuucuuuuuuuaaauuacguuuuuaggcuagcacagaaagccaagagucucauuauauggcagcuucaaauagcugugucauuauaccuuguccuugauuggccccuucccccacuuccuuccccagaacauucuucgaauaaaaaagaggagugauauuuccagcagcaaggcuccaauaucauaaauucaggcagaaaugcuaauuuagugauuuauuccaacuccccuucucucucaucaaauuaacaaggagaugggcuggaauuucacccacaggcuucccuuucuugaucuuuaacauuaaaguugcuacauuauauuagcacacggccaagauuugagaucaaauagguccccaaggcaaagguaaaguucucuuaaacacaacgaacuugccugcaauuagcacauuagagucuccacccacaucccugcuugggaaagauacacucuugcagcuacuguuguuuccaagacuuucuauuuacauguaugaaucccacuuuagcaagggaaaaucuaccagaauacacagaauuaauuuuuaagucuguuuuucuacucucuguucuguccaauucuugcugauacagagcggcugccucucaccacaccagaggccgugggcggugaaagaggcaccugcccaugacucagacgcucuccagcuuucaauuaaaggccaccuaauggauguagggggagcuguuuuauuuucccugacagagcccuuauuuuuaaaugcucagcuucauuuucaaaaauugcugccuuuagacaggaggaacaucuaucuuuugugaaaagcuggacauuccuccuucgcccacaucuaaacuacauucccucugcagucuggcugcagagaacuuccuguguuccagggagggcuuauuaaaggaugguagucccuggugucaaauccuguucuaaagaugcuguaucccucgcccuggguaggaaggcucaccugcaguuuugggggccucgcccuaguuuuucucucuagaaauaauggguccagggaacgauguucauccuucuaauggcuuccagaagggcaaaggagauaacauggaaggguguguuucuuuugaauacuggaucuaaacacaccaggguauuugaaccuuaugucuauuguggaguuguggauuauuuucauuagaucaaacaagagcaaacauuucuuuggaugggguuggcccuuuuccuuggaacgcacacaaucucagcaaggauauuucuauacaguuuucuccaauggguaauuaggagauauucacaggcaggugcagaaaaaaagaccuaggcuccauaaaucacauaugaacucuaugaacuugcaaaggcccaugcagucuucugaacacaggcagcgcuguuuccagacuugagggguuugaagggagugaugcucuugcugcuggugggaguugugcagaugagcagaucccugaaggucggacaagugcuuccucgggagaggaaagcagguacacugaguugcccuugaucugcucugggggcccuggcaucucaucccaauuccuguuuguuuucaauauccccugaggauaaugugguaaggucaagagauggcuucuggacaccccagccagugucacagaucuugugacagugucagggagucacaucaaagguagguuuccaccuuuccaggaaaaagagacccacaugcaggaguccuucugaaagagacuugaacuaauuuguaauuuuaaauuucaaaaugacuuuuaugagcuugcuugcucaaagcauucccuuuaauuuuuaauuuuuaucuucagagugcuccacaaaaugccccaauguguauucucuccacccaccucauuaagggggagcacguggggggggguuggagggaggagcauccugcuggcgaugccgccuuagggguccucauuuagagacuaaagcagaguguggauguaaauuacuuacaaccuauuguaucuuguggacucugcguucauuuacaacuggcaaggggugcagaccauuuucacguuuaauuguguugguaacuugucuguuuucuugaaaguggaaauggagaaugcugaggcaggaagagcugaaauaagccauugaggggaaauaacugcaguacaccauuaggaagaaacccagagcugcuauguguguuugccaugaaguugucauugcaucuucauggguaagagcaagacagccugucuccuuauagaagaagacauaaaccuagcaggaaggcuuccagcuguaaucuguuacucagaagucaggggcaggagaagugccaugaguuccaggcccuacuagcucaacgaaugacacgauacucuccaucccaucuaggcacaaaagagcaccugugugugaacaagaagcccacaccaagaauccccuccuccacuucccuccaaaacucagucaugucacagagcaauaaucagaggugggccaugggugggugugccugaccaaguggaaaaugauuuagagcaauugaauauguguguguguguguguguguguguguguguguguguacauacacacuuauauuauagccacacauauauaauaacacacacauauaguacaauuccuaaccuguauaagacaccugauguaacagggccaauuauagaacucaggauucacaacuggcaacucaggauuuagucugguuucuucuccacuguaaaucuguuaagacugucaccaagaaagauuaaugugcccuggaugugucugugggcagccccaaaucacuuacuucacuguugcugaauuugaagugagucuuuggaaucuagcaacccaggaguuuucacaggugagcuuccagugaguggcaggcaggcccagacgcugcccaggcaguggucugcaugccauuugcuauauagaauguuuuccccagaucagauccaggaccacauuuggcuccaguagauaucugccaauggagucugcugcauaacccaucugccaucugcccuccagcaggucaggggugaaagcacucaaugggguccacaaguguaggggcuucccucugccaucaaaccacugugcgaagugcucagcuacggucucaguuccagccugaaccccucagacuaccuccuaggaccauuauuugagaucuccacaggucuggaugggggggggcaucaucuuauacauucuaugugggcuugucagucagguaagcaaagagcgggagaguaauaaaugucccaaauccuggagacuuugucuugagucaaacccagccagcggacauugacaagaggacacaaaaauaagcuacaucuuaugugauauuuaugaguuucauuucuacucugucaaauguaauuuguggcagcccacuucagagaaagccagcaccagccguuguguucucuuuccuucugaaaucuaccucccagcuucaaccucccaaaccagcuacuggcuucaucuaugucagacagccucaugucaccucaagccaccaugugcgagaagccacagccagggauuuuucugccugugcccugaagggaaugagggcaagggaggggaugaugguuuccuuaugaucugguuucuucaauaaaggggaaaauaaauggaaaugaaaaguauacaauuaaaaaaauuacauuuugcuuccuuuugcuaaugcccguaagaugauuguuuuuggcuuggcagggacuccagauggguuguauaaugaacauaauuuaauauguaggcccuggaguucacagaaacacauuuuuucccagucagaugguagcaggucaccucccguuguugaauguagaacaccaguaccugcugcugaaccuuuuccucauagggcaucggccuuuacuucuucuugucagcgugacaagaccucaagccaucagaccuagaagcugucacuguccaugaugugcuggcacuauagcacacuccacaaaaggugagagaccacuaacugcucagucuacuuuuccuccugugucucaggauuuaugccaccaauuaaagccauaacaagugccccagguugaccuccuaggagcaagaauuaauuaagcacaguauuucuuagaaggaaugacaucuccccaaauggcuuagcaaagggggcauguugcugacaugguuguuacaugcggguuccuaauuaugaacgcaagcggaacauugcauggacauggcuuaguuuaugccuuuaauuugacaauaaaagaaaauaagucuuacuuuuauuuuuauuuuggggcaaagaggauguuuggcauguauauaauggcaauaucauauuacuucuuuuacuuauuaacaacacaaaagaaggaagcugggacucacauuuaccauuguccagcuuucgaaaacaagaaguuugcuagaaaaauucuucucuaccccaaguucuuauggaccuauaaauauauaauugaggugaagacaaaaccgaaacaggcugaaguuuccauuucauucauuacaugauggcagguagucuaaucuggguccuggcagauuuuuuugcuuuugauuauaaucuccuucuuaaauacucacucuguggugagggaguagccacauacaacacacauagauguaugccucugagcaugccucugugugugugugugugugugugugugugugugugugacaaaaagagauggggggugugugugggugcuucauggagaccagaggguauuauauucccugaagcuacagccaaaggugcuuguagccauccaacaugggugcuaagcaccaacugucauccuccagaacacuauuacucacucuuuuuuuuucaaauuuuuaguagauauuuucuucauuuacauuucaaaugcuaucccgaaaguccccuauacccucccacccgccccgcucccccacccacccacucccacuucuuggcucuggcauuccccuguacuagggcauauacaguuugcaagaccaacgggccucucuucccaaugauggcugacuaggccaucuucugcuacauaugcagcuagagacacgagcuguggggguacugguuaguucauauuguuguuccuccuauuggguugcagaccccuucagcuccuuggguacuuucucuagcuccuccauuggggggccuuguguuccaucgaauagaugacugugagcauccacuucuguauuugccuggcacuggcauagcuucacacgagacagcuauaucaggguccuuucagcaaaaucuugcuggcauaugcaauagugucugcguuuggugguugauuaugggauggaucccagaagccuuauuuauaguagccagaagcuggaaagaacucagaugucccucaacagaggaauggauacagaaaaugugguacauuuacacaauggaguacuacucagcuauuaaaaacaaugaauuuaugaaauucuugggcaaauggauggaucuggaggauaucauccugagugagguaauccaaucacaaaagaagucacuugauaugcacucacugguaaguggauauuagcccagaaacuuagaauacccaggauacaauuugcaaaacacaagaaaaucaagaagaaggaagaccaauguguggauacuugguuccucauuagaauaggaaacaaaauacccauggaaggaguuacagugacaaaguuuggagcuaagacgaaaggauggaccauccagagacuauuacucacucuuaagcauggagccaucucuccagccugggaaaucuugguuuauacuuaagugugaguugaagauaacuuuuuaaugcauauuauaacuuaauaugaguuuaagaacuuaaaaugaaacaaaacaaacaaaaccaaaacaaaaccaacaaaaauaacccaacuucuuccuugauuguauaaaauguggugggacacaagauccauucuguaucccuugucugacagcguaguguaaaacaugaaaaugcagaugacuugccccuucacacacacacacacacacacacacacgugcaugcacauuacagacaacugucagcaaccuacuuuccaaguuucuugguaaauacaggcaaacaugacaccaguuugucuccccagaacucucaaucaagagugaaaucuggcugcauucucaugacugugguaggaaagagaccuuguccucccauccuuucucauccagaaaacuuccacauugaauuagaaauuucauccucuuuccuggaaggugugaacauagccagcuccaucugcaaaucccugcagccuacuugccaauuaauguauuuaacucuaaggagcaggcucauuuuaauuuagcucauccacaacauuuuuguagaaaauauuaggauuuccaaauaauuuuauagcucuguaaauugccaacauaccaucugcaauugaauuaacauuuauaaccaaacugaaauaauaaauaaagcaaauuacgcugcaaauauucacaagugcccacuaugcacuugagagugauaauuagcauuuuauaaucacgcuucauuuucuuuauccaacuuccugucacauuaaugauaaaauauuuuaaacugugcucuaucugagagccgcacagucuguagauuagccauuaacuaaugcagagaauaagaaaggagaaaggcugcugcucguguccagaguuugccuccaagucuuggcccugcuuauuucuggguuuugaguccuagcuugccuucuaaccuugagguucagaaaguuguugcuggauuuaugucuucuaacucugcagcucuguggggcuucccuguguucucuugugagcagggcccucacauaauaaauucuguucagaugagacauucuacucuaaaggaaagcucauucagacuuugaaguuucuaaaaggaugcuuauuaagacucaggaaguaaacaacuaaaacuucccaggaagucccugaaagcagauucacaaagccccgcccucccuaaaaugaugugagcaguaaggacuauacagacaaagaccagucaggcuaucuggaagagacucacugaccaguugcgcugccuucaugucgugcagcaugccccagcacuucaggauagcuuuccagggcugcucuccagaguuugugaauuguuacucauggcuggcugguuuucagugaugcaacugccuuugagucaguuaggcuuguguaagugaccccaauaaaacucacuggcucacccugcuggagcuuggucauaguguuaguuuggucuuucaucaguucccuacuuggagugagaagacauuugcucaugucucaccacaaaaugucauacaacaaagaugaaauuaaauaauauuuuaagauguaucauacuugugcuggauaguuuuaugucaacuugaaauaaccuauagucauuuaagaggagaaaacuucaauugaaaaaaaggccugcagaaaaucaggcuguaagcagacaagccuguggggcauuuucuuaguaacugauuggggggugggcaacccauuguggguagggauacacuuaggcuagugguccuggguucuauaagaaagcaggcuuagcaagccauaaagagcaagccaauaagcagcaccagcuuuugcuuccagguuccugacuuccuuuuaugguagacuaugcuguaaaaauguaagccaaauaaauccuucucuucccaugauguuuuggucaugguaacuauagguaggauaauacgcuucugcuccagaagacugaacggagugggaagccaaucaucugaugucacccuauggaauacacccuauccccaaaggagccucccagaagcuuguguuuaccaugccgggaugccuuugaugaaagcauguaucugucuucuaccucaaagaacaagaaauucaacugcauaaaugaaugaggaguacacauguauacacacacacacauacacacaaaaacacacacauacacacacacacacacacacacaagcacacacacacacacacacacacacacaaacacacacacagaaacauauacucacacaagcacguaucaucuaguuuuuccaccagugaguaaauuuccaauuauuuuccuccaaaaauaguuacuuaaaaaucuaucccaccagcacaugggaagccaaagcaggaggaucaugaucuaggcuagccugcucuauauaagaucuuuccacaaaaaauaaaaauaaaacaaaacaaccucuccgaagccuggacccaagaugcuuugcuuccucaccaccuccuugugcacuggccaucucacaguucuagucuguuuuccuucuuucuuucuuucuuucuuucuuucuuucuuucuuucuuucuuccuuccuuccuuccuuccuuccuuccuuucucucucucucucucucucucucucucucucucucucuuuuucuuucuuucuuuuuguuguuguuguuguugguuuuuucuuuuuuugauuuuuuauuagauauuuucuuuauuuacauuucaaaugcuaucccgaaaguuuccuauacccuccccuggcccugcuccccuacccacccacucccacuucuuggcccuggucuucccuugcacuggggcauauaaaguuugcaagaccaaguggccucucuucccaaugauggccgacuaggccaucuucugcuacauaugcagcuagagacacgagcucuggggguacuggcuaguucaugcuuuccaauacaggagcagcauauggcaaguggcauauaaacugagauaugcugucaaugggaauggcugguuccuucuugagaaauaagcaugaaaaauguaaugcaaaaauagcuugauaguuguacauuaacagagaggccccuccaauucuuuugugaaaaauauguucuucuagugaccaaaaaugauuaagagaauaacucaaggaaaguugugcuguugaugaagaaaguccuguagaguuucagaggauagacuucuggucucagccucuguccagcuucuuacccacauguacauuuacugaggaguuacuagaauaaagaauguagagaagacuuggugggcugcuguguggucagcuuacagucccuccagcucugggagggaaggggaagcuugggagaggcacuggggagacaauccaguggcuacaggcuugggucuugcaccagguagccuggguucacgucccacaucugcagcuuccugugucaucucugacaaguuacacagucuugauaccuuuuuuaagguuuaguuucagauaaaauaaaauuuaaaagaauuuaaaaaucaguacuagugucucuuuuuccauaguuauaaagguuauguaaaagagcuugaaauagaaccuggcacaugaaaauacuuaaagaagcaaaagcaaaagcaaaccaaagcaaacuaaaacaacagcaacaacaacaacaacaaaaacaacaacaagaaacccaaccuacuaguugcaauaaaaaucauuaaacagaagcuucuacaaggcaaaggaaccuacaagggguaaaugaaaugggaauaaaguccaggugauagcagguccuucaagcaagcuggauacagcuguggagaacagaaacaugucuggaagacacugugaagggaugacauauguuccauacacaaagcccuggcuucucacccaagacuguuaacaccugccagagggagcugccugcucagccgagggcugcaggauucccuuuccagguuacccauggagagcagcugccgugcuacacugcagggucuugcuugcuggucuucaguuuuacccacaguuuucagagaguuuuugguugcagagaaaacauugcagacuuugacucauguccauucaccuucccagcauuugcauggaggcuacaaagugcuaauaguugaauggguaaggacuugagcaaagaaguuacaagcagcaagguccauaaguuagagcagcagcagaauugucucuuguucuacaaccuggcaugccagggcauagccagagaacauggucucagugauguuucccaagccaauauguggcauguuuccuucugcccuuccccuuaacaugauguacuucacagaaguccacagacacuuuauuugggaguuuaggaaaacucccaguuugcagcaggcugggguguccuaagguagcacaaugagcuugcccacaccagaguuuguuaaacacaggcugcuaaacaugccagacucaauaccuucucuauagagacauccaggacaaaccuguacaacguggcaagaaccaguuuuaaagaggaacaaacaaaagaacauaacauuuuaaaaacugccccaccuuuugaaugugugaagaauauuugcaugcuuugaguaccuuuccucucuguaauuagaagcucacagacaaauuccuaugagagaguuuggguugaggacaugggccucccacccugccaagcacagcaggaaggugagcagcacucugcauggggaacauuaugaaacacagggaccagaggaucuagguuaauagaagcaaaaaauguacucagcugcuuaaaaucaacaaguccauuacggugucacagagguggucucccccccccccccagcuuucccucuauugcugcaaacauuguguacacccucagugcacuucugucucuuuauugccugccagcccugauucacucuuagaggucaaaugaccauguaucacuuaaugagaauauaggugagguggguucuguuagaagcgagagcaaaggccacucaggucacagccauaugcagcuggaucacucuuuuccaauagcugauucuguguagaagcuccaggguaaaagacuccaacguaccaugggcuacuagugaguacaugugaacuacagggcccugcucuccaucucccucuugucgccuggaaaucaaccagccugaaaauaagcaugcaguauggacgccacaccagucauguggcagagaaccccuccuuccuauaaaccuguaagagagaucccuucccuggacucuggucaucgucuugcccgugugucuaucuguuuauguucagaguugauaacucuucuaugaacgaagacuguuugggaaguagagggaaccccugugcaucaggcugcaucuguucccaccuacacuuccaggugagccauaacccaucuuguaagcaaaggcccauauuuauuuaucuuacaauaguuuuguaauggucagcuauccacuuuauuugacauugaguuuaggaaaacucccaguuugcagcaggcugggguguccuaagguagcacaaugagcuugcccacaccagaguuuguuaaacacaggcugcuaaaugugccagacucaagaccuucucaggcuauagagacauccaggacaaaccuguacaacguggcaagaaccaguuucaaaaucaguaaaaaaaaggguugauggggcaacuuaguacacaaugcuugccuagugcgugggaagcccuggauucaauccuugcuacuguaaaaccaaauauaacagacaaacugaaaugucccuggugccaccccagacugaggagccucugauccucaccuccuggagucugaacugguuagugauuucuuuagccaaauagaacugacaaagggaacacuacgaaagaaaaggacaugugacuuccacucgugguccucaguaucccagcuucagcccuguagacuaccuguaguguuugucccuggagcugccaucuuguaagcaagcccaugccacacucaugaagguacuuguuggccauucuauuuguagcucuagaugagaaccuuuuccacaggaagcaucaauuaccacaaccaaagaaaaguuccuucccaugauccacacggucaguugacaagucauuccagcugcuugguucaguaacagcagcucaaggcaccaugaggcagaaacagccaucuaaauuagugauauacacauucuagaagggaaaggacugccauacaccuucaggaugggcaauuuguuacaaagcauugguaacugagacacucuggaggauuuaaaagucauuuagucauauacaauuuaacuuugugccccuauuuuuggaauaauccaugaaaagguauguuuuaccuucauuauagaggagucauggcaagcaacucugugccuugaaagucuuugccugccucagggacccuccacuuguuauuucccugguguaaaugaggagugggagaagacugagaaggucaguucaacuuggccagaagaaguuaucccaaugacugaaggucaguucaacuuggccaagagaaguuaucccaauaaucaguaagcucaacuaauagaaaaauuaaaucaauaagcugucucaucaaguggcaaacugaacccaaaugcuggucauagagcauccuccccaaucgcagagcaauguggccauggguggguggaggagaccaugagguagauucagagaauucucccuaaacacaacacugaacaguaagaacacccacaaaagucaucccuuuuccuuucucuucuauuggaacagcuuggcugucauuugccccuuacuuagccuuuguucuguauaacucggaccuugcacaaaugugcugcaguccuaaugguuuccccuacuacuucugcauaguaucuguuauugauucauccggcaaacauaugcugauauggccugccaagauuuguugcacacacuuagagaguaguguggaugaccgaggcuagggaaguucagguguuccuaguauugauacccuagagaaagagggugacuaaggaaacaacagaauacuuaacaguaagugccacaccagaaguuccgugucaggacaccagccacaucaggaagaggccaguacagcacauccauuccaggaggacuccccaaacaaucacauggacaagcacagcacacccuggaacuagcgucucacacaaagcaugggagugaggcuucucuuuagauucuguuuuuuugguuuguuuguuuguguuuucgagacaggguuuuuaucuguagcccuggcuguccugggacucacucuguaaaccaugcuggccugaaacucagaaauucgacugccucugccucccaagccugggauuaaaggcgugugcaaccacgcccggcuucucuuuagauucucgagucauucgccagacaggugaaauaaauuauugaaagacagauauguugcaauaaucauuuuagauguaacacaauggagucuccuaauuucaucucaggaacuuaugaagauguuuauagagaagaauguuaucaaagaggacccagcaagagaaaaugucucaaaggguuuuuuaaaugcacuuuuauuuuauggguauggugccuugccuguauguaugucuguguaccucuugcaugaauagugucagaaguacccagaagaggacauuggaacaugcaguauugggauuacagacagcuaugagccaccauguaguuggugggaauugaauucguauauucuggaagcagccagugcucuucacugccaucugagccaucucuccaggcucucaaagguuuuauguagcaacagcaagagggcacagugagugcagcaguacucccauggucauuuacaauggcacucccauggucauuuacaauggcagccuccuucuucuccaucucagcuaugugggaccuugaaaauggcuccagcugaugagcuguaguaacaguguccacagcccugggagguuagcaggaccaaacagugagcaucccccucaaugucagguacaauggcucacaauuccagucuaguccuugagggaagguaacguggaggagacucaugucuauccaagaugcaauggagcauaggugauggcaaauaauggcugcuucaggacccugcgauuuugcauuuccuuguuucuguagcuuaagccuugucuugaaagaauaggagagugagaaaccugaauguaagggaagaaagcugugacuaugacaauaaccaaccacaggcucacuuucagcaguaugucacaaguucaaccaauuacaaguucacucuuggcaguaguacaugccauauccacaccauuuaaccaaucaaaggcauaguuccuccuggaggaggagccugugaaauugcacaggauauugaaaagacucuaagcugcuuauaucuuauugggccgcauucacagggcagaaccuucugaagggaagagaggauuaucucugucaggguucagaguuaagauagcaacaccuauaugccuguuugccugguggcuugacaagaaggaagcaacaguaacaaagauaaaaagcuccaaaauuucagcuaaauuauuuuuauuuuuaugaagguuuguauuuaucuacaguaaaagcucgguuuauuauucaguaaguuaccaagauguuaauuccacuaggauaccuaaccacaguggauucccaguguuuuucauaguuagucacuuaugacauguacuuagcaaagaaucagcucuuugaaggucucuaacauugcucccacaguaagccuccuguuucuaauacacccaguaguggagaaucaggccugugguucaaauuacaacagaaaagacacgaggaaggaaggaauuccccagauaaucaaagacaaaaacaaauucaaaacaacaacacgcaagcauuuuuugugucuuaaaucgccagauuucugagguucugaggacccuccaaugccaagcacacuccaugucaauauaaagagagaaaguaguuuauauuuuaagccaaucauagccugugugucacaucauugauuaaucuuuuccagauuguguggcccaacaaacuggcuaacaguguugggaccaguugagggauuugaguaucgggacaugccuguggaauguguaaaugucaaagaccaggacuuuucuucaaugcuucgugcugaaacugguccuuuguguuucugagacauuguagaagucagaacaauaguggucaaagcaguccuuggcaugaaaugcacccacacucccaaggucuccagacauaggucacccaugacccuagcagacaagagacucggagagguccaagcugcagcgcucacuuccccuggggcagcagaggaaccuacuggguuugggcaaaaguggcaguuucuauggucugagggacuuuccaggcccgugugaaugggacuguggcauuguaaacuuagaaagcugcuauuuucagaucugaauacauggaagagaaucgacaucaucuugucauuguaauuucucuacauuuuuuccaccuugaaaauccuuucugaaaccuaagucuuuucuaaguugcugaccaccagcauggcucuugaguggcaagacccugagaagugcacuuucuccaguaccagaauaaaaaccagagcuaagagggugacugaagauuuugugucuauuuauuggaacauuuacacuuuuuuaaagaucggguuucucuguguaacagcccaggcuuuggaacucacuuuguaggccaggcuugccuggaacucacagagacccaccuaugucugccucuacaguucugggguuaaagacaccacuauaccugaccauuugcucuuuggaccuaccaacuuauaucuuaagugaagcacuguaggaaacccugcuauaauagauggacugguuuguggggccuggaaacacagguugagagguagacucaaaccuauguucucuugcauguggacuccaguagacaggcagcaacacccuggcagauggccaccuugccucuuuugacacggguaaugacaagauucuugcaaacccuuuuaccuuguacacugaugcaggcugcuuuuaaaauaaaacaaaaccaacccaaacaaaaaugccuuaggagacauugcuggccacagaccugguguagaagccuggguaggaugcugcuagcagaagaauggaaucuuuucaaugugaacaaggcucugauaggauaggccugccaggcucugacuuuccucuuggccuuugacaaugguagcauuguguacaagagaagcacucacaucauuaagccccucuccaggcuugauccaggggcaaguucuagaucucacagaauagaugcuuucccauuccagaguugcuaauccacacagcauauccagucuucuuucuaggguggaaaaauacuaagcaaaagccauaguguccaaaugacauaguucacaggaagcccaggacauacuccaacacaaaaaaaaugauuuuguugggagaaguucacugacaaaaaagacaucuagagaaguguaugcuuuccauuaugugacuauuaugccaggcuagccuaacuuuuaacgaaggucaaggacauaggcucuugcaauaaccugaauauagaaagaaacuaugucaucuggugcccugcuaccaggcuggaggaagcccccuggcuucuggguccuaaugggagccaacugaaaaucuccgaaguucauucuuugagggagggaaugcucuggggucauacagcgugauuuucacccuguaggcugagauuaggaucuuacuccugaccaaguuuuagcaccacugaguaaaucuuucccugcuggacagagugucacagcaccacgcuaggcauacagcgaugcucagaguugccagcucugagagcauuaauauguuuuagggaaaggguuaaggguagacaccuauucaaguagguuucuacaguacacguuucagaagagauucagauaaaucaagguugagcaugguagggccucgucugaccaacucugccuacuucuuuaauauuauaaaagcuaagcaaagcaaaaccaaaagacccaugguagaaaccauuagcucucagaaaucccauucauucuuuuccauagaaagaagacuguaccaggcuacauguuaauaaacuaucccuuccaucuucuuuuguaguuccuuuaguaugugaccaguucuaguuaaugaugugugguguuucuagcccagagacagauuuccugcccuggcucucuccaccauccuggcaauuagaauccuaugaugucaauggaccugcucaguccaagcucaacacugacccuaaauuucuagucaguguguagaagaguuuccaaccaggagccauguaacuucagauuguuacauggcaaagaaaauuucuuuuuucuuuuuuuuugcaaggaaaauuucuuagcugaugaauauauauauauauauuuuuuucuuagcugaugaauauauauauauauucaucagcuaagccaagugaauuuauucuacuuaggauuuugcugacucacaaaggcuacggaaauauaagaaggguuuauuguuucuguuguaguugguggagcaggggcagccaugggcagaggauucuuagccccaccccaggacaagaaggguagggcucuaaagaaucaggaagaccuccccagaggucugagccucuuauaccugucuauagaaguccuugagggaggagaaaagagaauggagagaacgaccagaagacucagccuccaaaagccuacugcaagguuaaggacccuacucacacagaaaacugcuucuaggcugacuuugcacacugacagauguggagaauugcaggcuggucugcaguugagcugaggucugcacccugguggugauaauucaccuacaugacaagguaggcauucccucaugcuccuggaaguccggcccccaccuaaguuacugccccccacagcccccacaagaaaagcauggucaguagucacuuaagcaauggcccaagcuucugaccuucaggcuaaacuccuccccaguuacuuagcaacaguuaagaccauaaaaagggcuguucagccccugcuugaccucuuacucucuuacuucucacucucuucuugccccucacucucacccucucucuccccucugucuucucuccucucuccuuucucuuuguccucuccucuccucuccucuccucuccucuccucuccucuccucuccucuccucuccucuccucuccucucucucucuuacucucuuucucucuagccuucucucucuuucucucucucucucucucucucucucucucucucucucucucucucucucucucucccucccucucuuuucuuucuaccugcucucuuucucccugcauuucuauaauaaagcucuuaaaccauagagagucucugcuccaucaagauccgcugcacacucuggucaguguugggaaccucuucccucaccccucucuaucauaucccaggggcuauaguguguagcccuggggcccccaggucggggguugcccuuuuuccauccccuguugaguggaucagaggcuuggaugcccacccuggggcuaaguggaaagcaucuggcagcccuccugcauccuccugcccagagcaucggaggaacucuggcaggacauggacaaucuuucccuucccccacuuccccagggcccuuucauuccugaggaaaacaauauucuuaaaaagauuuuacuuuuauuuaugugugugugucuccagagaccaaagcugucagaugccuuagagauagaguuacagacauucguaagccuuccagcacggguacuaggaauugaagccuggcuuuuuuuuguuuuuaacaagucuuuauuuauuuuuuauuagauauuuucuucauuuacauuucuuuuuuacuauauauuuucuuuauauacauuucaaauuucaaaugcuaucccaaaaguucccuauaaccucccccugcccugcuucccuacccacccauuccugcuucuuggcucuggcauuccccuguacuggggcauauaaaguuugcaauaucaaggggccucucuucccaguggugguugacuaggccaucuucugcuacauaugcagcuagagacaagagcucuggggguacugguuaguugauaauguuguuccaccuauaggguugcagaccccuucagcuccuugggugcuuucucuagcuucuccauugggggcccuguguucuauccaauagaugacugugagcauccacuucuguauuugcuaggcacuggcauaaccucacacgagacagcuauaccagggucccuucaucaaaaucuugccggcauaugcaauagugucuggguuugguggcugauuaugggauggaucccugggugggguagucuuuggauaguccacccuuuuaucuuagcuccaaacuuugucacuguaacuccuuucauggguauuuuguucccuauucuaaggaggaaccaaguauccacccauuugacuucccucuucuugauuuucuuguauuuugcaaauuguaucuuggguguucuaugucuuugggcuagcuaguauccccuuaucagugaggugcauaucuaaugacuuuuuuugugauuggguuaccucacuacggaugauauccuccagauacauccauuuguccaagaauuuuauaaauucauuguuuuaaauagcugaguaguacuccauuguguaaauguaucacauuuucuguauccauuccucuguuaagggacaucuggguucuuuccagcuucugguuauuauaaauaaggcugcuaugaacauaguggagcauguguucuuauuaccaguuggaacuucuucuggguauaugcccaggagagguauugcuggaucuucugguaguauuauguacaauuuucugaggaaccucagacugacuuccagagugguuguaucagcuugaaaucccaccagcaauggagaguuccucuuucuccacauccucaccagcaucugcuuucaccugaauuuuugaucuuagccauucugacuggugugagguggaaucucaagguuguuuugauuugcauuucccugaugauuaaggauguugaacauuuuuuuaagugcuucucagccauucaguauuccucaggugagaauucuuuguuuagcccuguaccccauuuuuuguauauuuuuuuagguauuuucuucauuuacauuucaaacgccauccuaaaaguuccccauacccuuccccccacuccccuacccacccacucccacuuuuuagcccuagcauuccccugaacuggggcauauaaaguuugcaagaccaaggggccucucuucccaaugguggccgacuaggccaucuucugauacauaugcagcuacagacacaagcuccagggguacugguuaguucauauuguuguucuaccuauaggguugcagaccccuuuagauccuuggguauuuucucuagcuccuccauugggggccguguguuccauccaauagcugacugugagcauccacuucuguguuugccaggccccagcauagccucacaagagacagcuauaucaggacccuuucagcaaaaucuugcugguguaugcaauggugucaguguuuggaggcugauuaugggauggauacccagguauggcagucucuagaugguccauccuuucgucucagcuccaaacuuugugucuguaacuccuuccauggguguuuuguucccaauucuaagaaggggcaaaguguucacacuuuggucuucauucuuucugaguuucauguguuuugcaaauuguaccuuguaucuuggguauucuaaguuucugggcuaauauccacuuaucagugaguacauaucauguaaguucuuuugugauuggguuaccucacucagaaugaugcccuccagguccauccauuugcuuaggaauuucauaaauucauucuuuuuaauagcugaguaguacuccauuguguaaauguaccacauuuucuguauccauuccucuguugagggauauauggguucuuuccagaaucuggcuauuauaaauagggcugcuaugaacguaguagagcauguauccuccuuaccaguuggaacaucuggauaugugcccaggagagguauugcgggauccucugguaguacuaugucuaauuuucugaggaaccaccagacugauuuccagagugguuguacaagcuugcaaucccaccaacaaugggguaguguucuucuuucuccacauccucgccagcaucugcuaucaccugaauuuuugaucuuagccauucugacuggugggagguggaaucucaggguuguuuugauuugccuuucccugaugauuaagaauacugaacauuuuuuucuggugcuucucagccauucgguauuccucaggugagaauucuuuguuuagcucugagccccauuuuuaaaugggguuauuugauuuucuggaguccaccuucuugaguucuuuauauauauuagauauuaguccccuaucagauuuaggauugguaaaaauccauucccaaucuguuggugaccuuucugucuuauugacggugucuuuugccuuauagaaacuuugcaauuuuaugaggucccauuugucgauucuugaucuuacagcacaagccauugcuguucuguuuaggauuuuuuuuccccuguacccaucuucgaggcuuuuccccacucucucuauuaauuucagugucucugguuuuauguggaggucuuugauccacuuagccuugagcuuuguacaaggagauaagaauggaucaauuugcauucuucuacaugauaacugccaguugugccagcaccauuuguugaaaauguugucucuuuuccacuggaugguuuuagcucacuugucaaagaucaagugaccauaggugcguggauucauuucugggucuucaauucuauuccauugaucuaccugucugucacucuaccaguaccaugcaguuuuuaucacaauuguucuguauuacaguuuaaugucagaagccuggccuucuacaagagaaucaaguucuaagugcugaguggucucucuagccuacaagacacuuuuuaaugucucuuggguaguuucuuaaucuuuagagucacugugccuuccacaugauguucuguacgaauucugagaaagcaacugcucuguggacagaugacucuaggcuuuaaaucggaaaaucaagaauugguaauuaaaaaaaccagugcauccuggucuauuugaaccagguuuguaagcgcucauugggguguguggggcguuaaaauggacaggauaauagcucucacaucaggaauucuuccucaacuggugacagaggcaggaguuuuuuuuuuuuuuuuuuaaaccaaucaccaaagaucuuuaguuuguuuaacauaacaugagccaugacgguguccuaacuauuuuuaaauaacagguaagauagucauuuacacuacucgucucaaacuuuaaaccacccaggcacuguaaacucuuuuagaacuagcaaaucaaucccucuucaccugaccaacaugaaaaacaaacaaacaaacaaacaaacaaaaacaaacccugcagagcugcagguuaguuuagaucucauccuucagguucuguuuauucauaugucagaaaaggggacaagugaagaaaacucagaguuuucugccuuuacaacccaagaugauugcucagaauuagaaagaugugaguggccaugaacaggaggagcugcuuugcuguugcuauugccagagacgagggugacucucagugacucaugcuccuaggcuuggagguaguguuucugcugagauuucucuugccacacugaaaggccacaguacuuguaagugcauuauuuuacucuucaguuuuuaagagguugucuuuaaagcaaaugauggagaagauaucucuugugguguggagcucucugauauagaaggaagaacuuccuaagaaaauuagcuggacuuuggccacuaaagucucucaggacguuuauaauuuuuuuacaaaaguuugccugaaugcaucaccaagcacccuauauaauuauguucaauuuguuuucuaauuagaugaacuaauaaagguggacuuccugaccacucuagcacacagauuguccuggguuugcuaucacauuaagugauguucuacuauucuuagggcuccaaacugaagcaaacauaccuguagaagcaacuaucagugugaggcauucuaaaaauauucuccagcagaauguaguauuuaucggugacaauuacgaagacagguuuaaaagagcaugucugcaugauuccacaaagcacacuuaaauaacuaacagaagcucucagaucaugagcacacauccaucuccugauugcaaaacuuuuugugacugaguguucugccagaaacagccagguuccccuuggacaaggcuagggaaagaaaagcaaaugagagaagcuggagaaucaucuuggaggcauggggaugggugggugaguggggaagucuaaaaacuuccaggcugcuuuaaauagagggccaucagcacaaccuucaggguucuuggugcaaaagauuccaccaaggcauccugggccuugcccaggguuucugcaguaugggcugcuaguguccuggaggcuggcuuacaaauggaaagucaauagguacgcuagccaggacaaaauggagaacaagggucagaacagcccugggugccaaaccuacaugggucugucugugucauuuuuaggguaaugugcuucuuuggagcucuccccucuucuuccuccucuaccuuccuacuuucccucucuccuccuucucuucuuucuuuucucucucuuccucuacuucuuuucuuuucuucucuucucuuuuccuucuuucucuuucauucuuuccucucuuccuuccuucuuucuuucuuucuuucuuucuuucuuucuuucuuucuuucuuucuuucuuucuuccuuccuuccuuccuuucuuucucucucucucucuuucuuucuuucucucucucucucuuccuuccucccuuccuccuuccuucucucucucuuucucccucccuccccuccccuccucuuucuuucuuucuuucuuucuuucuuucuuucuuucuuucuuucuuucuuucuuuuuuuuuuugauaggguauuacucugcaucccuagcugggcuugaacuuugugugggccaggcuguccugggguucauggugauccuccugcuucagccugcuaacuacaaagauucuagguacauaucacuaugucuggauaauauuuuugagguaccaccacguugagaaguguuuguuuccuacauaauugcacagggagugggguucuugagcacuauauauuucugccaccuacuuuuucauguaggguacagcuaaaacaguggugggguuuaacacuaguuacaggguuuucuuccuaacuguagcaaaggccagcuuuauacucuugacuaagauccuuagcuucuucaucugugaauauacaaagcuucugugaggcuaaacaggcuauuggaacaaaggccuagacaguggaguuuucuguuacuugaauaacuuuauccuuggcuguguaagacuaaucauuauguugcuccuaccugccgcacacccagaaaugggucagaaaagcaugguuaaauauaaguggugaguuccaucauaggaagagacaugcucaggaagcuagagaagacuguagacagaauggagacccaugccagcaccaggagucuggcucuugugcaagguauucuuucuuccauuucacccauuggauuuaggcuuaguugaacaauugguuaguuuaaaagcacauugguguccacugguguuagaaagucagggaagcaaucugugguagagcacuugucuuacacugcccacaauaaauuaaauuaagaaaagcauuugccuaccuguaggugcccuuuuucuaguuagaacucacacaccacuguguuagcaacauggguaaaccuaauggacaguacaacauggugacagaaaaagugcauuagucccagcaaaaucugggucacgugagcaaggccaucuugggcgagagaggccaucuuggaauagcuguucuuauacuggccauuggagggaaaaccuucccagaacugcagcaguaauaauuauccaguaagggccaaaacauucgacuuaugcaacaggaaagaaacacugcaggacagcaugugguauguuuucucaugauacugaaaggagcucaaugaguuaguuucuccugaauauggcgaugagaauauagacaccaugggauaaguggcuagagcucuggccagcuagaugucagccuuucaugcagcagggauaguuugguuugcugucaccagaacaagcaacuggagccagaagcuuccacuauuuagccuguaagaagaugccaccaugcccuguggcaggggucagggaacuaauguguacuacccauaccugggccauugcuuguuuucuauaaguaaaguuguugaugcagggcuauccccacuccaugucacagcuuacugcagguggcuggaggagcaaagcuaagucauucugacagaggccuuauaccuucaaagccuaaaaugccuaccauauggcucuccacaggaacaauuuaccaccccuggucuacagcaacccagguggggcugggauggaccuuuaugugaguguagaaggaaauaggcuuaguuauuuuuguauaaaggaacgagaaaaugcugaaagagccgugucagaggagugcuagcauuggagcuaauaucaccucacuguguauaguugcucuaguaaaguuaaugagaaaauuagcagaauagugucugggcuuaguagguaccaggcagguaccuaaagucuaggaaguaagcaguacaucugcaguaucauuuuauuuacaguauuauuuuaugauuuuauauugcuaaacauuugacuaacucuauuuucaugcuauguucucuuugugcccuggaaaacaugucccucaacuggaaguccccuagacgggacaucccaggggugugucucguggcuuucuuuguugcuauggugauguugugucaacauagcaguuacugacuguccccagaagugagccacacccauucauuaaguucugaccaucaucauuugucugcuguggucacuagcagugcucccuggucccuugggagagagagggcuuuuuuccaauaaugguaaagacaucauggucaugacaagcagaagcuaugacaaguacuacuuuuauuuacuuauuuugaagcaaggucucaaguaucucaaucuguccuugaacuuguuauguaggcugacauugaacuuucaucuucccugccaagguuagacagugcuggagaugaaaccucgagcuucacacaggcuagcacagcacuuuccuagcugagccacaaccccauaauccccuacuacuucuugagaacauguuccagguucuauuugggaauuguacuucagagcagaggcucucaccuggaguugugacccugcaucuccagaagagccagaugagccagugaccaauugagugccuuugccaguagucaaagugguacagacacaugacuucauguaaaccucuaauuaaacagaggaauuucaaagaaguugugaugaguccaccaucuuacugucaauauagagacagucucuaacauaaucaacuuguuacagacuuaacagcauaaauugauauugucaucuguauuccaagaauagcuaucccaaguguguggcuagugccuuuguugcuguggugauguugugucaacauagcagccacuggaagugaaaggaagugggcaauggggaugccaguugauacagugcuuguccaguaugcaugaggcccuaguuucaaucuccaguaaccucuggacaugcucgcucacccacacucuuccaagacaccuccaagucuguuuuuacuaacccacagacauguauagcaaagauuaugagguauugcucauaaaugauauaaaucaaaaauaccaugcuaucugauaggguuaauauauaccuuauuauauauugggguuaauaaauaccuuauuaggcagaauuaaguaguaaaucauaauauaacuauagcaacuauguugauuguaucaccccagaaacuauguaguuguguaaauuuuuaucaugaaauauaaauaaauauuuaaaaacagauuaaaauugcauaucuaauauaccauuuuauuuuauaaauucaaaaucuauaaauccacacaaauauugaauuuuaacagauuuugucuggggaggagccauguuguuuucugcuuuccagagaguaacuguaugauaguuuaaccaauaagauuauacuuuauauuuaaauauuucuuuuaucugaguacauuacugauuuaucuucuuguuuucacuucucuggguuucuacucuauuuucuaagccagcucaaauguagaguaaauuuuucccuacccaugaggaaagguagccaguuucccaccacccacagcauccaguguucaacuuccacacaugccaagaacucccggaccugauccaguuuacaguucugauuaaaggauuucccauccagagacucagggccacuugugugaguuuaucagucauuugugcugcagugguaaacccucagaaucccaaaguaaaauaagaggucagaaaauuagccaagcaggagcugaugagagcagucugagcuguagagauagugaaaccacuuacucugcagguugagcaucugccuggggaaggacaagccugguguuguccuucccacaucaugcaaacaggaagcugccauaccuuauucagauuuccgagcuugagauaacugaaaauuguuuggaaaucaagaagcauguuuuuauguugauuguaugauguuaagcacccacccugggagaacuagggaagaggguaaggccuguccuucucaaacucaaaggaaacagagccaugguaaggcugaccacaagccaaugguccccagaacauauccauuucccaagauugcuacuuggagcuguucccaucaaggcugcucagaccuacugaagcuaggcugagccaaugacuuguucaacuacuacuacuggcaugcuagacaccuugugugccccuuucuucucucuuuucuggaacccugccuuugacaauaaccuggaucagcauggaacagaauagucuuccuagcaaacacugacacuuccagaaagagaccugagucaauccauagcugaccagagacaaagaacaugauucuugacuuccaaaccaagaccagaggagcuacacuggugcccacaggacugugagcugaguaaagggcugugguguaaagacauaaagaaguucaacugucaaugacaugcuauacaaaagugccuggccaacacgauaagccaaugccacaggcucuguaaaguuauccuagcacgcuaacaauguaaaugaaucaugcagucuagauauaaaacuccagagccaaacauccagauagagagaacuagacagcaucuccauaucuggggaagagcuggcucaagacacuucaguugcuuggaaacauguccauagauaagucacaucugccugugagucacuuuugguuucuuccuuaugauuacaugaccucuuucacucaguucugcuucuuggucuugauaauaguugucuagcuugauucaaagcagccaucuccucucugacacauguucagccuccagugcucugugggcagaagcuuuaauccacucuguugaauuuacaacguaucuacaguagcaagucucuacaggcugaaaaucacagcguaauucaaaggccaugagguggaggagggagccaggagauaaauuccaauuucaaccuuggcucaacugcaaguuguuucaguggacugucagucacauuuaaaaauaaaauagggcuacaaagacaccagauggcaugucccaagagaaacggugucaugcugcuuaggacuccgucacaagauucuuaacaggaaagaacuugcuugaguguuugugggggcaggguggaagcauuuuaaaggccuaguaauguuugcccuuggucacucauuucagacauuucuguauuuuaaacuaaagaaaugcaaggacaugacagagacugugagaugcagccaagcuccaaccccagcuggaggugaugcugcagcugucagacuugcuuguuucuggaguagggaggucaccucaugaagaaaggaggaagugaggcacuggggaacucaccuugcaccccucgcaggcacugacgccauagugguagcccgaugacuuguccuggcaaacgaagcagggcuuguacacccgaggaggaggaaguggagauggugggcucgggacgagcuccucagagcugguacucugugucucgauggcuacaauagagaagagaggggagaagacaagagaaaauacauuuucuguuucuuuagguuuuccccagucaauuccaacaucugugcuccaagcucaggcaagaacccuagcagaacuaagcucacagaggucguuguccuucagcaguagugaugcugacugaccccugcaaaagcaaccucacacgcaucuaauuggaaguucacaagcaccaugaggguaauggauaccaaguuaccugugagaaacagaaauucaacccaaggccaaggggcaaagccuugucuaagcccagaagggaucaagcccugugucucucuccuguuuucacagcuuuccuuuaccccgagucuuguguguauuauuugaugcucacuuaacucaaaauaauuuauuuauuuguuuuuuuuuucaugacaaaauaaaaaaauguugaagcuuggcccuguaggucuauguggcugaguuuuuucgguauggccauaaugaauaaaggccaugauuuugggaaagcucugcgcugcuuugagcuggcccugggccugcagcaccaauaacccagagcuuaggaaaaggucuacuuucauaaagccccaggucagggugcaguucauguuggagguaguguagguugcaacuaacuuuuaacuugugcacauauguauucugaacauuuguuuauuuuucugaggaaaggggguugcuauuauaggcccagcuagccucaaacuugcaacucuuugcuggugccucccugaugguaaugccaccaugcauggcuuuuuuuauugcagacuauaaaccacaugaucucuauuuuuauuaucaaaccacucaaaugccacugaaauggaaaccuguagagcuuggacuagacuguucuuccaccaaagucagcauaggaacugcccuuugcucacugcuggccaacagagcccuuacgauacgaggagccuaacuggaaggaaucaaaugcaguuccagaaucuuccacucuccaaauagcuccacaauacacagaguauucccaagaugaucagguuucuaguuguugcacugcucagaauugagcuggugagaugcucuuuggacaaguuucuucugcagccacagcuguagcacucaggcuccuccacuugcugagccugauugugcauaguuggcuuggcugcuguggucuuuuccucagucuacccgagcccacacuugccacucuuguacuacaucugucaucuguccaugaaagcccuccaacaaucacugaugaggucagacuccuuaccauacuuugacaguacgugggcuuucaugacauccccucagcaagagauucaccucccaugauucccucauuggaugaggucuaaauaaucacuuucaauucuucuuuugaacaagauaagcuugcauagcaaugugagacaccaccucuacagcagugucuguaacuacagccuuguaggggagacccaggcuugaucccaagugcucuccugggcuaggagcauugucagaucugugccagacaggugaucaaauaagcagacuagccauuuuccucaccuaccaagaccaucaggauuggcuguuauccaucaccuaucucucagagugagugucauucucucagaggugacugcuguaaugaaaguguccucacuguggaaggcaguguggcucagugguagagcuugugcuuagcauguaugacagaauggggucaauucccaacacaaaaccaagggauagaagaaaacuuaagaaaggccccuuccuauuccuguucauugggucauauuauuucaucuuauuuucuauaaaauuuuaacuguugccaaacuuuagaaaagauuuuuuguuuauaacuuuauauuuuacaauuguuccccacacuuagaguauugugaggccaggaacccuagaugcuguacuucuagcugugugccaggacugggucuuccuauagaguagaugaucaauaaauacugagugaacuaauucaugaacuuuucccucccccacuucuuuuuaaacacuaagugcucuucuaaguaguuacaugauaaaauuugaaauaaaaaagcacucuuauacucauuugcuuccuuaaaaaaguaauuagcccuuuggaacagaaucaacuauaauuauaguauuuucauaauucauaggaaucuucaaaugaauucacuggggugucaugaguccuaguagauaaauccauuauaaucuuuacagguuagaucugaggacagagaugaagacauuaaucuugagugucuacuucuucuggcacacagaagcccuggcucuggggauugugguccagaggugccaaggguccagcagacaggaagggacuggcuugggacguugcugagacuugccaagaguaaguccuaauggcaaacauucucacacuccucuguguccguccuaaagcugacaggaauccuggcagcgacaggaaaugguaccuguugcacuuaguacauucaucuuuguaaaauuguaagaaaguugaggcaugagggugcgugagcuccuagguacacguuucacagucucuucacuuagauacccucuguggucuuggggcaucccuaaaagacuuuuuuccaugcucgaaaugccuuuguuugcuuacuaauguggaauuauacugagacuggggcacuguuuaguuuaugacaucaugacuguaguuccuuguuaguauuuuuccuccaaaggaucucacagaucaucucaguguauuuccauccauuuuuuuaggauaaauugucagaacuguaauuauuaaguuuaacaaagaugauauuucaaaacacuuuuguuaguguuuaauucauguugaucaaccaacuucuaggaaggcugcccccacucauggccuuugcucccaugcacaucaucuagguuggguugaugugugugugcuucugcuuuuacaucaacagcucggcagauccaucaauaggaacacucuucaugugaaugaggcauaagcuuccauugaacaccuacucuggcuugucucagagaguagugaagaguucuaucaggguuggauggacucaguugucauagccaugcccugaaucucaaaaguggaugaagacuuucuauaaauacaccauuucaauaccuguccugaagggaaccuggcauuuuaucuuccuccugaggaaacagaacaggaagugagcaauucccacacaaugugagacacagaagaguaaagagaggccuguagauguacuaaaacccuaaacauuucaacauuuuaaagaugcugagaagagccuucuuuugaugagcaccaugaauaaacugagaaggcuuuucugaaaccccuucaggagaggaaaucucuuccaagcaagcaacagagugcuagacuuggauucuccacaguacaaaggacucucacacccucauuuugugcccaguuaguugaagccaggaggacugaaucaugccagacuaagucauaugcugugugaagcuccagaugagcaagacauggugcggcaggucuggcuuucuucccagcuucuuaggaagcuguggcaggagaggaagaugguuagcccaagcugggccugggcuagaaaaugaguucaaagcccaaucuagaaaacucaagagauccugccucaaaauuauaaaaaaaaaaaaaaaacuucccaaaaaucucuucuaauuaaaugguaggguauuugccuaguauccaugggacaauggguugaaucccagaacuuaaaaaaaaaaaaaguauagucugugguuuuauauuuccucuaugugaccuacacugcuuaaagugacaggaaaccaaagggaacaaaaugaaauuuucaguagaaccauaguuagcuauaggcaaacauuacaaagcaugcucuagaaggaacaccaggaaguggcaccaagauagaagaagaggaagauuucaguacaacugcuuggucuuuagcaauauagcacaaaaacacuggcugaguuuaucagaguucuuccuacuugccugcuuacuuggcuucccacaaagaggugcgaaucagugggggacagagguggcucucuuuccuaggacaguuuuaguauuuaagguggaaccccuuucccugaacaccuuugguauuuaagguggauacagaugacucagccauugaucugcucaccaucacccugcuuuaaaucaauaaucuauuagucccuuuaaauuagaguuggauucaucaaaugcccuugagagguuucaaacauuuucuuccuuauuucaggcaagcacgaucagucuacagaaugauaaaaauuuugcuggaaaacucugccagcucagcagacaaugcauucuguauuagcucauucagcaauuucaaacaggccaaaaaagcagcuuguagaguucccauggggaaagaggcucgugccacucaauaaagccgaggcaccacagccacccugauggacugcaggcuagggagucagucuuggaggagcaauuccuaucuacgccuccugcuuucauccauuuccuuccugaccuacucuguuccaucaggucacccaccgccucuccaaccugcagcaucauccaauugcaaaccagaugaggagcuugcuucuuugcuaggacauggguaggaaggagagccuggcuguauagcugaggaaugccugggccgauaguaauguagaagccauguuagcagcagagaggcugacaucccugcuaggcaacacauguaucucggggacuggggacuuuugagaccuaagauggagccaaacuugcacugagaauauuugugcccuaccacaauuaccacacucacaagcugauccuugagggaaacaauaaucuguuugccucguccuucuuucuuucuccucuccucuccucuccucuccucuccucuccucuccucuccucuccucuccucuccucuccuuuccuuuccucucucuuucuuccuuccacccuccuuuucuuccucuguguuuuuugucuguuuuuguugugagacagaaucucauauguagcucaggcuagccucaaauucaccaugcugcuaaggcuggcuuugaacucucuuuuuuucaagagacaggguuucucugugaacuccuggcuguccugaaacucacucuguggaccaggcugaccucgaacucagaaauuugccugccucugccucccaagugcugggauuaaaggcgugugccaccaccaccuggcggcuuugaacucuugauccuccugucccguccuccuuccuucucaucaguguuccucaaaguauggccuacagcaguagcacgucacaguuaggagagcuggcccuggccaucagcuuguaacuuuucagcgagucugugaugaaaagccauucccaaccucaucuuucauaaacagaccaaaugcaaucaaaaccaaaaugggucucuacaacagagacagaggaaagcaaagagcauuccaaagcacaaacuagaaacucgcucuaacagacaaaaucauacccucaaguugguguaaaggaccaaacccugaccgucaguucugccccucucccaccaggacuggcagacuacugaggugcggggcccagagcagagaucccaccugcacacuuagguugcuggugagaucuggccccuugagccaguacaaaagcaaaaccaguaccacacagaggcagcacucacugccauaaccguaggaauugucucagucucaaagcaaagaggaaaaaccuuaaaacaaaacaaacccccaaaacauaguggguuuugcacucaauggcuggacucaccugggaaaacaguauaaaugucccuuugucaacaaaccugaguuugguuuaaacacacagaaugucuccaacaauagcugcuugacaauuccuuucgugcuuggcauuuuucuaaagguuagauuaagaagcagauaacacauuuaagagcucaguagacucuuuggccuuugugagagcuaauuuacagcccacuagacccuguugacagauuacaggauucuauguucagcuugauuagaggcagacaggcaggcaggcaggcaucaggcaucaugaaaggccugccucuuuacuagaaccuucugauuaagacaguauuuuaaugcggccucugggcagcugauacuuauguggaaaaggagcuguaaagcaaaaggcauuuccugcacagccccuggggaauuuggagccuagcucucggguaagcggguaggaaucauugcagcuaaucaagggcaagaggcaaguugcauuuggccaaaacaugcaguuagguuugaauuuuguuggcaccagagagcugaucuuguuucccuuccccccuuccccccucuacuuuucugaggauucucugcaggagaauccagggcucagcucacauacauagagaagaaagucaaaggaaacgccaaaguucaucuaaaguacaaguaauuagaaccagauuuggcuguuacagugcgcuugugugagugagcuugcagagcuuuuuuauuaacaugucauuugcaggccuggggaccccuggauggggugugcggaaaacucugcaccaaccaugccuggggagauggcucaugggcucaaagggagguuuguaaguguacaguucucuaggagggcaggcccaccaguaacgcagcccuaggaggcuucacagagaggcagcagcaaagggaaaccacagcccaaccuuggcauccuggcuccguaaccugcacgugaccccgacacugugugugcuuucccugucagcgcugaccauaaagaagcugcgaaagggugugggauucucuccuacucugaccaugcauguaacaggugcugcacauaggcagggguugacaaagcuccgugccaaagacuaauuucugagucacuaaagaaagucuugcuuuccauaguacaguuccugacccucaucuggauggucuuuuagggcacaggacccagccuguccugagacucuggaccaucugggcauccuaaggaaaagccagguaauuccugugcacauuaauauuuagauaguauaacauaaaaaaugccauucacuauccucaccaccucccaguuggcucaggaacuccaccagguccccacuucgggggguguuucaagccuuagauguaggcuuuguggaauuagcuugugauaacccaggaacucaguucuugcucaugaauuuggcuguggcucccaccagugcuggaagaacccugaaggaacaguaucuaugucuacuaagcaguagucuugcuugcccaucaccaaaaccauagggagggaaggagcaggagcucucccaugugcucaaacacauucuacucucuuuaauccacaaaaauaauuucccaacacuggcaugauucaagcucugggacucaaagagagaggcugucguucugcuugugacuccccaccuguuugagcucaccaccgauuggagaccucacuccugagagugacauuuaccauaguuaaugaugucauauuuucacaagggaccacaacaacaugacaccuauauuucaucucuaucacaugcaucccacuucaaggaacauacgugaacuaugugagucuguuuucugagacaucuuaagucagcuuaggacaagguucaaauaguucuuuccuaaaaagcacaauaggcugacacuucugcauguuaaugaucaggcuggagguacuggagauagagcuacauugagagaacacaugcugagugaaccuaggagucaggucagcaugggacugauguggccacagcauuaagguucucccagagagauuauccgaaugccacaugguuccguuccacauucuacuucuaaauuaggagucuaauagccuuuaagaugguuauuguacuaacauuguuuucacguguucaaauaucccagguagaaaguagacuaaaacaugaauauuaaaucguccaucaugcaugcacaccuuuauuuguggacccaaggucagguuggcaucacucuuacaaaaaaagucacaggaaagcuaaugugauagcucacaucugucacuguagcacucuggaggcugacaggaaccuuaugaguuugaggucagucuuugcuacagugaguucaggacugcuugggcuauacagcaaacucuugucucaaaaauaaaauaaaaguuaaaaggagaaaaaugaaagcaauggucagaugauuuucaggggggcaacagugaaauccucgaagccauacucugcccagugcuguucugaggaggcucagacaugaacaacucauacgagauuuaaccaaaccuuucuucucagaaguagugcucuacuugacugcauauauguucccuggagguuuuuguguuauuucuuacggguauaugccauauuuuuagccuacagugacuaugaagugaauuuaauucucguaauacagguuuucuugaugaugucaugcaccuguguaggcuuuguugcggagaugauaggaguuccugggcuuggcuccagggucaauuggucuucaccucccucuaccacacaugaacacaauaacugugcagcuuucuuuacuuuucugagccucagugguuccuuccugaagauucagauaucccuaaaauucuuguuggugaauggaaagcaauauuuggaacuugccagguagucaggaaggacucacugaguccuggguccucauggacccuucccuuccugcaaacacuuuuuuuccaccuucuuauuuuaaggcagggauucucaaccagcaacaauguuuccuguaggacacugcaguacucuaggcuguugcaguggggacugcugcuuaagcuggaccagcauccucuacuguaggacuaagacacaagugggcagacaacacaguaagccacaaaugccacaagcuaaggcugguggccacaagauggcauaggucugauggggggcugacaacugccuuccaguaggaucgccacuggagccaggcaaugcuauggccuuguacgcaguggcauuggagcugggcuccuccuuccccugccccacuugcucucguaggccccucugccuuucaagugccuucugggcuucuuuucugcaaccaaccuuauguuccugucagagcuauuuuugauuuuuauucugaacguucugaacgagagacuaaagaaaaaacgcagccagagacucuaguacccuugaggcagagucaucagauaggguauaagacaucucauagggcccagugaaggucuuuccccuaaacauaaaaugaccaaacucaaauuacaaagggugcugaaaugggaaagacugagcaaggugaagagaguccugguaaaaagacucuggcaagggaugcagggaauuacagagguagucuccuuguagcucugcaagugaggacgggggcauugguagucaccuuugcucuuaugcuuaggguccacucuguggaaugggggaugcaugcuuacugcaucuugaaguguguuucucauuggcuacagcgaggaggggagaaaacacacaggaacagccacugacucuuggauauugguaugcugaggcagagggcuaagguccauguguugguauggcucacagucaucacaggaaugacaagugccucuggaguuuugccaaauaacuccaccaagcaauaguaaacagguuucauugaagcagguggcaugcuagucacccacaagcuuucuguauguguuaauucccagggguagcccagaguguauuggauguaggagcauuuuagaagcaagauuucagagggacaaggcggaaaggcagcacaagcuaccagcaguggaggccagcgaacaguguugaacaugucucugaacucaccuagccuugggcucaagaguauaagagccagggaucaggagaagauaguucuaugcuuuuaagacuuccaugaauguucaggcagacagacagcagauaaacagacuccuggucagcacaauguacaaacuggaaaacuaacaagucagggaaaagggugugauacauuguuuucucucuggguuggagaccagagcaguuagcauaggcccuuguggaugagccacccacacaucauguuguccccucacaccacaggcuccauguacccaaaguuaacuuggugcagcaagaaaagcaagauuggaaagccuguggccucugcagccacugugaguacucguggaaggucccaucguggagcuggauuauccccuucacagcaggaucuggcagguaggcagggagcugagacauggaacauggugagcauccagcugugccuugagguaacuagugcggagaugcuguuacuaauggagcccgguugaauacagcaaccucaggccacauuuccaucaaaacugcucaaguuucuacagagucaucagcugacccuacaaccggguuccauuuuguggcucuuccuucccuagcagguuucuauuaugagagaaagcugucuucaaguugucuuugucuuauuucuuaaaaaaaaaaaaugugaaggaaaguuucaaaaauguuccagcugugggauccccaaagcugaaagcuuucuuggauauucugaaagcugguucaucuugauagagggguagcucguuugagggcugggguugagagcauaagcccuggggccugccgcccuggauucacagccauguguaucauuuccuagcugggacuugggagacguuccuuggcuccccaggcucacguucuacugguguaaaauaauagcaaggcccucacugaaugguugagaagauuuaaacgcacaucaucauaaagcauucgaccugaacagagcagagggcugccacucaggugggggacucuggggcagggagugucgauguucuuccucuuuuuaguuuccuccuggcugcgcccggggccguucuaucuuggacgauuaaccuucucuuccacuuuccccucccacaaccauuuccucuccuaacaaaacugagagucuuuggaagaacguuaaguggagcaaggcauguucccuuguuucucacagagcguuucuuucuaaguccauggacaucuguccaaagcucugauuccacucucucccauggcuuacccuggcaggucuccaauucaggcugccaaguacccguagaguccauaccuauaacuccugcacuugggguggggugcugaggcaggaggacugcuguuuguauaaagccaccuuaggcuaauaugugauucccugucuauaauaaaaaaacaaucaaucaaacagacaaacaaacaaaauaauagacuacuuaauuuauguggacaaagcagcaugggcaggcaugacuagccaguaucacagcuggaccaaacaagucauuagggagacugccuacacagacagacagcuagaagacagccuguuauagccuggcagcagaggaugugacccacacugugcacacagcacuaggagcagcacuaggccaaacagcagcuuuguugccuugcccuugcaagauguggguggacaauugggaaaccaucaggagaaugagauggcucuaaccugcccaggacaguaauacucugcauugguagauguuagagcuauuuuaucacuucacugcccaauaugcuuucuggugacaaggguacuggagagcugggucaggucacaaggaaagucacagccuggaggcucuauguuguagccuaguucucauagacagaaacuggcuugcuguaggacccaccuucucauauccccacauguaaaucuuguauugauaaggcacguccugauagcuguucuugagggcucugcuugguuuuauagggguuuguuuguuuguuuguuuguuuguuugagacaggguuccaggaaacauggaacucaauguuucucagugauucuuuugucuuagccucacaaacacagugauuaaggcaugacccaccauguccagcugauuuuuaaguuuuaacaaaugacaccaaauaaacuucucggacucguggccuucauagcuucuccaagcagcagggcucuguugcuagggauguguguugccaucugaaaaaugugacugauaggugugaccuggccauagcccagauuaauuuaaucugcugagcuauacauaccgauaaacuaaacucuuucuccuaacagcagcuccccauguguaggauaaaauugaugaauucucucacuuccaggagagaaagagagacagagagagagagagagagagagagagagagagagagagagagagcgggagagggagaaagagagaaaugaacacugagaaagagagacaccgagauacacaaagagagucagacacagagucagagacagagagcaugacagccauaugucacugagacugagacauguuuugaaagcauggacacuacaaugcauuguaaggggcugguauuauuuuacaaagcucaccuuguggauacacuuuuauuagucagaggggucagcaugcucgccauaaauacauuuuugaauuccuuccugcauacucugucucuggauuauuuuucaugucuuguuuccuggcauacagucaggcagaaugugggaguuuuaauaccuuuaauccauuauauggacuuuuuaaagguccauaagacaaaaauaaagugcacuuucauggucaaauaugcaauaaaccugauauguccuuuaauauuucauaucccaucuuccauccuggcuguggcuguuuccgaguuucaguguacagaaugacaggauguaggcaaacuuacugcuaauuucuuauuugauugacagaacucuugacaauugauaaacaaugcauuuugcugggcacuuuuaggagauuauuguuccccaauauugugaagauuugaaaucacuauccacuuauauaucuauguguauguguauuguuuugcgucugcgacagagccucacuguguagccaaagcuggccuuaaacuugcagcaauccucccaccuaugccuccagaguacuggaacucuagggcugugccacugcacuaggcaugguggaguugauuuuuaucaggucauugauuucuacaagcaagugucauguggacacaagccuuguaauagguuuccucaucagacugccuucccaguucccaaacugcuuacauaacugcccagcacaccuagugaacuuauugugaauguuaccugcccauccgaauguacucucuugagggaugcaguugucugcucauggggcugcuguauuuuauuugcucccauggggaagugaauuguccuccccacccuggacacugcaauucacaaucauugcagacaccggaggugaagggugguaaggcucacuuugauacgcauuagaggagggcuuagaucacuggccugcuaccuugugugaaacaucuguuuucuaugagccaguuaaaagugcaaacaucuguaaauaaaaagcccauaugugcacauaauuuaaugaacuaguacauagagggagcugaagaguagagaauagcaauuagaguaacugcgcauguugucagagaugguuuuuuuuuuuuuuuuccuuuucacuugggagcacuuuuucuguggguucugagaaccccugcucuccccacacaauaacuggggguauauuuuauggccagcagaguucuguucugugcccucacauggugaaaagccucaccaucuuuucugcuucucgaugcugugagucagcuuugcuuuccucuugcccacaaacacucuucuauaagaugaagaagcaacagugccuuacuccucaguccauugcuuccucuaaguagcagcucacaaugagccuccuaaacgcuguaauccugcugacugucucaguuuagcaaagaucaagcacaaugaagacaccaaggcaggaaguaaaccugggucaaguuucuccuaauuuaucuuuuagcuuuauuucuauuuucuuuuuuucacacuuucuagagaugggugagagaggaggaggugggaaauaguaggauuuuagagaacaggaaaagccaugaggaaaucuacacugccaccaacgggugugccccgagacagaugaaacugccuccuauuucugaacauucccagauauacauaagggcuuguuguggaagcuagcaggaacugcaucagcuuugcaauagccuugaugucacuucuguuucaaguaacugucaaauaucuaaacaaccaaaaagcagagaccaccugagguagucugcaauucaaauucauuuccacugaaccacaccuaacauaguucucagcaucuaucaugugccagguccuguguuacaaacaaggcacauaggguguauucaggaggaaaugccuauagaagagagugccuggaauuuugcacaaacaaauaggggcuuccauggaguccugcucacacucugcuuccuugaaguuuguugcgauguccaaacugauaguugauguaguuugaagauguuggaauaguguguccacugcaaacccaggacauguauggacacauuguuugcucccaugauacaauugucagaggagucugaaggggaaaccacuagguucucugcauuguuagggaaaagccuucaccgugcucagagaauaguucuucucugagggaaaagcaauucaacauuugacugagcuuccagcucugcaacucuguuuacauucuccuguggucuguuugccaucuacuuaaaaagauaauuagagcuugcuaauagugaagagaaacaaagacugaagacgcuggaggggaaagagaggcaaacagacaaaauaagagcugaggcagacagaguugcgugcccucacuaggccacauggcuauugaagauuaaauuaauucugauaaaacaguaucuauaugucaugugcucaagagccaugugugacuuucaucgauuguaucagaccauguauguucucauauuguuucuacauaugggauauccugcugaaaggcaugauaugagauguacaaaagggagucuaaacaucuccguggcauacaguuaacugaguguucauaguggaucaagaaagauaacaggccugauaaaauagaggcagugucugaucucagagaucuccuagugcagaaacacucacaugcaugcaugcacacgcauacacauauacacaagagcacauaccuguacauacuaaaggaagcaaacagacacaggaaacacaucuaagagcagauguggcaguagcacccaguuguuaacugaacacacuuucaacuuucugaacuuagcuuuucacacuaagacacugggaacauacucuguuuaaugagaaguguacguugcuccuguugauuuuugucaacuugacacaaacuagagucaccaggcaagaaggaaccucaauugagaaauugccucuauuuuaauuggccugugggcaggucuguggagcauuuccucaaugaaugguugaugugggagggcccagcccacugugggcagugucgucucugggcacaugggcuugggcugaacaaaccagaauucuguggcuucugccucugcucuugcuuggguuccuguccugacuucccucaaugguagguaagaguguggaagccaaauaaacccuuuccacuccaaguugcuuucagucaguguuuaccaaagcagacauaugcccauagccucuuccuuaaaucuuugauuaagacuuugaccuugaacuuguaugguaaacaucacagaucaauuucccagaugaagaggugaggcagcuuggagcuuaagcucccagaacacaggcaguagguggaggagcgugcuccugaggcugcugugacacaugggucaugaggucauccaccaucacacaugaaacacccacaucuggggcuaccaugugacuuccaacaaaguguguuugaacuguaucuaaaaucacugaauuaagaagagaaucuuaacagccagcaauaaucauuaugacuauuguaauuuugaccaaaaaaugaugguuaacuaagguugggauccucuauacucaauggguacuucaagaagguagcagauagcaaagaucauucaguuucaccaucccauggauuucuuccauuuccucuucccuccucucucaucuacuccacuuuccacucccccuccccuccccuccccuccccuccccuccccuccccuccccuccccuccccuccccucuccuccccuccuccuauuccucucuugcccuuauuuucuuuuuggaaauggaaggcgcugcuuaaggcagcaucucacacaagccacuaacacacauacauacagacuagaguggugugaaaagcugcaccuccuguugcuuagaugcucaggaaccucagcaauggccucgcagucagcccagccucaggauccuuguuagugagaaggaacacagcccgcuaccaacaggaugugagaacaaagaggcuaaagugaaacgguuccucauaguucuagcaguuuccuucacggucuaggacaccaucauuuauguuagagaaaauaauguaauuagagaaaaucaugugagccacaauucuguggugauccaggcuucccaucccacuccuaacacuccugggggccuuacuugacauuaaggcauaaagcauuuugcaggaacugucuacucaguagacagugaugacagucuaauggcagaggcuaaagaccugcaagggaaaacuguguggaagaacaaaucagcuuggugggauugucauccaggcucacaguuugcugugugaccucagucauacugcuugccuacucugaacuucuauuuucuuaucuauauaauguagauaacaacauagucuguggaggauuaacuaaaucuauauauagccagcaauauagaauucuguuaaauauauaaggagccaaaaggaaaacucacugaaagucauggauuguaugucagaaugcaguacucccuuccugcuguguagcacacaugcuacgauguugugcagacuaaugaucacuggacacucuugcuacccaccacgaagggguagauuuacugacuguugucuaacccugucacugguuaaacaccagaagaguaaaggaaacccgaggccacucugagucuuuaagagacacuucagcuuguccgucuuggaaggcuggcuccuggguuaugagaagccucccuaacagauccccugucuggucuuccagacaccagcccuagccuaggucuccuccaguaguuaacaagcacauggcccuuggagggagcuuuccugauucuggaugccacugucccagaugaucccacauugaguuuaguggaaggacugacaagcuaaguucaucuacgggauggcuagauaacaaaguguugggacacuuaguuuuagggugguauguugcaggacaguuaagucacaggaacaaucaugaagaaugagacauuuccaagagucaaaguaaacucaacuccauccccaaggaacaugauuaugcccuagaugcuccagcaauguccacagagaagugagguggaggaugcgcauuaccgagucauucaggguagacuuugucuucuuuuguccaaguuuaaucaugagccucuacugugauaaaauggauaagucucuuuauccccagcugugggucucagggacuccaucaucaaucuuagaauuccagagacaugcuuauguaaugaggugugugucacugacacacccuaguuuccucuaaguuuggagggagcagagacaguggcuaaagguugccaauacccggagaggucaaaucaaggcaccucacacaugacagacagccaagagucugagccaacaggaacucugcaggaccuaacccauggacccauggagaggugaugaggcuaugcaggugccgucacgacugugaggaccauguuaacuuuacaagggacaaggcuuacuugucagugucaguaaugugugcaaaucugaaacuuugguaaauggcugcccccgaaucaguaccagagaacugcccaaccuuugacaagcaggaaggacugucaucuaugugaggagcaacagacagaggcgaagggauaaaguaaaaauuagucccaaaaguagcaccugcuguucaccagcaugccccugcccaggcaacacaccaaacucagucaagaaagcacaaccagagaccucuggauguucccaagaacagaaucuuauuuuacacguuugccagucuuuccacagauccugcauggcagacaugauugucuccaauucauagcuucagaaaucgagcucacauuaaaucaagcuauuucugauaucucagaacauuggacagauguggggagcagagguggagagauguaaggaaagguagcuguggcuggcagccaggagucaguccugaguacagcagggcagcucucacagccucugccugguggcaguccuucuccucucacugcauagggcaccacucacaggcaaaucagcacagcuccucuguauacuccuacuugccaauccagacuucuucucaucuccaguuccuauuguuuccucugauaagcagggccccagugaacaauuaaagcuuucaauaaauaaucucuaagcacauucauuugauugacuguuauuugauacagcuguuaguuucaauggggcaguuaauauugaccacauaaaguacuccagacaaacaugaaacagcuucagaacuccaugcauuauuacccuuuaucugccagucauccgggcuacuuauaauggucauggaauuuaaaaaucaauaauaacaauuaguguucuguacacccaaacagaucaaucaugugaaauguguuuucauauaaaaaucaaaggggaacaagccuggaacacagagaaggcucuuugaauccccagugccuacuuggcgagguaccuucauuggagccuucuggucagguagcuagacucaaacaagaguguucagggcgaaauguggcuacacacacaggaacacagaaucucucacaagaugaacaugaucaaaggagcgcuaacaaacacuaaaauuaauggaacugguaauuuacauccucagagacgcguggcuaguuaccuuucauuugguaggcauugauggcgauuauuuugcugagaaauggcaacagcaguauuucagcuucacacacugccacugcaaugucuagauaauuaaaauucaaagcaaugaggaaacaucucaucccgaagcuguaagcagcacgguacacgaagccauccauuccaaagacuuguuuuucaucaauuauuuguuacuuuucugauguaaauauaagaaggacuaauuaaaauguaugacuuuuauacagcuuguuauuaaagccaaugaaagcauucugaggaccauaauaaaauaauuacgugugccuuuaagaauucccuucgcaauacacggugguacugaguaaaaugaaaaccucggaaacuguauuuugaagccuccacuuccauuuuagcuaauuauccccacaagcuuugcaauagaccagacccuaaaaaaucaucugaagcuaaaaggaccuucagacugucaucagccuuuucacaauuauggacuuugaugacacaacaaaggccguagcuguggcaaccguuaauauuuuugaggacaugaagucauuauauugcuucuucaucuguucuggaaaugggaagaaaauugggaaaaaugagaucccguucuccucuccccaguuaacugcugcacuuguuuagucuuaccugcaguauuuugaauuuggcaaaguuuucauuugugaaaaacaguaguuaauacagaguagcaaaaaccaccauucuuguuuuguuuugucuuuagaaagggacuuacauagcucaguccagucaagugcacugguccugauuuccugauucuucaucuuucaccuccaaagaccuaaauuacagaaggguaccaccaagcucaccagaaaaacaagcuucucccucacaucccaagaccaggucaauuuagggaaauaaguccagauuaaaguuuacaaagcugugaucuuuaaagacaaguguaagcuuagagagcgggugaaaccuuccauuggaacuuuucuaccucucaagacaggcacuugggaagugaaaacauggguuucaagugaaaaggaaaauggacguggcaggaaacagacuuagggucuggcagugaacaaauuggucauaugaugcagagcagggcagaaacuuugggcugaagaagcuaaauggaggcugcagggauuggcccuaacagcgaggaacuggcaggguuugugggugguugguacccacugauugcuggacuuuguuagaaggcaaagaaccccacaucuggcagcugaggaaggggcacccacuacagaguuguaaaaucaugucucagaagacauuuauuaaaauacucguuuucuaucaaauuauuuuugguauugcuguggcuuguuagagccaagauugcuuaccaugacucuucaaucugagauuucuuucuccccucucugggugggaucucuccuuuugaggcccugaaaaccugaauucuugaggcucaucugguaggaaugauagucugacaucacuuccuauaauccuagucuuuuucuguguaauccagaguccuacccaacucaccccuuugcagcucugcaccuaaugaggcuggagagcaagcaaauccacaguccugugccugccugaaccugccugagacaggcagaaagccccagaugucacaguuccugcucuugguagucagaacuuuuaacccucucauuuaaagaggcuugaguaggaugggaugcagaucucacaucaacuuuguuuucuuuaauuuguguuugagacaagaucucuauaugaccuuggcuggacugcagcucacuauguaaaccaggcaggccuugaacucggagaucugccugcuuguaucucccaagugcuaggauuaaaggcaugaaccaccauacccaguagaucuuaaggauaacgcaggaagccaggcaugaaaagaggauucagagcagcagacugacugaugaugucacaagaucuugggguggggugggguggggugggcguagggagguuaucgagcuuccugcuuagcuagaggaacuuagaccaagccacuuucagauaagauccugaucuauuuaaaaccugagcugaccauccuccuuccuccaacaccucaaaccucaacuuuuuaaaggccaucgaaggguucuuucagaugucuuuguaaccauucagaugaacuccacgccccucccccaacccaccucagcucauacugaaguggagccucgcugagccuaucaaucuuccaaggccagccuucuauuuacacaucuacaauuggcuacgaaaggaaucugugcuuggaagaaugacccagaagcacaagaugauccccaggaauaguggaaacauuaaguugugagcucuccacuuauauugaccauggaaucgcaaggcucucugugccacccguagguucaaggggcaaccuagaauaugucguaauggugaacuaucuggcauauuucagugauugacaugggaacugugacggaacauuugaaauugagguuuucuagaaacguggagauaaccagccuuugaaaggcaacauuggacaucaauaucuuggcaaagguuuccagccuacguuuuucugauuaaccuucaucaaaaacucccauaucugaaauaaucuauuuaauugauaguuagcugaauuuauauuagaacauuuaaagcacuaaaaugccauuuaaggaugaauuuauuggcacuuacauguagcucacacucugaaggagagucucuucaagagcuucuaaaugaguguuucuuagccuuccuaaugcagcaauccuuuaauaaaguuccucauguuggggugauccccaaccauaaaaccauuuucauugcuacuucauaacuguaauuuugcuacuauuaugaauuauauaaaaauguuuucugauggucuuaggcaaccccugugaaagggucauuugcucugucgguguugagacccacagguuaagaacccauguuuuaaaugccccacaguguuugcuguuaaaccugagcaaugucaaaaggaguuucaugcuuagacucucagggguuuuccauuuccaauuuuccucccugacacuaacuuccuaauuaaaaacuguccagacuucuuucuucaaaauucuuuuuuaauuuaaagaaugauaaaucuccuaagaguagaauugacagucuucaucacuuaucauguauuucgucuguggaagaaagugaacggccuugcuuaauauguauaaaagaaaacaguaagauuuucuuucuauuuuagcuaugacccugcuuaauggguugaugggggaaaaagugugugaaaucuaaagacuauaguuguauucuugugauucaucagaaaacaaagacaaaauggaaguaucaaaccaggacggucuuugcugguucuggaugguccaaaaugagaaggagaccccucauucaugccagccaacccagcagaagcugacacuccagucacuuaucuaguaagagaaaacaaggacacaucccaugccagggcuuucuguuccuacuugacaguugauucaaaccagagaggcuaaucugguccaaacuaacagcuuacaguuaagaagaugcagggcacugccccucccaugacuugguuuggggcuuuggaauucacccuuuucuggcaauaaaauuuaaucgcugcuuuucuguuuccccuguucuaauuugcaaacucacccauuuaucuggagauugacagauuucucuuuucuucucucucucucucucucucucucucucucucucucucucuggcgacugggaaagaaaacuuuguucaucuuuuguuuuugaagugacccuguggugcacucucucugagauuucagaaguccccguucuucucuucuuucugacacugucacuaagucaugcggcugaacagcagaaaauuauguccuacuuuagaaaaacaaguggcccuuuuuacugaaauauuuauucaaaaugccacucaguucacauggcggcugucggucuucauggagucuuucucagaagguaacuuugauuuugccacucugaucucauguuauagcucacuaggagaggacuucgcuuccacuuaauacuucaaacucagagcccagcgcuuuacgaggagaacuuuucuuccuuaaucacacauugcuaacuguucauuuuuaaaaauuucuucugaauaggcaaacccccauguaaaaagacuuuuuucuccccucuuuugauguguggaaaagggagaacacggggaaaggagccaagauguugccacucucaugacuucaucaaaagcaacuauauuuagauuuuuuaaauaaugagguuuaauccgugcccauaaagcaauuaauuccgcaaaacgucuggaguuacccaaaaacaagagaauccaggagguaucugaauagacccuuggugacccagggccgucuuuuuguuauuuacaccacauucccuuaguggccccuaauccugauuuccaauauuuauaccaaacaauccacaggcccuaccacaaccaacagcugguuggcauaucaauuuucugucuuucaaauuaaaagaaaaauagagaauucuaacacuugacaaagugaggcucuggggacaauauguucaaagguuuucaacacacacagacacauggacucgcacaagugcacacacacauacacacacacacacacacacacacacacacacacacacacacaaaaccuacauaagcuuccaaaguuggagauaguuuuguggaauucagucccaggcuuucuuuccucucugccccacuguuucuucuguauuaagagcaaaguugagcugcgucuuuucaaaacagccauuagguaaaauggaaaacuaaguccacaggauuuaagcuguuacuuaugcaaagguaguucacagggcuuuccuuucaaaagccccaacacuguaagacacggauacuuacuagaauuucuuuugaaagaauguuuuaguuauccuuaaucucuggaaucaacagaaagaacugggauuccuugguuuguggacaacagagccagucugagccagucugcgggguaccggcaauauugacacuugacucgguucagcucuagguuggaguaugaguugaaacccuagcugaagcggaccacaaugagcccugauugccuugcuuacaaaaacaagacacuggaauuccugaaacccuuuugucaaaugcuuuuauuuacuuugucuaaagcagguuucuuugauuagcgaaaccuuggugcuauccacaguuuuugcuuaucagcucgcccuaggcuagugagugacagucagcucggcucuccccagauaaagcaaaucccuuguuuaacauuaucaagagcaaacaaagcuuuucccuccacucuugaaaccuaauagguaaguuaagcaggguaauugcaaaagggagaauuucuauaaguaacuccucuccacagaaucucuuuccaagacaggucuucccuucuacuaaaaauguuucaggacaauccucucuaagaagucaaaguuuccucgugcccagucccuagaaucucaacuagaacguuggcaucaguuuaauugcuauggaaaggagggcuugagggcaugcuagugacuggaaaauauuuucuaaugcuaaaguuuuuugccuucuccaaaaagaaaaugaguagcaaagaggagaggguauuuggggagccgaugacuauuaaggcauuuccuggagcgaucgauacucugugugccuacauggggcucugugaauacuaaguuggauggcaaggccuuuggcaucaaauaaaugguuaaugguuuuccaacuccaaaccuguugauuugcuggcccaagaaguaagucuuuuuuuuuuuuucuuacuguccuuuuuccuaagaaaaaguuucagagagucagcugacaugcugccccugccccuccucuauuuugccuuuugccucucucuuuagacaagucaccuuguuguuaggaaaacucaauuucucccaguuaaacuuugaccgcuuuguaaacaaggauuuaaaaugucauuuucaggcuaaugcuccaaugaauugucaaaucaaguacuaaaaacauuuugauagauagaugagccauuuaucuaaaucacugucaggguggcgaagcauccugcaggcucccacuaccaucagcucuauguaagauuucccaggacuccuggucauuucucaggccugcagcugagcuacuguugacugaugaagcugaagcaccaugucagcaucagauaaccaaacagucaauauuguuuuugaaaacgaggcuaccccauuuagauuucuuuuccuuuaacugaaguccaggcuccugacugaauuguaagguauggaaauaaugaauggccagcccgagggguguuggugaccaggaguaaccuagcaaaacagaaacuucuuagaccaacaaaguaacucggagagauggcaguggggucacagcuaagacauauugccuuuucucggugaagggaacgagggaggcagcaucuugcaccauccugcccgguacauuaugaacucugauuaaccgccuuuacacgguugcauuccuugaagagaccaugucauauuuuaauuacuuugcacuguugaaauacauaagggggaaguguuacugagcucguggcuaaucccagcaaaguuaaguccccucucuacccguuacacaaauugcauggaauaucagauugcacuacuugaagaauguucaaaguccguggucaccuucuauuuuuccccuuccuuucguacuuauuuaaaaacaaacaaacaaacaaacaaaaaacaccuaucuucaagaaagaauagggugguaagggagaacaggggcgcaggagcguuucaagaaaccucuccaagggaauuucagcagagggaauccauaugcauggcagccuaucacaccccuucagcauuaaaucauuaaacccuuugucuugccaccacugcacuuuauuccagugucuuuauugcaugcaagagagacauuuauuuuuccuugguaaaagaaaggaaaaaaaauaauaaaccuacauugagcaguaugccggugcugccauucggccugggugaauccacugaggcaggcuuugagagccuuuuccugcagcaugcaggaggaagggcucgcgguguagaaauccaggaucugcccgggacucacugacagaacauccauacagucaaacaugaucucuccgcaccgcgcucugcaaaagugcuuauccucuagguguggaggcgagccgcacagaaaaguccacgaacuccaucaaacucugccccuuuuuuggcacguaggcuguuggucuuuuucccagccccgaaucaugaauuaugacagacaagccagcuaaaagccuguaauugauccaaaugaucauuua

SEQ ID NO: 12507 - RNA, 19963 nt, Mus musculus
cagucccuggaagcagacguuucggccacagacccagagaggaggagcugacaaucaggaggcgugagccgccuggagucugcagaauucguggugugaaugaacugggggcaucuugggcacagggauugcccccccuccuuccccgccucgggccacaguugaguaguggggcauuuuuuuucaccuucuugugaagaauuuuuuuuauuauuuguuguaaagucuuuugcacaaucacgcccacauuugggguuggaaagcccuaauuaccgccgucgcugauggacguuagagagggagcgccucgccgcggaacagucgccugcgcgcccucgucggacccgcggcuccugcacuguguccccgcucggcccugcgcuugcugcucgcccgcgcgcgccggcgcccucucgguuccugggcacauuuccacgcuauaccaacuccucugcccgaguccgggcgccagugcucgcuuccgcuccgggucgcugcgcccacccgacgcgcccaggaggacuccgcagcccugcuuuggauugucccccaaggcuuaaccccgacgcuucgcuugaauuccucggccgccuucgcucggguggcgacuuccucuccgugcccccucccccucgccaugaagguaaguguucugugcgcacggacgcucccuacuuuuucccccccuuuucaaaguuaacugaacucuuucaaucuaucccuauccucuccauuucucuaacugccuggagaaagcuaaacuccaauaucgccggcagggacuccuaucuuuucgucccuuacccuggggacacugccucugcguccuuggagacuuuuugcaccggcuauucuucaaaccuuuucaacuauggagaagagcgagggcaggaaagacaguucgggucacaggcggcgcgccuuuuuaccucgagaacuggaguguaguuuuacuacguguauuucagugacuggauaaugauucgauucaucaaguauauaucaaacgcucauuucaccggcacgcggagauuguguggcugaagcucugaggccggaugaggacuguguuaggagaaacggcugcgagacuaaggaaacuaggggccaccuacccuagagcaacgcacaccccacccccaaccuccgaucagggcccaguucccggcucuccaggucgaguaacccgagcguucccggccccugugccuuuaagagugccuggcggggggccagagcgcaccccgcgcggggagcagggucgcguuauuagcuuuauuagcggccucugggugagcucagguccuuuacugcagcauugggggcggggaguagugguccuaguggcuuuaauccugcccccugagcggagucaaccuagugcuuuggagacucuagggccucugcguuucgagaucgggcggggguuaguuugugaacucguguuuguuuuaauugucaguuguauguuaaagccgagucacacacucugagggucaccgagaguucacuuuuacaaaaaaguuaacguuucgucuugaaauauaacuagcaauuuuccaaacaacuuuuccuucgguuauccuccacgccucgauaacaauuuccauuuauacuucauaccucucauuuccagcuuucuaguagggaguaaggugaagaucgguacgaagcuguuuccuaaaagcaaacaacguucuuucuucaaagaaaggguuuuaaaccccggugcuucuaaggcccuguuuuacccucuaugcccuguccgagccacagcuccguggucucacuuuaaaugaacaauucgcuccugggaaauaacuugggucgggugaugaggucguaccuccucagcaucugcugucuugacgauauuagcacaccuagccagauuuaauuucaagacauuuuccaucaggcgaggcuuugcgggggggggggggauuuggaggagacaauguuguaaguacccagcaauugaggaauggcggaaaguaggguaugagaggacgcguugggacccuugcuuugcuuuggggacuuggggagcuggagaucaguuuuugacaagcuggcuuuagucuuggcgguucggcccuagauccuccaaaggagguccagcccaagacccuggucuucccuuccaaagcgcuccugugcacaaggggcgcgcuacgugccggcaaaacucuugagcuuuaacgcggccuuucuaaccggccgcgcggugccggcugcccccuguuggccaucuggaaauaaggccucucugagucccaguccuucaacuuugcaccccuggagacaacucagccccacucuucccaccaagacccuucuaaggucuccgccaggggacaaucuguguuaccccgagcuucaaauagaaaagagccauagguguaacccagcaaugaggccuugggcaauuuggacuaaggauuucgacccuucuggucacuggugagggagugucacaguacaaggccucggguguggcccugguugucucaccaauucuuucugugguccuggaugcuuguuguguuucccucucucagccucugcuucuucauccauuaaacacagaaacaaaaacagugauuuuguuuucauuuaugaacuucgucuguaaaaaaaaaaauccccuguaaagauugggagugaaccgaucuuugauuucucacucucucuuggggcuacacaacuguuuuagacaaaugacucugugcucaguuacucgagguaauuguguguggguccuugagaacccugggggaacaucgcugaagcuuaggaaaagagccgaaguuuaucuccuggacuauuacuguucuccgaucuccuggcaauucugggucacucgggaauuuuucagguuccuuacccugacugcagcuccagacaaccucuggcuuaucucacuggcuauuucugccugcugcaugugcucugaccacguguauucaugaagugggacagguacagcucagcugggcccaggcccuaaagauggggagcaacgcuucuuuugucuacucccccuuaagcagacauuggucauuucuucauugucuucucucugccauucuugaagccggagaaccaaguuuguuccagcgacagaguucuucucccucaaguuucuccaucggucuucuugguucagagaaagagcagacuggagaacacuguucaauuuccaucucuucaagaacagagaucugggaguuucccaucuuccuuuucgccacugggagccugggucacucucuuccgccuaguuggcaucucucaucauuuccacucucagacgugggcccuaaauguagaaucuagcagaaggaaaugacccaacugggaaguagggccacugcccccuacuucccgccccugacccuggaaaaagacucugugccuagccgcucuaguugggagcugagcacuuuuauguguguccuguagcuauguagaccgaggaaauagucuuuuccaccaacuucccucucuuucguguuggcaccuuagaucagcgcugcagccugcaccucucaccuaguccacccugaaagcuuugagguuuccuuuauggggaagcagcagcaucgagauucagcgucuuuggcuucaagacucgcaaacgcuuuuccuucgcuucacccaccccugcgcugcaccucuuaaaagcccgcacccuccacuguacgccggggaacgacagaugcuccggcuucucagccugcuuucccaacccuauuggaaaacauuuggcucguucucuggauaauuuugaccagaacuuuuaaaaaaaaucuauauaacucuguugcgggagucucccgaaaguucuccuuccacaccgucuucuucgcuucgauuucuccuaaacucaccgggucggauguuuuacacucuagaguggaaguguuccuuagugaguucgcugugaguuccuugaaucgcucagauuuguggggcugcaacagacuggagaggaaagaaaaccgagguuuccaggcaagugaagaggguccaaggcagaugcugcucucgggacucuccggccgaucuccuugggacaccccuaagcuguaaccgaggagaccugaguccaguaaacccggugccuccgcucgcuguuagccaggguucugggaacugguggauuugccccgggggcgucggccgggauaggguucgguuugugugguuucggcucuaacaaagagauucccuguaauccgccgaaucuguuaucaauuucuccaccacccgcgccccgccccgcgcgccccgcccgcugugaagcuccaaaaguuagugagacccgccgcgauuugagagcuggagcccuucgcagcguguguguaucugugcauacgaguguguaagugugcacgaggguguguauagauguggugugaaugugugugugugugugugugugugugugugagugugugugugugugcgcgcgcgcuuuuagcuuccacuagggacucuaaaccuuugcagccugggccgcgcaaagaaagacccugaagcccaccccuccccuggaggaaacuugacacuucaggcggggguagggaaggagacugaaccuucuuucucuuagacuggggaaacuccacauuuccauucucuccaggaugcguccccagcuuugcugugcuuuggggacggccgagccgagacucggagcacugguuagcuggcacugggaagcacuuaaacuccucuaccaggagcccggaggugugcaagcccaagggguggcucgaaaaggaaagcuaccgccugcuccaaggccccuuagcauuucuacugccuacaggguccccuucaucccuuuugcggagcuggucucggcagggccuucgccuggaagagguucaccuuucuugccuuuccaaaagaaggggcucccucgggggcuuugggcaucacagaguuacacuuaucagagacguaaaggggaacguuggaaaccugcuccucguacccacacucuucucucuccgccgccgccugcagguggaaaaaucaccagugggagcagccugagaacucucugcccccgaauaucuucaggaaggaaacuucuccgcccggcucccugcgcccuggaggccaggggcacugcugaugcuugggagcuggcuccgcuuggggaccugucgccucggcuccguuugccaacauuuuggaacugaaugaacugagcccgacuugggccagagaggcuagacuggaggcaggguagcaguguucuucaagacacaggccugcaguggugcgaugaaaacauggggacaacuccaagagaaacaacaggcucuccgugguuuucgccccgccucccagccgcugcuggaccuggggaccagagggagaguaaaaagucagaauaaugggguccaagagaagggaaggguaggggaaagauccuccccuaaaggaacugaagccggauacuucuuucuauccgagaccuacgucuccucucguacugacuugaggccgcuggcaggagggggcaggcuuuccggguucccuggggugggagagccgacccucuucccauucauuaucccuuaccccccaacuccaucuacuccccgccccaaacuggcugaagcagauccuaaaggaaauccaggcugcucuuccccaucuggaaguggcuuucccaaaaucggccccguaaacugauuauaaaacauacgauguuaauucggagcugcauuucccagcugggcacucgcgcgccucgcuggucccuggggccucgcccccacccccugcccuucccucccgcguccugcccccacccccacccccgcgccggccaccccgccuccucgcagccuccggcagugcgcuccacucgccuucgcgcucuucucgcccauggaauuaauucuggcuccacuuguugcuccggcccagguccgggagaggacgaggguggcggcggguuaccgagugaauuuucugggagggaccgagcgcagcgggaaacuagagggaagccagggggugagggacuggaaguugcaggaaaccugguacccgggcuuugacucaacagcauugagacauguuuguaaucgcuggcgugccccgcgcgcaggaucccagcgaaguaagacuuccuggugagggugcguggguggauuaauuuggaaaaagaaacugccuauaucuugccaucaaaaaccucacggaggagaagcgcagucaaucaacaguaaacuuaagagaccucggauguuuccguuguuuaaacuuguaugcuugaaaauuaucugaaggcaauaaacaucugcuccuuucuuuccucuccagaagcccauuggaauauuaagcccgggaguggcuuuggggaccgcuggaggugccaugucuuccaaguucuuccuaauggcuuuggccacguuuuucuccuucgcccagguuguuauagaagcuaauucuuggugguaaguugauucugugugccuauucugccuuuaaaaaacaaaaacuuacacuuggacuauguuauggccuuagguacauucaucuaauguagaugguauauguucuaugagcuuuuaaaaugugaauuuucuuguaacccgcucauuuuguaaaucauacacucaguuccacggggaaaucagaauauauaaaucucagccuuuuucuaugaggcccuuguugagauguggguuuacaguaacaucguguacuaaaagggaaaugcacuucuuuaauaauuguaagucuaucuauaacguuugccacccccucaccagguaaaauaaaaaugaguuucccuuuuauuuuucugucguuugagguuauuaagccacagugucugaagcagcagaguccuagaagacaucuaacccccaaauagagaguauuugcacuugaaauuugaucaaagggaggugaacuugaaauagucaaaugucccuaaaugagguuuucucucuggguugcagugaaucccggggauuguguguggcaccauucuggauauuuucucccugguaacagaauagcauuuuuuuucuuuucuuuucugacuguuaaaugugacuucuggucauuggauuuccuaacuugaauccuucauauucacuuaagaauccccuuuaauaugucuaaaaacaugggggauuuucuucagucuguauagacauccccaucuguguuuccauuucucggaagguacugcuaucuccuaccuaauuaucucuacuuuugauguuccugaauuuucaaggaggauucaucuaccuuguagguaccaagucacuuucucuaaagccaguggcuggucucuggaaaccuccacuucccccccccccccuuucucagugacuuucagaaauacugguucagguauguagugacugcagaagaaggcaaugaaaacacugacugagggagccagauggcuggguggggacugcacaauaccucuguuuucugcaggguuuaaacagaggaguucuaugaagcccuucuccuacuuugucaugcagacaaacaggagagaaaaggcauuuguuugcuucaagccccugaauggcugacagguuuuugggaaggagggagcuaccucuagaguucacguaaaucuugaaugaacaucucccccuccccuuugcaggucucuagguaugaauaacccuguucagaugucagaaguauauaucauaggugcacagccucucugcagccaacuggcaggacuuucucaaggacagaagaaacucugccacuuguaucaggaccacaugcaguacauuggagaaggugcgaagacaggcaucaaggaaugccaguaccaguuccggcaucggagauggaacugcagcacaguggacaauacuucugucuuuggcagggugaugcaaauagguaggacguguugggaugcccaucaccuuugucugcaaaggucuuuguguuugcuucaauguuugaugagcugucugcuuuacagccugggugauggcuugggagaugcauucuuuuccagaaugguuuuaauuucugauccccacuucugauugcaguuucuaacuccuugaaccagaucaguagagugacaccucauaucccaucguucucuaugacacuucauguuuuuuguaaaaugcauuuuauuuaaaguagaagcaguauccugcuuugcuuugauugaucaaaaguagauguggcaaagcagagccauuuaagcccuuuuaaaacuaaaaacccuccugaugguugugucuuaagccacaauccaaauggcccaaguugucaucuuuuagaacgcuggcaaugccggcaguaagguuuugauuuuccuaauauagacauuuccugaggcuacagagauauauaaaguuaaaagcuuuauuuuuagucccagaaagaauuuuaauaagaagugauacaacuugugugugugugugauuuuugacaacuggcagaaaaaaaaauacauacuugggcuuucaaccuagaaacucugucauagcaauuuuaauuuaauguuuugugugcaguuugaguuuuaauuucaaauauguuguugaguuuguuguuccauucagggaggagacagcauuuaaauuggaccaaaagaaaaaaaaauaauugaaaacucaguuugccugugguuuucugcaguagucugcgauccuacuugacagaugggcccuguguguuuucuagugugaauauuuuaggucucuuuaguuuuaugcaaacaagcccuuauaauuaauaagacugcagugacuccaaaaguaagaagcaauuuaucaaggcaauuaacuguuuauacugacuggagauaaagaguuggcuuaauauccaucacagauggauaaaauacuuuugaaagaaaaccuuaaaaagugcauucauugagaacaaaaaagaguugucaguggaugcuugagccaagggacuucauaagcgaaaauaacacagguuuggaaaccacuccucuaauccagugggggaacagccugccgccccagccugcaagguucauggggcuuuguccuuucugucaaugauuaaaaugugcuaauguauauccuggggucggacugaaguagcaaagcccagggaagcgggaaugaucacuagauauagacuguuuuaagguagccaaauggggauaucguagggaccuuacuucugccuuccgaaacuucaagagagaaguuaaaaccuccuucagaguuuuaucuaaaugucaagugcuguuggguguuuccuuuauaagcaccucaaccgccuuuaaaaccuguguucucacagggacaggaguuagaaaaagccaggggaaggggcaguugcaagugcuucccaacugugaacucacuugaacauagcuuugauugacauccuccuuccucucccuccucauccuuggcagggggcuugcucuaggcaagaguguacuagauaagcucucacuugcugagugaaucuaaauaccgccuaaaugugguccaagauucaaagugccuguguccucaaggccugagcagagcuccuacuccaaacaccugcguuuaauugucuccucuuuggucuuugacugugugguacucccugguagggacuggacgguggggcuugugugaguuccacccucucaaagucuggugaggugagagugaccagugaccagugcugugggugggccaucggaugcuccaggaagcacagcaugcauccagguucccaaguaccugguuauccucgagcagaaagccaccugccagccuagguuugacucucaagaggcuuuuuaaauuuuuuccuuaauauuugaaagaagggaaggagaguaggaaaauuauaauaaauuuuucuggaugagaaggaucagagacugaacuccaagaauggaacaaagucuuugccuucuuuuuccgagcucaggcuuugcuugaagucagugaguuuugggacaguugaaaacaccucuggugcccaaggugugcccgggucacuccaaaacucucaggaucccagggauguggagaggaacacuugucugugagacccugacccugugaggggccagcgucugagaagcuccugcugccaccucugaccccucuccaggcucauuuuucuaaggugccaguugcccuggaggcaccgugcgcagcagccuccugaagggcccccagcuucauuuuggaaacauucucauuuuucacccguguuccuuuuccccaccagcuuuugucccucuccugucuuuguuuuuagacugugaaaagaugucaggaaggcaccauuuuuaagggaugugaggauccaagucagccuagauuucaugcagagggagacuuaaccaaaugagcagccauagagagacacagaggcuucacacagccccagccaagcagagcucuucaaacugcugcuuuuccacagucaacaauuagcuuagagacuccuagcagguuuuguauucuggaugaaaaucaaaaugauugagcuagauauauggguuaaaaaaaaaaaaagcucuguaggauuuguguuuuguauaaaagcccuuuacgcucugugcauucaaagggcagugucucagcccccucuguccucugaggaucaguuuaucuccucuuccucuacccacacuuuuaucccacaacccucuccugcucagaccacaccacuucccacauuaucaguguuaaucuucaaauaacccccaccaauccguuugcucuccugguuuauuuccacucccccuccccagcccaccccacccccagcgcacacacucugccaucuaaaguaaagccccacugggacuuucuggucccaucuuccugcccacuaccagcacacuccugaugggcuuuuguucauuuguuaaguguaggagggggagucuguaugacuuaagccauaggacuuccuggggaucacaaauggcccccaugaacuaugggacaguacuaauccuggagagggcagguaccagagucagcaggaccauccuccuggauaggccuucucuuugggguuggcugagaucagcugucuuuguucugccccugcuucauaaagauugcuugcaagcuuccuaacuguaugagaaauccagucugguacaggggauguuagcaucagaagggaccuuuaguucgugggcauucauuucaauacucuuauuuuacaguugauucugaaagugaggcaugguaccagucuuuccccuacaugcagguccagcuuccuucaaugggcacaauguuaaccuuucucucucacggugcagcugguuaucauguugcuucuuguuacauuagcaaugucuccuuuugcagguagagcucaggcuggcggauggggcucccauaaguguucuguggggaaaugaucuucacacuuucuaucuauuccccucccuguucacccugagucuguucuccuuuucuuuaucuugucaucucaccacuucaggcgaaggccauggguagagagagcacagagcaggagaguccagugguccagggcaguaguugaugcagaaccaagaugaaccaggaagcuguuuuaaacuuaacugcuuauucucauguagggguggugguggcggaagcagcacacacuuuuaaucccagcacuuagaagguggaggcagggagaucuuugaguuugaggccagccuggucuacagaguuccaggacagccagggcuauacaaagaaaccaugucuugagaaacuaaaccaaaccaacaagcacaaaaaaccaaccaaccaaccaaccaaccaaccaaacaaacaaacaaacaaacaaaaaaccuaauugcucauucucaaaugaagaaauuccagggcagguuuagcacuguugugcagagugguaaagagggaagagcucagagggucccauagccgggaagagaguauagcugcagagaaagggugccagguagaaacuauccguggcccccaggcuggcuugagauggggacuugagauauacagaggcuucuaagccuagcaaauucugcucuguucaaggugaaaacaauaugcacauuagaacaaggguuaaaaaaaaagucuagccuaguucugagcuuucuuucaaugacuucuuucaugugcauguuuggaaauaagacguuuugaauaucuucaaucgggguuaaugaaaaaucaagccagcaggauuggaauccugccuagacucuaaaacauccuagcagacgcagguauugcuguccccuuuguuauuuguuguugcuguaugugacuggauccauccuucugagcuugucacgaggugggcccaggccugaguguacauuuuggaguggggcucuguaugggaugucaacuagagguuuaucucugccgguucacuucaguagcagcugaggcauguuggggucggucucucucucucucucucucucuuucucucucaccaaauaauccagauuuucuguguuagggcuucuuccucuucuugcugcaggggguuucugucuaguuuuuuucugcccgcagugggccugagaacuguuugcucccguguuuugacgagugguuucccccagccccacaaugggguucaaggccagagugcuggggaucccuaccucuccaaugaucuauguauguuggggcucucucagccuucuccagccugcacaggccagugcguuaggggucuuagugacgccccgccuucucuccccccauucccagcaagauuuaggcuucuguguggggcaggcaaucuagugaccccucauccuuaaucgcaggcagccgagagacggccuucacguacgcggugagcgcagcugggguggugaacgccaugagccgagcaugccgggagggcgagcugucuaccuguggcugcagccgcgcugcgcgccccaaggaccugccucgggacugguuguggggcggcugcggagacaacaucgacuauggcuaccgcuucgccaaggaguucguggacgcuagagaaagggaacgaauccacgcuaaggguuccuaugagagcgcacgcauccucaugaacuuacacaacaaugaagcaggccguagggugagugccauggucccccugccaccaccaacccccauaccauuuauccccaaccugcacccccuguacccucccaccacacacaggaguuggguccuggcccccucaguucaggucucuccggauacucauaccuuggccuaucuguauauacuuggcauccuccaucuuccucggcucugcuccuuucuggcuuucucuuucucuuuucuuuucuauuuucuuuuuuccuucucuucucuccucuuccuuucucucuuucuuuuccuucccuucuuccuucuucacucacccccucccucccucccucccuuccucuuuccuucccccucccucucucccuuccuuccucccuuccuuccuuccuuccuuccuuccuuccuucuuuccuuccuuccuuccuuccuucuuuccuuccuuccuuccuuccucccucccucccucccucccucccucccucccucccuuccuuccuuccuuccuuccuucucccucccucccucccucccucccucccucccucccucccuuccuuucauggucuuucaagucaggguuccccccuuccccuguaguccuggcuguccuggaacucauucuguagacuagacuggccucugacuuagagauucaccugugaguacugggauucaaaguuuuuuuuuuuuuuuccuugagucacuucaucauuugugggccucucuguagaaagguaggcauucuagaaagcccucccccucuagggggacugacugauccacaaaugaacucuggagauccagcucuuuucugagaaguaugcuguguaucuuuuuagcugguccccacagauggucacaguagaggucaccauuuguggcuggguuucaguuuggggaaagcaccaagcaaggccaaggccucacuuuaacuuggacacuuauuuucuuuuucccugucugucuuguggcauucuguagcagaccugaugggcccuuuuuagggaaaggacagacauuuuagcaguuuggcauuuuuaaagucugaccaucagacaaauccaggguggcuguagagagaagagaaacugacauucuguccccagccuuccugagccuccugcuuccccccucuuuccuuccccugguguggauaugaaaagcuacuccaagauauuuuaaaagacccuuuuuuccccugcgguuaaacacauggcacuuuauggcugcuuuaaaaugaaggggugaaaauguuucuuaacuuuggcagcauugaaaaccagggucauuaguuuuucacagaacccaagguaggugccaggaacucucuggucagagauuucacucuucuguauuuuggggcgaggaaaaaggaagauaaucacagaguagaacaaggaggacuggaaggagccucuggccccaacacccuagucucacagauugggaaacugaggccaaccacuuagcagcuacggaagaaaagcggugcaucuauguuauaagucucaguuaacauacuuuaaacagaugcauuggagccuagggcugaaacacaggggcguggccacuggagaugcugacugaaaaucagauccucuggugucguuguccacauuugcauaucuuccaguggccgugguuacgacucccacuugugguccuugugaagauggagugagaucaggcauuagggccacaccauaagaaaucugacuuacaacaaugcuuccuuugguucaagcucagauuauaguuuaaagucagucagcagucagugcuugauaaaugauacguuaauuauuaaacacugcagaauacuaggaccuagggaagccgcagaucauggagauaauuccagcuaacuuccucucacaucugagggugucaaugagauugugcuucccugaggggccagguuguugccaccuagagagcgccacucucuugcuugucacuguuguaaguccagccgugauugcaggggagggguccagcuccggucucugaaaaccccuaagggugcauuuccaggaccccaucauccuggcaucuuccccucuguguaggauccaauggacacauucaaccagaaauguccccugccaucuuuggaacuuccuuaucucuucuuuccuagagagaaauccugaggggcuugucuauugcagggaagggucaagcuuuuccaagugucaagaggaaccccccucccccagaagguagaaagugaccuggcugguuuuguugcccuuaauaacgauaguugcaucuucuaaggugccaugucuuugguuuuguucugucaugggaaggaugagccaaaggaaggaucuuggucaguaagaaagaggcacagaaaccagcucuucucuaaaauggagguuagguaccuuagaaaguuguacacuaugccagaaaaucauauuaacacuuuuuagggcauuaacuuuugguuuuccuuaaaaggggagcaaagguuaaauauauuugcaaagccuuccucagucugaaagucuuuauggcaagucuuuauggcaaguacugugggccccuaguaaaagaaaguccuuauaauuccuuggaggagggagguaauuguucaggcagaagcagcucuggguucuggacaggcccuggccagugcugccauaccaugaugacucugaaaggucgcuggcaugaggagcugugggcaguaggacuauaaauaggcaaccaccaccucccagacuguugggcacaguacugugggccaggccuaugagcacugcuccugggaggccugaggugacugggcaaaaaacccagggccauggccccaucacccuggagaaagaccaggcuuacugaauggauuuggagugccaagugcuuccuuggcuccuucaauuuuacccuccuguguaggaaguuggugccauccaaaggugccaaauagguuuagaaaggggcagccaguugccuaaguucaagggcaaaguuagacauccucuguccacagcugcaaggugguccucaagaccuaggguaggacaggacagagucgggauguagaggguacagcaguggacauaauugaagcccagaccaaguuccccuacaaccugguugugugaucugugugagccuccuuccuaugccaccguguuaucaccuguuucuacacaugccaccaagcugcuagcaugacuggaugaggucacaggugucacagcagguguccugauagcugagcuaacacaguaguacaguagaaugggagagcauugaaacccugaucccacuggggauagaccccuucccagcucagcacuuaccaagucacugaacauaggcuuggugucccacugucuggguucaaauccuggcauuccccacuggccagugguugggcagaacuugucucucuaggccuccauuuccuucucugcaaagaaauggauaauagcacaccccucagaggcuuggaugugggucugcguucagguaggauaggcaagauauggagaucucauuguacugauaacguuucccucccauaaaacuggaggccacugggaucaguuucuuuuuuucuuuucuuuucuuuucuuuucuuuucuuuucuuuucuuuuucucuuucuuucuuucuuucuuucuuucuuucuuucuuucuuucuuucuuucuuucuuucuuucuuucuuucuuucuccuguucccaucugaaugugauagugguggacagaaugauaaagacuaagaaguugcagaguuucaaagaaggcaauacaauauuucuaguggugggaaaugaagauguaacacagccuugaauucagccaagggacauggcugccucuacaaaguguguacuaggcccaugccugcaucucgccuccuccagggaucaguacaauaaccuucccccuuucuuccuacagacaguauacaaccuggcagauguagccuguaagugucauggagugucuggcuccuguagccucaagacgugcuggcugcagcuggcggacuuccggaaggugggcgaugcccucaaggagaaguaugauagcgcggcggccaugaggcucaacagccggggcaagcuggugcaggucaacagccgcuucaacuccccgaccacgcaggaccuggucuacaucgaccccaguccggacuacugugugcgcaacgagagcacuggcucgcugggcacgcagggacgccugugcaacaagaccucagaggggauggacggcugcgagcucaugugcugugggcguggcuaugaccaguuuaagacagugcagaccgaacgcugucauugcaaguuucacuggugcugcuaugucaaaugcaagaagugcacggagauuguggaucaguucgugugcaaauaguggugugccugcccuucacccagucccacucccaggacccacuuauuuauagaaaguacagugcuucugguucuuuuuauuucucccccaagaauugcagcuggaaccauguguuuuguuuuguuuuauuuuguuuuuucuuuucuguuaccaucuaagaacucugugguuuauuauuaauauuauaauuaauauuuggcaauagugggggaaacuaagaaaaauauuuauuuugaggaucuuugcaaaguuaguacaaaauuucuuucuucugaugcuacaggauaaaggggaaaaacuauguauucgaacuuagcugugcaguuggggguucacaucuagaagguguaggagccauuuucuucucaaacagagaguccuuugagaugggugguauccaggugaaggaggagguacagacccaugaauaacaguuccugugaccaaaaugaauugcaggugcucugguacaaaagaucuuaaauauagauauauuaaauauacauauaugccaaaaauacagaauaugagacacucccuaacccagagguuaccagccugguuuuguggguuuuuuguuuuguuuuguuuuuucuuuuuuuggguuuuguuuguuuguuuguuuguuuguauuuuugguguguguguguguguauuucuagaaugaucuuuuagaagguacaagcaagaaucucauaucuucagaagcaggcauaucauguauguuacugugucccaccuacagauacuccauucaugaaugggccuuuuucuaacaguucaugaauauuggggagccggugggcugggggagggagguccccagaaauuagaaaacuugaaguuuccuacauugaggccauaaucuuguguuagcccagcugauucuuaauaccagacuuuuagauccauaaaggaauuuuugacuaaaaaaaaaaaaucuuguuuugaaagccaucuuauuuucuuaaaaaugaaaaauuacccaugaaucccauuugcaaccccucacccccacaggcaacaagaaagucccauguaguugagcacugcgaacaccucugugaggagaugauggcagccaucuuccugcaugaucccaugcccuuucuggacucucugcuggccaugcuuccgaauggcagcccugguggacacucacugcugguagggcagaaaauguacacgaggagccauguucagaaccagccacuuagggguuguucucugaggcuuuucuuuggagguacgguaacuugauguguuuugaugauaucucuuggcccagggaguccacagagguguugcagcuguuugguuguuauccuccugcguuuagacuuuccauuugugcuuuuccuauuacccugcagguguacccuaaaacuguuccuaguguacuugaacaguugcauuuauaaggggggaugugguuuaauggugccugauaucucaguuuuuuuguauauaacauauauauaaauauacauauauaaauauagauauaauuauaucucagugcagucugggauuuagaccuacaguuuucucugggcuugcucucugccuggaguaucguccuucauugcaguccaauugggauuucuuuuuuuccaaaaauuuugagucuuaacauugaccugugacaggauccuaccacgaauaccaggaagcaagcuaagacucggaggaagcucucagggcucauguccugaauguauguugguuagaaaguagccuuucugcuuccugcccauggccaguucuccacccucucuuugguguucuuuguggggagggcacugugguuugucgcagcccuggacuucgagaggcucccagaacccaggaucaccagccuccugucuguuugcuucacuccuuucccagggaggacuugggacuguccugucugacaggacggaucugaguucccgaagcaaaccagcucaccacauagauagcuaguuuaaacaauguuuuaaaauaagggcaccucuguuucaaaagugacaucugcuguguuguuuucgaggccugauacucuuacaagguuugaaaaaaaauguguguauccauucaugggcuugguagccuucuggucaccucaguccuguggcucuuaacuuauugcccaacaauauucauuuccccucagcuacaaugaauugcaagcaaaagauguugaaaaaaagcacuaauuuaguuuaaaaugucacuuuuugguuuuuauucuacaaaaaccaugaaguucucucucucucucucucucucucuuauuuguuaaaucagauuauguucuuuuuuuguuuuuguuuuuagugauucauguuuaugagcagaguggaguuuaacaauccuagcuuuaaaaaaaaccuauuuaauguaagauauucuacgcauccuucagauauuuuguauauccccuauggccuuuauucuguacuuuuaauguacauauuucugucuugugugauuuguauauuucacuggu

SEQ ID NO: 12508 - RNA, 19963 nt, Mus musculus
accagugaaauauacaaaucacacaagacagaaauauguacauuaaaaguacagaauaaaggccauaggggauauacaaaauaucugaaggaugcguagaauaucuuacauuaaauagguuuuuuuuaaagcuaggauuguuaaacuccacucugcucauaaacaugaaucacuaaaaacaaaaacaaaaaaagaacauaaucugauuuaacaaauaagagagagagagagagagagagagaacuucaugguuuuuguagaauaaaaaccaaaaagugacauuuuaaacuaaauuagugcuuuuuuucaacaucuuuugcuugcaauucauuguagcugaggggaaaugaauauuguugggcaauaaguuaagagccacaggacugaggugaccagaaggcuaccaagcccaugaauggauacacacauuuuuuuucaaaccuuguaagaguaucaggccucgaaaacaacacagcagaugucacuuuugaaacagaggugcccuuauuuuaaaacauuguuuaaacuagcuaucuauguggugagcugguuugcuucgggaacucagauccguccugucagacaggacagucccaaguccucccugggaaaggagugaagcaaacagacaggaggcuggugauccuggguucugggagccucucgaaguccagggcugcgacaaaccacagugcccuccccacaaagaacaccaaagagaggguggagaacuggccaugggcaggaagcagaaaggcuacuuucuaaccaacauacauucaggacaugagcccugagagcuuccuccgagucuuagcuugcuuccugguauucgugguaggauccugucacaggucaauguuaagacucaaaauuuuuggaaaaaaagaaaucccaauuggacugcaaugaaggacgauacuccaggcagagagcaagcccagagaaaacuguaggucuaaaucccagacugcacugagauauaauuauaucuauauuuauauauguauauuuauauauauguuauauacaaaaaaacugagauaucaggcaccauuaaaccacauccccccuuauaaaugcaacuguucaaguacacuaggaacaguuuuaggguacaccugcaggguaauaggaaaagcacaaauggaaagucuaaacgcaggaggauaacaaccaaacagcugcaacaccucuguggacucccugggccaagagauaucaucaaaacacaucaaguuaccguaccuccaaagaaaagccucagagaacaaccccuaaguggcugguucugaacauggcuccucguguacauuuucugcccuaccagcagugaguguccaccagggcugccauucggaagcauggccagcagagaguccagaaagggcaugggaucaugcaggaagauggcugccaucaucuccucacagagguguucgcagugcucaacuacaugggacuuucuuguugccugugggggugagggguugcaaaugggauucauggguaauuuuucauuuuuaagaaaauaagauggcuuucaaaacaagauuuuuuuuuuuuagucaaaaauuccuuuauggaucuaaaagucugguauuaagaaucagcugggcuaacacaagauuauggccucaauguaggaaacuucaaguuuucuaauuucuggggaccucccucccccagcccaccggcuccccaauauucaugaacuguuagaaaaaggcccauucaugaauggaguaucuguaggugggacacaguaacauacaugauaugccugcuucugaagauaugagauucuugcuuguaccuucuaaaagaucauucuagaaauacacacacacacacaccaaaaauacaaacaaacaaacaaacaaacaaaacccaaaaaaagaaaaaacaaaacaaaacaaaaaacccacaaaaccaggcugguaaccucuggguuagggagugucucauauucuguauuuuuggcauauauguauauuuaauauaucuauauuuaagaucuuuuguaccagagcaccugcaauucauuuuggucacaggaacuguuauucaugggucuguaccuccuccuucaccuggauaccacccaucucaaaggacucucuguuugagaagaaaauggcuccuacaccuucuagaugugaacccccaacugcacagcuaaguucgaauacauaguuuuuccccuuuauccuguagcaucagaagaaagaaauuuuguacuaacuuugcaaagauccucaaaauaaauauuuuucuuaguuucccccacuauugccaaauauuaauuauaauauuaauaauaaaccacagaguucuuagaugguaacagaaaagaaaaaacaaaauaaaacaaaacaaaacacaugguuccagcugcaauucuugggggagaaauaaaaagaaccagaagcacuguacuuucuauaaauaaguggguccugggagugggacugggugaagggcaggcacaccacuauuugcacacgaacugauccacaaucuccgugcacuucuugcauuugacauagcagcaccagugaaacuugcaaugacagcguucggucugcacugucuuaaacuggucauagccacgcccacagcacaugagcucgcagccguccauccccucugaggucuuguugcacaggcgucccugcgugcccagcgagccagugcucucguugcgcacacaguaguccggacuggggucgauguagaccagguccugcguggucggggaguugaagcggcuguugaccugcaccagcuugccccggcuguugagccucauggccgccgcgcuaucauacuucuccuugagggcaucgcccaccuuccggaaguccgccagcugcagccagcacgucuugaggcuacaggagccagacacuccaugacacuuacaggcuacaucugccagguuguauacugucuguaggaagaaagggggaagguuauuguacugaucccuggaggaggcgagaugcaggcaugggccuaguacacacuuuguagaggcagccaugucccuuggcugaauucaaggcuguguuacaucuucauuucccaccacuagaaauauuguauugccuucuuugaaacucugcaacuucuuagucuuuaucauucuguccaccacuaucacauucagaugggaacaggagaaagaaagaaagaaagaaagaaagaaagaaagaaagaaagaaagaaagaaagaaagaaagaaagaaagaaagagaaaaagaaaagaaaagaaaagaaaagaaaagaaaagaaaagaaaaaaagaaacugaucccaguggccuccaguuuuaugggagggaaacguuaucaguacaaugagaucuccauaucuugccuauccuaccugaacgcagacccacauccaagccucugaggggugugcuauuauccauuucuuugcagagaaggaaauggaggccuagagagacaaguucugcccaaccacuggccaguggggaaugccaggauuugaacccagacagugggacaccaagccuauguucagugacuugguaagugcugagcugggaaggggucuauccccagugggaucaggguuucaaugcucucccauucuacuguacuacuguguuagcucagcuaucaggacaccugcugugacaccugugaccucauccagucaugcuagcagcuugguggcauguguagaaacaggugauaacacgguggcauaggaaggaggcucacacagaucacacaaccagguuguaggggaacuuggucugggcuucaauuauguccacugcuguacccucuacaucccgacucuguccuguccuacccuaggucuugaggaccaccuugcagcuguggacagaggaugucuaacuuugcccuugaacuuaggcaacuggcugccccuuucuaaaccuauuuggcaccuuuggauggcaccaacuuccuacacaggaggguaaaauugaaggagccaaggaagcacuuggcacuccaaauccauucaguaagccuggucuuucuccagggugauggggccauggcccuggguuuuuugcccagucaccucaggccucccaggagcagugcucauaggccuggcccacaguacugugcccaacagucugggagguggugguugccuauuuauaguccuacugcccacagcuccucaugccagcgaccuuucagagucaucaugguauggcagcacuggccagggccuguccagaacccagagcugcuucugccugaacaauuaccucccuccuccaaggaauuauaaggacuuucuuuuacuaggggcccacaguacuugccauaaagacuugccauaaagacuuucagacugaggaaggcuuugcaaauauauuuaaccuuugcuccccuuuuaaggaaaaccaaaaguuaaugcccuaaaaaguguuaauaugauuuucuggcauaguguacaacuuucuaagguaccuaaccuccauuuuagagaagagcugguuucugugccucuuucuuacugaccaagauccuuccuuuggcucauccuucccaugacagaacaaaaccaaagacauggcaccuuagaagaugcaacuaucguuauuaagggcaacaaaaccagccaggucacuuucuaccuucugggggagggggguuccucuugacacuuggaaaagcuugacccuucccugcaauagacaagccccucaggauuucucucuaggaaagaagagauaaggaaguuccaaagauggcaggggacauuucugguugaauguguccauuggauccuacacagaggggaagaugccaggaugaugggguccuggaaaugcacccuuagggguuuucagagaccggagcuggaccccuccccugcaaucacggcuggacuuacaacagugacaagcaagagaguggcgcucucuagguggcaacaaccuggccccucagggaagcacaaucucauugacacccucagaugugagaggaaguuagcuggaauuaucuccaugaucugcggcuucccuagguccuaguauucugcaguguuuaauaauuaacguaucauuuaucaagcacugacugcugacugacuuuaaacuauaaucugagcuugaaccaaaggaagcauuguuguaagucagauuucuuaugguguggcccuaaugccugaucucacuccaucuucacaaggaccacaagugggagucguaaccacggccacuggaagauaugcaaauguggacaacgacaccagaggaucugauuuucagucagcaucuccaguggccacgccccuguguuucagcccuaggcuccaaugcaucuguuuaaaguauguuaacugagacuuauaacauagaugcaccgcuuuucuuccguagcugcuaagugguuggccucaguuucccaaucugugagacuaggguguuggggccagaggcuccuuccaguccuccuuguucuacucugugauuaucuuccuuuuuccucgccccaaaauacagaagagugaaaucucugaccagagaguuccuggcaccuaccuuggguucugugaaaaacuaaugacccugguuuucaaugcugccaaaguuaagaaacauuuucaccccuucauuuuaaagcagccauaaagugccauguguuuaaccgcaggggaaaaaagggucuuuuaaaauaucuuggaguagcuuuucauauccacaccaggggaaggaaagaggggggaagcaggaggcucaggaaggcuggggacagaaugucaguuucucuucucucuacagccacccuggauuugucugauggucagacuuuaaaaaugccaaacugcuaaaaugucuguccuuucccuaaaaagggcccaucaggucugcuacagaaugccacaagacagacagggaaaaagaaaauaaguguccaaguuaaagugaggccuuggccuugcuuggugcuuuccccaaacugaaacccagccacaaauggugaccucuacugugaccaucuguggggaccagcuaaaaagauacacagcauacuucucagaaaagagcuggaucuccagaguucauuuguggaucagucagucccccuagagggggagggcuuucuagaaugccuaccuuucuacagagaggcccacaaaugaugaagugacucaaggaaaaaaaaaaaaaaacuuugaaucccaguacucacaggugaaucucuaagucagaggccagucuagucuacagaaugaguuccaggacagccaggacuacaggggaaggggggaacccugacuugaaagaccaugaaaggaagggagggagggagggagggagggagggagggagggagggagaaggaaggaaggaaggaaggaagggagggagggagggagggagggagggagggagggaggaaggaaggaaggaaggaaagaaggaaggaaggaaggaaggaaagaaggaaggaaggaaggaaggaaggaaggaagggaggaaggaagggagagagggagggggaaggaaagaggaagggagggagggagggagggggugagugaagaaggaagaagggaaggaaaagaaagagagaaaggaagaggagagaagagaaggaaaaaagaaaauagaaaagaaaagagaaagagaaagccagaaaggagcagagccgaggaagauggaggaugccaaguauauacagauaggccaagguaugaguauccggagagaccugaacugagggggccaggacccaacuccuguguguggugggaggguacagggggugcagguuggggauaaaugguauggggguuggugguggcagggggaccauggcacucacccuacggccugcuucauuguuguguaaguucaugaggaugcgugcgcucucauaggaacccuuagcguggauucguucccuuucucuagcguccacgaacuccuuggcgaagcgguagccauagucgauguugucuccgcagccgccccacaaccagucccgaggcagguccuuggggcgcgcagcgcggcugcagccacagguagacagcucgcccucccggcaugcucggcucauggcguucaccaccccagcugcgcucaccgcguacgugaaggccgucucucggcugccugcgauuaaggaugaggggucacuagauugccugccccacacagaagccuaaaucuugcugggaauggggggagagaaggcggggcgucacuaagaccccuaacgcacuggccugugcaggcuggagaaggcugagagagccccaacauacauagaucauuggagagguagggauccccagcacucuggccuugaaccccauuguggggcugggggaaaccacucgucaaaacacgggagcaaacaguucucaggcccacugcgggcagaaaaaaacuagacagaaacccccugcagcaagaagaggaagaagcccuaacacagaaaaucuggauuauuuggugagagagaaagagagagagagagagagagagaccgaccccaacaugccucagcugcuacugaagugaaccggcagagauaaaccucuaguugacaucccauacagagccccacuccaaaauguacacucaggccugggcccaccucgugacaagcucagaaggauggauccagucacauacagcaacaacaaauaacaaaggggacagcaauaccugcgucugcuaggauguuuuagagucuaggcaggauuccaauccugcuggcuugauuuuucauuaaccccgauugaagauauucaaaacgucuuauuuccaaacaugcacaugaaagaagucauugaaagaaagcucagaacuaggcuagacuuuuuuuuuaacccuuguucuaaugugcauauuguuuucaccuugaacagagcagaauuugcuaggcuuagaagccucuguauaucucaaguccccaucucaagccagccugggggccacggauaguuucuaccuggcacccuuucucugcagcuauacucucuucccggcuaugggacccucugagcucuucccucuuuaccacucugcacaacagugcuaaaccugcccuggaauuucuucauuugagaaugagcaauuagguuuuuuguuuguuuguuuguuuguuugguugguugguugguugguugguugguuuuuugugcuuguugguuugguuuaguuucucaagacaugguuucuuuguauagcccuggcuguccuggaacucuguagaccaggcuggccucaaacucaaagaucucccugccuccaccuucuaagugcugggauuaaaagugugugcugcuuccgccaccaccaccccuacaugagaauaagcaguuaaguuuaaaacagcuuccugguucaucuugguucugcaucaacuacugcccuggaccacuggacucuccugcucugugcucucucuacccauggccuucgccugaaguggugagaugacaagauaaagaaaaggagaacagacucagggugaacagggaggggaauagauagaaagugugaagaucauuuccccacagaacacuuaugggagccccauccgccagccugagcucuaccugcaaaaggagacauugcuaauguaacaagaagcaacaugauaaccagcugcaccgugagagagaaagguuaacauugugcccauugaaggaagcuggaccugcauguaggggaaagacugguaccaugccucacuuucagaaucaacuguaaaauaagaguauugaaaugaaugcccacgaacuaaaggucccuucugaugcuaacauccccuguaccagacuggauuucucauacaguuaggaagcuugcaagcaaucuuuaugaagcaggggcagaacaaagacagcugaucucagccaaccccaaagagaaggccuauccaggaggaugguccugcugacucugguaccugcccucuccaggauuaguacugucccauaguucaugggggccauuugugauccccaggaaguccuauggcuuaagucauacagacucccccuccuacacuuaacaaaugaacaaaagcccaucaggagugugcugguagugggcaggaagaugggaccagaaagucccaguggggcuuuacuuuagauggcagagugugugcgcuggggguggggugggcuggggagggggaguggaaauaaaccaggagagcaaacggauugguggggguuauuugaagauuaacacugauaaugugggaagugguguggucugagcaggagaggguugugggauaaaaguguggguagaggaagaggagauaaacugauccucagaggacagagggggcugagacacugcccuuugaaugcacagagcguaaagggcuuuuauacaaaacacaaauccuacagagcuuuuuuuuuuuuuaacccauauaucuagcucaaucauuuugauuuucauccagaauacaaaaccugcuaggagucucuaagcuaauuguugacuguggaaaagcagcaguuugaagagcucugcuuggcuggggcugugugaagccucugugucucucuauggcugcucauuugguuaagucucccucugcaugaaaucuaggcugacuuggauccucacaucccuuaaaaauggugccuuccugacaucuuuucacagucuaaaaacaaagacaggagagggacaaaagcugguggggaaaaggaacacgggugaaaaaugagaauguuuccaaaaugaagcugggggcccuucaggaggcugcugcgcacggugccuccagggcaacuggcaccuuagaaaaaugagccuggagaggggucagagguggcagcaggagcuucucagacgcuggccccucacagggucagggucucacagacaaguguuccucuccacaucccugggauccugagaguuuuggagugacccgggcacaccuugggcaccagagguguuuucaacugucccaaaacucacugacuucaagcaaagccugagcucggaaaaagaaggcaaagacuuuguuccauucuuggaguucagucucugauccuucucauccagaaaaauuuauuauaauuuuccuacucuccuucccuucuuucaaauauuaaggaaaaaauuuaaaaagccucuugagagucaaaccuaggcuggcagguggcuuucugcucgaggauaaccagguacuugggaaccuggaugcaugcugugcuuccuggagcauccgauggcccacccacagcacuggucacuggucacucucaccucaccagacuuugagaggguggaacucacacaagccccaccguccagucccuaccagggaguaccacacagucaaagaccaaagaggagacaauuaaacgcagguguuuggaguaggagcucugcucaggccuugaggacacaggcacuuugaaucuuggaccacauuuaggcgguauuuagauucacucagcaagugagagcuuaucuaguacacucuugccuagagcaagcccccugccaaggaugaggagggagaggaaggaggaugucaaucaaagcuauguucaagugaguucacaguugggaagcacuugcaacugccccuuccccuggcuuuuucuaacuccugucccugugagaacacagguuuuaaaggcgguugaggugcuuauaaaggaaacacccaacagcacuugacauuuagauaaaacucugaaggagguuuuaacuucucucuugaaguuucggaaggcagaaguaaggucccuacgauauccccauuuggcuaccuuaaaacagucuauaucuagugaucauucccgcuucccugggcuuugcuacuucaguccgaccccaggauauacauuagcacauuuuaaucauugacagaaaggacaaagccccaugaaccuugcaggcuggggcggcaggcuguucccccacuggauuagaggagugguuuccaaaccuguguuauuuucgcuuaugaagucccuuggcucaagcauccacugacaacucuuuuuuguucucaaugaaugcacuuuuuaagguuuucuuucaaaaguauuuuauccaucugugauggauauuaagccaacucuuuaucuccagucaguauaaacaguuaauugccuugauaaauugcuucuuacuuuuggagucacugcagucuuauuaauuauaagggcuuguuugcauaaaacuaaagagaccuaaaauauucacacuagaaaacacacagggcccaucugucaaguaggaucgcagacuacugcagaaaaccacaggcaaacugaguuuucaauuauuuuuuuuucuuuugguccaauuuaaaugcugucuccucccugaauggaacaacaaacucaacaacauauuugaaauuaaaacucaaacugcacacaaaacauuaaauuaaaauugcuaugacagaguuucuagguugaaagcccaaguauguauuuuuuuuucugccaguugucaaaaaucacacacacacacaaguuguaucacuucuuauuaaaauucuuucugggacuaaaaauaaagcuuuuaacuuuauauaucucuguagccucaggaaaugucuauauuaggaaaaucaaaaccuuacugccggcauugccagcguucuaaaagaugacaacuugggccauuuggauuguggcuuaagacacaaccaucaggaggguuuuuaguuuuaaaagggcuuaaauggcucugcuuugccacaucuacuuuugaucaaucaaagcaaagcaggauacugcuucuacuuuaaauaaaaugcauuuuacaaaaaacaugaagugucauagagaacgaugggauaugaggugucacucuacugaucugguucaaggaguuagaaacugcaaucagaaguggggaucagaaauuaaaaccauucuggaaaagaaugcaucucccaagccaucacccaggcuguaaagcagacagcucaucaaacauugaagcaaacacaaagaccuuugcagacaaaggugaugggcaucccaacacguccuaccuauuugcaucacccugccaaagacagaaguauuguccacugugcugcaguuccaucuccgaugccggaacugguacuggcauuccuugaugccugucuucgcaccuucuccaauguacugcaugugguccugauacaaguggcagaguuucuucuguccuugagaaaguccugccaguuggcugcagagaggcugugcaccuaugauauauacuucugacaucugaacaggguuauucauaccuagagaccugcaaaggggagggggagauguucauucaagauuuacgugaacucuagagguagcucccuccuucccaaaaaccugucagccauucaggggcuugaagcaaacaaaugccuuuucucuccuguuugucugcaugacaaaguaggagaagggcuucauagaacuccucuguuuaaacccugcagaaaacagagguauugugcaguccccacccagccaucuggcucccucagucaguguuuucauugccuucuucugcagucacuacauaccugaaccaguauuucugaaagucacugagaaagggggggggggggaaguggagguuuccagagaccagccacuggcuuuagagaaagugacuugguaccuacaagguagaugaauccuccuugaaaauucaggaacaucaaaaguagagauaauuagguaggagauagcaguaccuuccgagaaauggaaacacagauggggaugucuauacagacugaagaaaaucccccauguuuuuagacauauuaaaggggauucuuaagugaauaugaaggauucaaguuaggaaauccaaugaccagaagucacauuuaacagucagaaaagaaaagaaaaaaaaugcuauucuguuaccagggagaaaauauccagaauggugccacacacaauccccgggauucacugcaacccagagagaaaaccucauuuagggacauuugacuauuucaaguucaccucccuuugaucaaauuucaagugcaaauacucucuauuuggggguuagaugucuucuaggacucugcugcuucagacacuguggcuuaauaaccucaaacgacagaaaaauaaaagggaaacucauuuuuauuuuaccuggugaggggguggcaaacguuauagauagacuuacaauuauuaaagaagugcauuucccuuuuaguacacgauguuacuguaaacccacaucucaacaagggccucauagaaaaaggcugagauuuauauauucugauuuccccguggaacugaguguaugauuuacaaaaugagcggguuacaagaaaauucacauuuuaaaagcucauagaacauauaccaucuacauuagaugaauguaccuaaggccauaacauaguccaaguguaaguuuuuguuuuuuaaaggcagaauaggcacacagaaucaacuuaccaccaagaauuagcuucuauaacaaccugggcgaaggagaaaaacguggccaaagccauuaggaagaacuuggaagacauggcaccuccagcgguccccaaagccacucccgggcuuaauauuccaaugggcuucuggagaggaaagaaaggagcagauguuuauugccuucagauaauuuucaagcauacaaguuuaaacaacggaaacauccgaggucucuuaaguuuacuguugauugacugcgcuucuccuccgugagguuuuugauggcaagauauaggcaguuucuuuuuccaaauuaauccacccacgcacccucaccaggaagucuuacuucgcugggauccugcgcgcggggcacgccagcgauuacaaacaugucucaaugcuguugagucaaagcccggguaccagguuuccugcaacuuccagucccucacccccuggcuucccucuaguuucccgcugcgcucggucccucccagaaaauucacucgguaacccgccgccacccucguccucucccggaccugggccggagcaacaaguggagccagaauuaauuccaugggcgagaagagcgcgaaggcgaguggagcgcacugccggaggcugcgaggaggcgggguggccggcgcgggggugggggugggggcaggacgcgggagggaagggcagggggugggggcgaggccccagggaccagcgaggcgcgcgagugcccagcugggaaaugcagcuccgaauuaacaucguauguuuuauaaucaguuuacggggccgauuuugggaaagccacuuccagauggggaagagcagccuggauuuccuuuaggaucugcuucagccaguuuggggcggggaguagauggaguugggggguaagggauaaugaaugggaagagggucggcucucccaccccagggaacccggaaagccugcccccuccugccagcggccucaagucaguacgagaggagacguaggucucggauagaaagaaguauccggcuucaguuccuuuaggggaggaucuuuccccuacccuucccuucucuuggaccccauuauucugacuuuuuacucucccucugguccccagguccagcagcggcugggaggcggggcgaaaaccacggagagccuguuguuucucuuggaguuguccccauguuuucaucgcaccacugcaggccugugucuugaagaacacugcuacccugccuccagucuagccucucuggcccaagucgggcucaguucauucaguuccaaaauguuggcaaacggagccgaggcgacagguccccaagcggagccagcucccaagcaucagcagugccccuggccuccagggcgcagggagccgggcggagaaguuuccuuccugaagauauucgggggcagagaguucucaggcugcucccacuggugauuuuuccaccugcaggcggcggcggagagagaagaguguggguacgaggagcagguuuccaacguuccccuuuacgucucugauaaguguaacucugugaugcccaaagcccccgagggagccccuucuuuuggaaaggcaagaaaggugaaccucuuccaggcgaaggcccugccgagaccagcuccgcaaaagggaugaaggggacccuguaggcaguagaaaugcuaaggggccuuggagcaggcgguagcuuuccuuuucgagccaccccuugggcuugcacaccuccgggcuccugguagaggaguuuaagugcuucccagugccagcuaaccagugcuccgagucucggcucggccguccccaaagcacagcaaagcuggggacgcauccuggagagaauggaaauguggaguuuccccagucuaagagaaagaagguucagucuccuucccuacccccgccugaagugucaaguuuccuccaggggaggggugggcuucagggucuuucuuugcgcggcccaggcugcaaagguuuagagucccuaguggaagcuaaaagcgcgcgcgcacacacacacacacucacacacacacacacacacacacacacacauucacaccacaucuauacacacccucgugcacacuuacacacucguaugcacagauacacacacgcugcgaagggcuccagcucucaaaucgcggcgggucucacuaacuuuuggagcuucacagcgggcggggcgcgcggggcggggcgcgggugguggagaaauugauaacagauucggcggauuacagggaaucucuuuguuagagccgaaaccacacaaaccgaacccuaucccggccgacgcccccggggcaaauccaccaguucccagaacccuggcuaacagcgagcggaggcaccggguuuacuggacucaggucuccucgguuacagcuuaggggugucccaaggagaucggccggagagucccgagagcagcaucugccuuggacccucuucacuugccuggaaaccucgguuuucuuuccucuccagucuguugcagccccacaaaucugagcgauucaaggaacucacagcgaacucacuaaggaacacuuccacucuagaguguaaaacauccgacccggugaguuuaggagaaaucgaagcgaagaagacgguguggaaggagaacuuucgggagacucccgcaacagaguuauauagauuuuuuuuaaaaguucuggucaaaauuauccagagaacgagccaaauguuuuccaauaggguugggaaagcaggcugagaagccggagcaucugucguuccccggcguacaguggagggugcgggcuuuuaagaggugcagcgcaggggugggugaagcgaaggaaaagcguuugcgagucuugaagccaaagacgcugaaucucgaugcugcugcuuccccauaaaggaaaccucaaagcuuucaggguggacuaggugagaggugcaggcugcagcgcugaucuaaggugccaacacgaaagagagggaaguugguggaaaagacuauuuccucggucuacauagcuacaggacacacauaaaagugcucagcucccaacuagagcggcuaggcacagagucuuuuuccagggucaggggcgggaaguagggggcaguggcccuacuucccaguugggucauuuccuucugcuagauucuacauuuagggcccacgucugagaguggaaaugaugagagaugccaacuaggcggaagagagugacccaggcucccaguggcgaaaaggaagaugggaaacucccagaucucuguucuugaagagauggaaauugaacaguguucuccagucugcucuuucucugaaccaagaagaccgauggagaaacuugagggagaagaacucugucgcuggaacaaacuugguucuccggcuucaagaauggcagagagaagacaaugaagaaaugaccaaugucugcuuaagggggaguagacaaaagaagcguugcuccccaucuuuagggccugggcccagcugagcuguaccugucccacuucaugaauacacguggucagagcacaugcagcaggcagaaauagccagugagauaagccagagguugucuggagcugcagucaggguaaggaaccugaaaaauucccgagugacccagaauugccaggagaucggagaacaguaauaguccaggagauaaacuucggcucuuuuccuaagcuucagcgauguucccccaggguucucaaggacccacacacaauuaccucgaguaacugagcacagagucauuugucuaaaacaguuguguagccccaagagagagugagaaaucaaagaucgguucacucccaaucuuuacaggggauuuuuuuuuuuacagacgaaguucauaaaugaaaacaaaaucacuguuuuuguuucuguguuuaauggaugaagaagcagaggcugagagagggaaacacaacaagcauccaggaccacagaaagaauuggugagacaaccagggccacacccgaggccuuguacugugacacucccucaccagugaccagaagggucgaaauccuuaguccaaauugcccaaggccucauugcuggguuacaccuauggcucuuuucuauuugaagcucgggguaacacagauuguccccuggcggagaccuuagaagggucuuggugggaagaguggggcugaguugucuccaggggugcaaaguugaaggacugggacucagagaggccuuauuuccagauggccaacagggggcagccggcaccgcgcggccgguuagaaaggccgcguuaaagcucaagaguuuugccggcacguagcgcgccccuugugcacaggagcgcuuuggaagggaagaccagggucuugggcuggaccuccuuuggaggaucuagggccgaaccgccaagacuaaagccagcuugucaaaaacugaucuccagcuccccaaguccccaaagcaaagcaagggucccaacgcguccucucauacccuacuuuccgccauuccucaauugcuggguacuuacaacauugucuccuccaaaucccccccccccccgcaaagccucgccugauggaaaaugucuugaaauuaaaucuggcuaggugugcuaauaucgucaagacagcagaugcugaggagguacgaccucaucacccgacccaaguuauuucccaggagcgaauuguucauuuaaagugagaccacggagcuguggcucggacagggcauagaggguaaaacagggccuuagaagcaccgggguuuaaaacccuuucuuugaagaaagaacguuguuugcuuuuaggaaacagcuucguaccgaucuucaccuuacucccuacuagaaagcuggaaaugagagguaugaaguauaaauggaaauuguuaucgaggcguggaggauaaccgaaggaaaaguuguuuggaaaauugcuaguuauauuucaagacgaaacguuaacuuuuuuguaaaagugaacucucggugacccucagagugugugacucggcuuuaacauacaacugacaauuaaaacaaacacgaguucacaaacuaacccccgcccgaucucgaaacgcagaggcccuagagucuccaaagcacuagguugacuccgcucagggggcaggauuaaagccacuaggaccacuacuccccgcccccaaugcugcaguaaaggaccugagcucacccagaggccgcuaauaaagcuaauaacgcgacccugcuccccgcgcggggugcgcucuggccccccgccaggcacucuuaaaggcacaggggccgggaacgcucggguuacucgaccuggagagccgggaacugggcccugaucggagguuggggguggggugugcguugcucuaggguagguggccccuaguuuccuuagucucgcagccguuucuccuaacacaguccucauccggccucagagcuucagccacacaaucuccgcgugccggugaaaugagcguuugauauauacuugaugaaucgaaucauuauccagucacugaaauacacguaguaaaacuacacuccaguucucgagguaaaaaggcgcgccgccugugacccgaacugucuuuccugcccucgcucuucuccauaguugaaaagguuugaagaauagccggugcaaaaagucuccaaggacgcagaggcaguguccccaggguaagggacgaaaagauaggagucccugccggcgauauuggaguuuagcuuucuccaggcaguuagagaaauggagaggauagggauagauugaaagaguucaguuaacuuugaaaagggggggaaaaaguagggagcguccgugcgcacagaacacuuaccuucauggcgagggggagggggcacggagaggaagucgccacccgagcgaaggcggccgaggaauucaagcgaagcgucgggguuaagccuugggggacaauccaaagcagggcugcggaguccuccugggcgcgucgggugggcgcagcgacccggagcggaagcgagcacuggcgcccggacucgggcagaggaguugguauagcguggaaaugugcccaggaaccgagagggcgccggcgcgcgcgggcgagcagcaagcgcagggccgagcggggacacagugcaggagccgcggguccgacgagggcgcgcaggcgacuguuccgcggcgaggcgcucccucucuaacguccaucagcgacggcgguaauuagggcuuuccaaccccaaaugugggcgugauugugcaaaagacuuuacaacaaauaauaaaaaaaauucuucacaagaaggugaaaaaaaaugccccacuacucaacuguggcccgaggcggggaaggagggggggcaaucccugugcccaagaugcccccaguucauucacaccacgaauucugcagacuccaggcggcucacgccuccugauugucagcuccuccucucugggucuguggccgaaacgucugcuuccagggacug

SEQ ID NO: 12509 - RNA, 14945 nt, Mus musculus
aggcuccaucauggcacccuuccugcgcaucuccuucaauuccuaugagcugggcucccugcaaguugaggacgaagcaagccagccuuucugugcugugaagaugaaggaggcacucagcacagguaggguuggaagggucccuagaggggcauggggcucagggugaagggaggcuucccuucuucucuagauccucuugccuuccugaacgacccagcugaggaugcaggaagacagaagcacccaguuccugacacuccacggugcuuaaauugaaccucccacaucuugaguuucacccuacugugauuuccaugucugccugggccuggcccugugcuggacacuaaggcuauuguagugcuccaggacugacucggccuuguccucaccccuagaaggccuggacaggucacaggagauaagucccuugcuaagggagccuagggaagacccugucccagccuagggucaggguugcuuccuggaggaggaacccuuugcugucuucucaccugauggcuucugccuacacagcuguuagguucugacuaagcugcccacuccuccagggucaggccacgugauggcuggaagguucagagccaccgucuuuguccucuucgaucccaucacagcuguuacuuaguggcuuccugaggagugcagggguucaugucucugucugggacuugacuuggccauguuccuugccaucaggucauggcuaaccuguggcagcucucccaugugaucacugggugaaugcagacagaaagggaaguuguauuggagcuggagcagaaauguuauaggaacgggaacagcaaggccaaaggauuuaggugggaccugccagaguacccgaaaggcacuagaggcugcuggagagcuguagcacauccuuggggcuggagagaaagaagacuguguggcacugagggauaaggagguccagggaagcagggacuagucccagucugacuucucugcccggcacugucgcagagcgagggaagacacugguacagaagaagcccaccauguauccugaguggaagacaacguucgacgcccacaucuaugaaggccguguuauccagauugugcugaugcgggcagcugaagaccccgugucugaggucacggugggcgugucaguacuggcugagcgcugcaagaagaacaacggcaaggcugaguucugggugagaggccugugagccacggucuugcaugugcuugugugcuagugggcugggacuuggcaagugagugagcccaacucuguagcugcugugacugagcuugaauccuggccugauuuaccagguccuuggccccucugagcucucuuucuacuuccauaagaaggaguaaaaaugucuacuccaaggaacccaucagauaaaaugagcaccaaugcccagugcuuauugccagccaauuguggugcccuggguuucuaauccuguguccucgggacucucaagcagcaagguuacaaguucaugaccugcuggguaacuuaacaacaagacccugccucaaacuuuaaaaauguaaagguagaauuggggaugcagcgcagugacaguuuguccagcauuucuccaguacacaaaguauggagacaccgaagucugauaccucgucagucccgaaggcaguuaucugacucuugcagcuaacucuccccaccgauuaguguugaaaaggcaggguaugcaucccaaagugcugugcuccuaccccagccccaggcuccuucccucuuagaggcaccuguuguuccuauuugggggagcguguugaggauauuacaggucuagccagauauggaccgaacaucauguuauuuagcagaaaagagguaagagaaggaagcuggcagucugcccacucaccugcagaaacuaggacugcacaugccuggggccacgugcaucuguggugauauucuuggcggcacaugccugggaccaggugcaucugugguaguguucuuguuggcaguagaaugccagagccaauacaguccuguggucuucugcagccaaaaugccuuucuaaaaagacgcagugaccauuggaagcacuggucagccuuaaugagaagugaaggagccgagauagaagaggggaccacauaggacugcuccaacucuuagccaguuaggcagggacacgggagccuccuggccagugcucucccugaggaaauaucacugggucuagguccugacagaggcuuaggccuuucccucuugagacuguagugaagaaucugccucugcgagcaguguucugugucuaucagguguagugguguggugucugcaugugcagauggggaggggggaguuccccuguacacugcuccuggaccaugugaccuagcagggugugggcuggauccuuucacuuccccaaauguaauaauacccugggugcaaaguggggcggggcuugggcggggcccugccuacccugcccacccugcccacccuggacaggcuggagucugaacuggcucuagggcccccccuuggccuugagggagaccaauggggcggguucugagucucaccugggucaggcuggcccucacugauuugucaucccccucccaccccugcagcuggaucugcagccucaggccaaggugcugaugugugugcaguauuuccuggaggauggggguaagacccccaccugggcaggggcgagcucuuuugccaggucagaggcagagcuggaaacaacucccauggggcuauguugggaccaucuugggagggacugaaggggaugcugaccuuaauggacuuggggcugacuucacuguauggcucauagauugcaaacagucuaugcguagugaggaggaggcaaaguuuccaaccaugaaccgucguggagccauuaaacaggccaagauccacuacaucaagaaccacgaguuuaucgccaccuucuucgggcagcccaccuucuguucugugugcaaagaguuugucuggugagagcuggugagcccugcugcagguggcgcagggagggaaggacuggacuggagcauucucacuuauucugucggggcuuugccuuucaggggccucaacaagcaaggcuacaaaugcaggcguaagucuucccuguuugcugugugcacuggugugugcugacaccugccacuguuugugucccugggucuggagagcaagucugaacaagagcccuguguacaugaaugugugugcucaagucagucagugccagacuggcuuguugcagcuggucagagccaguucugugcgguccuucccaacucugugcagguugucagguaguuacccccaauuggcuguuguagagauuuacaccaaaaccagccacagccuaggcacagacacacacaagaucucugccccgggguuggugugagcucuucacuagcccuccccugccuucgugugcuugucauggaugcgcgugugugaugcauaggugugagugugagcacgccuuucacagugagcaagcccaugcugcucugccugcgccucugcagucuuggucacguuucucagcacugggcaggugccucugcuuccuugcccguacaugauagauaacagauucaagugugaagaccuacuagaugacauguaagcuauguuuugagagcuuagcagguggugaguguuccuuaaagaagucugucagugacuacgcaagcucuguauggauggacaggugucuuuguauggggguguggcauguguaccugugaaagagagcucagcaacuguuggcugacuggaauaaaaaaaugggaaagaggugcucucuuuccugccccuauacagcaucacuucuaccccccccccacacacacacacacacgugcacgcaugccucacuacugagagcccuugagccuucucuaauuuuuacaacccuuuagauuggcccaucucuuuuuuuuaauuuuuauuuuauuuuauuuauuuauuuuugguuuuucgagacaggguuucucuguauaguccuggcuguccuggaacucacucuguagaccaggcuggccucgaacucagaaauccgccugccucuaccucccaaguacugggauuaaaggcguguaccaccacagccuggcugauuggcccaucucuugcccaugcuuuucaggcugcucuggaaaggcuagcgggggggugggggguggggaguugggggggcaggauaaagccccuggccgagccuauauagggugaggguguaggcggcuagugagaaggcuggcuuugugcagagggcuguaguuggcaagcagugccagcucagagucugccucucuuggugccucccccgcuccguccugggccugugccccuucaagaaugcaacgcugccauccacaagaaaugcauugacaagauuaucggccgcugcacuggcacugccaccaauagccgggacaccaucgugagcugggcccagggcgcgggggucuggggauugucagaugggaggggagggucauggguacccuagacucuguggggcucaccaucuuuccucacuuuguuuugccuuuccuugcuucuugccugggcuccuugggccuuuggguuucccagaccuugguggagcccuguuaggccucugacaacccacaguuugggagaacuagcaugugacccccuuaccugugauacgcuuccccuccaguuccagaaagaacgcuucaacaucgacaugccucaccgauucaagguuuauaacuacaugagccccaccuucugugaccacuguggcaguuugcucuggggacuggugaagcagggauuaaagugugaaggugugugcuacccagauuccagaccuaaaccccaguacccaccaccaugccugauaguuuugucuuuuuuuuugguuuuaagucaggguuucucuguauagcccuggcuguccuagaacucacucuauagaccaggcuggccuugaacucagaaaucuaccugccucugccucccaagugcugggauuaaagguguaugccaccacgcccggcucugauaguucuuacacuaagucaaaggacccuuaucugucuacccuucauuuggggggacccuccucacuggccuuccugacaguuuggagaccauaggucuccgaacuacacccccugccccucccagguacacagcucacaucacugaggagcaagugacuggaagcgcuuaaccaaggcuugcugugcacuagcggcccugccugcuggccugccuuccuccccaacccgccccccccagcccaaccuucccuucaggagacucugaaggcccugaggaaagcugccucucacuugucccagauguuaaagagguuaaagagguuauaauuagcuaccucucucucucucucucuaucucucucccucccucccucccucccuuuuccucccccuuucucucccucucccuuguucucuuucucucucucccccucccccucucccuuucccuccucucucuccuucccacccucccucuuuuuuccccucuuucuuuauccuucucccucucucccucccuucuucccuucuuccccuuccucccaccauauaucuccccccauuuauuuauuuguuuuauuuuuugguuuuuguucuguuuuugagacaggguuucucuguguaucccuggcuguccugggacucuguagaccaggcuggccucgaacucagaaauucgccugccucugccucuggagugcugggauuaaaggugugagccaccacgccucucccucucuuucaaucucuuucuuugacaggguaucacacaguagccagggcuggccuugaauucagagcaguccucuugccucagccuccuaguugcugggauuauaggugugacuuaauccauccggcuauuuucuuuuuuuuuuaaaauaugguuucaaauguucucauccccagaagcucaacaagccaaaaagucccccugucuccuccccuuccuccuaccaucccuguucauuucugagaccuaacauggcuggaccugccucugauucuugcagauuguggcaugaaugugcaccacaaaugccgggagaagguggccaaccugugugguaucaaccaaaagcucuuggcugaggccuugaaccaagugacccagguaggcagggcccgugggagggaccuggacauugggcagugggaacagagguaucaggguucacaggaugccuggggagcccuaaggugggugagacuucuggaagauaguugaugaauuuaggcagcagagagagguggccuuguuaucuuuggaaauuauaucauucaggcagucuguuaccugaggggaggcaggggcugcagaguugaauguugggacauuuugaaugugugugugccauguaugauauguauaguguaaguguugugugugacauauguaugcauguauguaugugugauauuuauuugguauguaguguguguucccagaguauaguagcuagguguguguguguuauauagaguguguacuguaugcauauguaugcuauauguacauaguguauaugguaugcuuacauagugugaguguuguguguaugcagugugugguauguaggggguuguauguaguaugugaagugaguguauuguauguacauaauaucuaugcuaugcauaugugugguagugugugaauguacaguguauggaguguguuggguauaugagaaagggguucucaugguauguguauauuaauaugugacuggaacuuaagggauaacacaaaacuuuagagugaaaaucuagagccagauaugaaguuaguggccagcaagauauuucaguggggccgggcgugguggcgcacgccuuuaaucccagcacucgggaggcagaggcaggcggauuucugaguucgaggccagccuggucuacagagugaguuccaggacagccagagcuacacagagaaacccugucucaaaaaaaaaaaaaaaaaaaaaagauguuucaguggguaaaaguauuuuuccacacagccuaacagcaugaguucccgccauagaacacacaaaauaggagagaaacaagucuaacaaguuguccucuggucucauggguguccugugccauaugcaugugugcacauauaucuguucacauaugcacaaauaaauguaaaaaaauucuuuaaaaugagacuagauaauuuauuaaacgcuuaggaagguauggcucaguuuaauaaacgucugccuaugaucugugcccuucagaucucagggccagugggagggaggaaugagaccugggagacccggguucugcccucugacgucaucgaaguugaggaggguauugcaguuggggucuucuucgccugagaguucugacaauggucuuccauucuuauguccuuucccuagagaucuucccggaagcuggacacaacagagucugucggaauauaccagggauuugagaagaagccagaagucucugggagugacauccuaggugaagcugggucacauaucucuuuaaagcuaucauuccccagcagggcaaaggaaaaggacaguagugagaccugcgguaagguccugagcuucuuucucuccaaggcuccuccuuccuuccccagcccacccuugggacuccagugaguccucucugucuaguaaguccuggaaagagguaccaccuguuaccaaucagcucuuuuccuccucuccaaggccccuugccuagcccacuccuguucccugggaagggagucauguagacugaaaccuuauucucucucucucucucucucucucucucucucucucugcagacaacaacgggaccuauggcaagaucugggaggggagcacccggugcacccuugagaacuucaccuuccaaaaaguacuuggcaaaggcagcuuuggcaaggugaggguggccugcggaccagggcucagggguucccuguuaagcacagaggcuggaugcugcugauaaccuccagggccuuugcucagcauccuucccauugguaggugcugcuggcagagcugaagggcaaagacaaguacuuugcaaucaagugucugaagaaggacgugguguugauugacgaugauguagaguguaccaugguggagaagcgggugcuggcgcucgccugggagagucccuuccucacccaccucaucuguaccuuccagaccaagguuccugacuuucccugccauccucccugcagugggggcugugucuguucuagucacaccucccaaauugucacccucagcgcaaguccugugcucucugcuuccaguuggggcuccauggucuuuugcuaggguaucuccuacuuacccuuuaccucugcuuacuuccugcccuacccaggaccaccuguucuucgugauggaguuucucaaugggggugaccugauguuccacauucaggacaaaggccgcuucgaacucuaccgggcuacguaugugagggcucuaugugaggggaggggcuuuggcugaguguacuggcagacuccuucagucuuucucuccccauccuuaccccccagaaaagcuugagucaggauagagcuagcacuggggagacuggggacaucaggugggcaacaagguaugguuaugggaccaggacacguacccuagguccugcccucucuucugccucagccagaacagcagaauggaccugcauagcauuggacccugguguguggccccuaggccacaguaguaaugcugucaagcauuugccuaaauuaauggcauguguuugcacauuugugccaacagaaaucucuccuacaacagagcauuggcuuauuaagauuucaguucaaacuuuacugccugggcuuccagcccccacuuaccugauuuacagauugguuagggcccugguguugauggaguuacuuuuaguguuuccugcccugggauggggcgaugggacuggugggcaaaauccuggaauagcaucucuuguucagguuuuaugcagcugagaucaucugcggacugcaguuucuacacagcaaaggcauuauuuacagguauuguuggugccggggacuguggggagggacuucugggaaggcuguugcuuagccugaccacaggcccagcacagcugagacuggggcaggaaacucacuguccuuacucagugcuguuggaaagggggcagcgcaggcagguacagugccuccauacgugauguucaucuuucucacuccaaagaccccagcugagcaaucuaagauuucaccacuaggcacugguuccuuaagucuuuauccaguacguuaggcuccacccuauggcggaugccacacacucaccagaaggguugaggcuguacucugugugucauaggauaucugcaucuggguauaugugagaugauacuaaacuauccggcagaaacuacccuguggagccaaguuguggcuuuacaccucuguaaucccagcacuugggaggcagaggcaggcagaucuuugaguuagccugggcuacauaggacagccagggcugcauauugagacccuguguuccaguuuucugaggugggaguggggcucuagagagauggcuuaggaguccagagcgccugcuguuggcaggauuggguucuucacauucaugcccagugucucacaguugcuuguagcucugccuccaggggucugacacucucuucuggccucugugggcaccuagccucaugugcacuuacccacacacagacacacauaccuaugcauaaauuaaaacuaaaaauaaauuuaaaaguaggcuagugucaagcgugguggcacaugccuuuagucccagcacucugaaagggagaagcaggcaggucucuuuggaggccagccuggucuacauagugugcuccaggacagucaaggcuauggagagacccugucucaaaaaaaaaaaaaaaaaaaaaaaaaaaagagguggguaugacguacauauucuaauuugcuugcuugucugugccuagaauugcuaaaggcggucuggugguugaaguuaguaacgaugaaccucguacuguuuguacauauuguuacuuguuccugugccuguaaguuaucuacucaaaugacuaaugauggaaaucaacauggcuccugcccuuguugagucagacagaccugaguuggguagaaggcagugguauauaucugccagccaguuaagucacaagggacagugacaucguugcucugaacugcacucaggaauucagggacuaagguacugugugucacauuuaacaccguagguggcuaccagaaggcaccugcuuacccccccacccccacccccuuucuccucuguauucucucgugcucugagaaaaagguguggacuugcagggcuaaaauccagcguguggcagcaacgcuagggaagguuagaacuugugcccagggauguucuguccuguccucucaucagggaccucaagcuggacaaugugaugcuagacagggacggccacaucaagaucgcugacuuugggaugugcaaagagaauauauuuggggagggccgggccagcacauucugcggcacuccugacuacaucgccccugagguaagaggucucucucucagcuaugcuuuuggccuuggguggguagaaccagagaggcucccugcagaaggcuggcccccuguucugaccccuguugccccagauccugcagggccugaaguacuccuucucgguggacugguggucuuucgggguccuccuguacgaaaugcucaucggccagucccccuuccacggcgacgaugaggacgagcucuucgaguccauccggguggacacaccacacuauccccguuggaucaccaaggaauccaaggacaucauggagaaggugaggccuggcuggugcauaccuuggggcuuucaggagggccugucucuggaauaagggcucccugaggcuccaugccugacauaucccaagccuugcucugucccuguucccaggcaguccuuuugaauccccugccuggaaucggcaggguguagugacuaaggacucagggucaggagacagacagaccugagggcaaguccuggcucugucuguaacuagcuggugacugugggugggucacuuaaccucucucuuuaucuucacacugucucagaauugcuagaagcacauagaaaccccuaacacucagcaccuaggcagauaguaucaguaaaacauacagcuguacccucagucccagaguucccugggcugagccugucuagucuuggagccacugggcugccagugguuugcagagcucugguuucccauggccaugaccaagacccccguggauugcagcuauucgagagggacccugacaagaggcugggaguaacaggaaacaucaggauucaccccuuuuucaagacuaucaacuggucccuccuggagaagcggaagguggagccgcccuuuaagcccaaagugguaugucacccugcccugcuccaggccuggccuucccuugcucugccccuugcccugcagccuccccacacgccccucuuuccuuccagcaagccugcuuccugaccccuccuggcaugcuguguauguaccacagccucuacucuugcauccucgcaaucucagcccugcacucauucaggagacagcuggaacugcagauuuaggaucuugagcuggggaauguagcucggaggcagagcacuuagccuagcaucuacagggcccuagguuugaaucucagcaccaccaaauaaaaacagcagaaacagaaacgggugcaggcaugauggagcacaccaguaacccauaguacuugggaggcagaagccgaaaaguagccacaaguucaaagccagccuagugaguccucagcuacguaguggggacccuguuucaaagcaacaaccacaaguggcaugugccuguaaucccaggagugguggcagcaaggcaccugaugcugagguaagaggauauuguaagucuaggucagccagggcuauauagcaagauuuugucuaagacagacagacagacagacagacaggaccucgcuguauuucucggacuggcucagaacucuuggacuuuuuaucccccuacaggcacacaccgccaugccugcuagcagccauuccucguaauuaaguucuucaguaccuuguguucccagagcuguauuuuggccaccagaguuagggcuuuacuuccaucugucuuuucaucaaucauaaauaguggacacgcugaguccuuguugggaaccgagcacagugcuaggcuuuggcagacugagaaaaaguccuaaaccccgaggagcccagaccagaugccuagacacuggugacacucugauagaaggcagcaguaggggagaugucacagggcacacauuacagguugcuucccagagggacuagcaguaggaaccagaaaugcaggaccagaguggucugugaggaugcuuuggacgaacugguauaugggaguggggcucagcugucagacagggagagggcaucccagguggugagcugaucuguaucacugggacuggcugagauaaguagaucacggcaccgggaagcuggaaccugcuggguguguacaucagugugcuguaguccuaaugcucagagggauacaggagcuuccugacuucaaacccacuucccagcacgauccugucuuuaaaaaaaaaaaaaagaagaagaaguuagggcacagugucccuuuuguggucauagcuccuucucuggcuaccuuuucucucacuugucuucugccaggacauacuguucucacugggcagucuggccugccccacauuugugcuugagauagcagaacacuucccccccguggaagucauaaucaaaggcucccugaccagggugacaggcuggcucagcuauaagggcaguauauggcucuugcuccccaguuauuccuccacucaguggacaugugagcagccucugccucugggggcugagcaggacagugggcuuucaggccuaagaguggggccucacaggaagugggcccaggggcucugguguaccuauagcucauggcagaguacucccccagccggucagcguccuccccaaguaaaggucaaaaugaaagaccaaaaccaggcaugguagguaggacauagcuauaaucccagcccuugggagguagaggcaggaagagcagggguucagggccagccucaguugcaugagacugucuugaaagagcaaaaacaagaacaaaaaccagauucugaucuuuuaccugucaagacucuccagagugagagcugauauggcugagccuguuuugcugcagaugcaguagucgccguugucucugggacuguggugugagaagagagaagggugcucaccuguuacuaucuuauccaguccucgggggcaggcagugaauuaggaacuuuccuuauaaacauccuaagaauaaacacuuacaguuuugcagcccugugcucagugcagccgccuuccuuguucugcagauggguguggcuguguagucauaaaacuugauuugugggcacagguguuugcauuugacuucauuuucauaugccauuggauagucuuuuuuuuuuuuuuuuuccucccaaccauuuaaaaucauagaggcuagagcuguaaguggugguguguagcgguucuaguguuugggaggcugaggcaggaggaucaugauuuuguagacagcaugggcuacauaaugagacuuuuguuucaaaaauaccaaaacuaaaaccaacuaucuaaaaauagugaaagcuauucuuaacuuauagaccuccauuaagagcagagcaggagaucugaggcccauaggccguuguugacuggcccugcucugcaggaugucccaggauauccccuguccuuacuuccccagugcucccugccugccuuccucaccucuggggaauagcauuccccugugauggcacuguccuuggguuaccagugacauccucuuucccaacugagcugacugcccuggcuugccccaacaagggccccagaagccugggcgccuugccaugucuuugaaggcagaccuuggagacacccuuucagucaagucacucuuaccugccacugccuuuugcccacagaaauccccuucagacuacagcaacuuugacccagaguuccugaaugagaaaccucagcuuuccuucagugacaagaaccucaucgacucuauggaccaggaagccuuccauggcuucuccuuugugaaucccaaguuugagcaauuccuggacauuuaauuaagcucccagaccugcuuuaaacgcccuggcagaguaggcccgucugcccugguuugcaccgcauugcccguggagaacagugggugacuggcugauuucugcugccacccccuccuccuuggagaguccggcuccugcuggcugggcucacaguacuuccucugugaacuguuugugaauuugccuucccuuugccaucagagggaaacuguaaauccuguguuucauuacuugaauguaguuauugaaauauauauuauauauaugcacauauauauaauaggcuguauauauugcucaguauagaaagcauguaggagacuggugauguguugaccuuuuuaaaaaaaaacauauguauauguguguauauauauauacacacauauacauauauauguguauguauguacguauguauauauauaugaccaaaagaaaagaagagcacaagcugucugaaccacagguucuuuuaugugugucuaaauaaaca

SEQ ID NO: 12510 - RNA, 102456 nt, Mus musculus
uggauuuacggcagcacugggaggggugagggcggugagggcggcgggugccggagagacggccgcggccagaggagcgcuagcagccguggcggccacggggcggggcucggcggucggggaccgcagccggggcugcaggcggcggagcggcgggguaaggccgggcccggggcgggcggggccgccccuccucggccggcugccgggccuuugugucggcccgggcgggcgggcgggcgggcgggagucgcggcggaggccccgccccguggugcggacgcgcuggucgggcagggcgcggggcggggcgcggcacggcacggcggcggggccucgggacagggcccagcagcccggccgcaccugccgccgggacaaaggcagagcagggcccggaaacucccuucgcugcucuuucccgcccgucgcgggccgccuucaaagcugucaacguuuccuuuagccccagaaccagugacaggucgggcgaacucuucuuuuccuccgccucucaaggccucuuuuuuuuuuuuuuuuuuuuuuuuuuuuuuuuuuuuuuuuugguuucuugugcguucggcaaaaaacucccuauugaguuuuuguuuuuguuuuuuucuuucccaaugaucgcccaaacggaauauuuuuuuguuuuugucagagagacuuacuuauuuacaggcuagguacuuaagcuucucauuuguaccgucacgacgaguugaguuuuuguaaacuguauuuucugguuuuaaaaguauuuuccguuucaaaauuuuguuuucugaagaagugagucuuauuuuaagaaaauuugauaucaaaggggggacaaaaauauaaaauuccuggaaaacaaaugacaaauacacaauagaccggauguaggaauucgaggacuaacuauagaagcguaugguggaauaugcuaucuuaauccaaacuuuucaaaacuuacuguaggagccaggcacaguagaaaacaccuguucuagcucuugaguugggaguaucgcaaguuccaguguacuuggguuacauagugagaccugccauuaaaacaaaaaagugguuauacguuucuuucuuaacccauuugguaguaggcuuuuccccccaaaguaauucagaagcauauuggauuccagauguugaggaacauagcuuuugcuuuaguaguuuuuaagauccaaaaugaaagauuggaaaguauccucguuuaucuuugaaguggccuuacuuugcugcuagauuuaccucagacuucuggaucacccgccucagucuccugaaugcuggguuuacaggcgugugccacugcuggagggugggggaagugaggauaguaacugcugaagacauguuugggauuaaaacaguaacaccuguaugugcagaugcaccuuagagugugaaacguagcucaaguacuagugcauuccccaaauccccaugcuauagacccgucuaguagacuguuaggaagacaucagacaucaugaaagagagugcugacuugguuaccucuucauuuuuauaucacuccauuuaugggaaagauaguuggguugaacuguaguugaguugguagagaaucugguauauuugugaagcacuggguucagguccguauacuacauaaacuggacauggugguacaugcuaucccagcauuuagcauguggaggcaggaggcucagaaauucaagcccugaguucaagacuaauaugguauggaugagacccuguugcaaaaagaaaaggagagaaaacaacaacaacaaaagauaacauaaggaguagguaaauauuaaaggcucugaguggcaguggugaaggugguuuuccugugagaaguaggaugguaauugccuacuuauuaccacaauuuuuguuuuaaguauuuguuacaaugcugaauauuacuaaaaaacacagaauacuaaaaguauguugucagguauuuggcuauacuagguacuuacacaguuccauauuuuuuuuuuaauauuuauuuuauguauaugaguauaccauagcugucuucagacacaccagaagagggcaucaguucccauuacagaugguugugagccaccaugugguugcuggaaauugaacucaggaccucuggaagagcaguuagugcucuuaacugcugagccaucucuccagcccccacaguuccauauucuuaaguacucuuuaaaagacuuacuugguauauguaugccugugucuguagaggcuagagauccauggcauuguuuuucuauuguuuguuuuuuuuuaauuuauauuaagaucuauucauuuuuaucuuauguguguggauguuuugucuccauguauggcugugccucaagaaaucagaagaggguccccuggaacuggaguuacagaugguuauggcugccaugugggugcuagaaaucuaauucaagcccuauagaagaguagccagugcucuugaccucugagccaucucuccagggcuaccuuauuuuugaagacaaauucucucauuauauaccuggaguuugcugggguuugacuaggcugaucgccagcaaaccccagugaucuuaaugucuuuacaccuccucuguaccuucagugauggggucagagggccacacaguugugccuagcuuuuguuguggguccuggggaucugaacucaggcccucaugcuugcauggcaaguacuuugauuuuccucuucccagacuucugaaguauuuauugugcacugggaguauccagauucauugucagacacuugcauuuuuuacuguaaauaaggccauccuaacaucugaaauuaaaccccagaaucauuuguuuucugcuuauggauaaagaaauaaugaaguaguacuuagagacuguuuuuaaauuaugcaaaauuuuguuuuucugccucccaagugcugggauuaaaggcauguacaccacgcucggccuguuuccacuuucuuaaugguaguauuccauguguguaccaccaugcccaguuccacguggugcugggauugaaccuggggccuuccaaucugcuaggcaaccacucuuccaacuuagcuauugcuagcccuuguuugcauuugaagauaaagaaacugaucugaguuguaguuuggcuagcaucauacagauaacuagaguggaaggucugacuccuaaguguggaucgauuauuucacauuacaaguuaaaagguauauacuucggauaagaaaauauuuuuuaaaaucccucucuuguaucuuuuaucuuuugaaaguguauuaaagauuaaggggucuggguuguugugucaucuaaaauuacaauauauucaaaacuaauaauuuacauuuuuuugucauuuguuuuccagugcguuauaaaaagcaguuauuuugaauugccaagauaauugaagacuuuuuaaagcccuguuaaaacuuaaaugcugugucuuuccagugcagauagagcuuuuggaaagaaauguuuuucucugaugcuuggguggaggggaggaagaauuuuguagaguuugcucucaugagccguucuugguuuguuccagcuugccaacacuuggugucacaugugagccucccacaugugugcacucuccauuccagcucugugauugaacucugcucuuauugacuagggggcacuugggcaggcaugcuucauuccuggaguugacagucauuucaugugaguaaaggugaacucagugagacauuucuaagcauguggaagcauuggguuguuaaaggaaagaaaugucaggugcaccugagagcugacugaugugccuguaucucucacuuuagcaauucuauuugaauguauguuuucugucuguuuguaacucauuuaucccccuauuuccccuuucucugccuuguucuucucuuucaguucugaauagacuaacugaauaagcccucccuucucucacgggcuucaguuggccugcagacauaaugaggagauuggcuuuucgaggcgcugguugugcucugguaaagcugguaaauuacugaucaucuucacccuuuccuguuucugucguucuuuaccuuuucccuucagcauucugaauuuuauaguauuucuucccaucugagucccuccuguguuuaucagaguguuuccaaggauuaguccuuaacuucauuaaauuguggcauuguggccaguuagcagucuuuuauaacaacaacaguaccuaaguguucuugacuuaagguuuuagaagcuguuaaccacuuuuagucaauuucaaacuaauauacuugguaauaaaccaaagccuagaggaaggaacaugaucacuguggguucuguuuuaaacaguguguggacuuuauaguucaaagcaagagacagaagacuccucuuguuucuuaguugcucaacggauuuuuuuguuuguuuguuuuguucuugcuuucuauuuccuggagauccccaguuuucucucuguaauacuggcagccacuggucuacuguuguuuauuuagugaaacuaauaaagucuauuguuacuuuuagcuuuaggaaaguccuuugaaauuacaaugcacuauuugauacuacuguuaaacuauauaagcauuguaggacuuccuuggguuuauacccuuuaacuguaguaauuuauuucugugguugcauuucuuauagccaaaugcguauauuguaaaguuaaaaaguaguuuauuuuuauuuuuuuauuugagguaguauguagcccuggcugaccuagaugucaguauguacaccauucuggccuugagcacacagagauucccccugccucugccuuucuugucaagugcugggguuaaaggcuugcaccacugcaccuaucaaagaauagugucuuauaggauuaggaagguaucucagugguuaaaguucuugugcaaaaaugaggcucugacuuuggauccccagcacccacauaaaagccaugugugggugguagggucuguagccccucacuggaggaacagauaaguaggucucaggcacugacugacuagauauucuccaggguuaggggaaagugcuaaauggagacauccaacaucaacuuauguccugcacacacagcgacagacaggcacacacacagaguuccuuuuguauuaaugauagggcucaguguuggagcacuuuccuaucaugugaaagguacuacauucagccccuaguacugcaaauaacaauaaaaaugcugaagucagcagacaaacaaaaauaucagucaagcuaacaacaaguguuuguguuucuaaaugucuacacauucguuacccaagaacccauguguauagcauguucuuccagaucgucuaauucuaauaagacuuaaagcuauuuuccaaaaucugugaguauaguggacaucucuuacugaaaggaaagacuuaauagaagaguucaguguacaaguugcuauuucuucccagauaaaacaaaacuuacauuguuucacagagguauuuuuaugaauucugcuuuaagaggauaauucauuuucaagguguuaauuuuaggguacuucuccagugcuaagaaguuuacugcuccauccccuuugcuucagauacugcuucuuaguuucauuuucuacacuguggcccacugagguauuaguuacauucaggaaagcagcugaaguuacuaacccuugguaaugaccuuagaguccccauguguaccugggccucagggucuuagggaccagugcuuccagugcacuauugaagacuagaggacuagaaggauggcucaguguuuaagugcuggcugcucuuccagagaaccuggggcuauugcccagcaccuacuuggcagccuacaaccauuuguaucuccaguugcaggagaucugauacauucuucugaucuucucuagcaucaggcacacauguggugcacagauacuuacacaggcaaaacaccuguacacauaaaaaauaauacuuuuuuuaaaaaaugacuauacaugaauuaggaagccacauuccaagauaaaucuggagcaagaaauggcuaauuuagaauuauugacauacaaauguguauacuucugccaaauuuauccuaucagaguuugaugguacagcauucugauaaguaaaaggcuaaaaaaucauugaggucuagcacuuaaauuaacaaaagaacuuaaagcuaguucaauuccucuggggggaaaaaaaaaaaacucuaucagcuaucuuaaaugaaugagaaguuuggugauaugugcccugcuaagaguuuguugacauuguuaaagauuaaauauaagaacuuggcuaauuauuucuuacagaagaaguuggauuccauggguuccaagagaagaagagccaccucuccuuccagcagugucaguggagacuuugaugacgggcaccauucugugccuacaccaggcccaagcaggaaaaggagaagacuguccaaucuuccaacuguagauccuguaaguaucuaagucauggcuucugcccaauuucccaugguaauccuacucuuccuucuuugaagcaguugaacaucuacauggccucccccccccccaacugguuugauagguauauagaaguauauuuauagccucaagucuuaacaguaaugguaucauuuaauauuuugaaguuaaaauauuagugcguuguguuauauauuuguucaacaaaaaaauaugugguuaggggcuagagagauggcucaucaguuaagagcuuuggcuacucuuccagaaauucugaguucaauucccagcaaccacgugaugacucacaaccaucugugaugggaucuggugcccucuucuggcaugcagguguacaugcagauagaacacuccuacauuaaauaaauaaauguuaaaaaaaggaggaguggguggguauauggugagcacugaauauauaugcuguggccaguauagaggggagugggcaacuugagggagucaagucgucaucuuuugccauguggguucuagcaaccagcucagguaaggguuggcagcaaguugugagcacuguucaaguuauugagauaugacuauauuugaggcuaucuccauuuucacaugaagcauagauuccaauaaaguacuggcaccuaguaggaaguucuaagaagaagaguaugucacgugggaaaagaggaauuagugaguuagcuuaguagguuaaugugcgugcuugagugcauaguccucuugucuuagacucucaguacuagaauuaaaguuguguuucccuaaugcccagcuuagguggcuuuauuuuuauuuacguuucaaauguuaccccuuucccgguuuccccucuacaagcccccuaucccauaccccucccccuuagguggcuuuuuaaaaauuauuuuuuaaauuuuuuuaugaguaugaauuuuuugccuguauguaaaggcauuguguucuuggagaccaaaagagggugucagacacccuagaccucaagcuguaggcaguuaugagcugccauguagguccuggaagucaaacucagguccuuugaaagaguggcuagaauucuuaaccagggagauaucucucuagcuccagcuuuccuuuuuuauuuuuuguagauuuacuuacuuuauguaugugaauacaugacacaccagaagagggcauaggaucccauuacaaaugguugcaagccaccaggugguugcugagaauugaacucaggaccucuggaagagcagucagcacucuuaacugcugagccaucucuccagacccccaaacuuuuauuuuuuuaaguuagauuauuuuuaagcaggagaguuauauaagccaauaagcugauuuaguuuaaaagaaagucagaaucagacaugguaaugaucugugaucuuaguaccaggaaaugaaggugggggacacagaucuaauaaaaguuacaaaaacuugagaguauuuucuguuaguuuauuuauauaauuauuuugguguuuugaggcagggucuuacuauauagauagcccucgcuggccuacaacucacucuguagaccagguuggccuuaaauuggagcuaccuccuacuucugccucccauacauuauuuaaaaacuauguccucucagcauguagcagacuggggaccccauuggguacuuuggagguuuuccuuuucuucucuauuuuccuuuucuggagauguuuuuaauaaagaauuguugauaggccuucauuggauguuguuuggugauucuuuuucuuuucuuccuuuguguagauugcugugugccaugaacucuauaacaccauccgagacuauaaggaugaacagggcagacuccucugugagcuguucauuagggcuccaaagcggaggugaggugggaaacuuagauaagugggaagaauuuuuguuuguuuuguuuuguuuuguuuuuugagacaggguuucucuguguagcccuggcuguccuggaauucacuuuguagaccagccuggccucgaacucagaaauccgccugccucugccucucaagcgcuggaaucaaaggcgugcgccaccacugccuggcaauugggaagauuugacacggggucuaaaguuaggguguuugguaauuauuuuuucauaaggaguggguuaagucugggguucaauuuuagucuuuuuuuuuauuuuuaaucuuaauuucaguuuuauucaucaagauacuuauuugcguguguguguguguaugcuacauugcguauauggaguuguugcaggaguugauuuucaugguuuuuaauguauguagauucagagaucuuugcaaauguauuuauuuauaagcauaucuguauucccuagcucuuuccacugacacagcaugaaaugagcauauacagcacucagcagagacugggaugauccuggagaacucuuuggugucaggaaauaaucaaguacauggaaagugaugggaacauguuagaacaacauagaaaauagauacugucagcugagacuggggcagguggaucaugauugggaggccuaccugagcuacauaguagauucuaggucagcuuggauuauauagugaagcccugucucaaaacaugaaaaauuaaaacaaaauauagaaguacacuaacagaacacccacucgcuagacauugaagcaguuugguaauaacauaggcuguaugugauggcauugagagguggguagauaugugugaauucaagaccagccuggccuacauagugagauucagaacagccaggauuaccuaguugcgacccugucucaaaaauaauaaucauugcuaucauuauaaccuuuaacccauuugguaaaguaguaacucaggaacccauaugaaaauaaaaaaugaauaaauugaaaguauggcaagaaugggcuuucugacuguauuucccuguuuaaaugaaacaguagagaaaccuagcaaacacugccaugaucaaaugaucagagguaaccuuaucagauuaauaaaauaagacagaaccauguguaagcugguaaaauugugaguauugccacaucaucucuacuacacucuguucuguaaagaacagggcuuuauuuucaaaggaagccagaagaagcauuccaguugaguaaugcuuuacaaaauaacuagccuguaaucuucaaaaauauaugaaaaucaaggaaagcugaguaguuauuuagaaugaaagaaacuaagaaaauacaaugaaagcaggauuucuguacucaauuuuuuucacugugaaggacaagauuggaauagcuggcagaauauaaauagaauaaacagauaagaugguaccauagccaaguuugucuccugguuuugaauaguggucccuugauuguaugaaaucaguacucauccgggcgugguggcgcaccccuuuagucccagcacuugggaggcagaggcaggcagauuucugaguucgaggccaggcuggucuacagagugaguuccaggacagcacagagaaacccugucucaaaaaaggaaaaaaaagaaaaacaaguacucaaacauaugucagcgcuuaacucaguuguuuuggaaaauaaguuuuuuaggauguucuuaacauuaaaaguacacuuuuuaacauuuacuaaauuuugugcacacguucauucaaguguacaugucuggaggucagagaacaacuuggaggaguuguuucgguucuggagauuggacucagguuaucaggcucgggagcacuuccuucucuguuuaguauuuugcugauuugcugaucacguucuuagaacuuuuaugacagacuuaaaagcagauguacauaauggaaaaugacuauagacucuccaaaggcauugaaccgucagugaccagggcagucuuugacuguauucacuuuucuguuacacaucuaaaagggagcaaaguaacccuguugggaaacugagaaaguaaucacuuagauuauuuuuuagguuugcuuguuuuguggaacuccuuuagaaaaaaaacagaaaauaauaaaugucaugagcccuaagaaauuaucuuaggaacuuaauucucauaauugucucugaaauuccuuugugucccucugugucucuccuuuccaggguguaucucuugucacuauccuggguuuccaucucuuuccccauuggugguguugaggguugaaccagggccuugcucauucuuuuucuuuuucuuuuuuuuuuaaauauuguuuauuuauuuauuauauguaaguacaccguagcugucuucagacacuccagaagagagcaucagauuucguuacagaugauugugagccaccaugugguugcucggauuugaacucaggaccuuuggaagagcagucgaugcucuuaaccacugugccaucucaccagcccugccuugcucauucuaggcaaggacccugccacagaguuacuucacuauucccacuaucagaauuuuuuguuuauuauucuuagaccauuguauuuagauacaguuuuagaucuuuuacauuugguaagcaucugucuccuuucuaaguuuauuaguugauuauacuucauagaaguaauaguacauggccagaaaaggccuugugauuacuaagugagaaaacaauaaccuauuuuauauauuuuuuuucaagacagggucucauuauguagcuccaguugucuuagaacucacuguguagaccaggcuuaccucagauuaugugaucugcccaccucugucucuuuaaugcugggauuaaaggugugccacuaugcuugacucauuguguaacuuugaauuuuguuguaagccauuuuggaaugaggaaguuuauagacgauacuauucacaucgguuuaguccuuagauaauuauauuuauauuuaaccuuagauauuuggcauauaaaccugaucaucaauguuaacuuagguuuuuuuuuuuuuuuuuuuuuuuuuuuuguaugaaguauguauuuugaaaagagagcacaccugcaucuugcuuuugguauuuccuuuucuaguaaugagggagagucucuuggggaauuuguaauuagauuuguuauuucauguguuggauauuauacagauagauuugaaauaaaacuuuuuauaugcuuugaauucguguuauuuaaacauacuuaaauuauaacagaaaucaaccagacuauuaugaagugguuucucagcccauugacuugaugaaaauccaacagaaacuuaaaauggaagaguaugaugauguuaaucuacugacugcugacuuccagcugcuuuuuaacaaugcaaaggccuacuauaagguaagaaagcgucaguuuuggaauguaucuaauuuuauaaauuuuuuaaaaaaaaucauuuauauuuuaugucuuuauuuaauuugggaauacuauauacuugagcuucugauccucuuuccucuaucuucaaaauacuaggauuauaggugcauguaucacaccuaguaacuuaaaaagauguguguuugugugagugucuuuugcccauaugcauauaaguacauuauguauaugcagugcccauagaggccagaagagaugguccauucucuaaaacaaguuauagaugguugugagcuguugugugaguccucaaagccaaaaaaauccuagugcuuuuuuuuuaaagacuuauuuauuuuuuauuuauaugaguacacugcagcuaucuucagacacacacuagaagagugcaucagaccauuacagaugguggugagcuaccaugugguugcuggaaauugaacucaggaccucuggaagagcaguccaauaguuucacucccuaugagccuguggggccauuuucauucacaccacaaagacuuuccucacgucuugugucuuugaaaacuucgucugcuuuuguguauuuagguauuguuuuuuagguagcuuaauucuuucuguuuuuugaaguuugcuguuagucuaaugcaaaguagaaauaauuucacuaguuauuucuaucuuuuauaauaggucuuuacauuggaauuuuuauaauuaauuuuaaguuagcaaauaauuugucuucugccucaagugcuucuguaaauuuacuucagaaaugucuuuaaaaugaauagccauuuuuucuuuuuuguuuuagaagauggacuaaguugugcauaucuucuaaucaugagaauuuugaaguagggcuggcgagguggcucagugaugaagagcaccuacuacaauuccaaagguccugaguucaaaucccagcaaccacaugguggcucacaaccaccuauaaugagaucugacacccucuucuggugcgucugaagucagcuacaguguacuuauguauaaucauaaauaaaucucugaagaaaaaaaauuuuuuugaaguaauuauaauaauuguauuuucagauuugucucuuaaauuagcaguucuugggccaggcagugguggcgcacgccuuuaaucccagcacuugggaggcagaggcaggcagauuucugaguuugagagcagccuggucuacaaagugaguuccaggacagccagggcuacacagagaaacccugucuugaaaacaaaagcaaaaacaaaaaaaagagaagguuuucugaaaaaaaaaaaaaauagcaguucuuuguuaaacaguaugauuuaaaacuagggauugagucgucaauaaaaguaaauguuccuuucuuucucuuugcuaauguauagccagauuccccugaguauaaagcugcuuguaaacucugggauuuguaccuucgaacaagaaaugaguuuguucagaaaggagaagcagacgaugaagaugaugacgaagaugggcaagacaaucaaggcacacuggcugacggcguaaguucgagcacacagcagcacgaggaccuugggaaggaggaggaggagggagcgcuauguugcugcuucugggcuauugugggaagccauuguguuagugcuugagaguguaagugaacuuggaguguaagccacacuccaguuucaugugaucuuaaacauccugacagugcuacucguggguguuuccauggguuguuuuuguauuaaugcauauuuucuguucaauuuuaaaaaccaugauauuaccaagggcuaguucaguccaauagugcuagauuaucaauguagguaggcaguguugagauuaaaauuucggagagccaguuugagucaccuuaguuaggaaugcuuuguuguuuuaagcuagagaacaguuagaaguagagaggaaaaacaaaaaggcaggcaagcugacagucuuggcaggugcugggaguuuggagguggagaugaaagaaaggcauucguuuugcaguggggugaaaggcagcugcauggcauaggggagaggggcuugaaaggaagugagacagcucaguguccaggagagcauccuuuaucuuugcccagcaucugggaaagaggauggggaggaaaagguaaaggugagaaaaacuguuauacucugugugugccuuaucaauaccuuuaaaggaguuaguuggacuuaauagugguaccaggauaaaaacucuguaagcagcugucaggaauacuuuaguauacugcacuagguaucuacugcuugauccuaggacaugccagguggauucugaacucugggauuuugcauuugcucuuaccuuugcuuagaaacaaauuuauuuaaaaaaaaauuuuuuuuuaaauuuucuauguauugguguuugucugucugugugaugauguuagauccccugaaacugaaacuacauacaguugugagcugucauguggaugcuaagaaucgaaccugggcccucuggaaaagcagccaaugcucuuaacugagcccucucucuagcccccuagaaauaaauguaaacaguguguguggauguuuuaccucugugugugucauguguguucuugguacccaaggaggcagauaaaggagaaauaacuagccgaauguugcuugcugaguuccccagucuuucaauagcuuuagacaaaaaauaaaauuuaggcuguggccuuuuacauuuuuauuucugauacuuugauacauguaaucacugaauuuuagguuguccccauuaccuucucucauuucucaaccuuuccugcugaaacucuucccaacacagggcuugccuaucuuuauccauuuauuucauuugcauaauugaugaaaaauagagacaucuuacauauucauauuuaugucucuuaagauucuuuuauagcugcaagccuuuuuuuuccaaagaggaaggcacuuucaagcaccuaguuuuuauuuaagauaaaauuuuuauauuuuauuuugcuuugcuauaaaaucuuaguuagaauauagauuauuuaggagcuagugggauggcuuaagagguuaagaguacugacuacuuccagacucaguucccugcaccuacauagugggcuacaacuguaacuccaagaucuaaagccuucgcacagacauacuugaaggcagaaaacaucaauguacauaaaauaaaaauaauuuuaaaaaaaugaauuaaaaaaagaauauagaauauuuuacuuuauuguacgucuauguauauaugauuuuucaaagauaguuuuuaaaacccucuaggauauauuaucauaugauuuaaauugucuuauauagacugugucuuaggguuuuacuacugugaacagacaccaugacuaaggcaacucuuacaaggauaacauuuaauugggucuagcuuauagguucagagguucaauccauuuucaucaaggugggaaaauggcagcauccaggcaggcaugguucaggaggagcugagaguucuacaucuuuaucuuaaagcugcuagcagaauacugacuuccuggcagcuagggcgaggguauuaaagcccaugcucacaaugacacaccuauuccaacaaggcuacaccuccuaauagugccacucauauacagaccaucacugccugacuucuaguuuaaauaaaauauuucucauucuuacuagcaucgauuuacauaacauauuuugauuaucuucagccuccuauuaucauaucuugccccccuucacugccucuaaaucuuacaaguacaguguaugggguccuugggaucaaacuuagggcuucuuguauuuaggcagacacauuaccaacugagcuaaaugucuaaucuugaaacuuaagaauaacuuucuuauaguuuaucaacuccuggaauaaauguguucgugcauccuaaucaguguugccugugaaugucucucagcacuggggcugggcugggaagaagcgugggcuuuacagcuugagacgucauuaaauaaauguggaaauaccagggcauauguaauucaaguccuaaguaaccguuaaucuuacuuucuuuugcacagaaguaugaguugaaagugaaguacuauuuacuauaaauauuaguuugagacaaucuuguuacucaguguagagauuucuacagacauggggcuucuuugaucaaguacuguuuggggcacauaauucuguguaucagaauagugacuuaacuaggugcgacuaaacucaaguugcuaggucugaagaacagaaauguuguauaugaguguacuuaaucucuauuuaguuuuuauuuaauuugaagagcuaugaagaauugauaugggcuggugagauggcucaguggguaagagcacccgacugcucuuccgaagguccagaguucaaaucccagcaaccacaugguggcucacaaccaucccuaacgagaucugacucccucuucuggagugucugaagacagcuacaguguacuuauauauaaucaauaaauaaaucuaaaaaaaaaaaaaaaaaaaaagaauugauauagcgaagugugugugugcaugcacauauacauacauaaguauuuauauauggcucaguugcucagaucccaaagggauauagauuucuacauuuacauauaugauauuuuauaguauuuauuacaaaauuaagauucauuauagaaccugaucuaagagauuuaauuacagaaauacuacaagagcuucacuaaauuaauguaguucucaguuaacaaucaaggugcucuugaaacuugaacuuaggauaaauacugcuaaguaguuguucuuuugaguuagcgcuauaaucuuaaaaacuauuuaauaguuggcacuuauuuauggauuugcuuuucuuucuucaccucuuugccgucuagucuucuccagguuaucugaaggagauccuggagcagcuucuugaagccauaguuguagccacaaauccaucaggacggcucaucagugaacuuuuucagaaacugccuuccaaagugguaagugaugugcucagugacaaacgaauuaaauauuuaauuuuaaaugcuugaagaguuauuuauuaguuguaaguaagauuaaagggacaguguugcuggguagugguggcgcaugccuuuaaucccagcacuugaggcagguggauuucugaguucaaggccagccuguucuacagagugaguuccaggacagccagggcuacacagagaaacccugucucaaauaaaccaaaccaaaacaaaccaaaacaaacaaaaaaaaagggacagugucagagguagccaagugauacucuucauggccucagcagaaagcacaaaggacauagucuguuauuuuacuugauuagagguggcuuuuuaaaauauggguauaaguguuugccucuguguguguguauguguguauguauguauguauauacauaugcauacacacacacacacauguauauauauauauauauauauacaugcacaccauaugaguaccuugugcgagaggaaguuagagauuggauucucguuucucaggugcucuuaacugcugagccaucugcccaauccccaaagguugacuuuuaaaaaaagauuauuaauuguauaugucucuguucaagagauagggugagaagaagacacauaaauucuuccuccuuuuaguuuccuuuuguccuggugauggaaaaggacaaauugaguuuuccauccuaagacagaagagauuugcuggauaagugagacccuuuuaagguaucagggccucauguggcuucaaauauaagagaagauuaauagggauacaaguaugauuucauuauagcuucuuacacugcaaagaugucugugacccuaacacuccuuuuaguucuuuuuaacaguauauuuuaagaagaacucuauuucagcacuuacuccacagugauaacuucuauuaaaaauguuuaaggcuuuuguauguguaugcauguuuugccuguauguguaccucagcuuuugguacugggaaggugacucaguaaaguauuugacauacagauuugaggaccugagguaggcuuucagcacccuuaaaaaaaacuguauaugguugugcuccuauaaucccagcacugagcuaacaaagguaagaggauuuuagggcuugcuguuuacccagucuagacaaauuggcgaguuucagguuuaaugugagacccugucucauaaagugagaugaaagugauagagggagacaacucauggugaccucuggcaauucaugaacucagacacuguugauuuagaucuuaacuuuauuuucauucugucuacaagaacaaaaauuacguaggcaucauaguugaagagaugguggaaagacgguaagagcaagaagaacacaaguuuacuaugagauugugucuuauagaaaugucagggaagcaaggacaucaucagugaacaugcuaauguggaggggaaaaucccauaggucuucaaccauagucagagaacuaaggcaacugagaaauuuggagaguaggagaaauagucuuucccagggaagaaccccaaauugguuacccaguaccaaguccucauaugcacacauagcaugugggcugagcagguugcauuucuauauuuaagaauacacacauacacucacacacugacauacucacacacguaauaauuuggaaauaggggccauaaauuuaagagagcaaaggaggguggggauucauggaaaugguuagaaggaagaaagggaagggggcaaaugauguaacaauauuuuaauuuuaaaauguuauaaaaauuuuaaaagugaacaaaaccacuuuagauuuuuggucaacuucagucaguuaagagacaaaauuuguaggauagccuaagagaaaugaaugugaggggcaucaugaagacugugagggcauuuuccagugugucuguuucuugggaugagcucagauuagaagaauuucacagauguguuccaccuguguucuaacacaaauuuuaaauaccuuuacaguauuaugagggaggaguguguauguguuugcaaauuugaaucucguaguugucaaauacaaguuuuguagaugccaguguuguguugcaaauaugaaaagcuuggguucacccugaccuaaagaacugugucaguugguguguuccuagaauuccagccaagugggaagcugaugcagaagaauuuuaacaguuugaggcuaaaaucaacuaaccuggaugcucucagauccucccagaggcugaaccacuaaccaaagagcaagcacaggcugaacugaguccacacacacacacacacacacacacacacacacacacacacacacacguaucagaugugcagcuuggucuucaugcagguccuccaacaacuggagcacggccuguccugaacccauugucugccuguggaucccauuccccuaacugcugcugccuugccuggccucagugggagaugaugcaucugcaaguucaauccugcagugacuugaugugaagaaguugggggagauacccaaaaggagcucccccuucucaucgaaaggggggggaaaacugagggagguuaugcaugagggggugcugugagggguggugacguugggauuuaaaaugaauauauuaaauauauuuuuaaaagcuuaaagcuagcuugaauugcauauugagacccugucucuucccugaaaaggaaaagaaaaaucacauucuuuuugcuuugcauauagcaauaugcuuuagcaaugaauuucauaaaguuucucaauuugcugguugaagaacagacugaccuucuaacuggguacuuuagcuuauugaacauaccugcuuuugucuuccagcaauauccagacuauuaugcaauaauuaaggaaccuauagaucucaagaccauugcucagaggauacagguaugaugguggacaucuguaaucauguggguuagaggagauugacuuagguuuagaauagauaguucuuuucuucuaguuguagauuuuuauuguguuuuaggauaagaguauagcuuaaguucaagguccuagguucaguucacuuuccugccaaaaaaaaugaauaaauagcuacacaagugggacuggguauagacauuucugauugugaaggaggcaggcacauugacaauaaauagcuuuaggauaucuuagaaugaaagcugcuuaggauauuugauuauaagguuaacgaaaguagauacuugucuaugcucuuuaccuggucuauguguuuccuuucuuucuaaauacuccguggaaaacaggcagaacucaagaauuguagugaaacacuugagauuauguacaaucaucucuguggugauacugccauuucuacuguuguuuguuaaccaggguagccuucuggccugcugcuaggcuccuucacagaaguagagaugaauccuggcguccuugacuuuagucacucgagaucuaaauugugaauuagcuggcccauguuuauuuuccuuuaccuugcagcuaaaguguuggcaaagcaauaguuugccaauguucagucuaauggcuccacucaccauuucauagaguccuuccauguaagauggauguucagauauuaccuuguccacuagcuauucuuugccuggcugucucaauucugccucauuugucuuuuccuugucugggcagccugugcuagauagauagauagauagauagauggauggauggauggauggauggauggauggauggaugcuacucuuucucauucuccacuguacuuaaucuuauuucuccaucccuuagaacuuacccuguuuaucugaguguuagucauuagucauauauacuuuuuagcuuguguauauguuccuuucuuuuguaaacgugaagcaacucuaugaguauccuugcauuauuuuagacugaaugagcuuuaaugugugugcucaggcacauagcagaacugguuuugcacucugccucaguggucuuggaaauagagaaagugcuacuuuacacuguuaugucuacucuaaugagugaggauccauggagcacuuagugucuggcuaaauaaaaauuaccuuacuugaucuuuuuuaaaugguaaguuguuuuauaaaaauaauaccagauucuaguuuuuuauguaucacaaaauauaccuguaaaauaaguacuaguaauaaucuguaaaaaaggaaaauaacuuuuaaguguuguuguucauaaguguacuuccuagugauauuuuggacuauaaugacaacuuaaaaaugcuuagucuguuucuuuaaccguuauauugaacucuuacuaagaagaauugcuauuuucuguuguuuacuauagaauggaagcuacaaaaguauacacgcaauggccaaagauauagaucuucuagcaaaaaaugccaaaacauacaaugagccugggucucaaguauucaagguuaguuuuugcuguugcuauuuucaucaaugagcguaggaacuaacuuaagaccaauguuuguuauaaccuuaaauuccauccauuaaaauagaacuuagugguuuaguauuuacagaguuguguagccauuacaccagucacuuucauuucccuaaaacuucccaaacccuagacaacgugcaucuacuuuucugucuguacacauuugucuauucuggaaauuucauauaacauggauuccuuugugagugauuuuuuuuauagcauacuguuuuaaaauuuguguguacuuagucuuuuuucaucacauuaauagcauaucuuacggaugaugccauauguuuuuuucauucgcuuauuacacauuuuaauuguuuccauuuuuagcucuuaugaacauacaauuaggaaccuucacauauauaaggucuuuugugagcguacauuuucauauuacuugaguauauacuuagaaauauaauugcuugagcauacauuaacuauguauuuauucuacugaaaaauuggcagaaucuuccagaguaaccauaauguuuuacauucccaccugcagucuauaaauacugcaguuugucuuccugucaccaaacaccugcuuuucaguuuugcuuuuauuauggccauucuaggaauaucacaguauguuauaguuuugauuugcuuuuuguuaauauaguuaauaacauugaacaucuuuuuauguacauaguagcuauuuguguaugauguuguccucuuuggugagaugucuauuuugacccuuugcccauuuugaaauuagguuacuucucuuuucauugucauuuaauagucauuuauauacuguggauaucauauccuuaccaguugauuuuaaaauacauucucccauucucuugucuuuuuacuucagagaaauuuauuuugacauuauuaauuuuguugaauucuaguuuauuuauuuuuuauucuuuuuuuucucucagauuuuagcuaccauagcaagaaaaguguuacccaauccaaggucaaaaauauuuccaccuauauuuucuuaagaauuuuauagugguggcacacgccuuuaaucccaguacaugggaggcagaggcaggcagauuucugaguuugaggccagccuggacuacagaguaagugccaggacagccagggcuacacagagaaacccugucucaaccaccaccacccccuucccaaaaauaagggagaaaaaaaaaagaauuuuauaguuuuaggucuuauauuuugaucuugaaucuaaguugaauuaguuuuuguauauguuaaguaguaauccaaauacauuauuuuacauggauuguuaucccagcacuacuuuacaaguuauuauuucuuuauugaauuguguuggcauccuuguugaaaaugaauuaaccauaaauacaaagguuuauuccuguauucuugucuucuguucauuuaagcauuuagcuuuuuguaaguauuuaguccuuaaacuuaguaaauauagaaagcauccuuugaaauguauauaauauaaaauaacugauuccuuugcaguugucacuuggaagcuuucuagucuaauaaugacuaguugauuguagcaaugucuuugcuuaaucauugagaauugaggaaagaguacucagaaagucuuuugcuaguaaaaucauuacauuuucugaaugcaggccaaaaauacugaaaauugauguugguacuuaauauaaacuuuuauuuguacuuauuugguacugaauuuacuucugugccauguuuuaauuuuguuuggaauaucuuugucuucugugcagccuccucugcauagggguaguuugguucuucccaaugaggaucuugucuucuguggcaggggaagcucaggcauggcuaguccaccacagacagucucuccucucuguaaauccaucuggggugcuuuguucaccugcauuuguucagugucuacagacucuauaucuaaacccuuaguucaacauuacucucuuauuuuuaagcaugugcagcaaaacuuaagcacuuuuugggggauuauucaucuugugccccauuauuuggccugggcauaccuacuggcuccaccaucauacugcugggauggcacacauugcuucuuuaaaguuacaucuuucagguacuuaguggcuuuucagauauguauaucccccauagccugggcaguuucacaggugucccccuccucacccccaagugugcuauguaagggagguaguaucuguaacauuguuuccuuuuauuauuuuauuuuauaccuguguuuugccuguguguauuuacaccauguaccuaccaugccuggggaguccagagaggacaauggaaccucuggaacuggaguuacacaccgauaguuaugagcugccacgugggugcugggaaucaaacccagggccuuuggaagcacauccaguacucuuaacugcuaggcuaucucuccagcccuucauggguaucucuaaaauaaacaugaaaaucugaaccucuugguuuuuaugauuuuguagggcuuucucugucgagagcguaguaagccauguuuacaacuuacccaucucagacugcuuuucuuuuuuuuuguuugguuuuucgagacaagguuucucuguauagcucuggcuguccuggaacucacuuuguagaccaggccggccucgaacucagaaauccaccugccucugccucccaagugcugggauuaaaggcaugcgccaccacacccggcuucagucugcuuuucuuuugcauuuuuuaaaaaaaaagaaauuugggugaaguuggguauaguagugcacaccuuuaaucccagcacuccaaaggcacaagcagaaggaaucugugacuucaaagccaguuuggucuacauagaaaauucuaugcuaucuaugcuagagauccagaccuauauagaaagaaccugaugggggagggagaaagagaggggagagggauacuugagugagaaucaguaaugaauuaggaaguccuuaaaaucuuacuuugugaaaggacauuuuagugauacauaguacuguuugcuaggauaauuuuuuaaaaauuauucaaauuauuuuccgugaauuaagcuguuuuuauauauucauuuauuuuuuaugaagcaaaguuggaguuuauugagaauaaaguuuuaauauuacagggauaauugcaaagauauaugguagagaaaggagaguaaguacccaagaacaugggucugugcuucucaacagagagucaaccugaacuaagucuuaaagcaaaggaaacuuuggaucuaaugugauaaguugcuauuaauuuaagcaaguacacuugugugcauuuuuuugcauuuuugaaaagguaauuuauaagauacauuaaucgcuucuuuaaaagaccuaguuauagaaucauuacauaguacagguauuuaggauggaaccuucuuaacaauuguuuuauagaucagacagagagagagaugauagauauagauagauacauacauacauacauacauacauacauacauacagauagauaagaguagagacagauuuaaaauugaagaauuacaucuuuauuugcauuuuuagauaauuuuauacaaauagaauucauuauauuuuguuauuaaaucuagugugccccuuaauugcuaaauuauaaaagaaccagcagccuuuuaaacuuguacuuaacuagcgauaacuuuugaagauaauuuagaaguuucugggaagguauuuagggaugcagguuuacagcuagugaauagaaaucggugccaaaugaaagaauaacaugaaagccagcaugggucaggauaguguucacucuuauccugcaccaguuuguuuguuugcuuguuuauccuuuguuuguuuauucauuuugggugcgugaagaccuaaauauauggcgguaagaggacaaugucucugucuaccauaugggcuuuagugauggaacucgggucaucagacuuggggagaagugcuucuacccacugagccaucuacugagucuuuucuaagcaaagucauuuuaucuugcuaggaugccaauucgauuaaaaaaauauuuuauaugaaaaaggcagaaauugaacaucaugaaaugacuaaaucaagucuucgaauaagguaaguuuaagauaucuuaagagccuugugccuguuugcugaacuuuuagcuaguaaaauuaauacaguagaaaguaagauuaauuuauaguugauauaugauucugaaaacagcaaaagaaguguuuuuagcuguuucauuguagcugaagaaaguuauuugaaaagaugauggacauaaauauuguauauuauauauaauacuauguauuuauauuuguaauaggacauuuagucagaagaucucaagugucauucuggcuuuucuuucauuaggacugucuuugaacaggucuuaguucugggauuccauuuccuguuaaaugaaaugggaacauugagugcuuucacagcuuucuuccagcucuuguguuuguuucaauacggugucuucugacuuuguaguaaacauagugcaugaagauuaguccugcccauuucuuuagugucccagaucuugacacagaacuugcugcauaauagaagcucagaaauaguuuauuacuccucuuaacagaauauaguuguuuccuuuuuuuuccccccaacauucugauuuuuaguuauucaguccauaagguuuuuuuuuauuuuauuuuauuuauuuuaucuuuggauaggacugcaucaaauuuggcugcagccaggcugacagguccuucgcacaauaaaagcagccuuggugaagaaagaaaccccacuagcaaguauuaccggugagagucagaggguguagucugaaagcugauucaugcuuaugacaauaggcauguuagccagaggcgaucuuaaaguauuaucuuuagguuuuaaggaggaugugccaaguacuuaaaaagauugaggcaagagcugagcauagugauguauacccguaauuccagcaguugaaaaacugaggcaggaagauugucaguucaaggccagucuggguuauauagcaaaauccugucaaaaaguaaccacacguaaguuaagguucuaugguagaccuuuccucaccucacagauagcacuuaagcauuauuaaguaguguuuaacguuacaaauaagaugugguauuuuuauaauagaaccuguuacugaaaauucgaguguuuuagacgacaauaaugaaacccuuacuuuacauaaaauauggaguaguguaccucauuuaagugaaaaacaaauuguaguagucuacucuaucucucugcuaccauuuucuccuuuuuaagguuuuauguauaugaguguuuugccugcauguaugucugugcacuaugugaguacagugccuguggaggccagauaugacuucagugucauaucuauugacacugaaguuacagauaacugugagcugcccuuugggugcuaagaaucacacucagucucucuggaugggcagucaguguucuuaacugcugagccaucgcuucagccucaacuuuucuuuuuugagaagaacaaaaaucucacuuuucuuugcuaagacuaugaggaguauuauauauuaaggaggcaguuaauaggaauuauuuuuccuuguauuagcacauuuuaacuguuccuaugucauuaagguaugcaaaucauaacaguguucuguuuucuaauugcuuguuuuucuuuauaguaauaaaagagcaguccaagggggucgcuugucagcaauuaccauggcacuucaguauggaucagagagugaagaggacgcugcuuuagcugguaggcauuuuuagauugagguccuucuggcugagggaaauugcaccaacuuuggucuuggaguugguuaguuuuuuuaagaaauguuauuuuguugcauugaugcaaucuuggguaaauaaauugucaaaggcaaauuguucucuguuaaugaacauaauuggauaaacagaaaaugcgaacauaaaagaguagauaaagauauauaucagguaagaggcuagagaaacugcucaaccaugauagggguucaguuuccaccaucuacauggcaccuaacaacccuuuguaacucgaguuccaagagaccuggcacccuuuccuggcuucuguaggcacugcaugcauaugcuguacaggcacaagcacucacauaaaauaaaaagaacuuuauuuuuuuuaaacaauguaucaggcgaauaauaaccaagaagaaauaaaucaccaaagaguaaagacuagcuguagcuauauugacuucugauaaaguuagcucucacguacagauagugacagauaacauuaggucacagugauaaagguuuguuuccuugcaaagguguaauauaagagcuccaaguaugaaaaacaacaacaaaacauauggaucuuugugugaaacuugaaaauacugucuuuggaaguuaaagggccccucucacagucacuaaaugagcagaugguagcuguggauucauuaacuauggcacuagcaguguacuaggcauugaacccagggcuacauucauccuagacuaagcgccaacacugagcagcauccccagcccuuguacagacuucuuuguauuacuuugcuuccuauuguugaagcaaguuaccauauuuuuacugauuuagagcaacauuauuuuauuuucuuguaguuguggagcucggguaucuaaagucaagguggugaguaggccacuaagauauaggaaaauccauuccuccauuucucuggcuucuagaggccuccuguauguccuuugguucauagucccuucuuccaaguucacaauguagccuugguauuuauuauccguucuuccugacucuuugguuguagugugcuugucauucuuuuucuuuuuuaaaaagauuuauuuguuuaauguauaugaguacacuguagcugucuucagacacaccagaagaaggcaucgcauuccauuacauuagugaggcaccaugugguuacugggaauugaacucaggaccucuggaaaagcagucagugcucuuuaaucacugaaccaucucuccagccccacguccuuuucauuauuuuuaagagccgacuuaauccacuuucaccuucuuaagacaagauuguuacuaaaauuuacaaaguucuuuuuaugacauagguaacauuuacagguucuguggauuggaacauugauguguucuagugcuuauuacacauagcaggcuugauauguacauucuguacuuagaaaauauauauuucuccccaguucacaguuaucaaaauugacuuuaucuacugagcuugacauaaauuucaguaaauuugaacaguucagaauuauauacugcaucuuuuugauauuauaagauaacaacuaauaaagaaaagauaaaguuuaaaaaccuuacuggggaccaggcauguaccucaguugguaagagcacuugccauacaugcauaaaacccugguuuugaucccuaguaccucauaaaacuggcucuggugguacauguaauuugagcacucuagacauagaagcagaaggaucagaaaguuaagaugaaccucagcuuuaagggaaacccuuuucuagucucuucaggcaccuguacacacgugcacgugcaugaguguguguguguguacaaauacaucuuuagauaaaugagaagcauggguuuuauauuucuauaaaaaucacuauuuguuguguucugguauuucuaugacuuagcuucuaccugaauacuuccucauuaaggaauuguuccucucauguuauagaugaaagggacaaagugagacuucaugcugaauuaugucugagagugucagccuaaucuaaguuuauacugagagugguaaauguguuggucuucuauuuuucuaacauuuuuguuucgcucacaauuuuggaaguucuagucugugaucaguuagaccuguuucucguagucuauggcaaaguguuauucauuuuacauacuaggggcuaugguagagcaaaaccuucucccugguguuggguaagugaaaugaaaacagaaauaggucucauuaccuccuucagaugcaucaccaucucccaccccaugcccaagacucccacuaaugcacaccuuuaguuucucccaccucucaauaaugccacucugaggaagaugauuuuuaacacaggagacuuuuggguggggugugauuacagauccuggcuguagcaaugaacuucaugcuucuguauuaguucugagcucucugaauaacuacuuguuccuuuuggcuaaacauagcaggaaaucugaagaaaacauuuuuuaaaaauaaacuauuuuuuagucuuuuagcugaguguaacuuuugaauuuaauauuucuagauauuuuucuguuacaugcaauuauacuaaauacuuuuuagauuuauuuuuuguuuaugugucugugugaauguauagugaguguuugcuaugccuaugaagggaaccagaaauccgauccucuggagcuguaauacagguucucaacugcccaguguggguucugggaaacgaauucacagucucggaaacagcagcaagcauucuuaacugagccaucucucgaguaccuacucuaaucauguuuaacauugucuuuaaggaaaauuagagaucuuuuaaaaucaucuucaaagcugugcauaguuguaugugcccaaaacacuagcacuuuaggagguagaugcuuuuccuguaagcuggaagccaaccaagucuauacagugaaaccauuacucaaaaaagaaaaccugccgggcggugguggcgcacgccuuuaaucccagcacuugggaggcagaggcaggcggauuucugagauugaggccagccuggucuacagagugaguuccaggacaggugggguuauacagagaaacccugucucgcaaaaccaaaccaacccccccccaaaaaaaaagccuaaauaaauaaauaaauaaauaaauaaaaauuguuuuuagcugagcaugacugaacuugcuuguaauuccagaugaaagcaggaugauuucugagaguuauagauuagcuugggccauaguguaggacccauuuauaaacaaacaaagaaaaacagaacuuuaaaguguugguucuggagagauggcuugguguuuaaaagcacgaacugcuuuuguagaugacccaaguucucuucccagcacccacaaggcagcucacaacucuguaacuccagaccaagaggauccaaugcccucuucugaccugugggcaccaggcacccaugcauauauggaggcaaaauacucagacacauaaaaucuuuuuaagaguuauuacaauuggauguugauuguuuuuucuguauuccccugcugacucugugcuugucuugucagcugcacgcuaugaagaaggggaaucugaagcagagagcaucacuuccuucauggacguuuccaaccccuuucaucagcuuuacgacacaguuaggagcuguaggaaucaccaagggcagcucauagcugaaccuuucuuccauuugccuucaaagaaaaaauacccagauuauuaucagcaaauuaaaaugcccauaucacuucaacagaucagguaagacuuuuucuacauuacucaguauacaugugucuucuuguaguugaaggugcacauaccuauagcuucuggaaauagauaaggacaugaacugauauaaaauguucaauauuuaacuaucugucuuauaacugaguaaaguaaaaacaaaacaaaaaaccuucaugguuacaccaucauucauugcuauuuacuuuguuagcuuuuuaaaaaaguagucuuguaguauaaucauggguggccucaaagcccucuugaucagcauauacuaaaaugcagaaugaaggcuaacaugcgcacucuguguaucauccuguguaauaccucaccugugggauguugugcucuuaaaaugugaugauugcaaguaagaaacuugauuuuaaauuucauuugauguuacuggcugugugauucagcaugguccuagaaauauucauuagcauagagaagaagacugggcugugugauuuagagugccuuuggguucagucuucagccccacccaaagaaaagaaaacaaaagagaaguuaagagaaccuagucaguguggcuccucaugccacgauuguacuaggguuugccaucccugcguguccucauuccuccgccuccauccuccaacccucccaagcaccacauugccauugaauaacacugguguaguaucuguagacacagaacaagcuguugguuucaggcuuggauucuguuuuguggcagguguacauguuguagaaugcagucucaugcauaccauaaauuguauagaugucugaggacaacuuucaggagucaguucuuucacuuuugaaucugggaauugaacucagguugucaaacuguggacaagcuuuuagucacugacucaucuugccagcccagacuuucuguucuuuguggguguucuugcuaaguauugcuaucuucaccuuuugguuugucgggaauaaguugagagcguaucuuaaagucuauugcuaggcuuaugagcuaguacugagaacugaauuuguacuuaauuguuuuugguauauccaguaauauuucccacuauuuguauuuccuuaagcacugcacagaaucugaauaucuuuugcaaaaacuuaaaguaaaacuuuacaugcagauuggauaguacuauucuaauaaaaaguuugggaucucuauauucacuugaugaagcucuuuuuaaccuacugucauucuuaguacaauuuuuuaaauuuuauuuugaugguuagcacauagguauuuuaaucaaagaagcuaauguccaaauucauauagaguuagagccaacagaaacucuacuuuguacaaagagcaucaagcccaucugagagcugauggugcauaauagugucuaaaaugcuugcauucuuaaugacuugugauacuucuguauacauaaugacugcgcuggaagaaaguaguuaguaggcacugaccgaucuuccucaugcgagcuccagcaugagagccaccuucacuguuugcaugucuccucugcaggcaaaaauguuauucugaacgcuuuuuuaagaccuuguuauugguaaccugugugaacuggaauggacuccugauuuucagaaaccaguaguucacagugauucuuuauugaguuaaaaaucucucuuaauuuuuguuucucaggguuuuuucacuggaagucuuccugguguauuuguuuucauaguugacuacuaaggccuguaauuuauuuggauuuucagaugaacugugcuauuaucuaaauuuaauaguguuucagacuuuacuuuugaauauggaagccuauuacauggggcuaaaaauacaugugguacuugugaaggguuguuuuuaaguugggcuuuuaggaaaaauaguugauaauuuuuauaauaagaacuuacaaucauuuauuugucuuuuacagaacaaagcuaaagaaccaagaauaugaaacuuuagaucauuuggagugugaucugaauuuaauguuugaaaaugccaaacguuauaacguucccaauucagccaucuauaagcgaguucuaaaacugcagcaagucaugcagguauuuugcuguuuguuguaucacugacauagucucauguaugugguguguccuuuugagauaugucccacgucucuaucccagggguauuaagucauuucuuuguacuacaaguacuguugaaugguuuuuagacuugucagaacccuguagaggaaaaauaaucuuuuaaauacuguaaauauugagguagaggaagcaaagauuuggcccuguggggagagccaguuucaggauucucaggaaguaacccuuuaauuccaaaugguaauugugcugucuguagugaucccagcacgggaggaggaagaggccaaagaacccuggguuuccagccagguugugcuguauaacaagacccuguaacuaccaccaccaccauaucucucucugucucugucucugucucugucucugucugucugucugucugucugucucucacacacacacacacgagagagagagagaaagagagagagagagagagagagagagagagagagagagagagaaugagaauaugagcgagcuaacuggcuuuggcaaaagaacaucugaaaacuaauugagcauuacauuauccaagacuuugucagaucucucacagaauauaucuuagagagaacaagaugcuguugggucagaaauuuuuaggacaaaaugguagguucaaugaaagauuaacucaagccagguggugcuguugcaugccuuuaaucccaguacucaggagacagagguaggcaaucucugaguuuggagaccagccuacucuauagaguuaguuucagaacagccagggcugcucagggggaaaaaaaaaaacccugucuugaaaaaucaaaaaagcugaguggugauggcacauacauucaaucccaggggcagaggcaggcagauuuguaaauucaagggcagccuguucuauauagagugaguuccaagauagccagggcuacacagaaaaacccugccuugaaaaauggggguggggggugguuugaguggaagaauuauagauuagcucugucuuacaugugggcuuuuggucuuuguuagguuuaaugugguggcaggggauuggucagaguacaauucgaaggagucaguuuucuccuuugaccauaugaguccaguaaaucaaacucaggucaucaggcuuggugccaauaccuuuacccacugagccuuuuugcugggauauuucuggaagcaagaauaaucuugaaccaauaagaaacaggcauuuaaaaaucaaacauugucuuuauuuacuuuuuuaugauaguaaaucuauauuuucaccucucaguuuuugaacuuuuuuuucuuugccaaagugcuucuuagaaguucccucuagccaggcagugguggcgcacgccuuuaaucccagcacuccggaggcagaggcaggcggauuucugaguucgaggacagccagggcuacacagagaaacccugucucgaaaaaccaggggaaaaaaaaaaguucccucuaaguuagcuuaacuuaagcaaggcccgcagugcaagccaaccccacagccugccucagcuuuuaacuacaccaugccauugacaauuaucaaugcucuuggcuaauauugauuuauucuuaucuuuuauuuuuuuaguuuaauuucaccuauuuuucugucaugaaggcuguuaaguuagguuauuaaaaauguuugaagacuguugaguauuuguaucguacaugagguugcaccucugaaugaaugugauaugccuggcucuuuaacauucauguauuccucggaaugcuugauagaaugaggcucacuccuggcaucugcuuuauuucaggcaaagaagaaggagcuugcgaggagagaugacauugaggacggagacagcaugaucuccucagccacuucugacacugguagugccaaaaggaaaagguacccauucgucucccaucugcagccggcucacucuuacuuacuuuaucuuagauaaauucagaaaaaaaauguagcuaugaaguaugaauucuuuuaaaagcuuuaaauauuugauaguaugucuuuuccaacucauuuuaaguuggauagaugguguuucuuuuuucuccuaguaccauauugcuuuuagaugacagaaaaauaacguguaguuggggaaacauuguuuucacaguccagauuucuuuuguaagguggcauuuugaaagugccauuugaauaguuguuucauagugaauugcagaaauggaauauaauuaagaaagguaaggaccaaaucagugcugcugcugcaguaagucccugcgcugauccuugcuucuccuuaguaacguggucuuugcucagugugacaaaauccgaucagaacuacuuauaggcaauaaaauguuaaguugauuguuuugggguuuuuguuuuuguuuuccuaaucauccucucaacuucucuaauccuuuucuuccccucgcugguuuuaaggagggaaaccucacuaugagauucuaaagauaggcucuuaauaaggaaccaugcaagaccuucucuuggaguuucuuuggccugaucaucauggaacaucauauucucacugaagaugaacuguuuuacauucuuuguagcagcagucagucuggaagggucccuugaacaagggauaaguuaaucacugacaucagggcuugacagacgcagaauugaaugaagaagucaguucauuuuuugacauauuucuuuauuugcauugaaagagccacuaagaucagaaagaaggcuuugaaaugugauucaggagaaaagcugcccugucuuucccucuuaaacugcaguugggaaacaguuuuuaacuuggaaaauaacugcaaagcuguguggaauuagcugaauugguugaugugcccugagcugcaagucuccuccauuacuagcccguggauuucauccuuccaaguucuuaauuccuuguuauacuagggacaacggaggagaaaugugagaccagaucagagacaucaacccaagagcaccuuugaguauaauuauauaauucucuucaacaucaccugugcuuuccagaucagucaccaaucaaagauagaaacugcucagacaaaagaagguaauggaggcaaaagugauggugcaguuagugccagcauuggaugaguguuagggagcaguuucaagaaagcauuaaccuaugcucgauacuuaaaauuacauagcucuguggccuguaguuuaugggauauuccaaguagauuaaguuauugcccuucaaccuccaauaaaaagaaaacuaagcuauauguuauuaaaauuaauaaaucauauuucaaacaaaauucuccuuaugaauaggauuccuaggaaaugguucauauuaauaaagugaaaaaacuagcagaaccauaaaucaaaacagcaauaauaauacacauguaugauacauauuauauauauaaaaucucccaggauugggcugcauguguaaauauuaaagguccugucuauuggucaguaacaaagugaugagucucuucacgaagguuaauaagugggucucugaagaaggcaagcuugguuggaaaugucagaacuauguuuuccaaauaccacucuacucccaaguaauauguaugauucuguuuuuucuuuuuuuuuuuaauacugaaaagucuuaagaaaaguggauugcagguauauauucucuucauucugggaggacauccuuucucccuacccucuacccaaaaaucugcuuucaguuucuguauugaaauguuucaaauguuaugaucuauuauccuuuggaccaaauaaucuucuuuuucucagucauauuuggcuuaugcaugacccucuaauguugcuuguuuuauuucucuucacauguacuguuuguuucugcuuucccaggaauacucaugacagugagauguugggucucaggaggcuauccaggugugcgaccuuuuuuaugcauaaacauacuuuuaauauuguaauucuucugugacaugaucaguacugacaggaugaaaagaaagaccuuaugcauguuaaacaaguguuuggggugccaguucuucugaguagagaaaacaaugcaguuuggaaaucuaguuagugugucaaaauuagccugaauauguucaguacuaccuuaauuuuguuguugacuuuccuuuccaggggcaaacggccccucacuuacauuguggcuaugcaucuuuaucaaaauguagaggcuggcauugccagugacaugggcuugugggugcuggucucaucucaagagucuuucugacuggaaugguggagagguuaacaugaacacuggcaauccaaucagugccuguagguacuuguacauuguucugggcuaguguuucuugucauuuucuuauucucugacucugucuacaucuuacuucuuaaagcauccauuucuauaaggcaucuuuuguauguuauuuaagaauuucaguacagagccgggaggugguggcacaugccuuuaaucccagcacucgggaggcagaggcagguggauuucuugaguucaagaccagccuggucuacaaagugaguuccaggacagccagggcuaugcagagaaacccugucuugaaaacaacaacaacaacaaacccugucuugaaaaaaacaacaaaaaaaacaaauaaaaaagaauuucaguacaaccuauaaguugcuauguuacaaugcugaauaacuguauagugggguuuuuuguuuguuuuuaagauauauuuuuuauuuuauguguaugggaguucugccuacaugcaugucuguaccaugugcgugugaugaccacagagaucagaagagggugucagauggucugagccuggaguuagaagccuccauuuaucggugcggcagcucagucccauagccacagcaucccagaggcucaggaaggacggucacuaccuauuuugucuguuucguuuuguucuuaaaaagaugaaggguucagaacaaagucccuucuuacucauaaucauuacauaaaguaaaaagacagucauuuauuuuuuaauuucaucuucauggguuggaaguuuguucuacuauccugauacuccuaguauaggaccuuuucuguccagucaccucuaaaauuaucuuuauuacaauaauguauauuauuuggcuuggaaucucuuuaaguacacccuuaagauguauuuuaauuguguauuggggcuuauacuuguaaucucauugcuugagaagcagaggcaggagaauucuuugucuagcguaagaugcauagcaugagauuuuaucagaaaaauagcaaguauuuuagccaggccugguaguaaacagauguguacaauccuggcagugcuggcauagggaguucuagaauucucggcaagcuuguacuagagaccuuaucuuggggaggaaaaaugcaagaugaguuuacuuuaauauguugcaagguacugauucucaaagauuguuuauacauguuagaaguacagaaccuguuuugauauauguuuucaaaaguggaauuuaccccaauauuaguaguuaauagccaagugacgucggagauggacagaagggagcuggagagcuuacuccaauggcugaaagagcuugaugcuauucuagaggacccaagugugacuacagaaccuccagcagauagcuuacagcugccuauaacucccagcccaagggauccaaagcucucuucuggcuuucauuggcaccugaacacacauggcauacuaucacaucacaucacaucacacacacacacacacacacacacacacacacacaucccugaaugcacacaaauaaaguuaauaaaaaagagaauggucagaaguuugagguagggagagcugcaguuucuuccuacacguuuguaauaaaggauucaucucauuccauaaaguacaugaaacuuucagaagucacuuguguaauaagguucacuguacauacuggaaagcaguaaacauagcagccacuaaaguuaacugaaaguuuucugaaccagugguucucagucucaaaggcaauguguaaugauuuagaaaacugaaaaaagaaauaaaacuggauuuguucaaggaaggccaagugugacccuaguaauagcuuuguuuaccucuguuuuacaguuuuauugcugugaacagagaccaugacauaaggacaacauuuaauuggggcuggcuuaagguucagagguuuaguccauuaucaucaaggcaggaacauggcagcauccaggcagccaugguguaggaggagcugagaguucuguaucuuguuccaaaggcaaacaggagaagacuuauuuccagucagcuaggauuaggguaaaaagcccaugccuacagugacacaccuacuccaacaagccuacaucuucuccaaaagggccacaccuuuaauagugccacuuccugggccaagcauauacaaaccaucacagccucuaaggcaguaaaccaauuaauuauauguuacuuaugauguaauagaggaagaaaacuacagcuacuaguuuagaacagugcuuguauguacaggaagauucagguucuggauaugacccauucauaguugccaaguguuaggauuguuggcauugagaauggaccacuugcuauucuuuuacuugauauaaaaacugucuuuuaaaaccucacuaaagucugccacagauucagucccaaauaagaguauggguucauacagaaaagucuccgcugaguccugggagagaauggguucaugucuggcuuuugauggaaggauucuacuucuuagaacuucuggaaugagaaacugauuucuuucuguguuaacuaaugagugcuuuuaagccuagcuuuucaaaacugaauucuggcaucuucuaaagucaagcuuuacauaugagacauuucuaaacaagccauaucuaacuugguuuuaaguaugacuucugugacuuuuuugauucaaguuccaaaauuucuucucagucucugaaaguuaaaguugucguaccccaguguggagcucugucauuuggagcucuguccuuauuaguaguaccuauuggauacagaccuuuccacaucaucuuuccauauuguucuuagagaaaauacuacccacgagaugaaccagcucuuagguuaacaacuauuuacuugaugcaggaaggaaaagacggcagaaugaucauagggccacaguggacaaagggagucagaaugacgucguaaugaggaugaguccaguccuggaaaccauaaguuauuuucuuuuucuuuccuauguaggccacuuugaguuugccaugcgccaucauguuagauagacauuucugagacucgagagcaucuggguugcugauuguuuuuuaacauacacuacacauauacacagaugaauccgugaucuuucuguccccucucccuuucccuuuucuccaacccaccuccaucucauguagcccaagcuugccuaaacuugcuaugaguccagagaugacuuugaaauccugauucucuggcuuccaccucuugcuucuauuucugguuuuuaaaaacaugucuuuuuuuuuuuuuuuuuuaagauuuauuuaauuaauuauuuauuuauuuuaugugaguacacugucacugacuucagacacaccagaagaggacaucagaucccauuacagaugguugugagccaccaugugguugcugggaauugaacucagaaauucuggaggagcagucagugcucuuaacugcugagccaucucuccagccccuaaaagcacgucuugaauugaggcaaagucucaugacccagaaagagagugagaauauagucugggggcuaggcuaagaaacccauagccauauaauuuuuuuucagaaaugaacuuccuucucuuauaagauagaaaacaauuaagaauauuuacuucuguguacaaugcuauaggaucuuagccauuuuuuauagacuagaaacuaaaucuuauaaguuauuuccuuuuuuacauacuggccacuuggagacugcuggguagucuagcuagaauuuaucaguauccugaagacauuaaaaaaauauugaccagaagucaaacugaaagauaaacuuuaaaaaaaaaaaaaaagauuuauuucuuauuauaaauaaguacacuguaccugacuucaaacacaccagaagagggcaucugaucucauuauggaugguugugagccaccaugugguugcugggaauugaacucaggaccuucguaagagcagucagugcucuuaccugcugacccaucucuccagcccccagaagauaaacucuuguaaugauuuauugagccauuuuccuugaauuuuagccuuucugagcugguuuucucaacaguuaaguaaggcaaccccaucuugggccccuucugaacucugguguuaauagucuuuguucuguaccauucauaucagguucuuauaucuugauuguggacuauggagaaaaagcauaauugaauugcuaagugcuaaaugcuacaaauguagaauuuagaugaaccacagucuacuugaggcgacugugguuuagauaggaaugcugugggacuuguaccuccuauggagauaguaguaugcagaggucuuuuuguuuugucucccccccccccuugguagcugggauauuuaaucuguuuaggaauagcuaucuuaagagauaaaacacugguagguuguuuuguuuugucuguguuuagaaauggaguggcuauuuuauugcauuauuugccucaaaaugaaaaauguauuucauguaguuauugaauuucauuuucuuaugguaucacacuauauuuuuugaacauuauauuuuaagagcuauucuaaacagguuugucacugguugcuccugccaggaucacuguuuaaucauuuuguaaauuuuccuaauauucucuuacaccuuuucagcgugcuuacaauguuuaugacacaucuaaucaacauauuguaaacauuaugaagugccugcccacaaaaaaauuuuuuuucuaauucauggucacccuuggauaaaguaagcugaccuuguuuuuccccuuuucuaccuuccccucaacaguaaaaagaacauaagaaaacagcgaaugaaaauuuuauucaauguuguucuugaagcucgagagccagguucaggcagaagacuuugcgaucuauuuaugguuaagccauccaagaaggacuauccugauuauuauaaaaucaucuuagagccaauggaccugaaaauaauugagcauaacauccgaaaugacaaauaugcaggugaagaaggaaugauggaagacaugaaacucauguuccgcaaugccaggcacuacaaugaggagggcucccagguauggaggagcuccuagagugugaaagaucagagcuagacucucucugugucucugacucgugugugugugugugugugugugugugugugugugugugugugugugugugagagagagagacagacagacagacagacagacaugcaagugaaucucccaaguguguguguccuuguaagugcaugggaagcuaaaggagaagguauucuguauuccucaaucaugcugucuuaucucacugacuuucagcuaggcuggcugaccagcgagcccucaggauccuuuuacccaguguuacaguuguaggcaugugcaguaguaccuagcuucuuacauagggaucaucuucucaauucuuuuuuacauuucaaggcaaaguaucucaugguccaggcuggccuugaacuuaacauccucuagucucugcuucuucagcauuuucauuugccaugaacuaccucaaccagccaccucuucuugacucuaguuauuuuuggugaguguguuaauauuuuguuauucuugguugcuuaaaaauggaagacagcauguuuuaaagaguaaaaguuuauaguuuaaaaauuguuuacugggcuggagagaugguucagagguugagagcucuuccagauguccugaggucaauucccagcaaccacauugugguuccuaacucucuaagauugaucuggugcccucuuguggccugcaggcauacaugcugucagaaugccguauacagaauaaagaaaucuguuuuuaaaaauagaugguccuugaguaagaguacuugcucugcaaacacacagauucaagucaaguuccccuaugaacuauguaaaaagcuaggcaguacugcacaugcuuauaacuguagcacuggggaagagagcagaggauucugagggcuugccugccagccagauagauagcugaaagucggugagauagugagauaggacagcaugauuaaggaagauaccgguuacuuuccuuugguuucccaugcacuuuuuuuuuuuuugguuuuuucaagacaggguuucucuguguagcccuggcuguccuggaacucacuuuguagaccaggcuggccucaaacucagaaauucgccugccccugccuccagagugcugggauuaaaggugugcaccaccaccgcccagcugcccugcacuuauauggcacauacauuuuaauccuacucuguguuggggagacaguuuaguauguaaaguacuugcuaugcauacaugaggaccuaagugcaaguccccagcacccaauguagaaagccagauauagcaguacauaccuguaguacauaccagugcuagggagauaagaccacagaaucccuggaacuacacauugguuuagccaaauuaauggguuccagguucauugagaaaacccugucucaaaacaaaacaaaaaaaaggcagagaaaugaucagccaacucuguccugcaugcacaaauacacacagacacacacacgaaaaauaaagagcuggguguaaugaugcacaguguagucccagcaacuugggaggcagaggcagguggcuuucugaauuuaagaugaguuuguucuucaugaauuauaguccuaccagggcuauguaagacucagucucaaaaaaccaaaaugaugaugguaacagaaagaugaguguuauaaauggcuccugcuuugccagugucuguguaaggaaauuuuccuuccuaaacuucuguuuuccuacuguauacuuuagaaauaauaguaguaguacuuacuccagaguuuuauaugauauuaaaaagauauuaaaaaaaacugaguuuugggaacaauacuuaauagugaauauguacucuaagaaaagccaauacauuaaaauguuuaucuuauuauuuauuuauuuuuaaggauuuuaaaaagauuuuguuuuauguacuugaguauuuugccuguguguguguguguguguguguguguguguguguacacacacacauuacaugugugucugguguuaagaucagaagagguuguuuugucccuugaaacuggaguuacagauaguucugaacuuuguuccaaggaauuuaguauccuuugugccuucuguagacacagacacuuacaugugcaggcuaagcacccagacacuugaaauaaaaaauuaaacaucuauaaaauuucuaccacaauggaucuuagauauuagcaugcauauuuauacauuagaaugacccagaaagcuucaaaauagguucuccccauuaagauaggaguguugcuguucugaagagagccuaaagauugagcugucggcucucuuaaaccauguuggguuuuuuguuuguuuguuugcuuuguuuugcuuuuuucuuuuuguuuucuucaagagaagguuucucuguauagcuuugguuguucuggaacucauuuuguaaaccagaccuugaacucacagagauccaccagccucugcccuccugaguaguggaauuaaaggcaugugccaacaccauccagcugacuuaaacugugguguucuuuuuguuuuuuggguuuguuuuuuuguuucuguuuuuuguuuuuuguuuuuuuuuuucgaaacaggguuucccugugaagcccugacuguccuggaauucaccuguagaccaggccggccuagaacucagaaaucugccugccucugccucccaagugcugggauuaaaggcaugugccaccacugcccggcuuuuaacuuuuuuuuucucuuuaaacuguguuuuaaacucauucacacauagucauuauuuuuugcuuguuuguugauguuuugauauuugaguuaggauuucacuguguaaaugaugucugccucaaacuugugauuuucugcuuccugagugcuaguaguuauguaucaccgcccucagagaguaaagacuucuuuauuucuuaauuacaauguuuuuaggaaaaaaauguuaagucuguuuuuggaauguagguauacaaugaugcccauauccuggagaaguuacucaaagauaaaaggaaagagcugggcccucugccugaugaugaugacauggcuucucccaaacuuaaauugaguaagucugccuuagaauuugcucuucaguuuagucugucaaagagagacugcugguuccuugacauuucuuuaauuaaaugaugaacaaguguuuauucacuggcacugcucuuagguaacuuucuucacauugacacucuuugacuguguuuuaaguaagagucuaagaauaagcaagaguauaaaguuagcuuuuuuguugaugggacugaguauaugacagugagaaauagaacggauucauuuugcuacaacuacagagcuuagucuccguuguucaugggcuauaguaaaguagaacaucguguaaggacaaagaguugcagauuugcuuagcuuaugauagacgaggagcagagagacgugauucgaccacuccaucagggacccacuuaacuccaacccagcccaucucccaguaccgccaucagauuaugacuccucaggucaucuguuaauaaaagcagcacucucaugcucugaccucucagugauuguaucugccagcuugguucuaagucuuuuaugaggaacuuuucaagguauacuuuauguccaaaucauuaaaaaaagaacuugaauauuaacggcagagguuuuccuuauagccauugacugagaagaguauucuuuauaugaagccagaaaaaaagaguauggcagguuuuguuaauuuuauuugguguuacauaaaauuaaaaaugaaucccaacaauucuccuggauaaaauuuguaaagugggggcuggagagauggcucagcaguuuagagcacugacugcucuuccaaagguccuaaguucaauucccagcaaccacaugguggcucacaaccuaugcccuccuuugguguguuugaagacagcuacauuguacucauaugcauaaaauaaauaaaucuuuaaaaaaaauuuuugggaaaugagaaauguacuacucagggaccauuugaguaaccuacguggauaugguuuaucaaaauuuuuaaaggaaaagaacacagaaaaaaaaaucacugaauuaaaggagauauuucugaauuauuuaauauaaaugaaacaaugcugucuuagucaggguuucuauuccugcacaaacaucaugaccaagaagcaaguuggggaggaaaggguuuauucagcuuacacuuccauacugcuguucauccccaaggaagucaggacuggaacucaagcaggucaggaagcaggagcugaugcagagccauggagggauguucuuuacuggcuugcuuccccugcucccuugcucagccugcucucuuauagaaccaagacuaccagccauucacaaggggaccucccccguugaucacuaauugagaaaaugccuuacagcuggaucucguggaggcauuuccccaacugaagcuccuuucucugugauaacuccagcugugucaaauugacacaaaauuagccaauacaaaugcuaagcauacaauaacaucaaguaaucuuaaacaaauacuaagcaaacaauaacaaugucaaauaaucuuuaaaguuguguuuacuggaaaggacaaagacaagcaucuuuuuuaauguaaacuacccauaaacugaauuucuucauuacuuuguaaauugcuagcaaaugacaauuccuuuucacuaaggaauucuucuuuucauauaauuauaaaagcauacacauagucagauauggagauacauacuuguaaucccagcccuugggagcuggaggcaggaggaucagaaguucaaggccaggcucagcuguauaguuugaggucagccugggcuucuugagacucuuuucuauaaauagacuaguuuggggcauccuguuacugaguugguuaucauuucuagaaauuacaaugaauggaacuagaauacauaugacuucauauuuagaaguaagauauaguaaacuauauuaauacuuugauauucaaguuuuaagaauuuucacacuucaauuuguuucaacaacuuuuaucuuuuuccugaagugaaauucucaguucuccagggugucagaggugauaauaacgucagaaugucagagauacucguuugcugagcccauucacagcucucucaucaugaaaguauuugcucucacaucaaaauagagugaccagcuuuugugucaacuuuacaucuuuaauccuagcccuuaggggcuggggcaggaggguucaaagcccaccuauguuauaugagacucagucucaaaauguuuauauacauauauaaauuuuauuuauauauaaauuauauugcugaaggguaaagguuuucuuccaggucuauuuuugucuaugagaucuaucuuacuaaagagaugcugaauacugugguuuuacaaaucauuuaggauaaccccuuucuuaugguugugcuaccaacuauguaaaaaguuaugcuuaugccauuuuuuccacuucgcaugacaauaccucucucucucuccagguaggaagagugguguuucuccuaagaaaucaaaguacaugacuccaaugcagcagaaacugaaugaaguguaugaagcuguaaagaacuauacugauaagaggggucgccgccuuagugcuauauuucuaagacuccccucuagaucagagcugccugacuacuaccugaccauuaaaaagcccauggacauggaaaaaauucgaagucacaugauggcaaacaaguaccaagacauagauucuaugguagaggacuuugucaugauguuuaauaaugccuguaccuacaaugaaccagagucuuugaucuacaaagaugcccuuguacugcauaaaguccuccuugagacucggagagaccuggagggagaugaggauucucaugucccuaaugugacguugcugauucaagagcucauccauaaccuuuuugugucagucaugagucaucaggaugacgaagggagguguuacagcgacuccuuagcagaaauuccugcuguggaucccaacucucccaauaaaccuccccuuacauuugacauuaucaggaaaaauguugaaaguaaucgguaucggcgacuugauuuauuucaggagcauauguuugaaguauuggaacgggcaagaaggaugaaccgguauguuuucaaacccaucucuuuaugauaaauacaugugauuuuuaaugcaaaacagaugagagaguuaugcuuugauaaacuuucugcuuagguacaugguuauaguagguagccuuccucuuuuuuuucuucaaaauauuuauuuauuauuauacauaaguacacuguugcugucuucagacacaccagaagagggcgucagaucucauuacagaugguugugaaccaccauguuguugcugggauuugaucucaggaccuuuaaaagagcagucagugcucuuaccuucugagcuaucucaccagccuguagauagccuucuauccugaauucuugguaggcaaaacauaugcuccccccaccccuuuuacaguguuggaggggucaaaacuuauaaagagggaguugaacgguggucaccuuuaaccccaucauucaggaggcagaggcagauagaucucuugaguucaaggacagccuggucuacagagcaaguuccaggacagccaagaccacacagagaaacugucuacaaaaaacaaacaacaacaacaacaaacuuguaaagagcacuacugaguugucaucauaagugccggugagaggggcaggacugaagcucuugcauaaugcagaaaccuaaaaugcagccuuucgcagaagaugucuuuuaaaggaucaauaauacagucuguaauaaaacuaaaaguaggauuuuuuuuuucuuugaaaauuagucuuaagaauguuuuaaaugaauuagagagcuuggaguuauucuuugaggauagacuggucuaaauccauucacuuuuuuaaaaacuugcuuauuuuuauuuuauguguacugagauggugugccuguauguaugucuaugcagcacauauauccagugcccacaguggccagaaaagggaguuaguuucuuugggacuagaguuacagaugguuguuacccaccaugugggugcaguaaauugaaccuggguccucuggaagaacaccagugcuccuucucagcccccucaaucucuauuucaguuacuuaauaaggccuuuuguuuuuuuaucucauuuaucaauuuaagagcauaguguaggacuauaaaugguuuaaaagaauaaauuuaauuuacuaaaauuccuucagcuuuuuagccugcguaucuuuggcacuuacuggaagaauacccaguguaauccagcaaucgcaguauaaguucuauaugcucuuacaggcacuugguuaaauugaacuuacagauaguaaauccugcccucuucugaaguacugagagcuagaacuuuagacuguuuaauugcaucuaggagaucuuugcucuagaccgugaaggaaaaguaaauauuaaugauugcuuuuccuagugacaacuuuuguaaaauaucaugguaaagcccuucgugaagaucaucucuaagucaucuguacuugucuaugggacugauaaucuuuucaguuuuuauuugaagaauuggagaugugcaagcaauaaaauucauaaucuaacaucuaguaggugauaugccuuggcuuguuucccacugagagcacugcugcugauaguuaccaguuauggaacacagacaugaaugauaagcauuguugagcucuauauuaaagagcuugaaaucucaugguuagacugauacuuaaggaaaugugaaguagccuauuaaaacccaacaugaucacuuucaacaugaucauguaagaaacuuugugggccagaguuuaccuaaaaaggcacaaaguaucauaaaagaguuggaagaugaauagagaggcugauacucugcauaugauaaaugguauaaagaaagugagccaggcgugguggcgcaugccuccaaucccagcacuuggcaggcaaauuucugaguucaaggccagccuggucuacagaguaaguucuaggacagccagggcuacacagagaaacccugucacaaaaaaaaaaaaaaaaaccacaaaagaaagggaaagguuaggguguaaauaugcuguguuucagaguuugagguggauccuugauuagcauguuuaggaaaugguuccuugugaagaacuagggauagaaauaaagaggagaguggaggcaucuuacagucaaauucuauacgagguuucauucaagaaauuuuuguuggguguugauacuaguugaugaacaugcucuaguucaugggauguagcaguacuuuaauaaugaaauuuaagcugggcggugguggcacacgccuuuaaucccagcacucgggaggcagaggcaggcagauuccugaguucgaggacagccagggcuauaaagagaaacccugucucgaaaaaccaaaaauaauaauaauaauaauaaugaaauguaaaugccacuccugugguucacaguugcuugaguccagugaaucuucuaaagagcacaugucucauagauuauggggaacucuguuaagaaguacacagauugauuuuuuuacgaaauaagaucuuuuuauucucccauuauugauaugauaggcuuuugcuuuugagggcuggaagauacaacccaugacacauauagaaacagaaauccuuauaguuuaucucaugcccugaguucuguugagaaacggaacaggggccuggagcauggcucagcaauuaagagggcuaguuacucuucccagaggucuguguacaccagcacucacaugcugguuccuccccaucuguaacuccauucugacggcaccugacacccucuucuggccuccauaggcacuaggcauguaagugauacaaagauauauguacagggaaaacacccauaaaccucaauuuuuuaaauguuuaagaaagauaacaaaagccauuuuaauuuuuguaaaugaaaauaguauugggacuucuuguggcauaagaaucaauaaaaagagcuagauguuuaguguguaaaguucuugccaugcaagaccugaguuuagaucccuggcacccauauaaaagccaagcaugcuggacaggcuuguagcugcagugcucgagauggagguagcugaguguugacaacggaagaccccaggaaccagucaagccagucaguacaagacccugucucaggaaauagaauaggaaguaggagacaccugaccuugaccucugaucucuauacacauguacacacacccacaaacaaaugacauacaaaugaacauguauguacccauaugaccacacacacaaagaaaaaauuauaauaguuucuuaagaagaauugauagggcuggugagauggcuuagcgaguaagagcacugacugcucuuccgaagguccugaguucaaaucccagcaaccacaugguggcucacaacuauccguaaugagcuccgaugcccucuucuggugugucugaagucagcuagaguguacuuauguauaauaauaaauaaaucuuuuuuaaaaaagaagaagaauugauaaaccaaauguaaugguuuauaucugaaaucccagcucauggaaccagagauggaaggaucugaauuuuaggccagccugagcuauacagugagagcuggucucacaaaaccaaaagaaaggaaaaaagaaauagcuucaaauccaucuguuuagugaauuuaucuaauauaaauauuuagacauuuaucuaguauauucacauuaauuuuaggcaugaauacacauuuagauguuuaaguauucauugguaaauaaauccaugugaaauauacacauguagauuuccagaauagucuuccuucaucaccacauaaccccuacccaccaguacuacugacaguuauggaauacuagaaucugagcaguuacaggcggcaguggaucauucucagcagcugggaacagcacagugcugaggcaggacuggugaccagugcgugggcaggguuccuaaagaagcacucuggcucccuugcagguaaaaagacuccauaggaagacaaguacagagaagagaagaacuucucuuacaaguuuaauuauuucuuuuugcugaaugucugauuuaccugaaaggauuacuuaacaauugaaggaaauuagaguugguuguuuuucugucuugaauuuuugcucuugcauagucaacaccugguuucucaggcuaaaaaaaaauucuuuuuuuuuuuuuuuuuuuuuuuuuuuuuuuaaaaaacaacuaguuauuuaguuaguuuugagcacgguuucauugucuagcccuagguauccugaacuuccugugccucugagugcugggacuuacagugugcuacacugcucauggcuucuuaguauuuuccugacaggguuucacuguuuacuuuuuucccgacagaauguuuuugaaaucuauaauuauauugcagaaaucuuuaagaacaaccaaagcaaagauuaauaaauuauuuacaauacuuuuuaaauaaacaauuuaaaguauaugcuuaguguuuuauauaaaauuuaauuacaucagguagccugauacuauauaucugcucuuucaguguaacaguaauuuaccaaauguguauuuucacuuauaauuuccacuaaaauuguaagcuauuaugaaauuaauuuaauuuuaagaaaacaaacuucaucccagcacucgggaggcagaggcaggcggauuucugagucugaggacagccagggcuacacagagaaacccugucucgaaaaaaaaaaaaaagaaagaaagcaaacuucagauaucuuuggucaagaaagauuucaaaaucgguaucuuagggaacucuuccuuacuuaauuuuguuuuuauugcuuucccaaaaguacuagcaucuucagaucccagagcauguuucuagaaccuuucuagaacacccauguagguuauuggcaguguuaauucuucaucagcucccauuguugacaggagagucguccaaaguguaucugauaacuggugcucaaguguccauguuucaaaagacagcugaugggccuugcuuugucugccauacucccccagccagaaagucugcauaacuguuaauaauauauuugccauuaccccugauaacuuacgccuauaaucccaacauuuggaaggcggaagcagaaagaucauacaaguucauacaaguucagagcuaaccuaggcuuccuacuuucuuacaggccaguuugaguaucaguaaaacugugucucaauaaagcuuauuuuucauagcuucccaauaacaaggaaagaaauuuagacaaauauuaaauaugacacaaaacuuuucccaucuuggaguuuugcaucuaccaauuuccuccaaaucaguuacuuuugagaaacuaaauuuagaguaacucucaggccuauacuuguuaauacacagaauauucucaugccuuuaaaauuuagcuucuguucucaaugaguccugugagucaagguagcaaugcuuuaggacuaaaaagaagaaagacauuaaccuaagucuuuuaucacuuucuauaaauugggucuagaguuaagaaaauagauacagccagguaauaguggaccaugccuuuaauuccagcacucaggaggcagaggcaguuagaucucaucuugaauucacaccaccaccacccccaaaaagaaaaagaaaauuaaugcaaauuaaguauuggauuuggucucaagagcaauaguacaguuuuugauucugcuagcuccuucugcccugguugaaucauaggccuauauaucugacaaauguaggaggccuuuccuuugacauguguaagaaaggaacauaccuugagcaaaaggagacacagacaacucagguacucaauuguauguuuuuucacucauucuuuuguuuguuuguuuuuuguuuuugagacagggucucuuguaggccagacuggccucaaacucacuauguaaauggggaugacucugaacuccugguccuuuuaccuccaccuuauuuuuuaaaagauuuauuuauuuuauguagaagaggacaccagaccccauaacagaugguugugagccaccaugugguugcugggaguugaacucaggaccucuggaagagcagucagugcucuuaaccauugagccaucucuccagcccuuaccuccacuuucuaaaagugauggaucacugacauguaucacaauguguggcucagauacucuggaggguguuuuguuuguuuguuuguuuuuuaaacagcaacaagcgacaugggccuuucauuucuauuuauuuuguguaugugagugaagauacugucgcugucuuuagacacaccagaagagggcaucagaucccauugugaaccaccaugugggugcugggaauugaacucaggaccuuuggaagagcagucagugcucuuaacagcugagccaucucuccagcccccuggaggguguuuuuuguuuuguuauaauacuauuuuauuuuuuugucuguauaauuuauguauguuuguaccccacuuaugugcaauguccaaggaagccagaagaucuucuggaacuggaguugcagauagacguaagcuuacaugggugcugggaacugaaccuagguucucugggaaaacagccagugcucuuaaccacuuagccaucucuugaguccccagauacuuguuuuaacaaacuuaauggggcacccuucuaacugagccucaguauuguuaguauaucaaugaacauaguaaaauauuugauaugauuuaacguguaauugaaguauuaugaaagaagcaguucaugugucaauggauacucuuaaugccauuauaggacagauuccgaaauauaugaggaugcuguagaacuucagcaguuuuuuauuagaauucgugaugaacucugcaaaaauggagagauccuucuuucuccagcacucagcuauaccacaaaacacuugcauaacgauguggaaaaagaaaaaaaggaaaaauugccuaaagaaauagaggaagauaaacuaaaacgcgaagaagaaaaaagagguugguuccuuuuuauuuauuaaauaugaagaaauauuaaaguguucuagcagguaccacaguuagcucuggagagucuaugauugaggauuuagaugguugacuauuugcagaagauaugaugauauagaaagcuuguugucggcaucuguucaguugucacaucaaguuacuucugacacagcugauagucuaggagcacaguguuaagugacaaguauggggaccuuaugccacauacuugagaggcuuuuguugccauagagcuuuccucuuaaacacgugagaaccugacagguaggugagacuucaguugaacuauacuccuagcuuugcuuuaaucaugccacccuaaaugggguacuuugaaucauacuccaaauuugcaauauuugacaaugggauuaugucauugcaaaagucuuauuuucuggggugaugaggguagagagcuugaggcaggaccucccuguguaacccaagcuggugcuggugcugcagugauccuccuucccugugccccagugccagcacuguaggcauguauuaacacaguggcacaauuuggauaacacuucuguuuacacaguuaacuagaaguauauaacucuacaaaaguuguguuacucuguaacaucagacuuacuuagauuauuuucucccuggaccagaaaacagaauugacuugaagcacgaaaucuuucucugauucgucacuuaaucugccccuugguuaguugucacuuucaaacauggcuguuccuauacaaacuaaccuuaccuucauauucuguaauccagggugugucaguauuccagcuggauccugucuuuggaugugaucccuugcccaaauaaccaugcugcuggauuaacauucuucuauaccauuguuaguacaguuuucugguucuguuuaacaaaauucucaagaacuuuguagaucugucuguacaucacaggguuuuacucuguuaaucagcuauugaauaccuuuuuuuuuuuuuaauugccaaaacuuuuugcuuuauuuguuuuuugagacaggauuucucugugugucgcuggcuguccuggaacucacuuuguagaccaggcaggccagccucaaacucagagauucaccugccucugccuccccaguguuggggcuaaaggcaugugcccucacugccuagcauguuuuuuacuauaaugucacuauuagagagagagagagagagaguggggaaccaaaacccuuagauacuccggaacuuagguugguguaaacuuuuggaaauuaauuuggaauaugcgcuuacauuuaaauuuuaaggucggcagcauuuuaauuuacgggaaccuauccuuaagaaguuacagauguggaaagagucuuuaagcacaaguuucuuagagugagaaacauuagaagagcuucuggucaagugcuaagugcaauaccaacaggcacaggcaagacucagaagguuuacaguuuauaaaugagauguaccuuuuucagcuacauucuauuaguauuuaaaauagaauauacauuuacuagaauuucaaccacagcauccuuacuacaugcucauuuuuacuucuuuguauugauuuuuuuuaauuuuguaauuauauuuauguacagaaaauuuaguguacauuuaacccaauuuaguggcgaguucuuuagccuuugcuuuuuccagcuuggcaaugcgagccacagacuuaggacccaggacguugccucuccaguggcgacggaucucgucauaucugucauuauaauugguccuaauagcuuccaccagcuuagccagagcacccuugucuuccgaguuaaccugugugaaggcaacaguggugcaugucuuccuguggaccaggugccccagccuggccuuucccuugaugaugcaguagggcaccccuaucuuucgacacagggcagguaggaaaaccaccagcucaauggggucuaugucaugggcaaucaccaccagcugagccuucuuguucuccacaagaacuguauugacuguggugacuguauugacuccugcucggaggacagguggucucuuaguugggacgucgccuuugccagcagcuuucuucucaguaugggucaguagccuuugcuucuucucuugcuuugucucuggccuguacuugugggcaagcuuaagcagcugaguagcugucugccuauccagcgccugggugaacugguuaauggcaggagggacuuugaaccgcuuguagaggauagcucuuugccgcugcagccugauguagcagggccauuugacgaagcacauuaaaucucuuuugggcuggauguccuguccaaugccgaaguucuugggccucuucucgaacagaggguugaccaccuucuuggccuccugcuucuugacgacggcgggguccggggccaccuucuucccuuugggcaucuugcucggcugcuggagagagccuuuguauugaucuuaaaccuugucaaagauguuccuacuuucuagaaguuugguuauaguaucagaagggaaggcagcaucugaaccacgugcucauaggaggcaucaccacaggguaaaugcuuuauuuauuucuuuaugucugggaucaugccacacugauguggcagaaucugguagaacuggcauuggccaugaacaccaauauggcuguaaaaggaagauggggugagcauacaggaaaaaccaauagaguuuauguggaugaucugugcuaacugaccaggugacagaagguacccagaaagaaaauaguaccugcaagacaucauugacuacauacuccaugauaaagaacaguagggaggacuauaugcuuuggccaaaguaagauauuucaaaacaaggcuuugugugcagaucaguaguagaaagcuugccuaauacaguuauggccuuauuugauuucuaucacugcuagaacauuuaaaaauaugcuuucaauagauaaacaucuguaaauuuuuuaccuacuagaguguuaagcuuucuuuaauucuuugggggcaaaaaaaagaguuugagugaauaguuugugccugucccacucugaagucuccuucugggccugaaaagccagagccagaguguaaagcaaggaacaaagcuuuagaugaggcuggccaguugucacggaaucaggcuacacgcacaaauccacacucauauauaaucuuucuuggaaucuuucuugaaaagaaacuaucucucagccgggcaugguggugcacgccuuuaaucccagcacuugggaggcagaggcaggcagauuucugaguucaaggccagccuggucuacaaagugaguuccaggacagccagggcuacacagaaacccugucucgaaaaacaaaaaaacaaaaaacaaaaaaaaaaaccaaaaaaacaaaaaaaaaaaaaaaagaagaaacuaucucucagaggcuccaggcuccauuuuauauuccauaagagacucagaaaagcugggacuuguauguuuugguuuuuuuguuuugcuucguuuuaauuuuuuauuuuacaugcugacccaguuuccccucucuccucuccuccuguucuccccucccccauccacuccuccucuauuucucuucagcauagggaaggcuucccauggauaucaaccagccauugcauaucaaguuguaguaaggucuccucuucuauuaagacaagggucccaaaggcaggcaacagaguccaagacagccccugcucccaugguuaggagucccacaagaaaaccaugcuauacaacucuaacauguggguggagagccugggucagucccaugcaggcucccugguuggcaguucaacuucugugauccccuaugggcucagaauaguugauucuguggggguuucuugugguguccuugauuccucugucuacuggcuccaacaauccuucccccccaucuuccacaggauuccccaagcucugccaaauguuuagcugugugucucuacaucuguuucaaucaguugcugggugaagccucucugaugacagcuaggcuagacaccaaugcacagugucuggguccucccaaggaggaucuucauaaccaaauuuugaagucuaccaaaugacucucacacaaagacccucacucacaaagaccauagagacugcuaucgcugcaaaccgcaagaggauuuuuauugauccaacacguuggggaaccccucagcacgcaggcaagaggagagaccccaaacaaagaaagaacacacuuuuuauaccuuguaaggggcagauuuaggcaacagggcuagcuggcuuauuuucauuguagcaaguaaccuuuucaggcauugguugguuuauauagcgugacuaccuuuggccuagucccucacucugccugcccuuaugguggguuauuaugguuggucagcaaagcagcaguacauuuugaacuuaugggucagcuauuaacaucacagggaauucuagcgacaaggucagggcaguuugugguuuuucucagaauucaguguggggcaggggaggagaauuuuucugggaacugcuaaucuuguuuuggcagcugcaggcuuagucuggucauuuugaccacuaaaacuguguaguuuggaaagucccuuggggguuggggggaaaggacuaaguggucuugaauuucuuuuggauucuacagcagaaggauggauccuguuuuuauauccauucuguuagccugugucuuuauuggggauuuggguccauugauguugaaagauuuuaaugacacgugauugauaauuccugcuauuuugaugauggugauggugguggugguggugguguauguguguguguguuucucucuucuggucuugcuggugugaaauuauuuauuucccauguuuucuuguguguaguuaacuuccuuggguuggaguuuuccuuguaguaucuucuguagggcuggauuuauagaugaauaaguggaaaauguuuaaauuuaguuuugucaugaaauagcuuguuuucuccaucuuuggugauugaaacuuuuccuggguauauuagucuggguuggcaucuguucuuuuagagucugcaaaacaucuguccuaguccuucuggcuuuuagaauuuaugugcagaagucaugaguaacuuuaauaggucugcuuuuacauguuacuuggcuuuuuccccuugcagcuuuuaauauucuuucuucuguauauuuaguguuuugauuauuauguaguggagggggcaaaggagacuucuguuuucugguccaacuuauuugguguucuguaagcuucuuaucuguuuaugggcaucucuuucuuuagggaaauuuucuucgauuuuggugagaauauuuucugggccuuugaacugaaagucuuuuccuucuauuccgauuauuuuuagguuuggucuuuucaugguguccuagauuuucugcauauuuucugucaggaucuuuuuagaugacuuauaccgacgaauaucuucuauuauaucuucuguuuucuaucucuuauauucuauuggugaucuuucauuuguaguuucuguuugcuuacuuagauuuuccauuuccggaauucccuuaguugguguuuucuuuauugcuucuaaguucaauuuuaaggucaugaagaguuuccuuuaccuguuuguuuugucucggcauucuuuucuucgauuucuuuucugucaucuuccuaaaguugguuuuguuuuguuuuguugauuuuucaagacaggguuucucuguguagcccuugcuuuccuggaacucacucuguagaccaggcuggccucgaacucagaaaucugccugucucugccucccaagugcugggauuaaaggugugcgccaccacugcccaguuuguuuuguuuuuuuuuaaaucacccugaccagaagcaacacagggggaagaaggcuuuauuucaauguacaguuccaggcggcaauccaguuuuuuaaaagauuuacuuauguaugugaguacacuguaucuucagacacaccagagaaaggcuucagaucucauuacagaugguugugagccaccauguugcuggaaauugaacucaggaccucugggagagcggucagugcucuucugcugagccaucucuccagccccuaaaauugguuuuaaggucauuuucuugggcuuuagcugcauuuguugaagaaguguuuucuuccuugguuucuguuuuuucuuugguccucugagcuuuguggucucaauuucuggugaccugcuugaccucugacucacuaggaagucucugguuggaggauugacuucuggcuacuugccaggccuuuggugcagcagggggucucuguucaucugaguggugugggcugcaccugagcagcuggagacugucagaauuaggggcagggguguaacuaaggggcaggugguuaguugagagggagcuguggcagaacuggucuuggggaacaagucuagggaguucaguuaagcuggcacagacccacucaccugagacuugcuaucuucagagaguguuuuauuugacuaucaucuguauauaguaauaucaaguguguuuuacuuucagaaaaguaauauagucugaaguauuugcagauagcaaauguauuaggaccauuaaaagaugauuuuuugacaaaaauaacggcugggauauguagcacacauugguaaaguacuugccuacaaugcauaacuaguguacauaagacacugguuucacucccagguucacaaaggagggaagggcaggaagaucuuacauaacaaaaugagaauauugcuuauaaauauuucaucucaagagaaaauguuuaugguauuuuauaaacacuuggcuuaccauuauaggccauacacauuuauuucuaaaaucacuaaauuuaauauagucaguuaauaauuuagaagaaauaauuuagaaacaucuguaugggaaagagguauaucacauuuuuuauaggguuaugugauuuaugcugaauucuugaaaauuaguaaguguacauuauuaaggugguuaguuuuguucuguagaaugguugcuuaaauuaaugucaguuuguuuucauucagaaaggccauauugaggcuagcuauauuggugaacacauauaaucccagcuacaugggaagcugaggcaggacuagaacacuugagccugugaauucaagaacaggacaguuuagugagauccucccccaccucaaaauuccagcuacagcuugagguacagacuguugagaauaugcugauggugcuauuuuuccugauuccucucuuugaaugccacuguggugcuuuauccccacagucccagcagcuagugcaagaggaccccaaauuugaggcuagcuugggcuauguagagagacccugucucaaaaaggggagagggggaaggagggaagagacuggauuaaauguauuaauuugauguguuguuugaauguuuuucugacaaccacaaucuuuuacugagugucuuuuauuuacuuauuuuuaacccaagaagcugaaaaaagugaagauuccucagguacuacaggccucucaggcuuacaucguacauacagccaggacugcagcuuuaagaacagcauguaucaugucggagauuaugucuauguugaaccugcggaggccaaucuacaaccacauauaguguguauugagagacugugggaggauucagcugguaaguuugauuuaaauugaaggucaggugcuagaaagauggcucaguggcuaagagcaguugcugcucuugccaggguccuggcuucaguucucaaucccuacaucauggcucacaaccauccuuaacucuaguuccaggugaucugaagccuucauauggcacacacaugauacacagucauacaugcaggcaaaacucucauacaugcguguuggauuuuuguuuguuuuuaaagaguuacuuauuuuguauuaguacacuguugcauagaaucccauuuuaaaugguugugagccaccauguggguuuugagaauuaaacugaggaccucugaaagagcagccagugcuuuuaacuguugagccaucucucuagccccacauguacauuuguuuuuaauccuaaaaaauggggggugggggggggauuucuuuuuccaugaucaucaggaagaaaaaaauuuuaacucauauuuaagccuuuuaacaauagcuacaucaauaaauuuacuguucaguguaucaguaaauauaauuaaccacccagccauaugcaaacaugguauguagcauuguugggcaaugucacaauugagucagaaauguaacuucuuaauggggagaaagagucaauuauucaguaauacuuagagccaaacucuguguaggauggcaaagauuuaagaagagcaaaagacucauuuuuuuaaucuagcaaauuuuuuccaauauguaacugagcuuagaauuuauugucaaaaaagccuuccuuuaaaaaugcuuguaagcugguuugguagcacauaccuguccuucgcaaaacucaagacauugaggcaggggaauaagcuugaggccagucuaggauacagugaaaccuuucucaacagaaaacuaaauaaaauauaaaaaaaaaaaaaaaguugccucugagacaaagaauaaagacaaagguaagaaugacgccagcaucaguguuguaggcagucugauuguuuaagcugccagucagguggaaugcuuuuggauucuacaccuucuugcuacaaauguccuucccuaucccugcaugcucagugagagaguguggauugggccaagcagcccucuagccuccucucuguugcaugucacuaaagggugaaaggacguuuucuaggccucuuugugcuuuuuuguuugaaaauauuauuuccucuaaaauaauucuauuaagaaauuuucaucuaaaaccaguguguuuaagccuuggcauaauggcuuucuaaaauacuuucuaguuuuacaaagaauaugugauuucuguuaauaauuuuuuucuuucucuguuuuugaggugaaaaaugguuguacggcuguugguuuuaucggccaaaugaaacauuccauuuggcuacacgaaaauuucuagaaaaagaaguuuuuaagagugacuacuacaauaaaguaccuguuaguaaaauucuaggcaaauguguagucauguuugucaagguaagaaacucauucauuccaaugauaucauucauuaaauggagauaccauuuaagaauauaaaaaucuguguuuacaaaaucagaaaauguuucaaacauuuuuauucugugucuauauauaagaaauuaacaugaauauacuuacgagagaccauuugcuguguguaguuuaucuauauacaauuacuaacauuuuuauggugcugggauaauuucuaaggaugauauuuuuugaaaguaaucauuaucaaaugccaguuuugcuuuuagauaauaaaauguauuaucugucauauaugcacuguacaaagcauuaagacauuuuaacuauagaaaguaauauauuuucaaagggcaguugacaaaaaauaaauaaauaaaauucauaauuaaagggaauauagccaaggaaauagcccuacuaucuggccauuuacuuuuuauugucugaaaguuuuuauaguucaauguuagguuaauuaacauuuguuuuuuuauuuuugaguaaauuuucaaaaaauguacuuauuuguauuauuauuccuauuccaggaauacuuuaaauuauguccagaaaacuuucgcgaugaggauguuuuugucugugaaucgagguauucugccaaaaccaaaucuuuuaagaaaauuaaacuguggaccaugcccaucaguucaguuagauuugucccucgggaugugccuuugccugugguccgaguggccucuguguuugcaaaugcagauaaaggggaugaugagaagaauacagacaacucagaugacaauagagcugaagacaauuuuaacuuggaaaagguaugugggugguagcuaccuagaaaaggauuuuaaccuuaaaauaucuauucuagaaaguaaauuaauauauucaaacucaaaaaaacaaaacaaaaagcaaguugaggguagaaaaccuuagucaaacaaaguggaagaaccuaagggaaaagaaaagggaaacauuuaacuuaaacuaguauuuagaaguaaauugaggauggaggauaaagaaauggauuugacugcucuuccaaaggacccagauuugaucccagcacccgcauggagcuuaaccguaauucuaguuccaggcugucugacuucuacaggcaucaggcacacaccuggugcacacuggugcacagacauacaugacauacaugcaggcaaaauacucauaaaguaaaccaaggagaccagugagaugcccagugaguagugaguaggcgaacucuuuguaugauugcuguaauuaaaagcuguaaccuaggcaugauggcacaugucuuuaaucccagauaucagaggcagauggaucugaguuuaaggccagccuggucugcagagugaguucuagggcuacacagagaaacccugucucaaaaaaauagcucuuuaaacuacuugauauuauagagacaaaaauccuucguucauuguauaaagucagagcaaacuguauuccacacccuacaaaauucaacagaagacuaccccaaucucaaggaugaauaucaauauaaaaauugaggaaaugguuuggucuggacuggucugguuugguuugguuugguuuucaaaacagaguuuuuuuguguagccuuggcuguccuggaacuuucuguauagaccagacuggccuugaacucacagagauuugccugccuccaccuccugagugcugggaucaaaaagguggcuaccacugccuggcugaagaaauguuauuuuuauaagcaagauugcgccauuuuaaaacaugaucaaggaaggaaauguuccacuuaaaagggcaaggauuauucaaaauaaacuuuuauuucauucaauuacuagguuuuuuuuuuuuuacuaacauuucuauaucacuuaugcuuuccaacaaugaaagcccaucugaggggcccacaagaaaucaggucauuugcccuuuaucaccuacagcuaguaggugacagauuuaguuauuuagucaaagccagaaugcaucauguuuauaucacagaacuauauuguuucuugcuaugauggaauuaauaaaaauaauaaaaauguaaaaccuaucaguuguuaacauuaagaaaugaaaacaauauaguagagaccagggaaaaguccaagcuaguguuuagccuuccuuucucucuaaggguaguagguaagaagccagcguagaagaauauuguaccuuuugggaacagaggauuaguuaaaaaaaaaaaagaggaagacauauccuggacucucuccuuucggcuuuucuccucagauagcgccuccuauccucccagucugugcucaucugcccucccaggaauguaggacaggucuaugaauaguaagcuucaggcagacauuccaaaggggccucaacccugucacucugucaugucuccuggaguuuaucugcucuagcauuccucuuuuucuauuuagucuggagaugaguuugcuaugugcugcuguggugugaaaaacuacuccuuauacucauuucuguuguacuaaugguagcuuucccugggggucuacuagagauuuaaucagauuaggacagaaacuacagagacucgguaucauaaaggcaaguuaaaagccaacuuguuauauuucuaaaucccgcagggaucagaaagaaguauuauuuuucagagugggagcuaaaugagcuaugucauuagaagagacugaauaagcuuaauuuuuauauuagaaagcagcugaucugguggcaugugcuuguuagaauacugaaguaagaaaaagaaaagcucaggaccugcuugaacuauugaaugaguucaaggccagcuuaguaagacccagguuuaaaaauacauaaaggguuugagauaucaguaccugccuguuacacagagucccagguucugucucuauuaccacaaagagaaggaagaaauucuguaacauuaaauacaauaaagaagauaguauaaagaauuuguuucuuguacuguguguugugugaauuuguccacuuugaaguaaaugcuaauaaguucuuuccaguacuuuauucugaaaagaucaauucuauaggaaugggggggcagauauaaaaauuucuuaguaacauuuuaugaaaauuauaaauuugaaaugaauacaauaccugauuaugauuuugauuuuaacaauuuaauguuugguuucucaacuuugauaaaagcuuacuuagaguuguuguuucuugugccucuugcuaguuuccugccuuuauuuaccaguuccucuccacaggaaaaagaagauguuccuguggagauguccaauggugagccagguugccacuacuuugagcagcuucgguacaaugacauguggcugaagguuggugauugugucuucaucaaaucccacggcuuggugcgcccucgugugggcaggugaguuacagaagaugagguugggucuaagauuugagacuuaguauuccacaugcauagaaugaagacagaauucccuucccuggcaauuucucaagcuuccucacaccacauuuucccuguuccuacuucuguggcaaguagaugggcgcacacguguguauaaucccagcaauuagaaaacuaaggaagggggccuggagagauggcucagugcauugacugcucuuccacaggucccgaguucaaaucccagcaaccucaugguggcucacaaccauccauaaugagaucugauacccucuucuggagugucugaagucagcuauauuguacuugcauauaauaauaaauaaauaaaucuuuaaaaaaaaaaaaagaaagaaaaagaaaacuaaggaaggaagagcaagggauccagaucagagccugucccaaaauaaacacucaaagauugaaagauaauuuuacuucaguagagcuuuauucaaaugggguacauauaauauucagauguguguaccaaacaugauacauacuguugaaauugugaggugcucagaacagagagaaugguuugaauagauuucacaaagaauguggcaguuggguuacugugaagaaauguaagaauugugacuaucagggaaagcauuccaggcagaauuaauaaccagaauaaaggccugagagauaaguacaucacucuuaaccuguaauucacuuaucagcauagugagcccuauaaaaggugguagaugggguaaugggcagaucauguaagguuucagaaaccaugugagcccuugaacuauuacagaguuacaaaaagugucuuuguuauuguuucaagcagagaaguaacauuugacuucugguuuaauaggguugcucugcuuucuccuuauugagaugagacuguaaaggggccaagaguagaagcaaggagaucugcuagaaggcuauugugauaagccaagcaagaaugauggccucuuuagugugacuaauuacaaacaguaguauucaggagggcaggcuaacagcagucuuaguaaauacaauguggaguuccaggguagagcuuucaaggaugacucacuccugugaguaguuaggaaacuggaagauuggaguuauuauucacugaaaugaaaauguugcucuaugucuagaacccugcaaaugugggacaauaauacugauuuuaaguugauaaauaggacaguacaacaucgcaacgggaaaguacuuuagugcuggaucuugcacaaagaucugugauccucuguuuugaaggaauguuugccaaauccaaugacaaauguuuaguuguuuucaucuugaacaucucaggaagaaaaccuggaauuaaauaaaaugaucuaauuacauacuuugauacuauguuaaaguuuuuguuuuuguuuuuuuuuucccagaguggccaaauguccuuuucucuuuuucagaguaucuucucugaaaggucucuuaaagggugaggagaauccaugaaauuucucuuaaugcuauaugcugcuacauuuuaggggucuggagagauagcucagugauuaacagcacuggcugcucuucuagagguucugaguucaguuccuagcacccacaugguggcucacaacuguuuauagaggagcugauucccacuucuaauggagggaauuagcaacagagcacucauuuaaacaaggaaacauuuuaguuagugggguuuuaauuagauaaucauucaaaauugaaauuauuauaacuuaauuucucuaucccccuacccccaagaauugagaaaguauggguccgagauggagcugcauauuuuuauggcccuaucuucauucauccagaagaaacagaacaugagcccacaaaaauguucuacaaaaaagaaguguuucugaguaaucuggaagagaccugcccuaugaguuguauucuggguagguauuuguccuuuuucaucacaguuguucuguaaaacuuggauuaaguacugcugcuaugcagggcaugcuucuagauagugggucuauagcagcauaaaaauauuaaaagucuuugcuuucauaaagacauuggggugaagguugggagauaguaaauaaauagcagagaacaccagguaguaauuagaguuuuaaaugaaaauaaaacaaagaagauugacaauaaauguuuagaugaggucacaugaucagccaaaaugaacccuugaagaaguuuucaaauaaacaaaagaaaauuauuugaggcucucuucuaggaacagcaaaagaguugucuuagauuaucuguucuuguuuggaaucucagaggguuggagaacuagagcaagggaagggauguguuguaaagaaugagcccuuugaacuuuauggagacucagacauaguagaucuuguagauagugauugggcuugaaaggaaaucauagugggguugagcagagcugugaagugagucaucauggcugcugugugaacaguguaauacgaguaagguaggaaguagagagaauagccucauuuuucaguuucuguuagacuuuuuuugaggauuauuuacuuauuuuauuauaugaauacaguguagcuguuuucagacacaccagaagaagggaucagaucccauuacagaugguugugagccaccaugugguugcugggaauugaacucaggaccucuagaauagcagucagugcucuuaagggcugagcccucucuccagcccucuguuagauucuuaaaacuugaucauuuuauugucuccauuaucgugguuucucuuuggucaucuaucaaguauuuccagugguauuuuguuucuaagaucuaauuguaugcaucaucauauacuaacaauauugcuagcuguuauguuucuccaagcccugagagccacuagaucauacacuagccacacuauaucccuugagauggcauccuaaaagauuacuagaucauacacuagccacuagaucauacacuagccacacuauaucccuugagauggcauccuaaaagauuacuagaucauacacuagaucauacacuagccacuagaucauacacuagccacacucuaucccuugagauggcauccuaaaagauuacuagaucauacacuagaucauacacuagaucauacacuagccacuagaucauacacuagccacacuaucccuugagauggcauccuaaaagauuacuagcuauaggcuuuacaucggugcuuggaguuuugugggucccccaccaacacaccaauucagagauugaacccagggccuuguauaugccaagugcacacucuaccauuaaccugcauagcuaaaucuaguccccacagauuguugaugguuuuaaagaagccaccauagaucacaaccaaagaaaaauuugcagauucaaacauauguuagucuuuauucgaugcugcugcucauaauuauuuucaggauuagauauggcaaacugcuuaguaauucagcacauuuucaacuuucuaccacaggggaagugaacuaagcaguaaagucauuaaacucuugccuuucuguagcagaaaauaucuuccuuuuaaauucugauccagacuaaaguaauacccaaaguuacuuccuaguguaaauccagcaaggagauuaaaauggagcaugaugaaagugagacugaaguuugcuuguguuagggcagcuauaugauuuguuggguuaauuucuauuuuauuaggguuuguuuguuuuuugggggggggguugggguuuuuugggggggugucuuuuuguuuuuuuaucaagacaggguuucucuauguagcccuggcuguccuggaacucacuuugcagaccagucuggccucaaacucagaaauccgccugccucugccucccgaguacugggauuaaaggcgugugccaccacacccggcuaauuuuagguuuuaugcaacuuuucaaaugacuuuuuuaccuuuuauucuuuaacaguagaaaaucauggccacucaguagaauccaaagaacauugcuucuagcccuauauuuauaggaccuuagaagacucaagaagcauaacucaucacaaaauaauauauacugcuucaggaacuguauugagugauaucaaaagaauuucagaaaaaaauaacugugacauaacugucccaguguuuugaguuuguuuguuuuugguuuugaauaguuauaguuaugaauguccuagaacucacuaaauagaccaggcuggccucaaacucauagagaucugccucccaaguguacaccauaaugccuggcucuggcucuuuuuaagguguguguguguauuuuccuugcauauaugucuguguaccacguguguuucccauggaggcaagaagagggcauuggaucuucuggaacuguagucacagauacgccaucuuguaggugcugggaaucaaaccugggucuucugcgggacagcagccaaugcuuuuauugcugggcuaucaccaccaccaccacuccaaacgaguucuugauucagaaaaaaaaaaaaaaaguguagagaagcuauauucugagcaacaauagucaucuaugucuccacaauauagacuggaucaugguucagaugaaacuaguacacaaacauauauacaccucucuccauaauauuccugucagcccuugaagugauacuagaaaugacacuuaagcauuugcuuguagaaucuacuuguaauuuggaagaaggcauguuucaauauguaguuuuaaugucaacacaauaacuaagguagaaauuuacaucccuuauuuggggcugggcacgcaguaguagaauccuuaacaugaaacccugggcuccauccccaggguugcagagacacagaacaguucuuaaagcaucucaguccccacuuuuucuccccacauuuuaaaugugugucauuugauaacuuaagcccaaaugacaauacaugguuaauuugccuuuuaaugugcuaaggcuucaauauauguguuccuccaggacucauaagucuaaacuuaaugccagugggaucuugugggaggugcugagguccaaagagccaugcacugaguagauagacacuguuucaggcagggaucauacaaguugguuuacucuccugucuuugucuuugugcuucugcuguccaucaugcaucagacaccuagaauuuuccugugcaguaaacaggaauaugucagauacuggcaccuucauuuuuaggacuuccuaucucccagaacuggaaaauuuucuguucuuuagaaauugcccaguccacaguaguauugcuauaguagcaauauaguaggacuuuuuuuuuuuuaaguaugaucaugccaucuuucugagagaauuucauauuugacaaaaacagguaaauucuuugcaagggucauccuucaggaagcuccccacaagucaagcagucagcuaaaauguauuugagaaguuaggaaggaaggggaauguuccacucuacucugcccuuggcaucagaaacuucauaccaggaucccaggcugucuuuuucaaaacuguugcugaagccaagaaaaaaaaguguguguguauguguggggagagcuggagugauggcucagcaguuaagagcacucccuguucuucaauuuccagcacccacauggcaacucacaacugucuaugacuccaguuucaggcuauucaacacccuuuucuggccuccaugggcaccaggcaugcauguaaugucacauacguguauacaagcaaaauacagauaaaccuuuuuuuuuuuuuuuuuuuuuuuuuuuuuuacaaucuagccagugcccugccuccuggucccacuccugaaguuccucaucucauuacucuuucccccuaagccauucucugcuacauaugcagcuggagccaugagucgcaccauguguacucuuugguuggugguuuagucccugagagcucuggggguauugguugguucauacugcuguuccuccuauagggcugcaaaccccuucagcuccuuggguccuuucucuagcuccuccauugggcacccugugcucaguccagugguuggcugacagcauccaccucuguauuugucaggcacuggcagagccucucagaagacagccauauuaggcuccugucagcaagcacuuguuagcauccacaauagugucugggauuggugacuguauaugggauggauccccagguggggcagucucuggauggucuuuccuucagucucugcuccacacuuugucucuguaucuccucccauggguauuuuguucccccuucuaagaaggacugaaguauccacacuuuggucuuccuucuucuugagcuucauguggucugugaauuguaucuugguuauucugagcuucugggcuaauauccacuuaucagugagugcauaccacguguguucuuuugugauuggguuaccucacucacgaugauaauuucauguuccauucauuugccuaagaauuucauaaauucauuguuuuuaauagcugaguaguauuccauuguguaaauauaccacauuuucuauauccauuccucuauugaaggacaucuagguucuuuguagcuucuggcuauuuuaaguaaggcugcuaugaacauaguagagcauguguccuuauuacauguuggagcaucuucuggguauaugcccaggagugguauugcuggcuauguccaguuuucugaggaacugccaaacugauuuccagaguaguuguaccagcuugcaaucccaccagcaguggaagaauguccucuuucuccacauccucgccagcauaucugcugucaccugaguuuuugaucuuagccauucugacuguugugagguagacucucaggguuguuuugauucgcauuuuccugaugacugaggauguugaacauugcuuuaagugcuucucaaccauuagguauuccucaguugaaaaucuuuuguuuaacucuguacccaauuuuuaguaggguuauuugguucuccggagucuaauuucuugaguucauuauauauauuggcuauuagcccucuuucagauguagaguuaguaaagaucuuuucccaaucuguuggucgccguuuuguccuauugacaguguccuuugccuuacagaagcuuuguaauuuuaugagguccuauuuguugauucuugaucuuauagcauaaaccauugauguucuguucaggaacuuuuucccugugcucaugugcucaaggcucuuccccacuuucucuucuaugaguuucauuguaucugguuuuaugugggcguccuugauccacuuggacuugaacuuuguacaaggagauaagaaugggucgauuuguauucuucuacaugcuaaccugguucaaccagcaccauuuguugaaaaugcugucuuuuuucuacuggauguuuuuagcuccuuugucaaagaucaagugaccauugguuuguugguucauuucugggucuucaauucuauuccauugaucuaccugcuugucacuguaccaauaccaugcaguuuuuaucacaauugugauaauacaguuugaggucagagaugaugauucccccagaaauucuuuuauuguuuagaacaguuuuugcucuccugguuuuuuguuauuccagaucaauuugcaaauugcucuuucuaacucuacaaagaauugauuuggaauuuugauggggauugcauugaaucuauaaauuguuuuugacaagauggccauuuuuacuauauuaauucugccaguccaugagcaugggagaucuuuccaucuucugagaucuucuuugauuucugucuucagagacuuaaaguucuugucauacaaaucuuucacuugcuuagagucacaccaagguauuuuguauuauuugugacuauugugaaggguguuguuucccuaauuucuuucucagccuguuuauccuuugaguagaggaagggcacugauuuguuugaguuaauuuuauauccagccucuuugcugaaguuguuuaucagguuuaggaguucucugauggaauuuuuggggucacuugaguauacuaucauaucaucugcaaagagugauauuuugacuccuuccuuuccaauuugaaucccuuugaccuccuuuuguugucuuaauugcucuggguaggacuucaaguacuauauuggauagguagggaaagagugggcagccuugucuagucccugauuuuaguggcauugcuucaaguuucuuuccauuuaguuugauguuggcuacugguuugcuguauauugcuuuuaucauguuuagguaugggccuugaauuccuggccuuuccaagacuuuuaucaugaaaggguguuggauuucaucaaaugcuuucucagcaucugaugaaaugaucaugugguuuuuugguuuuuugguuuuuuuuuuaguuuguuuauauaauggauuaccuugauggaucuucguauauugaaccauuccugcaucccuaggaugaaggcuacucgaucaugauggaugaucaguuugauguguucuuagauuugauuugugaggauuuuauuaaauauuuuugcaucgaaauucacaagggaaauuggucuaaaauucucuuucuuuguugggucuuugugugguuuagggaucagaguaauugugacuucauagaacgaauuggguaguguuccuucuguuucuauuuuguggaauauuuugaagaguucugguauuaagucuucuuugaaggucugauagaacucuacaccaaacccaucugauccugggcuuuuuuugguugggagaauauuaaugacuacuucuuuuucauuagggguucugggacuauuuagaugguuuaucugauccuguuuuaacuuugguaccuggaaucugucuagaaaauugucuauuucauccagauuuuccaguuuuauugaguauaggcuuuugaaguaggacuugaugauuuuuuggauuuccuuguuuucuguuguuaugucucgcuuuucauuucuuauuuuguuaaucuggauacugugucugugcccucugguuagucuggguaagggcuuaucuaucuuguugauuuucuugaagaaccagcuccugguuuuguugauucuuuauauaguucuuuuuguuucuauuugguugauuucagcccugaguuugauuauuuccugucgucuacuccucuuggguguauuugcuucuuuuuguucuagaacuuucauauauacuguuaaguugcuaguguaugcucuguccaguuucuuuuugggcacucagagcuaugaguuuuccucuuagcacuguuuucauuguguucauuucaguuuuggguauguuuuggcuucauuuucauugaacucuaaaaaagucuuuaauuucuuuauuucuuccuugaccaaguuaucauugauuguagaguguuguucagcuuccacguguaugugggcuuucuauuguuuauguuguuauuuaagaccagccuuaguccauggugaucugauaggaugcauggaauuguguaaaucuuuuuguaucuguugaggccuaugaccgauuauauggucaguuuuggagaugguaccgugaggugcugaagaaggugguauuuuuuuguuuguuuguuuuaggaugauguguucuauagauaucuguuaaauacauuugguucacugugccucuguuuaguuuccauuuccauggucugucaauuggugagaguuaggugaugaagucucccacuauuauugugugagguucaaugugugcuuugagcuuuuguaaaguuucuuuuaugaauguggguacccaugcauuaggaguguagauguucagaauugagaguucuucuugguauauuuuucuuuugaugaguaugaagcguccuucuuuaucuuuuuagauaacuuuagguugaacgucuauuuuauuagauauuagaauggcuacuccagcuuguuucuugguaccauuuacuuggagaauuguuuuuccaccuuuuacucugagguagugucugucuuugucacugagguggguuuccuauaugcagcaaaauguugggcccuguuuacauauccagucuguuaguccaugucuuuuauuggggaauuggcuccauugauauuaagagauauuaaggaaaauugaguguugcuuccuguuauuuuuguuguuagagguggaauuauguguauguggccaucuucauuuugguuuguugaaauuacuuucuugcuuuucuagggaguaguuucccuccuuguguuggaguuuuucauuauccuuugaagggcuggauuuguggaaagauacuguguaaauuugguuuuaucauggaauaccuugguuucuccggcuauggaaguugacaguuuugcuggguauaguagccuggcauuuguguuccuguuugucuguaucacaucuguccaggaucuucuggcuuucauagucucuggcgagaugucugauguaauucugauaagucugccucuauauguuauuugaccuuuuucccuuacuucuuuuaauacucuaucuuuguuuugugcauuugguguuuugacuauuaugugacagaaggaauuucuuuucugguccaaucuauuuggaguucuguaggcuucuuguauguuuaugggcaucucuuucuuuagguuagggaaguauucuucuuuaauuuuguugaggauauuuacuggccuuuuaaguugggaaccuucucucucuucuauaccuauuuuccuuagucuucuauuuuccuuggucuucucauuguguccuggauuuccuguauauuuggguuaggaacuuuuugcauuuucuuugacuguugugucaauguugucuaugguaucuucugcaccugagauucucucuucuauuucuuauauucuguugcugaugcuugcaucuauaacuccuaaucucuuuccuagguguucuaucuccagaguugacuuccuuugugauuucucuauuguuucugcucccauuuuuagauccuagaugguuuucuuaaauuccuucacuuguuugguuguguuuuccuguaauucuguuaagugauuuuuuguguuuccucuuuaagggcuucuaccugguuaccaguguucuccuguguuucuuuuuucuuuuuuucuuuuucuuuuuuuaguuuuucaagacaggguuucucuguguagcccuggcuguccuggaacucacuuuguagaccagacuggccucgaacucagaaauccaccugccucugccuuccaagugcuggcauuaaaggcaugugccaccacugcucggccucuccuguauuuaaggaaauuauuuaugauguucuuaaaauccucuaccagcaucauuagaugugauuuuaaauccaaaucuugcuuuucugguauguugggauauccaggacuugcuguggugggagaacuggguucugauguugccaaguaaccuugguuucugaugguaagguucuugagcuugucuuucgccaucugguugucucugguguuaguuggucuuguugucucugccuggagcuugucccuccuguaggccuguaagcuugugucagcacuccugggagaccaguucucuaccaccagaaccugugcacagaaggcuuuauaaaaguccuagcucugggugcagauggugacugguaccccgcccccccccccgcccccccccgcucccacuuuuuuuuaauagaggguaaguugaggcuaaguuacaaagucaccugucagauuucagcuacauuuucauaauuaaacauuauaugguugugaaccuuuggcuuuugauuuaaaaaagaauuguugauucuagucaaaugagguaacugaguagguaaucugaauucuaugccucuguccuaggugaugaaaugaaggagucacaaguauucucugacauacaugugccacuacacauguguuauggcauguacauaaacacauaauaaaugaaauaauauuuagaauauauaugugauguguuuguccgucaguauauccauguguucccacagaggcccaaagaggacacuagaccaagcuggggauauugugggugcuggguauugaacauggucuucuggaagagcaguaaacccucuuaaccacugagaugugucuguccaaucccucaaaagacauguuuauucuaacaguuuuugccagcuuuucuucugugaagaaaugacuguugauguacucccuauacuacuguuuccacuaauauaacuuggauaaaucuuuucucuagaguuucuguuaaaaugcauugccuccuacaauauuuaagccauuuuuauaucuggaaucaacaugauuauauaagauaguauuuuccggaaagguaaaauaacugcccaagaaugggucagaacuaaagccuggguccucugucucacuucuguguuggucucauuaagugauugauagccaguugggauacauguguauguacugaugagccugcaguauugagcaggaugagagaugcacagugagacaugguuguuuuguuuuauaaaccccacuuagugcucacaaaguaagauccaggggcuggagagaugauucagcaguuaagagcacugacugcucuuccagagguacugaguucaguucccagcaaccaugugguaggucacaaccaucuguaaugggaucucaugcccuuuucacaguguacucauauaaauaaauaaaauaaguaaaucuuagccgggcggugguggcccaugccuuuaaucccaacacuugggaggcagaagcagucagauuucugaguucgaggccagccuggucuacaaagugaguuccaggacagccagggcuauacagagaaacccugucucgaaaaacaaacaaaaaaguaaaucuuuaaaaaaaaaaaaaaaaaagcuccauuuuuacaguuugguaugcaccaacuaccaaagggccuuauucuauaaauuucaaaggacuuauaauuccaugauguuaacuuuguucaguguugaauguaaaucuuacuuuuguacuuuuuuuuucugucucaaacaaguuuuaaaaauauuaaguacacugauuuuugggguucccugguagaauuggaaggcuuauuuagaagaaaagucuuagaacugucuuagaagacccaccgagaagacaguuuugacaccuuuauagggaauaucacuucugggaagaaugauccaagugaccagauaugguagcacacgccuuugaucccaacacuugggagccagaggcaagugaaucucugaguuugagggcagccugguccacauaaacaguucaaagucagccaaggcaacaacaauaauaguaaugguagugauccgauagacacagaggaauuacuugagaaugagcaugggcuuaccugccagagaguauaccucuacuguugaccacuaagauuauaauaauuucaguaauggagccugggcauuccuuuuuuaauauaauuauagguuguuuuccuucuuuauaaauuuauuuaaugcuuuaucauuuuuaucagcaaagcaaaaaaaauaaauaauucaagaauaaaugcuuuaaauuuuugaaagggaaaacaggccaggguauuuuguuuguuuuuaaaucauacagagaaaaucuaagagauggucucauauaucauuuccuuuuugccucaguggagacuuaucacaggauuauugcccagggcucccucaccaggucagaucuugauacagccaccuguuggaaauagagguucaggacccugugguguccauucuuuaccagaagcucccucuucugaaaagcucuggggcacccccuaggaacugagggcuacuuuccugaucugcacccaguuccuuaugcucagacuaugagcaagcagccuucauuaaaccuuggcuuccugaaggcacuagagcagaaacaggccucaauaagcagaaugccaagagaagcagacugccucuucccucgaacggccauaccagagaggccaaagacagaacuaagaauagccacgguguuggagcuaaagagugaagaaaaggugcuugguggcacccuggaggggaagaacaggauugaggcauucaugcaaaggacaggauugaaugauuugaauggcuauggauuggccugguauagguguccaagauuuuuccaaccuggacuuagagaaggaagagagcuagcaucauaauuccccuuaccucucaggaguucugaagagagaaaggccauuuauccaaacauugcauuaguuuauguguuuugauuuccuuccuagaaacaggguugauguccacugggugcaauaaaacaauaacuauugggugacuuuggugguguuugucuaaaaucccagcauuuggaagguagagacugaggaucacugcaaguuccaggcuagccaggacugcaucacaaaacugucuuguaaugcauuaauuaauuaugaagcaaaaauaaaagauaccuacauacacaccacuuuaagaaauuuuaauggcaaauaaugccuguaagcucucagaacuuaacaauauaagagaaaucauuuuaaacauacuccucaaauguacacuuaauccuucaauuaacaaacagggauugcauagccaguauuggggaaagggggaaaggacuggaaacagaauaaugaaguuaccuuacugaucacacacaaccuauuaggcagauaauagguagacaaaugcauuaaaauauuuuguugaggcuacuauaauauuguauacuuaucuacuauauuauaaacauguaaguaucugggcagugauggcgcauaccuuuaaucccagcacuugggaggcagaggcaggaggauuucugaguuugaggacagccuagucuacagagugaguuccaggacagcaagggcgauacagagaaacccugucuugaaaagccaaaaaaacagaacaaaacaaagcaaaacaaaacaaaaaaguaaguauuuaucucuacugccuuuuaaaaggaucaggaaauguaugaaaucuaaagagcaaaaaggugacagaaggauaacaaaaaacuucauauuaaaaagauaauaggaacuuaauaugacuuagcauaccagagaaagcugauaccuaauccccuacaagcaaacccagcagagaacucuagaagagacaggaauugucaacaacaggaaguuuuuucuacaugguuuuccuuguuguugacuuguaugaauuguuuguauauuguaaaaacaaauccuuugccaguuauauggcucauaaauauuuccucguggaggaggacuuauauuuuuauuuucuuaauuaugucuuuugaaaaacaggaaauuauuuugcugaggcccaauuugcauaugcuaauuuuuucuucuauguauuacuuaaaucuuaaugucucaugguugcacaaauuuuuaucuuguuuucuaugggaaguuuuccuuuuacuucacaccuguuauaauuuauccauugcaguagccacuagccacuguaauucuuguuuuguuuuguuuuguuuuccaaacaggguuucucuguguagcccuggccauccuggaacucacucuguagaccaggcuggccuugaacucagaaauccaccugcuucugccucccaagugcugggauuaaaggcaugcgccaccacugcucagccacauguaauucuuaagcaaauaaaaugggacuagucuagauuaaguuauauauauuauaaauaugaaauauaugaaaaagaaugauuaauauguuaaucuuuauuauauaauaaauguuauguggauauauggagcugaacaaaauauguugguaaguuuaaaaguauauaaauaaaauuuuuacacaaauuauaaaagacccaaauaaauaaaaaugaccuauuauaaaggaagaacucaauauuuuaaauauguccauucucccaaaguugaucuaucaagaucauuuuuauguguaugggcaaauccacauguauaucuguguggcuuguguaugguguaugccuuggaggccaaaagauuugcuucagcucacaaaucuaauagcuuauaaagaaaaauguuacuauuaagugaaaucaaggcuuucuuuuaccaguguuuaagagcccagcacagaaucaccacauuuauuucaggacuaccagucacuuggcuuuuguuuugaaaugggaauuucauauuguccaggcuggcuuggaacucaauuugugucugagaaugaacuugaacucuucuccugccuccaccucugcugggguuaugggcacauguugauaaugcuuuguacgcacuaggcaaguauucagccagcugagccacaccccaucuccaacuaauaauuugacuccuuaacuguggagagaauuuuuaccauuuuugcaucuccauuuuuuccuucuuuaagcaugaagaauggcuauuccuaacuguugaguuagguaaauaaauacuauguauuucuaagguagugaaagcacuuuggaacuucugaaauguuucugaccuguuuugaauguacauauucaagaaguucuugaccaugagcauuucuaguauguucaguagcaaauagcaaaaauaaguguucuaaguguuguuaguguucuuuuuuguuuuuucagauugaaccuagggcuugcucgcucccccucccaggugcaugcaugugugaguguguuuguuugccugucugucugacuauaugggaguccauguaacauguaacacucaguauaugaguggaggauaggacaacuuguagaacuuaguucgccuucuaccauguaggucccaggaauugaacucagcuugucaagcuuguaggcagacacccuccccacccgcccuccccugagacaggguuucucuguguagcccuagcuguccuggaacucacucuguagaccaggcuggccucgaacucagaaauccaccugccucugccucccaagugcgccaccauugcccggcagcagacaccuuuuauccacugauccauccaucuugccaguccaugaacccaggguuuugugcaugcuaggugaccauuacuuuagcauucauuauuacauggguggugguauuguuguuugguuggugugguuugguuuaguuuuuaauuauguauauaugggaagguaugugcaugcaugagugcagaugucaguggauccaggagacaaagucccuguaaguuggagccacaggcaauugugagccaccuagugucagugcuaagagcugaguuugaguucucuguaacucuguauacuccuagcugcugagccaucucucuaucugagccccuucucuaucacucuuacuuaacugugaacuaaaauauaauaauauaaaauuugggacgggggaaaaagaguucugcugguaaaguauuuuucuugcaaguucagucucuagaaccacacuuuaaaaagccaaguuuggugguacacacuuguaaucccggcacuggagagguagagacagaucccaggggcucacuagcugccagccuagccuguuuggcaaguuccaggcuguuaacaugacaggaguuaacuccuuuauuucuauauuacucuuucagggaaaugugcagugcugucauucaaggacuuccucuccugcaggccaacugaaauaccagaaaaugacauucugcuuugugagagccgcuauaaugagagugacaagcagaugaagaaguucaaggguuugaagagguuuucacucucugcuaaaguuguagaugaugaaaucuacuacuucagguaaagcuuguaaaacuaaggaagaaagggcacugggcuaacuuaccagucauguuacccaguguucugaguuguuuuacuaggucuugucauaucacauaauuccaauagaaaauaucaguucagugagaugggguaauuccuagacuugggaggcugaggcaguagauaguauuauguuugagucaacuuuuuuuguuuugguuuguuuuguuacagagagaaaaaguauugaguuaaaaaaaaguuagcaauuguuuuaauaguaccuuggauuagacacaagcaguuguagaaugaagacagcacuugguucuauuggcagccucucugugggaagauuuucucaguuucauagauuaugacaauuccuuuuuaacauauaguccacuagaccugacccgcaccucuguggguauuaaucagaauuguuaauaaguagaagugacaucacaaauacccacugaagcuaauuuguuagccuuauagaguguuuguggcagguuauaauaauacaucauuuguaaauauuuucaggucugcccucugaccaguccuggaagugguuggcaacuuuucacuuacuuguuuugucacuguuuuucagaaaaccaaucauuccucagaaggaacccucaccuuuguuagaaaagaagauacaauugcuagaagcuaaauuugcagaguuagaaggaggagaugaugauauugaggagaugggagaagaggauagugaagucauugaagcuccaucucuaccucaacugcagacaccccuggccaaugaguuggaccucaugcccuauacacccccacagguacagugauacgcccaugacuugccuuuuuaguucuagcccuuagcagacuuaaaccagaguaguagacauuuuuuguuugagauaucaguuagccuaggcuggcuucagacuucuuguguauuuaaggugggccuugaacucuuagucuucuugccuccauuucccaaacaagcacuucgaguacagggguacacuaccacacuugaugugugaauuuuugccuaauuauuuuuaauuagcaaaaagcauacuuauaucauuaagccaauaauaauuucuuuuacauuucauagugaugguuuaauaggaguuuagaagauucuugccuuguagacaagaagcaauaaggaauguuauuaugcucuuacaccuuagcuuucagcgcccacacacaagaucuugucuccacuucagccuccugagcaauaggacuauagauacagucugccacaccuggaugccuauaucuuuaauuuccccuuccuuaggacuucaucuuuuuguugaggugauccuucuuauauuuauuuuccucauucagaauuuucuugagauuuaauugugaggucaccauuguagacuguagucauggaauucagugaaauuuuuacuuacuuugcacaagacaagguagagguauauuuuggccaagaaaaugucagcuacaagcugaauaugucuauaaaacuucauuguaucauauaugucuggcuucuagaaacuguaagguaaccuauaauagcuuucugucuuacagucuaccccaaagucugccaaaggcagugcaaagaaggaaaguucuaaacgaaaaaucaacaugaguggcuacauuuuguucagcagugaaaugagagcugugauuaaagcccagcacccagacuacucuuuuggggagcucagcagacugguggggacagaauggagaaaccuugaaacagccaagaaagcagaauaugaagguaaauaaagacuaggcacaacucucucuacuuuguaagcaagggguguuuucaggaaugcacaugcauauacaggcuuuacucuguuguucuuaccacaugcacaugaaucugguguuguggacuguccgagcuggcauuagaugccaguaccuggaguguugccucugacuuggccucauauccuuguggcguugccccuccuggcaaauuucucaaacaaaaauauguugcuguuaaaaauugcaugauuuuauuuuauuuaucccuauaggcacauacauguugagcuggggaaugauuguucaauaauaauguuaauuauaauuuuuauuaaaauucaccugaaugcggccuuuuaaaauaagugauuguauugcucuugauaagccaaagcuguaaguuaaaguauagguggagucaugguaugccugguuuucuaggccagcccugaccuguguacugugucuguguucauagcugcucuuaagauacuuggauggcuuuggcugagcucagacgccuucauuucccccuuccucuaugauagaucacuuuaaacccugagcuguuuuacucaaggauuugcugauucauaguuguaaaaaauuaauuccuuagagauuuuuggugguugggauuuuuauuguucuaguuaauauuagguacagcuuuaauaagugagaguacgcauuacuuuaggcaauacuuucaaauuucguauguuagauaauuuuccaauauagucuuccucucuaacuugacuaaguccaaauucauuauuuuccagcaagcauacauuaugaaagcugcuccuuuuauugaagcuuaugaagucuccaaaguaacucuuuuguaaaaaaacuuacauuccuuucauuuguuacuauuuauuauuaugaaauuaucugacagacuuccuuaaggaucuucugcugaagccuaauccuacaagacccucagcccagaaagauuuuguggcagaaucaguuucagaagcauuucaaacucugggcauaguccuaaguuaaagucacuaaggccuacaguaaagaaccugguuuuuuauuaucugguauuuccugaaaauugcccagguauuuauguggcaucuauuaauacccuagaacauucuuugagaaagucuaguccaaucccauaagaaccuagaacucugggacacuuugauauuucagggcuuacugcaaguuaagaccaaauguacuacuaaguuggaggacuguugucuaagaagcucggcuaacauagugucucaaggcaaacaaagcuaggacuguguggcugguuauuuaggguacaaauaggacaaagagaucuagaucuagaucugaagucagaaaaucuagagcauggcugagggaagaagagaugauauuugaacaauucucucauuuaauggggugucugaaauuaggaagagccuagugagaggugaguuauaugucucagucaccugaaauucaaacucugaacuuuagauguuucugcccacugaauucaaaacacaaaguugggaguuuggcugguguaauuuuaguaauucugaauuccaaagcagccuaguucagcuucuuucaggaagaacuaauauuuuauccacaugccugaacuuuucuuuuuuuccaacuuuaauuuuucuuuuucccuccaguuuauuguuucauuuguguaaugaaaaaacuagcauuuaauauugggguaucuagaccacagauaguuuuuuuuuuuaaguacuagagaauagguuguuagaauggcuuugcuucucguacugugcagaagguaucaggcugagacaguccuagugagugaugcuaagugucuacaagcaacuucaucacagccucaggagcuuugaauugcacaauuuucacauucuuaccauaaaggaguggagcuguugcuucuugagucuuuaaauccauguaccucaaacuguuuuccccaaauagcuguagucuuugaauuucauguuggagagauaacuguggaaggugaagugugacaccaggcgucggggccaugaguugccguuucuccuguauucuuggacaagucacugccuguaccccagcuucugugugcccaucugaagagugggaaggacuuccugcuuagaaugugaagcugaauaagcccuguauagugggagcuuugggaauaugcccucacagaagguccggcgugcugagagcaugacuguugagggugcuggcucuagaggugcagcauagccuaaggaaguaaagaggcuaucgguuaauagcgagaggcuccagaagcguuccucuugcauuucaagugcuugaauucuugcugauuuaggauucauggucgguuuugaacucagcucagggaaccugguucuuucagaguauuguccauugcuacauacacguauguauuaguuccccucuucugaugacuauaguguagcuaaucacguauuuuccucccucggaguuaguuaaugaugaacucuuucuuugcuucauuacaauauagaaacuggcuguuuacuuuuccuaaagucuuaaggcagaggcaguaagcuacuuuucccuuacagaguuaauuuucuucagcugcuaaacuugugauauuaaugaugaguccucaaauuuuaguaaaauuggauacaaggaaucagaaaauuagaguaaguacaauuauuccaaaaauuauaaugggccauggaauugcuucauguugaaauuauaaucuguaaugcuauuaauacuagaaugaugguagcgcuucucaucuucagagugccucgugagauuaaccacguugguuaccuggugauguguuucgauaaaaucugugcuuucugaauguguguugcagucuuaacauucuugaaaucuuugcagaccaguucucaagaugggauaggaaagcugaauucuagguuaccaagugaaaucggcccgacuccuguguugagacuagucaucuaccguuccuuccauugagacagaacuguugccuguguuuuuacuaguccuguugaaugcaauggaugguauuuugaauuccuggguuaaaaacagaauugaaaaugugaaaugccuuuacagagcgggcagcuaaaguugcugagcagcaggagagagagcgagcagcacagcaacagcagccgagugcuucuccccgagcaggcaccccugugggggcucucauggggguggugccaccaccaacaccaauggggaugcucaaucagcaguugacaccuguugcagguaaaaacaggagcuaagaccauuuuuuuccacuuuaagaaauuccuucauuuuuuuuucuccaaaaggaguaggccacagucuguagccuuuucucaugacagauuccaaguuugaagucauccauguuguccuguauugcuuuucccauacaggcaaggccucuucucuaucccauagcaggcccuaggcccgacccuggcaauugguagauagcagcucuuccuuugcugugggcguggucuggcaauguucuuacuccagacugcucuuugauaaagcacuacagcaggaaauacaaguagaucuugaguucuguucugaggaacuccaaggaaaauauaacagcagucguuaggugguauugauucucugucucaugccaguucaguuugcccuauucugcugcagccauccuuaaaagacugaccacuuaaaaggauuuuugacagugaauuaauaaauccuuucuuggucaccagugugcaugacugcuaaauagggggaaguccuuguucaauucauugugcccacucuguaaugcuuuucuauuuaauuacauuaaacugcauuuucuguuaguaucccagucacauauuuaaauaaaugaauaagaugaaagaaagaaaaggaaaaagaaaugaugaaugugguuugcuuguguguguugucucugguucugguagccauagcaaauuugacuacuguugaauugaaaucuugucugacaugucuccacaaaaagccuguggaccaccucucaggccuuuccuuuguugccucuccacaucuggugagcucuguacaagccaccugggauucuucuuacacaagcagucucaccucuuuugcacagaguccaagacagcuuuguggggacacuguuuuuguuuuugcuguuuuuuguuguugccauuuucggauuuuuuuuguuguuguuuugguuuugguuuugguuugguuugguuuuuuuguuuuuuguuuuugccuuuuuuguuuuugcuuuuagaggaaagcuugcacagaauaacuuucccauuguugcuccuaacuuuugugauggcaaguucucaaaugcacugucgcugaccucagcagcugcacucgccaaagcauaccugagucauggcucucagugcuuucagugugacugacguugaucuaacaaaucucauaaccgccugcucuauuccauggcccauucugguuaaugggguuccagagguuuccagaaaucaggucuugaucauggggacuuugaaaguuaggauucccucauugacaauucuguuuuguucuauuugauguacaauacuguggcacucuguccuugacugcaaaacccaagaacauauauuaacaaaaugaauacauauagcuaaaaugaaacaaaaauuagcagcugcagcauuuuagcucccuguuggggaauagcaucugugguugaggaaggugguccucuagaagaccacugcucuguuacuaaaggugugcugcccaggcuucugggccacaggagugaagggcagagauucucuacaguaaaaagccuuugguccaaaaugagaacuuugcagcagaaaggguaauuuuucauggaauuauagguuguuuaggaccugagucuuagccuucuuguugucugaaaccagcuuugcuuacaagcauugaagcucauuugaacacaugugacugggauaauaaaugccaaaguacaguuuaaugaagacaaguguugugucuuucaguucuuaauaauuuaaucuucaaccacagccuaugacggcugcguucagaugggcuuuuguaauugaaagcaaagccuccuaacauuuguucaaccucucaccuacuuacccuuaaaagcugguccuggcgguguguugaaagggcaguuuggcagcaauggauuucaucguguuuuaagaugaugcuaucuacuuaaagucguuuuuaccucaaacucuuaaaaaacugaaaugcauccuauuucauguauagaaauccuuuuucauguuuuguguaguuguaaguuuuuguagccaguuuagaugugacuagggaggcaaggugagucagucuaggguucucugugugccauagcuuuagaagacuaaacuugugcaaacaaauguuucaaauaccuccucaaagaaaguaagacugaacuuucuucaaagaguauuuuggugcuaugccuuugcccuuccuaggugagaaacugccuaaaagugaccguacuccagagggggcuuuacauuauuuauucagacuugugcagauuccgagucauauuuuguuuuuauguuuuugauaggugaguccucacugaaauuauucuuauuaccacccguuuuccaaaaauacuuguuugccauaacauuucccuagccagauuuuauaugaugguaugcuuggaaaacaaagggacaaaagccucuguccauaggaauucugugccucguuaaugcuccuaucaguugaaggguuacaugacacagugugagccugcagacagaggugacaacgggcauuuucucuuguaguagcagagcugcucuuccuucgggccugcugcauguagguuucugaauuaucuggacuuuaguuggcuugagaaaauuuagauuccuccuuaacauauuuugaaaucuaaagaugaaauauuauuuguugugauagcuguuaguuguucuccagcucaaaccuuaacauaauccauucuuaacagcagugguggagauagaagggaggaguauaugaagaagucuugaaacuuuuuugcucccaaacuggagaaccaugccuugugaucaggacugugcaccucauuuuccccccauucugauuucccuucaugugcacccacgauagggaugugacugugggcagaguggcguaaugggguauguacugaucacuuggaguugcagguggcagaacuggucacugguugaacaguuugcaauaguccuguccuugaggaaacuguuacuagaacucuuuuauuaaaugaaaacauuauguuuagcuuauugaaaauaauuauaagcaauaauuuacuaaauacuaauucauccaaaaguguuggauuucauauuuguaacuuuauuuuguucauuacugcaacaaaauaauugcacuaauugcuguuauaucaugcaguacuaagggugcuuauucauugguagugcauggaggggguuguuauuacuuagcucauguugcauguuaaugaugcaugucugaaauuuguuguguccuucaaggcaugauggguggcuauccgccaggccuuccaccuuugcagggcccaguugauggccuuguuagcaugggcagcaugcagccacuucacccuggggggccuccaccucaccaucuuccgccaggugugccuggccucccaggcaucccaccaccggguaagaacuucauccucauucacucauuaaucucauuuuuuuuuaaaaauucuuuuuccugucucagccaguucuuccaggaggcacguucuacccaugaggccaggcuuuccucacacagaaucccagagcugucaguaguagggacuguccuauguguuaaucaggugaccuaccaccagcagcagaggauguacugcagagaccagauccuuagaucaaggagcuggaggcaugguccauuaucagauaggacguuugaaaagccuuaagggccacagccucuuaucagagaauugccaguucagagucauauguaaaaguacuuuuuacucccagagcauuucuuuaccuagugaaauucuuaucucauagggucuucauuauagagucccuguucuaacgcuuccuccucaguagcccuuuugaaguaaucagaacugcauaugugaagcucucgagcaauccuucacuuuguaacacaguguaggaaggcaaggagcuuuauauugaauuagucuugaguccccuaacaagcauaacaugaccuuguuagcuauggacauauuuguaugucaauagaagccaaaaauucuucuauguaaaaauauauaaauggaacucagaauuuacuacauuauuucacuuuauaaugaaaguuaaaagaugggaaaaucacaaguuuccauaauuuucaucauaugcaaaagaacuuacuuuuggcuauaaucuaguuagggggaaauggacuuuuaaaugacuuggagcagcagucaauccauuacugaaaugucaucgaagagagcccaaacucaugugaaaacucauguggguggagcagggcaggcuuacuuucauuaugcuuggacccauugcccauagaguucuacauggguucaaauaauagugaacccaauaguguguagggaaaacaaauguuaacuccaccauacuuuuuuaaaaauugugacaggaucaggcaggcuggcuuggaacucaacauucaacugccucaccaucccaagucagggaugacaugcaugcauuccacuccugcagugcagccacacucuguguuccuuagaggacggccauaauuccaaccaugcuucuauuuuauuuuuccaauguuuccagaggaagaaauguuggugguauuuguacuucauucaggauguggugacuuauguaaaaugcuguggcaccagaagucaaucagaaaauaaguuuucucauguggcaaaugaacuugguccuaaaucugugcccucauaccuuggcauaagguuucucugugucaguccgugaaaccuuguuggaguugacacuuucuaaauguauauagcacuugauaggauuccuguuuaaggccaguacacaccccaauuuagcagcugcguuuugaugguugugggggcaacacuagccucucuucucuugacuguagaaucuaaacugcuucggaaggaagcacagcacaccugauaauagucagggagacaggaacaacuuguuguaagcccaugcacagcugaucuggcuuugagcaucaaggggcucauauguugucucagcuccuguuuucaguggcuuaccgaaggcauguuauuuguaaacaggaagugggagagguugcugauuugugcugcccugcaaaucugugauacagccaguuuugggagccucccagucgguaggaucuaaggucaaugagugaccugcagggaucaggggccauagguuauaauguguugcugaaacagcagcuuaucuaccuugacuucuuuguucaauucuuaaaucaccaggacauggcugugaugacuggguuacaauuccaaguacuuggcauauuccuuuuuaagcagaaacuuguuucacuuuuuuuccuucuaccucucuaacaaauaaaagaugccuuguauuuccuggaagugacacuuaagaacucuaaaccuucaaaagaccaauuuucugcccauccaaaugggagagagauguauuuaguaacccaggccggccucagauuuacagcaauauuccuguuucagcuucgcaagugcugggauaacaggugugagcuaaaauacacagcaaaacaugagcauuuuuauacaaaggaacagaagacuaggaagcugguuccgccuagucccucuauacagaacaggacuuaugcuucaaggaacagcuuaaaaugauuugcugaugguuuguuaguuuuaauaaacugagucccuuggcuauuuuguuuuauuacaauagcaaacagauagcccugagaugaaaauugacuuaaagacuaaauuugggcuauucuguuguuaucaacuagugccugugagacagcaguugcucaugaacauuuacccaaggaaguuuacucagugauuaccagagagaauagggccacaaagucuuucucuauuccuucgucauuuggaaucugagguaauggcaacaaggcuacacugccuccacaucauccacugaaguaccuucucucugccaacauuagugccugagguaaagccagcuggugacuguaaagacacauuaagguagugacuccagccuccacaggguucaguuaacugcucuuccucagcccuguuuccugucccaguguaauaguuacuacgcagccugaucccacaggcuccaacuacagaagacuauaugauaagaagaaaagcacuuugaaaacagaaguguauucuaacuauagcucacucacucaggguaacccuagaauuuuaugcaggguuuaaaacagucuacgccuagaauguaccucuaacaaaguauacuacuacugugcuuuaaguaaccagaaacaaaagaauauaaauuuccuaauuagauucuuuuuagggugcuuaaagcuccuauccacacucaagggcaaagguacauagguuggcauuuaaaauggcaccagcucuuaucaguuuuucagucaacaaaacccagagacucuaauugugccauugcauucugaauuauaggugugaugaaucaaggaguagcccccaugguagggacuccagcaccagguggaaguccguauggacaacagguaagccuccuaguuuaauuuuccuuggacuugagauuuuuuuuuagccaucuaccuccucagagcaugugcccauuaucuuuuugacauaaucaucugaucccaugcucuuucagguaggaguuuugggaccuccagggcagcaggcaccaccuccauauccugguccucauccagcuggccccccugucauacagcagccaacaacgcccauguuuguggcucccccaccaaagacccaaaggcuucuccacucagaggccuaccugaaauacauugaaggacucagugcugaauccaacagcauuagcaagugggaccaaacuuuggcagguaaggagaguacuguugaaauacacauuuccucccaguccucacuacuucaagcucuuauacaacauccuuguaaagggaaauaaauuauguauuucacagaauaaaacuggguucuuugcauauugacccaguaaaaauaggcuaaaaaaaaaaaaaacaaagcucagucauaucauacuaccaucuucucaaauacauucuaauuuucuuuuucaauuuuucuuuuuuucagauauuuaagcauuagaauacaugucagauuuuaaaaaggggggaauggaaagcuuauuucuuuagucugccaagcuguucacuuaguugaaugggauguaucuacaguauaguaagaugguauuaccuauuuucucgagagaaaauugaaagauucugcuuuuucauuuuaaaaaauaaauuuguguguuuguguuaaagcucacaugugcuuuggucacauggaagauagaggacaacucucagaagucaguuuucaccuucuaccuuauugguacagggucucucuuauguaugcugcugcaguauuuacuauaggauaacugccccuugaacuugugggcauuucucaugucucagacucccaucuugccuuagaagauauuaggauuccugauacccagcaccacaucugccuuuuugucuggaauaagagaugguuauagucugacuuguacaacaaguacuucuaugcacugagccaucucccugauccuuggauuuuugguuuuuguuguuuggcuuauguugagaacuagcucuuaacauguauccuugaaucaguugccuuccucccucucccuucuaagagcugggaguacaggugcaugcaugugcgugugugauauauaaaaugugccacacgcaugccugguguccaccgucagagggaagaaaaagacaucagaucacuuggaacuguaguuauggacaguugugaguguccuguggauacugggaacugaaguccagcccucuacaagagcaacaaaugcucuuagccacugagccagccccuuauuucuaaacccagcuaggaaauguuaucucuuuuaagaauauuaaauaugauuucccuuuaggcaucuuuuauaacacugaagaaauuguuacuaguagggguguccuaaguggucagauaucaaugccuaauaaaccuugcuaugauuauaauuuauaucacauauucguaacauuaauaaauaguuuuguuuuaguauaaauacaucaacccuuaaaacuggggucauuuuaucauccuaaaauguuaacgucuguuuauacuuaaauuuuucagcucgaagacgggauguccauuuguccaaagaacaggagagccgccuaccuucucacuggcucaaaaguaaaggggcacacaccaccauggcagaugcccucuggcgccuacgggauuuaaugcuucgagacacucucaacauccgacaggcauacaaccuagaaaauguuuaaucacaucacuguuucuucuguggaagcaaagaguuguggagcgguagccauuuuaguuacuggggugggagggaggaacaaaggaugauaauuuuuauugcauuuuauuguacaucacacagccauuuuuauauaaggacacuuuuaauaagcuauuucaaauuugguuuuguuacauuaaguugacuaucaaauacacaaaagauuuuuuuugcauauguuuccuuuguuuaaaaccaguuucauaauugguuauauauaguaauaguuuuaucuuuacuuguuaaaggacuuaaaucaucaaagguuuuggcuuggcuuaggguuuucguuuucuuuuuuauaaauauauauuauauauauauacacauauaaaagaaaaaaugaaaaaaaaguuuacaaauuuaaguugacaaugaaaugugaaguugguccuaguuuacaucuuagaggaauguauauguauguuuuacaugccuaaauaucugcagguuuucuuacagguaaagcgaagugcuuugaaaaguuuagauuauacaugugugacagaugcggcauauuugcucuauuaacacagaggcuuacuauagaaaucuaaagucaaugcuguacauccauccaguuaguguaacugaagggaaauguaacuuugugcugaguuagacaucuguauugucagugauucuuguagaauaugugcucagaucugaguuauauuuaguuuuggaagguaaguugaagaguacuuuugaucaguuuaugauucaguuuaugauuuuaguuuuugccuucauguuauacauuuaugauuugaaacuguacaucuguuaccuugaaaaacauugaagaaaguacugaagugugcauggaggugguuuaagcauaauacuuaacccaagaaagaguguaaguggacacaagcugugccugcacauagcugugcaggguagacugccuacauacacauggccgggauucuuuauuuccuuguuaucaauuauagugcuuuguuuguuucaggguuggaauucucaaccagaaauaauacuuucuaaaauauuuuaaaauucagcuugugcuuuggauuauagaaggaaauuauacuuuaagaaaauguucacaaaaaaaaaaaaaaaaaaaggacuauuacagaucccaauacuuggauuuggugaccuugucuuucuuucuuuucuugagacaugguccuacuaccaacccuggcuggacuggagcucaguguauagaccaggcuagucucaaacucugccucuuccucccaagugcugggauuaagggcagguaccauagugcucagcaaccacaacccugucuuuccaacacggcccuagcguaagcacugaggcagugugcagugcucaggcagcagcaaacauuucccgggggugguuuugaaccugcuugggugguuguguggugcugacgcugccacugcccuguuguucauugagaaugauuguuaaaugacacucuuccuuuagaauauaacggaucaguacucauguuuaauugccaugcuuaauaaaucaugagaacaaaagaguauagaauggaaagcauucccugguagcuacuuuaaauacaggagcccuguaacuuaauaccaguagucaaccacuggaucucaguuuucaucaaguauuuuaaauaaauaaucuuaaauuuuaaaauacguacugcagaguaugccaguaucuuauuguuaaaacugaaucaaauaaaucuucgauuccugguuauuuggaccauugacucaucauggacuauauaauguaauaagauucuuuucucuuaagguauccuugaauuacaccaaagaaccagaaacuuaauuuugguuaaauuauuuauuuauuucaugcauuaauuuucuuuuucuuuuuaaagguuuagaugaggcuccuuagggagucucuaaaaccgcuucacuaucagcaaccaggaguacuagaagccagagcacucuuccuccuggcuccuccccagugcucuagugcuguaggaaccaagagccagccccagguuccccgaggcaguaaaaauccagcacagggggcugugucccuaaggcaagcccugauuaccuuuaaaaaaaaccaaaaaaacaaacaaaaaaaaaaaaccuaauuaacuaaagcauuuaaggcacuauuuauuuuagaaucaugcuuuugaagagcaucagugauuacuuaggguguaauauguaaagaucagacaucuccaaaaacagaaaaaguacaaguaaacaacacacuuucucaugacuuuuaagaacuguaguaauguggcuuaggaaauauaauggccuaauuguuuucaaaauguaaguuccugugaagaauuuuguuuauauuggguuggggaccuauagguuuaaaauagaaugucagucagcugacuuaaaaaacauugguuuuacuaagucugccuuccccuucuaaggaagaacugaguggguaagggacagguguguaaaaucuccaaauggauguuacagcuuucagcuugaacguuuguuuccagaccugauuaaaauuugguuuauucuaauuucuguacuauaucaucugagguuuuaagugguaacugguucuauaccauguauguaucauauguuuguucaucaaagcuuuuuaauccaaauaaaaacaacaguuugcaaaguga

SEQ ID NO: 12511 - RNA, 8442 nt, Mus musculus
cgagugacgcggcgcggcccguugucugugcggggcugagaagcccuaagggcggugggcgcucccgguugggggcggcgcggguuuagcagggccuggacauggcgcugagaggccgcuccgcgggaagaugaauaagggcuggcuggagcuggagagugacccagguacggaggggccucggcgggccgggggcuggggaggccggaugggccccggacgcaccugcaugacaaaucccucuucuugucgucccacccaggccucuucacccuccugguggaagauuucgguaagaaccccguuacccacgaccuucggucccuggcugguguggauguggggguugguccuugaguucucgcagcagagccugggacugcccugccgaccucuccuuuccugaucguaggugucaaaggggugcaaguggaggagaucuaugaccuucagaguaaaugccaggggugaguggcugggacgcccccuuaccuccggagggccgagaaagggcaggggaauaguaccccauucaagggaggcaguacuagaaaaccugagcuauauaaaauaucacauaagaaagugucacucuuugugggugcccucuuggacuuuucuuuucuucucagucuuuccucaguguuucuccuuagaaagcuguagcccuccuuuuaacccuaagcacucguggaguacaguugagcugccuuucugguuuugcagccggaacccuccguugcauaguguugcaccuuuuuuguaaguguacaguccauuaauuacaucaccacaugugcugugccuuuaaucaccacacaacauuuguccugaccauuaguggcgcucuccucuagucccaaugcuugggaggcagaggcaggcagaucucugaguuugaguccaaccuacgcuacuuagugagaccaugugucaacaaaacugaacacaguuguccuguauugauugguuagugugagaaggccuuuuuuagguaccuaaacucagagucuuguuuuggaaaucuauagaauagaggcauagagaaccuaacugcuuccaagggaaggaacugguuugggaguucacgcacuauacucauuuuacuaggacuggaggccgagguccaccagugaguugguacuuaauucuucaucaacguuuuugugccuuuuauugugucccuaccuugcuccauccugggccagcaguuccagauuuccuucuucucuugccuagaccucauagaccgagugggguuugagagcuucaggcucauacuugacugccugugauaggcuucugggguuugaggucucagagccauguuggauacaguuugguuaagagugagggacucagugcaagagcauuucagugcaaaggauuagggagagaaagaaggggaugcugauugucaucugccucuugcuucucuaggccuguguauggauuuaucuuccuguucaaauggaucgaagagcgcaggucccgccgcaagguuucuacguugguggaugacacgucugugauugaugaugauauugugaauaacauguucuuugcucaccaggucugcugaguucugcgcuuguuucgggccaggaugcuauuuuugucuuuguuuguuucugguauuguguggaagguggcagugggggagcaggaagaagcgcuagacuggaaccaagagaaacuguugcagaaacccuguggcagacagaccuaacucuuuuucauuagagggaauaccucuguaguuggugguguuuuaguacauucuccaugucccuagauaggagguauuuuaguugguucauguuaaaugaauaaagacuggguaagacaaaggaaacuaaaggauguugacaucuuucuuuuuagucuucauucucaauaagugugggcauggggaugucugggguaaagaguauaugagguauaugagugauuguuuuugauuuauagcugauucccaacucuugugccacucacgccuugcuaagcgugcuucugaacugcagcaauguggaucuggggcccacgcugagccgaaugaaggauuucaccaaaggcuucaguccugagguacgcugcaguaccuuagaucaugcuuacagauggcugggcacaucugauccucagagcuauugguaaugccacugcaugguaucugguauuuuuuggucauuucuuuuucaaauguuuacuaacaucuauuugacucauaaguaauguggaagguaguugauuuuaggcuuugcugcuaaaugagaugauagaaggaaaagacuuaagugaucugggucagaccuuuucuguuguguugcuccccaguagucacugauggcugugcacggccaauauggcccaucucuguaggaaauccuaagcaaggucucauuugccaccacugcccuuucagaacggucaucugugcugcuugggauuccuggaaugccucuaagccugcuuuauggaacucuuccccuauucagaggcucagcugagaaucuguauuuauguagucuucuuuuauuuuuagagcaaaggauaugcaauuggcaaugccccugaacuggccaaggcacauaauagccaugccagguaugugagagcuaugguugcugauguggggucggggugguggaggaugucucugauuuuguccuuuuccaggccagaaccacgucaccuuccugagaaacagaauggccucagugcagugcggaccauggaggcguuucauuuugucagcuaugugccuaucacagggaggcucuuugaauuggauggauugaaagucuacccaauugaucaugguaggccuucugaggaaggggccuguuggguuuuucaugcuuccuucugauuuucugggucucagggacuuuagauccuugagauguaggagcgugaguggauaccagggacaucuaacucuugccaugguuucaucuuauacuguuuaugugucuagcuuguagcuucucaaccacacgaaucuguuaacccuggccuaccccaucucaggguuucccaccugcugauuccucaucuuggucuucccuagggcccuggggagaggacgaggaguggacagauaaagcucgaagggucaucauggagcgaaucggucuugcuacugcaggguaagaacccuugguuguguccuucuggagcuauguccccuuuggggggaaagagagaagcguaaugaucuguagauuguaaggccccaugguaucuggcaagaucaggcuugggguuugggauuuaaauuuuagguugccuguggccugcucugggcugggcuggaggagggacaagccuugugugugugugugugugcggggggcguguuaagaagcacaggugugcuggcuuacuuccugacaagccucuaucagagcucaugggaagguguagcuggguuucagaugugugucuggcugcucgcugccuauuggaguggagccuauacuuagagcuacagaugugacugugagaggagcucuggcaagacacuugccucagucuuaacagcaggucaggucuggggugggaacuccucucaugguugccacugugauugcagggagcccuaucaugacauucgcuucaaccugauggcaguggugccugaccgcaggauuaaguaugagaccaggcuacauguacugaaggugaaccgacaaacaguccuggaggcccugcagcagguaaguugccuggcuuugccaacccagugcucccugucucuccuacauuuuauuuaguaucugucucuaauucccaaaucagugucuuguagauugaggcuuuaacuaaccauuucuuuccuuugcuuccuuuguaagggugguagaacuuaacuucuaaaacgauguuguggcuuggccuuuuuauuuuccaauaaauaaauaaauaaauaaauaagcaggcaggcagggucaaggcccuuagcuaucuaugguggaaaccuggcucuauccuucucuccuaagcuugaguuuuguuuuaagcugauuagaguaacccagccggagcugauucagacccacaaaucucaagagucacagcugccugaggagagcaagccagccagcagcaaguccccccuuggacuggaggcaggcagaaccccaguggccucugagugcacucagacagguacuagagggacuugggcaucagccauccaucguagcuugacauaggaagcacaagcacuucaagaagguacuugguacaggggcucuagcaggaggccugaaaucccaguaccugaagcuuucccauuaaaacagggagaguagagugagauuuuccuaaaggauacgugaaaaggacuaucaugacccuagacccacaccucucuguauugggugguccaucccaucccauaccucccaccccuauuauuuuaucuauaggcugccuucuuguugugucuuguuuuguuuuuuguuuuuuuuuuuuuuuuucauugugugacuuagagcuuaccugccuaugcuguuugcugucuucacugggggaaacaacugucacaggauuauggacuguagcuuuucuuaaggacacagcugaauguccuauuuauacuuugccuugucucagauggugcagaggagguggcugguucgugcccacaaacuacaacccauaguccucccagcaaauguaagcugguggugaagccuccagggagcagccucaaugggguucccccaaacccugccccuauuguccagcggcugccagccuuccuagacaaucacaauuaugccaaauccccuaugcagguaagauggaaguacccucaacugagaggccacaauguugguucccaguguuauucuuugacucucugauugguucuugaugaccaggcuccucuaguacucauaggccccaacagagcgcauggccuuaagguggcuaagagagcugcuucucugacuuuuaaguccaguugccugccacacaguuggguauacuccuuggcacaugggaaaguuucuccugguaacucaaaaguauguggcaaggcauucuguuucuuuuagaagcacuucgcacagcuaagagccuaguuaucuuccucccuagcugcgauaccaugccuggcuugggugagcucucucauuaccgcucuugccugccccaggaggaggaagaccuggcggcaggagugggucgcagccgcguucccguccgagcgccccagcaguacucugaagacgaggaugacuacgaggaugaggacgaggacgugcagaacaccaacccugccaucaggucaguccugacucggagacggugucaaacucuggguaccucagauccuguucucaauauuccacccugcgucugagagaacaguagacagaaugcaggcccuggaggaggcuggcuugaggggcuaacccauaaguuuagggggagguaaacaucuuaccauguaugugucaguacauuuuguugaggugaucuuucagcccgaccucaaagaauuaggguaggagaagagguuggagagaugauuugcugaguaggauggcacuuuuguuggaggauagagcacuagaagguuagaagugagauagcuagaguagaggaggccaccugccuauacucuggcacuuaggaagcucuugcuaagagauuguuuagaccaaguguaagagcuuccauuugggcuugggaagaagauacuauauuugagccauucuggacacugcuggguguggucaccuggcccauucccuguuuuuaccucuuauuggaccccacagauacaagcggaaggggacagggaagccaggaucguugagcaauucuucagaugggcagcugucagugcugcagcccaacaccaucaaugucuuaacugagaagcuucaagagucucagaaagaccuuucaguuccucuguccaucaagacuagcaguggggcugggaguccagcuguggcugugcccacacacucgcaaccuucacccaccccuagcaaugagagcacggacacagccucugagauuggcagugcuuucaacucacccuugcgcucgcccauccgcucggccaacccaacacggcccucuagcccugucaccucucacaucuccaaggugcuuuuuggagaagaugacagccuacuucguguugacugcauacgcuacaaccgugcuguccgugaccuggguccugucauuagcacgggccugcugcaccuugcugaagaugguguacugaguccccuggcacucacaggugggccuuggacucccucacuggucacuugguguacccaaggaggaggagggagguggcccggugacuacagaguaucauguacucugaugcacccuuuuauuccucucuagagggugggaaggguuccucaccuucuaccagaucaagccaaggcagccagggguccaguggccuagaggagaaggaggugguggaagucacagagagcagagacaagccugggcugaacagguccagugagcccuugaguggagagaaguacucacccaaggugagugucuuucagccuucuccuagcaggggaaggaccugggccccuacucccagguuuuggguacuugauuggaauuuuggagugaaaguugguggcuaaagccagggagcucuuugggauuggauggcauugguagcccccuggacuguggcuguucacccuuguuucuaguugcuucuuaguaauggagcuuuggugccagucaggccccuaagguauacaauguuggguuguggcaggagcugcuagcacugcuaaaguguguagaagccgagauugcaaacuaugaggccugucucaaggaggagguggagaaaaggaagaaguucaaggugggugaccccucuacugcccaaggacagcugcucugagaagaugggcugggaugcccucaugugccuucuuuuucacagauugaugaccagcgaaggacccacaacuaugacgaguuuaucuguaccuucauauccaugcuggcucaggaaggugaggaggugccuacuaugucuuaauuguccuacccucuugagggucauguaccucaaacuccucccccucccucccccaagacuucaccuuuggccgaugagacucaagcucagggagggcugugagagccugggagacagccaccuacuaaggaguuuccugcuuuacacaggaaugcuggccaaccuaguggaacagaacaucucagugcgccggcgccaaggggucagcauugggcggcuucacaagcagcggaagccugaccggcggaaacgcucucgccccuacaaggccaaacgccagugagaaccucuggcccugacucugcagccucucuugccgcaaggcccucaucagggcccuucacugucccucuuuuccaaguauuacugaguaguucaacgagagcccagguccugggagugggagugacauguauucugcacugugcucuggggucuggcagggacaaggcagcuccucaaugcucaggaagcagcagcuggaacuggagggcauccaccauggccuccacagccaucugaggagcagcaggaccuggccuuucugccugggcagcaggauguacauucuaccuauuggagauguuuagguuuugggcuuuuguccaucuugccacuguauuaacauggcagcuuccugacucugcugucucucccagcagcugucauucugcugggccaggucucuuagaauacaucacagucccagcugagaaacacaccaccacuagccuguccucguugggaagaagcuuggccuacacuucauuccucugggagagcaccaaacucagggaccuggcugcugagcuggaaugggcaugggguauccuaauaggauguacagccuaucagggucccacggcuauaguggagacaaguguuugaacugucccaguggcaugcagacuguccuguuagugagucagagcaaggcucuggggcucuuugccuucaguguuguggcccuggccaugggucugccuuaggcuccuaaucucugucucuggggcccaggggagccucgaccuagccccucaguauuaccaugucuucucuuaggaauaucagaggcagggcugcuugaauggagcugguacuauucaauucucccgacugugccagcuuccuuguccucuugcaagguacucaggguagggacaggguugagaggaguuagaacuucuguauccccauagggcuugguaguaaguacagcacugcuucaaaauccagcccccaaaagcccuguacccucugcuagauacaggcgauccaagcaggccccuuaucuguacauagugacuguaggggaccccucuaguuucuguaaauauugaaucagugagugaauaaaaaugugcuaauaaaug

SEQ ID NO: 12512 - RNA, 91480 nt, Mus musculus
ccgcgcgagacgacgacuguacggccgcgcgaggggcgaccgggcccgggccgcugcacgccgagggcggaggccgagccgggccccgccgccccgcggcuguccgugcccgcccgcgccgagcgccggaggaugaguuucucgggaucccggugaguuggcggguggcgacggagugcgggugcgccgcgggaggccggcgaaguuugggggcgacgguggcggcgcaggggaggccgcgacgcgccuccgcggggccugcgggagagaccccccggccccgcggcccggcccgcccgcgcuugcccuuuuguucgccuucgcaccacuccggggacgcuucuggaagccuuaaaugggaacggugcucugcucccgcuccggagcugcgcggcggcugcugcggggacugggucucgggacccugcuagagaacgagaacgaagcguguucagugcggggacggaggccgggcgaagugcucggcccgcccgccaacuuggcugcgggaaggcgccggguuucccccuccgucccugcgaguugguucaccuguuguucugcgcggccuccgcugccaugucuguugugauucugcacuucgauuucguaaaacuuugugcuggguugcguuacauccccccaacccccguuucagacuccuagcggaaagaucuggcaaagaaaaggaaaauuaaaaauuaaaaaaaaaaaaccaaaaccaaaaaucccaaaccuccaacgcggcagggaagaaaaauaauaacgccguguguuagucgugccuggcguuuuugugacuuguaagucgugguguggaucuuuuucauuugguuaaagagcugcaggcuuucucuuuuaaacagcuuacaaaccguucugacuacaugauacgaacuuagcaccggugucacgccauuuacuucuuaagauaacccugguuauuguauucuuuguugcuuuagaagaggaaaccgagacgcagagguuuaaauaacuuagauaagugagccgggauugaacccagggacgucguauucaagaguauggccuucuuacuaaagcaaaauugugcaaagaccuaggagcguugucuaguuauucacgaacuccuguguugcuucaguuguaaaccgacuuguguuugcucgugaggggaaauuaaacuucgagauaaaauaaaagguaauuuaaugcuuaucauuguucucgaacuaaaagauguugaacaaaacuaucuuaguuuuuguuuuuuuguuuuuuuuuuagugucagaacuaaacuaugaacacuucuugggaacccagaguuuauggaaaacagauuuaaaauuggaauggguuuuuaauuaaaccuguacucuguuuuauauccucgccgccgcccccccccccccaaaucuagggggagaccuuuuuaacuuucuuuccuucucccuacccuuuuaagagugaagaguucacugguugaucuuugguuuggauuucuucuccauucuauuuuccuucuagaggaccuccucccacuuacuaguuaacauuuugauucauuuccuuuucuuaccgauuggggcaugaauuauccucucuguugucuuguuguuuuuguuguuguuguuccuguuguguugauacagaguuucaauacauagcucaggcuggccuucaaguggcuguagaccaggcugguauuggauuuuuaaaaguacacauguacuuaggaucuuauaguuuacaaaaacuuuucuauaauuuugcucuucucucaggcuguuauauuuucuuuucaaaucauauuaacauuuugaaguuuuuucuuacaaaaguaauaaauagucacuaaagagaaauugcaaaauagagcaaaauugaaguaagauuagagugcagucauccauaacccguccuguggaggcugccaggaguggacuuauuuuuccugcuccgacucuggugaccauccaucgacuuaacuccuuguugacaggauuucacauucacaaaggagcuguagcuuagucccaucuaaacacuggacuucucacccuuaaaacagaaccuugccauguuuucaucaguguuucauuggagggauaugugcuguauucugacacacuaaggguggggggcaaccacacauauugucccuggacccguggagcuuaaagucuagugggggagacauguggaaggaugaguucuauauaauuaaguguaauugugaugauaauuaaaguguaggguauuauacaggcuuacaguggagaccugaccuggugcuggugcugcuuagagaaucuaggaagacuucucugaacauguuacuuugcauucugacauuuguuagggagaagaaugaagugggugaaaagggggcgucagugccauggcgaccuuauuccccuuugccuucuuucuaccucuguucuuccuccuuucucuuaacgauuuccaggucucacuuuucccaucacuuaaaaaaaaaaauguuucuuagucccaugaauuguuacauucauuucuguguguaugcuugcaggagugagccuuuccuucuaccauguggguccuggguucaaguuccgguccucaggcuugguugguggcaggcaccuugaccugcugagcuguguggcuggcccgcccaugaauuacuguucagauuuuucugucugauuauuucucaaauccugauucgucucugaacuugagucuuucuggugcuuuauguaaaacacugugccuggcaauggagcuuagaugagcucuucccuagcccuggcuggcuuacggugcucugucccugcuaauggagcaagccuaacucuuuccccaggccuucccauccagucuguaggcaacagcuauacaugcugcuuucuuuccugauacccugacuuucuuuguauuccugccaacucugauacaagucuuaguuuguguuaguacagggaauuauaauugucacagaaucauagaguagcuuuccuucuugcucucuuuucaggagcaguuugaacugggauuguuguccuugaauggcuggcauauacauacauacauagauacauacauacauauauacauacacauauauguguguauacauauauguguguguguguaucuguguauguauguauguauauguguguguguguguguguguguguggaggaaggggguuuguggaaaaaaauaguguauauauuuuuuuucuugauugauugugugccuuugugggcacauguguggagguuacaggagauuucauaggaaucaguucucucuaccacguggggucuggguauugaacgccacugggcaggcuugguggcucgcaccuuuauccccgggccaccucacuagccccaaguaguguuuuguuuuuguuuuuuguuucuuguuuuuguuuuuuaucuuaggaguuuaaaacagcccuuaaacaaccacauagagguuucugggcccgggcugcagucagugguagagugcacacuuguauagauaugaagcccuuggguucagucuucaauaccaaagaucauagggagaaaaaaaaaaggaggcucuuuugggaaauuuuucuguauggaucuggaauucauagagauuugggcuggaggaagacaaucuggagugauuaucauauagauuguguauuuugacagcaagauugauuggguaguucucaaaagugacuuucuugcaguuugacaagcccaauguacauuaagggaagaaaagcccuauccccaccauauuaaaaagaaaccuagaaaugagugugacugaaucuagugguguaauuggauucugucauuuugguggguuuuuuuguuugcuuguuuguuuuguuuuuuugucaguacauuuucuggcagaagagggucacugguaacuaacuaugagcuuaccugggccugccuacuuucaggagaaaggaaaccuuuucuaguugcauaaaucuguuuccuacagagaugauuaugcguggagugucugggccuuccuuauccacuuccuuacccacuucucucucaagaucuuuucagcaccaccuguagugguccuucuagaaccacguggguugggccaaugguaguuuuccuaaagauagcucuggagagagaaggcaaaauccauuugguucuuagccuucuaaggguaauucuuuuagaaucugaagaaauacaaaauaauuuuggagcaaucucaugguuauacuauggacuucuucccagguucuacugauauauuuagcaaagaucacaagcaauagcagcuuaaggccugaguaaagagguugacagcaagcaguugucuaacuguaguuaguuaagaucuacauaggggacguugcagggaucuuacauuaguagauaacaaggaaaccuggcuugucuaccacacaucuguucuagaaugugauuuguagaguaaggauguuugugauguguucagcaguuuaaaacauuuuuuuuacaauuaugagagcaauauaucuaguauggauaauuugagaacuauaaaaaauuauccaaaaagcaguaagacuuugaguuucccauuuggugaaaaugucuggcacuguuuguuucuauugcaguguagcgcugcagucuuggauaucacaagaaccuguuggaaucuguugguuucuugucucaaaagucaaagagaacaugugaacucucaggucauuuucccauugcagagaaagaaaggaaaggaagagggcucaucuugauguaaaccugaguucuaggaagggauccacaugccggagggacagaaccuaccccuacgaguuguccuuuuacccccaugaguguagugcacugcugcucaauguaguaaaaacaaaacaagacaaaacaaaaaaacaaaaaaaaaggaaggaagaaaacuuccaugacuucagugcagagcaguuaguugcugauauugcugauuaugcuuuggguccugauguggcauugcuggguuucugacuuuugccagaaaagccgcucauuuagccuuggcaguguuuccaaguaagaaagagcuuaugaccagugauguucucuuggugaagaaaaaguacuuacagauuacugaaaucguuuuacucaucauuuguccuuguuaaauguuuuucuuuggcuuauuagcuuacaguacaaaaucuaaaucauccaagacugccuuucucuggcucagucugcauuuccuuaggcauuuacuuccuacuauuuuguuguuagccuaagucaccuaaauauuaccuuucuagauuuguguuuuaaauauugagguuuguauugauuguugcaguaccccuuaccgugugugguuguuagccauuugaaaucuggcuaaucugaauuaugccauaaaguauaaauuacaguacauaccagcuacuauaauagugcaaaaauguaaaauacccauguuuucaaaguguugauuacauacugaaauauuauuuuggauacauuggguuaaagaaauuacuauuuaauggguuuuguuaugguuuuugauuuuguguuuuugaagcaaauucucccuauguggcuuacaguaucccugaacucugagcucacaggccuguuggcucaauuuucugaaugcugagauuauagguguaugcuauugcaccuaccccuccccccuuaaaaucccuuucuuuaccuauuagaaguuauauaucugugccuaaggugaaguagggugauagaaugagauauucuguaauccuuccuuaccucccauuacaggcauagggauuagugucauuuucuuuuuuuuccuaucccaaaauaggccaauuaaacauuuuuucuguuuccauugacuauguguggguacuuacuuuaugucaauacauuuugauuucuuuucuuucaaaauaauugauuccauuuuguggauaugcuuggauuuuauuugcuuuugggacagggccaugcuguauagcaguggcuggcuuuuugaacaaguggcuauccuccagucucuguccucagagauaugauugcaugcagguguucaccauuaugccuggcucacucgucccauauuguuuaauggugaaauuguuuccaguuuuuucucuuggguuauaaguaguacugucuuucuuugugagacuauuuuguagaauaaauuauuacauaugcaucuucucuaagagaaggugugcaaacuucauagaaguacuuacuuacucuguuagaucuucagaauuuguaucccagccgacaguguuucuguauucuuccuuguggcaaguaucguucuguuuucacuuuucuaaucugccagcucaaaggugcuccugccacauugcugugcugagaguugcuagcuucuuggugcaugaauuuuguucuaaaauauuuuguauugcuaacaguguaaaugaaauaccuuguacaaagaaagugcauacauauuugguucuguuaauggcaggaggcuccaaaauaugcuucugugucauaaaaauuacuuugaccugaaggcauuugcaaacggaauuuuauccuaaacuccuuuccuuccugaaacagagcuuuccagaagaacucacuugucauaggcuuuuaagcuccucuaguacucggauggccggaaagcucuuccuuuuggaauugugaauaaauuagggaagaucgacucuuacuaaacauauaaacagucauggcuaaaaauccagaucuccacuuacggauccuaaaaguuacuuguuaggcucuuucugucgcuugaguuuccuugguaagaaguaucuuacccguggcuauccuccagucucaguccugagcgauaugaucacauccagguguucaccaucaagccaggcucaccaguucgguauugauuaaugguaaaauuguuuccagccuuuucucuugaauuauaaauagugcugucuuacucuugaagguggugugugugugaguuuaaugcugaaaaucuaguugcugaaacuaaagaaagcagaggaaaaccuuuucucuuuuguaauggcuaaauucauuccuagucccaacaacaaaguagagauaagaaaagagaaguuucucuaaaaauacuuuaaaauaauauuauuuaaaaauauauauaaaugcuuuaaacaugaguaaaauugcuuuaaacugaauuuuccaaaaucuguucuccaaaaugaaagauuuguuaagugucguugaguguucuauuagauguauuucuccacaacgucuucccucuuagcauauauucuguagcuguaacacuauuuuuuuuuuaaagauuuauuuauuuauuuauuuauuauauguaaguacauuguagcagucuucagacacucagaagagggggucagaucuuguuacggaugguugugagccaccaugugguugcugggauuugaacucuggaccuucggaagagcagucgggugcucuaacccacugagccaucucaccagcccuguaacacuauuuuuuaaaugaguggcguaauaacucggaucuaauuguauggcaucuuugcucuucuuaaauuuauuuucauaucaauuuggcugaaagaguaaauugauuguccagguuuuucugaucauaucauugaggaggaaugacaaagucauuuaaguuaaauuucuuguagauuuuauuuuuauuuuguguguuugucugaauguaugucugaaccauggaugugugcugcucacacaggccagagaggauguuauccccugggauugaagaaaauggguuucucucuccaggccauuaucaauugcaaauagcuucuuaguuagggcugagauucugugcccacuugcccuucucugugcugagauuuuuaucugguuugaacuugaguaggucuugugcuugcugucugaguucauuugugcaucaguccuguuauuucuggaaaauacuguuuccuuggaguaguucaccuucucugccucuuaagugucauucugucacuuccuuccccccccccccccgagacaggguuucucuguauagcccuggcuguccuggaacucacucuguugaccaggcuggccucgaacucagauaucuacccaccucugccucccaagugcugggauuuaaggcgugugccaccacgcccgggucauucugccucuucuucugcauagguucuuuagccuugagaggaggagccggaagagccauuuagggcugaguacuugaaagucucucacucucaucacauugguugugagucucuauguuagguaaaaaggaguuucucugauuaggguucagcagugcacugaucuauugguauggcaaaacauuaucaggaguccuuuuauugguauaaucauuagauuuuuuuccccgagggccugugaccuaucuggcuagucuuagguucuuuuucucauuaacagugucaaguaugguucuaucacauugaucaggcuuaaauccgaucagaugguagugguuacucguggaacauuugugccauuauuguauuaguguguauuuugaggcagguugauauuguagcuuguagguuuuguagcugggugagguugaugaccacgucucucuuucagaagcaugucuauuguaaaagugaagccaccaguugagugcuagugcuguuucucaaugucugaugacauagguaugugguggagaguaacagacagcauuggcaacauccuguaauguguguguguguguguguguguguguguguguguggugaucuaagggaccccguuagccuauaccuuaaaaagauguaacccauucuugauccugggauuuuuauuugauauaauauggugucuaguuggggcauuaccucccccauuaaaugauaaguaacuccauuuaaauacuauuuauauauuugcauauaauguguguguaugaaugcuucuacagcaguagguuuccauaaaaaaguuuaauuaaaaaauaaaucuggucagguguucuguuuugguaaauauugcugaaugaauccaacguucucaugaacuuuucaugaaaaaaauagcugcuggagagggagcaaaaguaguaagaaaagguugacuagaaguauccuacucguuacucauugaaaaaugcagggaguuaagguuagagccucauacacacuaggcaggcuuucuaccacugaccuguauccccagcccauggaaguacuuuaugugggaagacagcagggguaggaacuccccuuuucuuaggguccuccuaaagacauguggacaccaaguuccauuuuauuuuucuguaugaagcuauaaugcugucauucacaaucuuuuggucuuuucaguguuguuucuaaguguguucugauuauauaaucuuagcaugagauguauuuucauuuugcuucaguuuuaaaauguaauguaaaagaauguuaauucuuuuauauaguauauuaagucaaauauggaguuguauaugaaauugagauauacuaaacaauacuuaacauuuucuuacuguaagaucaugagaucauuacugugaauccuacauaugaaccucuuuaaaucccacgagugucugugguguaggugcuguuaccagcuccuuugacuggugaggaaacuggauaugcaaagguuagcuaaucuucaagagcuacacaacuagaacaugguaggaauuucugacucacucugcauaguuuuuuaaaaagucacaugucagaagcuggucuugaacuucugaucuaccacugucuuccaagugcugaguuuauagauaugaacugcuaugaccauucuuauuuaugauuauuuaaaaaaauuuauauuuauguguaugaauaguuugccugcguguauguaugugcacugcaugugugccuggagccucccuggccaaccgagguaucagauccccuagaacuggugguguagacggcugugagcuaccaugugggugcuucggaccaagcugggguccuccagaaggugaguguuuguaacuacugagccuuugucuagugcccccuacuuuauauuuacuuaugugugugugugugucagugucuguguacagaugugcacauuugugcugguaccugaagagagugucaggucucccagaguuaauagguaauuuacugaccugggugcugggauaugaauccugguccccucagagagcuguauagauuuuuuuuuuucucaaaacaggucuuugaaaacaauguuuuuuuguuuuuuuuuuuuuuuguuuguuuuuacauguaugaauguuuugccugcauguaugucuguaccacaugcaugucuugcugcccaaggcagaagaggguguuagaucuucugggacaggaguuuucagaugacagugagcugccaugugggugcugggaaucuggguccccuggagcagccagugaauauaacuacugagccaucucugcagccugcaaagcagaugaggcuaacagaacagucgggaacauaggaaagccaugagaaaaacagaacuccucauccuccuacucacagccaacaucuguaaauauaaauagacauacuuuaaguugaaaucauuaccuaguguugcucccauaacuuaagauuaaagaaacuuaacauagcauaacuuaaaaugaaagaaacuucagaguaagggauaguguguaaauacaaaguuugaagauguuacugggucauaugcaguuauguucuccccuacauucuugcuggugguguuguugugguuugucaucuuuucugagauaggguuucucuguguagcccuagcuguuccagaauuugcucuauagaacaggcucccuucaaauucacagagauccacccgccucuguugagugcucggauuaaaggccugagccaccacugaaauguguagcucuugcugaacuugaacuggugaucuuccugcuuccaccuccuucagcaaauucuuccugccugcaucaccaaacuugagggagguaaaaaccagguggugucaaaaaacuagaaccucuagcccaaagaacauaguccuagcaucugcugggccccugugcauuccguacgcauggguucucuugcagaaauagcauuuuuuaaaaaaagaaaacuaugucugagauacauuaaguauauauucauaucaguaacuaugguaaguuuauuuuuaccuuucaauguauauuuaauucaucuuuaaguauacuucuguuuccuaggagucauucagauuuuuuuuuuuucuaaaaauaacagcacuuuuaggguauuaaauuuagauuuccugcuuauaucaucagugcugaaucaauaucuuaugagauuacacaucaggagcucgucagugguacugacaugugauacuguuguauacugcuuuaucccucaggaguccagggugagcuuggaccuugaaccagauugguuguaagaaagcaugagaaaacuuuagguaacucaguagcugggaaggaguacaaaaaguugucagcuauacuuuuuaaugggcagacuuuuaaaaacuaagacuucaaaggaauuuaugauuuuuauauuacacagauuuaagggaaaaaagagagagaagcuagucaauuagacuagcaaaaucagauaaagacaguugagagagaaagaggagacuccagucaauuaaaacaugugcuagaucucuagacuaaagccacccaaggguugaaggguaauuuuacauuucgaaacuauaguaucauuuacacuguauuaggaagaccaguuuaguucaagacaaaaaaaaaguaaaugaaauugaguaugaguauuagccccuacugguugcucuuucccucucucccucccuuccuuucucccucccuccuucccuccuuccuucauuucucuuggguguuugagacaggguuucuuuguguagcuuuggcugucccggaacucgcucuguagaccaggucagccucgaacuaagagauccaccugccuuugccucuaaaaauguugggauuaaaagcaugugucaccacugcugggcuaugaaugcaucuuuaaugccauuguuacuaauagaagcuuuagcuauuggaauauuagaagcuaaagaaaagguauaaggcugaagagauugcuuagugguuaauagcauuuauugcucuugcaaagggauccgagauucacaaccaccuguaacuccagccucagagggaucugauaccucuagccuccauggguuuuaaaagugugugugaguguguccuuuuuuuuugaggggaaagucaagaguguauagagaguauaguauuuaccaauguauguugccagguauacaguguaccuaagaaaaaaucaagauggccaacugagaaacuacuauuaggugacuggacuaugaauauagugaacagguuuccuauaggccagaaauagcugguugggacuuucaccaguugcuucauuugcuacuugugccugcugaucuuuggccuacugggcaguuuccaucccagacaugcuuugaauggugagaacgcucuggaagauaaagcuuucaguuuccugcuuaccuccacagaaaaaauccguuguuuugaagggucagugacaaacaaagucugguugcuuuuugagugcacuuagagagccaaaacuauacucuggugcccaucaguauaaaaacaaacuuaaaaagaaguuuauagucagagggcauguagcacugaguagccuggaaucuggaagguggaagcccuguuguccugcuagaagaauucgaaaaaguauauuaagagaaauugaaagaggcuuucucuaaaguuagcguaagggggaaaaaaguaauaugagggcuaaagaguuaaauaagagcugcucuucuagaaaaugggauuuuucccccccuagcacccaccaucuagcuuaaaacugccuguaacuccagcccaggggaucugaugccaccuucuuaccuccaaggcuaccuacucaaacuauucauacacuuaaaaccacgaagccauugucuuugauuagugaucucuacagcugcgcuuacuugcuuuaaacuuuaaagugagcuguccucauuugcuuugguuugcugcauucugaaaccacccucucauuuuaacauaucaaacaaaaaccauggcuuuaaaaaaucuuacacugucagaugauauuccuuguaauuuuccauugacccuugcuuccucuauucugugaagaaugugucuuguauggcuuccugucuccaauacgaccuuuuucuaauuucccuagguaggugcuucuugcaucacuucuaugaccuuucucuagcuucuggugccuuaucucagccaccuauacugaucccuuagguccguuauauuauaacaguagcgcaauuguaauuucuucagucauuucaguuuuggacaucaugcccuuuggcucuugcccucuaguauuaacaguccucugccucugaaaucgagaacucacugacaguuauccucucuguuccccagcacaugguguggagugaaccacauuugcuuuuagcgaguacucagaacucccauugggccucagccucauccccucccucauucucauauuccacagaacaguucucaucugaauaccaacauacuaugauuuaucucuccuuaaaaacaacuuuucuggcuauagcuacuuaacuuuuagcucugucugcucucuacucugaagguuucacuuugccacuuucucuuucugguuugccagaaauaaaccuugaccaauugcucccugaaaagcaaacaaaaacccaaauaacaguaacaaaacaaacauaaaaccauuccugggauucuacuuucuccucucauuguugcuuauucuuuuuuccugugaccccaucccuaaagaaauaucuguaguuuugauguauguauguauggaagauguauauaugcauugagugggcaggacaauaaccagaguauugccgcagccuguacuugugaguuugucaccuucucuuuacucacgagccaaccugaaucagguuuuggucccagccuccugcuaaacaaccauugagaaagcaucauuucucauccuggaacuguugauuuccuaacaguuuccucuugaaacgcuauuuucacaccaggcucgaggacaguauacuugcaaggguccagucuguaagccucgguacucauacauaguuuugguaauuuuauuugacaucaugacuuuaauggcuuuuauuuuaaucuaugaccugaacacuuugaaaaugcugccuuacuucacuuggguguuuaauaagcaauuaaaguagaucucucugggucugcagaguuagcucauucuugaagaguauugauuguucuuuuagaggacccaaguucacuucuaagcaccugcaugguggcugacaacuaccuguaacuccaguucuggagguucugacacugucuucugaccuaguguaccaggcaugcaugugguacacauacauauaugcaggcaaaagaauuauacauauaaaauaaaaacgaauaaaucuaaaaaagauuuaaaacacagcuuuuucuaaaacaaacuuuugucccucccgagucagucagugacuuaaggaaccaaccuauggugaccucaauguaguagaaaucuuuuagcuuucaauaguaccauuaggaauuaaagccccccuccccgccuucuugugcuggagauugaauccagggucuuucagaguacauuaacuucugcacccuaagcuucauacgugcuccuucuaugcuuaucuuucauuugaaucaguuucucggcuucuccuccaccauggccuuuuuaauucuauggaagaaagcaguauuucuuucuccuauuuccugcucuucucuggguacauuuugcccucuuguagaaaaacuuuaagaugaaaaaaaaacucuaaaggacaaaguacaguaggaaauccaaucacagaaaaauaaagauagcccucuacugcauaauauacugaauaaugaauucaaaaugaccuaagagcuaagccauaaaaauuccuagaagaaaagcauagguagaaaucuuugugguuuugaauuaggcaguguuuucuuagauacagcauuagcaccauuaaaaaauagacaaaccuggauuauaucaaaauuagaacuugguacaccacaacuauacuaucaagagacugaaaagacaaaccacagaaugggaaaauauuugcaaacuuuguauauggugagggaauuacauccagguuauauaaagaacacugcucaaaaagaacacugcuuaaaaaaaccacgaauuuaaaaauaaacuaaaguuucugauaaaucuucaaaaagauaaacaaaugaucagucaggucuuaaaauuucacucauuagagaagugcagaucaaaacaagaaucauuucuugucuacuagauugucuguauuuuaaaauauagguaaggaguuggagaaaugggaaucuggacccuaagaauguagguuguuccagucaccuuagaaacaguagcuugcuuguuugguugcucaauccucccucccucccucucucucucccucccuccuuuccccucccccuccuccuccuccccucuccucccucccucccucucucucucuuucucuuuccauuuuuuuguuuuuguuuuuuguuuucaagguaggguuucucaauguagcuuaagcuguccugaaacuugaucagagagauccaccugucucugccucccaugugcugagaugaaaggggugcagccagcaacuucuuuaaggaaauaaaggaaaaaccuuaaacauagaauuacccugcaaccuagcaguuucauauuuuugguaugcacccaagagaaugcaaaucacacuuuaacacagaagccuacaugugagcauaagguuuguguuugaggccuggacuacauuguaagaccugucaugaaacaaaacagaaauuguucagggaaaguucacaacuucauucauaacuaccaaguguuagaaacagccucgauauucauuaccuaaagaauaaauuugaucuuucucugggcaguaaaacagcaccuaugaaaaaugaaauaccaacuuuaugcuacaaugaggacuaacuugaaaacauccugcaggggguaguaauguaguagcucaguuggcagagcgcuugcucagcgcgcaugauccucucugcauuccacucuagccucucucaaaccaaccuggaaaugcauggcuucccaguccucgggauguggaggcucagaaguuaaagucuuuaucgguuucaaagcaaguucagagccagccuagacuagcuaauccucauccgaaagaaaaacagugaguacguccuucacaaaagaccacauguuuauuugaguucauuuaaagaaauuggaagaaaaaaacauagccuuucuggggugccagugguggggaaucugaguaggacuaugauuuuguuuucauggggugagaauguucuggaauuaguaguggucuuuuuguuguaucuacuuagaguuaucaaaggggggauuuuauaguaucugaauuuuguuuccaaaaaugaaacaaaaucuuaaucuucaaaaugguuagagagauggcuuagcaguuaagcuuuuuuuucuuuuaauuuuaacaaaaaugaagaaauguucaagucauuuauucagcaauauauuguuagcugcuaaaaauuaaaaauauuuuggugcugagguauaguucaguggcgaauggaaggguuugauccuuggcaacaacaaauauuuaauggugaauuaugauaacaucuucagugcauaacuuagaagagauuuugaaagggguuuuuuuuuuuuucuuuuuucuuuuuuuuuuuuccuuuuugguuuuucaagacaggguuucucugaguaguagccuuggcuguccugggucucauuuuauaaacuaagagaacaauccagggaagaccuguggccucacgcucauggccauacagguaagugcgugugcaccugcauuugcucaugcauacgcucaaaccagcagacaccaccacgagcaccuacgucagagcuuagauaggguuugcaguugaauccacaaaugaaaaaguugaggccagugauggucagauauuuggaguucuauuuaaggucauguaaccuuaaccucagguuuuccaucuguaaaaacagugguagagcucacugagcucucgggagaauucagcucagguaagagaaaugucuaguccagaaccugccaucugugcuagucagugcuuaucaagugacuucugucugcugcuguguccgugagcuaggacuuacuccugucugaaggaauuaguagcauaacuacggcagcagaguaaaguaaccaaugucuaagacuagccccacuuuccuuucuuuucuucuuuccccccuuccucuucauauuccccucccuucucuuccuuccuuucuuuuucguuuuguuuuguuugagauaggguuucuuuguguagcccuggcuguacuggaacucaauuugucaaccaggcuggcuuccaacucagaggcaggccucaaaccuaucugccuuccccuacuucccaagugcugggauuaaaggugugaaccaccacgccuaaccccucuucucuuuuuagugcuggggauugaauucacaauauuuggauuugaauccuaucuuuguuacuuuuuagcugugugacuuugcaaaauuacguaaaugcuguuuuaugcuguuuccccauguguuaauguaauaauagcaguguggaagcuaaggacuaacuuacucaguuuguuuuaucuaucacucuuccuuggccaauauucuuugaacuacauucaguguugaacguucugcucauuaauuccauucccucacuguuaugcaaauguucacuaucuuuguuuuuugaguucauucuucuuuuuuuuuaaacauguuuaaaaaaaauauuuauuuauuauuuauauguaaguacacuguaggugacuucagacacaccaguagagggcgucagaugucauuacggauaguuguaaaccaccaugugguugcugggauuugaacucaggaccuuuggaagaacagucagugcucuuaaccacugagccaucucuccagccccaaguucauucuucuugauugucaauucacaucuuuuuuuuuuuuuucccagccaugcuauguguuuuuaggcacuuaaaaagguuuuuuacaaaagaaauaucaacucccaguuugggcccauaggauaccuaagcagaggguaaagccccuaggcuuuuuauccccucugcccucauguugagucugcuuuacuucaagucagccuccggccugacugcgcaggcauaauacucacuaaggauguagugucaacucuccuaucucauccuacuuuauggaaauaagcauagcuagcuaugucauuguccuaaggcugcagucgccuaggaugccaguuuuugcacuccuuguaggacauuuauucaugaugggggggcuuguguuggaucaucuccuaagaagcaguuuguccucuuacacaauaauaauggacuacuuugcagugccagagcugaagcaguagucacugggacugacugcuaauuugugccccucugcuccuugcuccagugccucuccacuuuaaaccuaaggcucauauccguuccccaaggaauaaucgggaucauugaaacgguuugcuucccuucccaacacauugacuagaugucugcuuuucaucauugcuugccucuuuaauuaguauguugagugacugacugaaccucuuguggcugcuugagccaguuacauuccuugauauauucauaucccccacacccccccaacacacacacacagacagagagacagacaggcagagagugugagcucacaguguggaaagacaaaggaauucugugcuuugcaauuucaggguguguauuugguaggaauaggauagcaaaguuucaaaagcagaucauuggcccagaauaucacuaagcaacagaaugacauucuguuagauguugaaucaacucuuggccugugccauguuugugaacuguauuuuuauuuuuauuuuauuuggagagaggcaacacuucugacuuucugaauaauauauuuucucaacugacagauuuuuaaaaaauauauugcaagacaauaguuuaaaauacagaacagccaauuaguagucugauugguuuguuaguuuucuaugugcauucugguuuagaguacaaacauacucugacaguuccauaggggaguccaacaugcgccucaucagucuagaugaagaugucuucagaggcuguauuauuuauuccuuuuuggaagcgcuaagagacugaaguaguucuauaccuuuuccagacuuuagagacugccgcauugcuugcccugugaccugcugcuugcuuaucuucauagucagcaagcucaacucucagaccuuuucuucccauucuguucccagagacagaaaggguauuccuacuuuugggaacacaagcuauuagauggguaaucuccccaucucgaauuuuguggucacauuugcugucuguuuugccauuuuaaguaacauguucacagguuccaaggauuagaauggccugucuuuucuuucuuucuuuuuuuuuuaauuuuuuuuguuuuucuuuuuuuauuuauuuuuauuauauauaaguacacuguagcuaucuucagacacuccagaagagggagucagaucucauuauggaugguugugagccaccaugugguugcugggauuugaacuucagaccuucagaagagcagucggaugcucuuacccacugagccaucucaccagcccuggccugucuuuucaagggucaucauuagcuaccacaaucuggguugacucguggccugauguaugccagcuaacaauugcucuuguuauuggacuggaagcaguuaagccaccgaccucauuucuuugcuaagagaaggugauacugcuuuccagcauguauuggaauaacauuuaagacuuggucuagaaacuaaaguucagagauacucuaccacauucuuguguuugucuuaaauacaaguaugugacuugacuagcucacagagcugcaugaagaaguacuuugauguuuguuagaaaacuuuauaauuuuuuuugucaguuuucagaaaauucuuuacaucuuuggcuagcaggguuuuccuuaaccuuuaauacauuuucagauaaacuuauuuccuuuauuaugagaaguggaaaaugaugaaaagaaaacuaaaaauacuuaaacuugcaugaugcuuugaguaacuagucugaaaauccagauguaucuguuuaaaaaucuuaauuauuuucuuuucugacaacuucuuaggagcuaauuacuguugucauuguagaagcaagaucaauacuaaggccauuggauaaguaagacuaauuguucuuaaaacacuaguuggaauuuuaaucuuacauaauggaaucacaguaaaaucuuaguuuguaauuggcugccuagguauccaauguuuggcucucaaauauuauuacauauuaaacaaaagccacucuuuaaaaagcgauuggguuuucccuccuuagcugguaacaauaaguaagucccuuuccucauuaauggcacgaagaugcggauuguuauucuuauuuuuuugagagguuaaauuacugguggguguugcugugauggaaaauagaaggaagaucgauuaaguucgacauuguuuguucacugcuaguguggagccagccuagagugugcacacgcuucaguguccacccugccagccccuacagaccacccuaacucaguauuuuccaaugugcuacuuacuuuuccgccuaaaggccuuuuauauaauuuagcagguaagcaaaaagauuuuuguucaggcagaguguuuuaaaaaauaacacaguccuugagaagucaaaaauaguuuagccaugccauuaaauguaaauuuauuuguacuugauauggaauaaauuuagagucauauuuugaugaacacuuuucuuggcauaaaauaaaguugagugcauugaucacuugugcuuuagaaccagcaagaagcauagcaguucugcucuuguucagucucuugcugucgcagauaaaugaaggcuguaaagggcuuucacauaaacaauuacuaaaacucuuuuguacuauucugcguuguaauuugaccuuuuggugcuuuuuuuuuucuagcccaguuuuagaguaucaauuuuucaaaaauauuuagucuuuuaaguauuuuuugguuauuaaaacuuaaauguacuuuauaaauauguuuauaugcagcugguuuuauuucugaggguuuaagagguuuauuauuuauaaacugauuacaucuccaacuaaacacugccauccauuaagaaaauaauuuggggcuggagagauggcucggcaguuaagagcacugaguagugcucuuccagaggucuugaguucaauucucagcagccagaugauggcuuacaaccaucuguaauggggucugaugcccucuucugguguguauggagacaacuacaguguacucauauacauaaaauaaauaaaucuuaaaaagaaaagagaaggaaagaauuuguucucuguuacagagaaacccugucuugaaaaacugaaaaaagaaagaaaaagauaaaauaaauuuccuuaugucuaggucguguuaaucugucaguuugcuuacuguucuucugaagaaagucacugaaauuaauaacaaaauuacgucagagaugucauauuuauaucuuuuuaguauuuugauaguagguguuacaucccccuuccccacugccauuucuuuucauucuggcuggugcucuaccucuaagcuacuugcccugcccaagugcugcauuuucugaagaggauauuguauuaccuuagagaaaagguacagcugauagaagccaguggagccagagagaugucucagcucgugaaagugcuugcuuugcaaaucugcucugaacuguauguccaguucucaugguggaaagagaauuccuaagaguaguccuuagccccauguguacacacacacacacacacacacacacacaugcucaagcacacacucacaucauguaugacgugugugggugcuaagaauaauuaaaaguagugccugugcauuggaacuugaugucuuguuuugccucuccuaugugauguguguucucccuagcucaucacacuucuuuuuauuucauguaugugaguuaacugucgauguccucagacacaccagaagaagguaucagaucccauuacagaugguugugagccaccaugugguugcugggaauugaacucaggagcucuggaagagcagucagugcucuuaacccgcugagucaucucuccagccccacucaucauacuucuaacauaucacuuuuuuugugugcccaguacuuugcuaugauucuuggcucuuuguugugauuccaguucucuagacuuaucuauccucugccugucccuccuugucugguaagucccagccuucuuuauaugcucaccuuaggacuaaccucuugcauaaagauuucaccaccaucaccuccaccacuagcaucaccuccucuuccuccuucuguucuucuuccuccuccucuucuuccuucuccuuuuuuucccuccuccuuccuccucuuccucuucuuccacaagacuccaguugugguucuguuuuguuguuguuauuguuauuguuuugugacaggaucuaauuauguagcccuaguugaccuagaacucacuguguagaccagccuggccuuaaacucacagagaucuaccugccucugagucccacaugcuaaaacuaaaaaggcauaugucaccaagccuggcucugugcuucuguagagguuuuaaugccuuuguuuacugcucuuuuucuuaucauuuauucugcauuucaaauuggauuuuuaaauaaugaacuaguuucuguuuauauauucacuguacgccaauuacuguaucauugugaguuuuuaaaaucguauagcugagcaggugucagcaucuaucugaggaaagugagagguagcaauacuggugaggaaggucagauagacaucuuuuuucucuuugguuuaucuugcacauauugcauacuuauuaaauuguauuauauuauuaauuguauuauuguauuaauaggcaugcggugacuagauaacucauuuuugcuuaggcuuucuuuuaaagaugguuuuuggaagguccaaaagaaauggucugcuugaauuugagaauuguuuuuucauucuuuaaguugcauaguauucuugaguaccauguuuuaaauccccuuggugagauuuauuuuauccaguuuuuauugauuggaauuaagguccagcuuguguacuuuuuuuuuugagaccaauuacauuuuuuucagcuuuguaagcuucaggaaagugggaagucuuacucuugggcuuuguuagaaccuggcacauaugcuuagugacuucuuuguggcaaugucaguguucccuccugccugccuuucuuuuuuucuuuuuuucuuguccucuuuaauuauaguaguauaguaauuuaguugaguggcacuucuagcacuuggaagauagaggcaggugaaucucugaguucaaggccaaccuggucuacaguguugaguuccaggauagccagggcuacacagagaaacccugucuagaaaaacaacaacaacaacaauuuuaaaagcuuuguuuuuuccaaaguuuucuuuuuaagaggccugggagaggaacuuaauaaccaaaaauaagaacugacuucaguuuuacuugagucaguaacuggcuaaauuaaugaucaaagaagaacaguaaaaccagggaguagugaaugagcuagaguuaagguuuuagcugugucccccgcuuuucaaagaccauugcucagaaccauuacuuuguguuuuuaguauuuugauuuaagaugauugcaaugagauuuaaugaaaucucuccuaggcaaggugaagcacaguuucugcuggguaaaaacugcgcuucaucuguguaugaggugagguguggaccauaggacacuucauugaaagugcuugcuaauggaagguugccguuugugaguggacauggcauacaucucuaggugcaagaaaauucuuuucucaagaguaauugugaauuuaaaagcaaauuucuuauucacuucagaccaguaugaaaauauagaugaggucuauaacguaagaaaagggaaacuuuuuuuaauggcagcucagaaauagaccuucuagcaucacuuuaaguuucugaaaugugcauaaaugaaaagacucacuaguaucucugccuggaagaaaguuauuuacaccccuaaauaccuccccaaaucacagaccuagagguugcaaaccagugaccuaucaguuggauuugaccggccagcuucuugcugucucuccuuuucccaugugcacaugccgucuguuuuugagacagggucuuacaacauaacccugcaggccucacacucacaggugucuggcugcuuuugucugccagugugccagcaugccucgcuguuuuaauuguggggguuuuuguagccugucuuugcuuccuuuguggauucuuuuuucuuccucucuucuuuacucccuuucuacccuuucaacccccuaacaggacauaagagagaaaaaagaauagagaggaaaggauaugacuagaaggaaagggagaagagacuagaguuuugacauagaauaauguauguguguguucaauuuuuguuguuguuuuuauuuuuguuuuuguucuuuugagacagggucuuucucuguuagaaacccuggcuguuggcuggccucaaacucacaguucauuugacugccucugcuaaaaccaaaggugccaccuagcucggcuagaauauuauauucaaauaaacauuucuaccucuuccuacagaacaaagcuugacuuauaaagugaugggaccuuuggagguucaaauaaaacguagauucaguagucaaugauuggaaggggaaauuuuuuuuuuacuuugaaguauguuguaucuuaaguuuuuauuaaacuuuugcaaaggguuuuuuuguuuguuuguuuguuuguuugauugauugauugauugccuuuuuucaauacuuuucucaguugucacuaaccacaaaaguacaacuuugaauaagcccuccccuucucuccccacucuuccccucucuaccucuuuucaagacagcuuuuguauagucuuuucuggccuggaacuugcuguguagaacaggcuggccucugccuugaauucacagagaucugccugccucuuccuugacucuucuuuuuuuaaaaagguggcuagaguuagaguugacggaucuucaaaaacaaaguauacauuugauugaaaagggcaucuugagaaaggauccuaucagaauguuugaauuuacuuuuaugucugacucuauggucuauugguaagauuuugaaggccuagauaaaugacugaaagguaaaauaaaguguguuaguagaagauuaaaaauuacagagggaaagaaaaagcuagucugucagcuggguggugguggugcacaccuuuaaucccagcacuugggagacagaggcaggcagagcucuugagugugaggccagccuggucuacagaaugaguucuaggauggccagugccacacagagaaacccugucuggggcuguuauuugguugaauucuguauuauuuuaauggccuuccagaucugcugggagauacuagaaugaauugauaagcacaaaagcaguuucauguaauauuuccucaaauguuugagaaagguuuucuuucucacugaaaaaaauuaaauuacauauaguguguaucuguuuucaugggagugauuucuuuuccuucuaguauguggggccuggggauuaauugucuaccuuggcaacaagugucuuuaccuacugagucaugucacugguuccucucugugaaggaccauuucucagaauguagauguguuucaggaucuaguuguguuucuuuacacacacacacuuuuuuauuuuaauuaauuaauuaauuaauuaaucuauuuauuuauuuauuuauuuauugguuggcuagguuuugagacaguauugaauguaauucuuuguuuuuuucuauagcaaggaguauuuccccaucaaucuuuuaaaggacuuuuaguguuuuuguaauuuaaaugauguauguuuugguguaggcuaguuauaguuggguucuucucuacuucuuuucuaaaugggguggauuaaguuaguacccuucucuugcaaggauagcgcuaucuagaguuagcuauuucccuuuuucagaauauuuggaaccugauaaaaauccuagugggcucaccucugguaaauaauuugccuuauuaagaagaaaagaauguuccuguuugguguugugguauaaaacuguagugacacagaaagauugccaugaguucaggggcaaccuaucuaagagauacuguuguuuucauaacacccagaaagaaaaaggucuagcauauuucaaaauggcuccuuucccaccaccuucuuccuagaagggugagagagagagagaguaccuacuuuguaaaccuagcccugacagccugagccuccucuccacccuuuagggugcuucuuguugacagcagcucacguuuguuucccucuccuggcgcugccugcugaggaauuguauucaugaguuucugcucugguaaauugugauccucuacauguaguugucugucucuaauuuugggaacagugguuuaccccgcaacauuacuauucugauagaucuuaagagaguuguugacuuucaguuuguucagcuuuuuaauuguuaagucugaguggugguuugcaagcaaauuacaugcuggacuagaaacucaaaguugguauuuucuuuuuggacuguaaauuuaaguacaauagauauuuuuaaauuagguaauuauucuguaauuuguaguacucagauuuuauaauagaaauuuuaaggcauucucuucaacauaugucuuuuauuaagguaguuccugguuuagaaggcaggaauuacuuccagaaguauuuauugacugcaucaagauuuaucgugccuuuagugguaucugagguugcauguuaccauacaaaacuauacuguacuucuauggcauucugauagaaacguucagacacccgaaucaguucaguuuuaucauuaacaguaauaucauuuauauauuuaccacauaccuguucaccugcuauucugaugacgucaucugauuucacuuucuucaggggauggggucauguuacaugucuaggcugcuuuugaaauccuuggugcaaauguucuuaccuaggucuuaagcuuagcugggauucuggguaaauguuacccagucugacuucagcucacuuuuuuauguauugcaaauuaaguugcuaacauuagauaucucagcauauacaucauuaguuuugagguaaacauuuuuuacaucuuuagggaagacuuuuuaagauuguuaagugaaguaaaaaauauacauuuacuucuggcaguuuuauucccuuaaaaaauaguucaaauguucaaaaaguagaggaaacauucuuacauaaaauacacuuaaugcucacauuuuuugauguuuguacuagugaaaugacaauuuauauuugucccaacaccuguguguuguggguaggcauagcaccucuauucacaguuacuucaaacugggagcaggcucugugaucuuuuguagacagauggggaacugguccaucuacaccaugaacuguuccucaggaucagcaugccacccaagagcuaguacuuguguggacccaguucuauaaaauggaagaguguuuguuugugaaacaaggucuugcuguauaauagcccugccucuccucaaacucauaauccuccuguguguugggagcaaagaugugugccaccauauccugcuaggaagaauguuucuuaaugggagucauuguugugaacuucaguuagaguaugugugaagccuauuuuuaaauuaagaagugcuauaguucuauuaacaccuuccuuuuuguuguugcuaucauuuucuuaaaugugcaugcaaaaaaaaauuauuccuuuacagugccucuggaguuucaauuuaauuuguagucugguuuuugguuuccuaagucucuugucuuuuccccaucucuucuuuauuacagauuauucaugguagcuccuucuacuccuaauaacuacaccccuguucuuguuuucuuuauccuuagccagcuagccugcuucccuccuugucuucuuuugggucucacuauguagacccugucauugugagauucagugcugacauaugucaauaguucuguuucuuucuguugaggauuaguguuccguuaaauucauguguuaaaguuuauuuaaaacccuuugcuuaucaaaagacauggauuguugguggcagaugaguguagauugcuguuuauaaucauauauagguuuuuccuuucacauaagauuucauuucaguaaauaaagaaucuaggaauggccagugagaucaaccaguggcacuugcugcucagccuaaucagaccuaaucugaguuucauuucucugggacccacagaauaggagaggagaaugugcuccugagaguuacccuuuacauccacuugcaugcagggaccuaccugcuucuuccccagugcuaacuaaaguaaacagaacaaguuaggaaucgugugcuaguuucucccucucucucucccaccucagagagagagagagagagagagagagagagagagagagagagagagagagagagagagagaaaagcgagcgcgcgugcgaccaucuguguccuuuggccccaaacuuuuggugauucuaacauggauguuugggaacuaacuuuggauucucuguaagauaagcgcgugcucauaacucuugagccaucucuagacuucaaaaaaccaaccaaacaaaagcagugcauauauguagaaaccuuacauuuuaaaauaaugauuugaaguauuguauaauuaauauguaaacaagugcagugguuuauuaucagauauuauccaguauauauaauuauauuauuauacuuuuuauaugauuggcaguuuaauaguuuuuuuucaccaguagugucacaaacacaugaauggaacauugcacuagcucuguuguaaaagucaaaggcuauaacuacacauuaggaaguuuucagcucuuuauaggaccacuuuuauguaugcagccaggcgucgacuagaacauuguugacagaguagaacaauauauauuaccuuuuuuuuuuaaagcuuacucauugaugaguacuuggguugcuuuugcauuuuagccauguugcauaauaccuguuaugcacacaguuguaaaaauaaaaaaguacuacaaacaauuguacauccgcacauugggauuuauaagaaaaggagugauucuagaaacauaaaagcuaacaagagugacucaugggaaaagcagaaucugaguugauuaaggagagugaauggggaaucaagucucuucacagagugacccugggccuaauguccuuuuuuuuuuuaagauuuauuuauuuauuuuauguauaugcuacacuguagcugaacagaugguugugagccuucaugugguuguugggaauugaauuuuuaggaccucugcucauuccgaucaaucaauucugcucgcuucggcccaaagauugauugauugauugauuuuaaagauuuauuuauuuauuauauguaaguacacuguagcuguccucagauacuccagaagagggcaucagauuucguuauggaugguugugagccaccaugugguugcugggauuugaacuugggaccuucggaagagcagucagcacuuuuaaccacugagccaucucaccaguccuuuauuuauuauuauauauaaguacacuguagcuguacacuccagaagagagcgucagaucucauuauggguguuugugagccaccaugugguugcugggauuugaacuuaggaccuucggaagagcaguuagugcuuuuacccgcugagccaccucaccagcccccuaauaucuuuacugcugagcuucuaccaaacaaagcaggaacaccaccaggcccugucagacuucuccaaagaagaggagggaauacccaggucauucugagaccaauauuaccuuacauaucaaagccaaaagaaggcagugccagaaaaguauguacaaauaucacugguggauaccgguuuaaaauucugaguagaggaacuggcaaaccuuccccugccccgucuuuagauuucuuucaguugagcuaucuguuuguuaugaaaugugcaaaauguacaaaggugaagugucagagggacuuaaccauauugaaaucuagcuagguaauugagcuggcuagucuuuugucaacuugauaaaagcuagagcuauccauaaagagggaaccucuccagcugugggcauuuucuuagugaucaauaggcccagcccauuguggguggugacaucucuggauugguuguccuggauucucaagguagcaagcugaacaagucaugaggagcaagccaguuagcagcagccucugcaaaaccucugcaucagcuccugcuuccaggccccugcccuguuugaguuucugucuugacuuccuuugaugacaaacaacaguauagaaguguaagccaaaugagcccugucuuccccaacucgcguuuugaucgugauguuuuguugcagcaauacaaacccuaacuacaacaguaguuaguaggauacaguuuucaagaagacauuuugguggagguuguggcacuuuuauuuauaacuacauccccaggccuagguuagguccuggaagacagcacuugaaagugaugaauaacauggaaucauuuagaaaauuaaaugugauuguguauuacaagacauuggguaaccaaauuauaaauuguguaaggcuagccacauguuaaauaccaguuucuuuucugcucuucuauuucugcaacuggucucacacuuacaaugaaaaacuugauagcugcuuaauguuuaaaagccucccugucugucugucugucugucugucugucugucuguguaggugucaguucucacuuuucaccuuguuugagaccaagucucucauuugcuacugcauacacuaggcuagcugaucaagcuuccggggauguuuuuguuucugccucugcugucuccauaagagggcugugauuacagauacagcugcuguguucaggcauuaugugagaauucagacucaggcauagcaagcacuuuacacauggugcgcucucuccagccccaaccuacuucuauuucuaaagauuuaucuauguguuuucaaaaauaucauguuucuuaauagcuugccuauguuuggaagccuuucaauuacaggaaguuaaagauguuugcuauuugagguuuccuaaaaaacucugguauuaaaaauugcuugaacccuggugcuuccuuugaccauguagcucaucuucuaaauguaagaaggaguaggaaggcuauugugguuauugucuuuaugauuacaguaagguaguaacaaucccuagacagaccuguauucucuaguuaccaccuuuuuuguuuguuuguuuuuaguacaggaggccaaaccuaggaccucuguaugcuagacaagauucuacacugagcuacaccuugagauuuggauuuccuagucuuuuguuuuguguuuuguuuuguuuuguuuuuuuuuggagacaggguuucucuguguagcccuggcuguccuggaacucacucuguagaccaggcuggccucgaacucagaaauccuccugccucugccucccaaguacugggauuaaaggcgugcgccaccacggucugccggauuaucuagucuuaaugaguggcauaaucuaugugcauaccaacugugggaaaaacaauuugcagcugcuccuuccaguauguuguuuuguaugguguggauuguuccauaauuccugaccaugugauuagacagaucguucuaccaucucugggaaaaaguuuuccagcaacuuucccccacuguucccugcuuguuacucuacaccucauuccuauucuuuugauuuuagaagaugacuucacuuucuacuucaacagucuugaggcuaccaaauuauugucaguuuuauuucuuuccacuuuacucccaagaucuucauuguaaauccuuuucuuuucucuccugcuuaacaauuuuccuuuaauuuuuuuuuaaaaaaagauuuguuuuauuuauaugugugcaagugacuuuauguguuccauggaguucagaauaaggcauugauuggauccccuggaacuggaggcccaugcaguaaugaauugcucuguggguucuaggagccgaacugagggccucuaagagcgacaagcucucuuaacuacugagucaacucuagccucucucugauuuuuaaauuuucaugguguauauuccuuguacauggaacguguuaaaugaggacauuuucauacgacuauguauuguacaccaaguauauauccuccauacccccaucugugcccuucuccuuguuccccuagacaacuuuuccucuacauguuggaauaugccauauagauacauuuuaauguaucuauagauuuuauauaucuauaaaauuaaggaaccacaaaaaugauaaaacacaaaauacauaguuugugagacauguaauucacuuaaugauuuuuccauguuugcauccauuuuccugcaaaaagcuaauucuaaaaaaauucgauggugaauaugugccacauauuuuuuuacccguuucuuuguugcugaugccuauguuggcucaguaacuuagcuauuguaaauaguguugcaggcaucucuugacauguugcuuuggaaucuucugaguaaauaaauacacaggagugacauagcuggguugcaugguagaacuauuguuuuaggguuuuuagggacugccauacugcuguccauugcuggacuaguuuaguuucccaccaacaguguaugagguucccuuuauccaacuccuuaaaugacugccauugauugguguggagucucugucuagucucugaugucucaugagguugucuauaguauagaaugaauagguaugcuucucuaauagguuacuuaaggaacugaacaagacaaugaauauguagaacuuaacacauagaacuggcaguguucaguaaauggggcucaguauuaugucacuguugccaggccaugguucuuguuuguuuuucccagacaggguuucccuguauacccuugagugaccuagaauucacuuuguagaccagucuggccuugaacuuacagaauucucuaccuucuaaguucugggauuaaagacauguacaaccaucacaagugccauggcuuuguucuuaagccagccagaaaauguuugauucagcacuguuaguaauuccugagugguguuucugucauugcuuagauguauucugagaaugcuaaguaguugauuguacuuagaaguguuugcuguuugacugguaauauuuuaagagugguuacuuuucuggcuccuuugaucuaguaguucaagguuagaggguugcagcauguuagcaacagaggcaggauucgaaccuuggaucucaugcugacuguugaguuccaugcucuguuucuuguguccaucacuacucugcuucccaaaagaauugcaugugcaucacagcugcugugguaccuuagcuguuuggugcuucuguguggagaugggcugugagguuuuuaaugcuguuugaaggauacuucaguggauggugaugucugcugugagcaugggccucugagugcaugugaguuguuguuuguuuguuugucugucugucugucugucuuuaaggugugcaguuacccacagaggccagaagagagugucauauccccaagaguuggacuuguagacaguugugaacagcugauauggguauuaggaauagaguucugguccucucuggaagaaccacaaggacucaaucucugagccaccuuucuagcccuguugguguguuuaucugagucagagacacauugaugguucuucuccacuagccuagaaucugaacccgaguggaccuagaacccaucagaaggcauccuuaucuucuugguguucaugugaacccaucucacuuucuccuuauggcuugaugacucauguucauuuaauggagcuugcuagcaggaaacucucuaaaauauuagaacauuucuauagaaguagcauagaauuaacacuugacguguuuuuaaauuuucucuuauugucucauuuuuugguugauaguaguucuuuuaugaaacucaagcacagugacccuuacaaauuaagccccagagagcauggccugguuuuugcaagcucaguaguucccuggcagguaguuggauuauguguacuauguugggauaguugcuucuaauuaucugucugaaacucucccaagacuuguugcuuccuuaugaaaucuugauugcccuaguugcugcucauccuguauacaggcuccucccuuaggcaugugacucacuguuugaaagcugggacuguacagucauuaaguacuugccccucauuacauagagaugagaauuuaaauguaggcuuccuaucuaacacuuuguuccccaaguguuuaccccuguugacaguagcaggcacuccucuaccucaccuucugaagaagucucugcacugguuugucccccuugucagaagggauuaguuugcauauuccuauuccuguauaagggauggauuuuauaagggucaguuagcagaaaauagcuuuauuuucuacaguauuuuuauguuuacgggggguugagacgggguuucucuguguagcuuugacuguccuggaaaacuugucuguagaccaggcuggccuugaacauagaaaucugccugccucuaccuuauuuuuuuuuuuuuuuuagauuuauuuauuauuauauguaaguacacuguagcugucaucagacacaccaguagagggcgucagaugucauuauggaugguugugagccaccaugugguugcuaggauuuggacucaggaccuuuggaaaagcagucagugcucuuaaccgcugagccaucucuccagcccccugccucuaccuucuuagugcugggacuaaaggcauguuccaccaccacccaucuuuaaaaauauuaguuguacuucauuagaaaauaagucuauuaugaggaggaaguuugaauucuucuguucucugaauaggacauuuagaaauaauugcauuuggcuugguggcacacagcuguaauccuggcauuuuagaguaugaugccaggggauaaguuuauccugggcaacuucacuuaaaaguucagguucaaagugagguccuguuugaaaagaaacccaaaggagagaacagagggaggguggguuuuaaugcguugguauaguuacaucuuaucccucaauaucaaguaaaaucuuuguauguuaaguguaaaauaaacaaacugaccccccucucugaugcccuugccucaugacugcuuauuacacauaguugugugaucccccccccccgaaagugaauagaacacuucauuccagauagggaacaugccacaaaugaaagaaagagugccacccaaguguaguuuggugaaccagugagccuauugggguuacucaggaacauggccaagacuuaacagaagagcugcaucacugcaguucucugccagcacuuucuuacugcuuauuauggaacucuuggcgaggagcuccguaagucuuguguuuuguaagcuuccuaagucuuaugaauuucccuucucucugcaggaucaauauucuaauuaggaaaacacagcaauacaacagaagcauaggcauaaucuuuaauauuuuaagagcaauuuaaauuuucauucaauuuauaaggaauauuuugggguacgcucuacucuuccagaugacccugguuugauucccaagacccacauaacuauucauaaccauccauaacuacacaugcacucuuggggcuuuagaacgcauuccuggugaccucauuuuauuguagcagaacucuuuugguauuuucagcauugguauuuuucauaaauuuaauuacaaguuucuuuaugauuaggauuguccagcaguggauguugcacuuaguagucuagaauuacuuucuagugauuuuuuuuuuuugauaguagaaauuuuacugucuuguaaagcucuauucauagaaucuuguuugauggugcuuuuacaucuuagcuaauaauaaauaucauugauaauuucuuaaagucuuuacagaaaaaaggauaguauguauuucucuacugauucuguuuaauuggaaaggaaagaugauuaucaaguauguuaacuuacauagaaaacuuaggguuuuaggguaaauugaagcggagaggugguuuugugggacuggcuuugcugcaagcuuucccuagugcagcuggcauucaucaggaguagggagaggaggggcgagagcagaagggcaaggagcuauccuuagcgaagacagaagacucaaaguuggcacaggaguugcugcagguuucuuuaguuuugugcuacaagggcuccuuauuccacuagaaagcagaagccauuguggcacugaaguucccuugaauguuuucuuuguaauuaaaaaaaaaaaaagcuggguguagugcacaccuuuaauaccagcauuuaugaggcaggagcaaguggaacuugguguguaagaggccauccuggucuacauaguaagaggccauccuggucuacauaguaagaggccauccuggucuacauaguaagaggccauccuggucuacauaguaaguuccagagcagcuggagcugcauaggaagacccugucucagaaaauacaucuuuagaugucugugugaagguaaggcauuugugugcagugcccauggaggauggaagagaguguggguuccccuggaccuggaauuagagaugguugugagcucccugagguggauguugggauccaaacucuggucuucugggaaaguagugagcauucuuaacugcagaaccaugccucuaauuucccagagaagacuccugaggacccuugcugcaacaucacugcuucagagucucgcuuuacaauagaggugagggauugaauuuaucuucaaaugcagcaugggccuagugggugucuagagcaaggcagcaggguauagggguuuaugaauggaaaaugacuaagaagaaacuacagguuaaacagguauuuugcuaaaucuacauaacaggauuuuugcugaagucaggccagagucagggugauaaagcaucacuugaaagaauagagaggagagagggacuugaucagauaugagguaauggaagguccugcaaaguuggcuuaauuuaagacuggauuuuaugugaaggcaaacaggucugcaugaaagaaaauuuagagaaauuugaucaagcagagaaccuuugucaauguuuaggauuacaugugguggguuggguguuucaggaagccuuggaugggagacaggcucuuccuauguagucuagacugaugugacacaucauccucuuacaagcuuucugauuacuagaaauauaggaaugucccgugauggccugauugacgugucgguuuaguuuuaaaagaaaucgcuaggcaggagagacagcugggggugggguugaggaauauuuaagagcacuuguugcucuugccgaggaccaaaguucaagucccaggaguacccacauggcagcucaccacugucuauaacuccaguucuaagaacuccaacacucucuccuagccuuuauguauaucaggcacguacauggugcacacaugcaaacaaaacauucauaugcguaaaauaaauuaaaaugaaaaaaaagccaagcucuuguccaaaauggggggugcuauuuugcauguucaucaacuauauuugagaaaauccauuuuuuucacauuuugccaguacuuagccacugguugaauuuaucuguccuuacagguguguaguaauaucucuauauuaauuuguauuucuuaguaacuaguagucuuuuauuuauuuauuugccauucauaugaccucuugguaagaauuuugucgggggacuuuugggauagcauuggaaauguaauugaggaaaauacauaauuaaaaaaaaaagaauuuugucacuuacaaaaacuauuuucuuacuggauuuuuuucuuuccacuguugaauuugguuuguuuuuccagugcuggauauugaaccuagagccauguugguucuacaagcacccuaccacugaacugcacuccccccaacccccguuguugagcuuugaugcaacuucauauauucuugaugagucuuuuuuacuucuguacuuuguaaauauauucuccaaguuuguaucuugcucuuuucccuucuuaaaaagaucucuuguaaaguagguguuuuaaaucuuaaguuaucaauguaguuuaaccaccacuagugccugguguguuuauaguaguaauaaaaguauuugcuggggcuggugagauggcucagugguuaagagcaccaacugcucuuccagagguccugaguucaauucccagcaaccacaugguggccugcaaccaucuguaauggguaucugaugccauauucuccugugucugaagacagugacaguguacccacauauaugaaauaaauauggcuggagugagcagggccagagucgggggaagaguguuugcuaaucaugugccagguccuggauucaauucccaguaccacaaaaauaaaccaauggaaauccauuaccccuacagaaaccaccaagaauaaacaccaguaugcauaguacaauuguuauugacccuaagugucuaaauguuacuaguaauucuuguauuaagguuuguuuuauacaguacagcauaaauccaucuaagcagaaacuuaaaauuacuuuaaaaacuuaaaauuuaaguuucucuauuuuaacaugcuugaaaauuuuagcccaacaucuuugguaaaaaaaaaaaaaaaauuacauuuauuugguguuugucuuguuguuguuacauuucaguucauuuuuguauguuuuuguugugugcaugggcaugugccaugguacaaguguggaggucagagggaaacuugcaggagucaguugucucugauauguggguccugggauugaacucagguuucuaggcuuggcaagcaaguagcugugcuugcugagccaucuuaccaaucccaguguuugauuuuuuuuuuaauaagaucccuuguugaacacaagguugaacuugaacacgugaacauucauaagugaggaaggauguguggacagagggguauauugugggacacacuacagcuuccaggagauguuuucuauguuuuguuugugugguuuuuugggggaaggguuuguaaggguggauaugagggaauggagagaugcaugaugggaaacucuuaagucaauaaaaagcuauuuaaaaaaacgaaaagaaaaaaaagccaaaaacuugugaacacauauuuacagugcuaacagugaccuaguaaguuaagugauuuggaccauuuugcuuauguaaauccuguaucuaugcuugcauuuauagagguccuucuucugcauuuuuuggauuucuaguauguaaaaaaugaucuguagaccuguacugugaagcaaaucuuuuuauuucauuuuuuuuuuuuguuuaacuuuugagguacagaaagauuuucucaguaggcuguaagauuagguuuguuugugauuuguuuguuaagauuuauuuuagugaguguuuugcuuguauguaugacugugcaucacaugaauucuuggugccugaggucagaaggagaggucagauccccugagcaggaguuacagaugguaguggaccaccaugugggugcugggaacugaacccagguucuggaagagaaguuagugcucuuaccugugagccaucucuacagccuccaagauuaacuuuuaaauuuuuguuucugaaauuauuuuccuguuauucaccuaugagagcauaacaggagacuaaauaauuuggauuuugaauuaugguauauuuggauauuggggcuggauaauguguuucuucucuuuuaaaaaauuaauuuuaaauuuagccuaaaacucaaaucuuucuuugcugugaaaaaaaauguuauaauaauuaguguuguaauaagcaaugguuugcauguuauucaucauuugauccauugcaauuaucugguaaaguguuuaaauaaagguacaucaauggccuauuuuuacuuuuauguaaguuaauguaacacagugauuaucucacuucuguuuggaguggacucaagucccuccaacccccuaaaugauuuuagaguaaacuuugugccauuucucuaguaucauauguguguguguguguguguguguguguguguguguguguguguauguguguuguuuauuuauuuaaucaacuuaggggaaauuuuucuaagauauaaagauuuuggauuaaaaaaauaaaaacaccaguccuucaaaucuauuuucccuuccuucauuucuuagugacauucuaagaguagguuugaaaacugcuggggccugguuauauuguggauaaugauagcauugagaggaaccaagaaggcuccuaagugcagacaguguuacuaauagcugucagggucugcucauuucuuggacaaugaaagauuucucuguggcagcccaucugcugaguggacucuuuaaagacgguugcugucuucuauguuggacuggucuugaguugccccaggugaugugaauuuaguuacuauugccaagacugucagaccucagcauacugucauugaauggucugaagacaaaaggauugaccuugugauaggauauaguuauauucauauugcuuuugaaaauuucuuucuguaugaaacauaguauuuuuccucuuugaaguuuuaauuaaaaaaagucaaugaaauuguuuuaaauuuuuacgcuaggcaggaggaggaugaugagcuccuggaguccauaguguaagugagcauguauauuuuuaaauaaauuaaaaauuguuauuguuugccaucuugcauuuuuguaaaugucccuugaagcaguagggucuuuaaggacaguguuaguguguauggacccccuccauauuaaacaaauaaaaauuuuuaggcagucuacaagaaagggaaaagugagauugcaagaaaauuguuucauguucuuuuaguugauuuguuuuaaauugguauuguucauuaaaaccuaaguuuaacauaaacauuuguaccuaauugccucgaagauugcacugugucauuucccuaaguacuguaucuucuuuuggccaguaauuguucauugacuuuacuuugaaaauaaauaauuuuaccuaugaaaaauuuuuagugcucuuuuacacauuuuauucugacauuaaaagcuuuuucuuaaauaagucuuuuuuuuuuuaaagcagauuuaugaaaauaugcaucgcuuugauacugucuuggaauucaugagauggaagcauaggucaaagcuguucggagaaauuggaacuacaguuuuaucuagccacaucucugagguaaggaaaagauuaaagaaaaugaaguugucauguccgcucucgaccaacaagaaugacacgaccaccaguucuucuaacagcaguuuauucagcaagcuucagucuucaucucucucacuucaucuuuuucucccccgaaccccgggccucucacucuuaaauacucucagcccccauccacucacggcaggccaugucaccucaccaggcacgcagcuucagccaaucagggcggcaggggcaugucuucaccaaauauggacuuguuuacaccgccagcaucauggugcaccugcgcagcucucacgauggucguggcuuauuuucagguguaugaggaagucaggugcaagucuugagacuuagcugcagucccggugccaucuuggggcugcugccacacccgcuccucacaugaagucauaaaaaaugcuuucuuuaucacugaaggcagacuguguguacuuguguauuuugugcacuguguguauuguguguacugcuuccacaaaaucuucacuugugguccuuuaguguccuuguaacaccagagcuuuguguuaacuauucagcuucucgaaucaccuuccuuacaaauuaauaauuuuaauauauuuucguguuacaaauaggugguagccuauuaagaacugccuugagauccaguuuugucuguguuagucagcuucccuuagugucaugagacaucugugguaauuaacuuauaaagaggaaagauuuauuuuggcuuagaguucugaguggccuuguugcuuuggaccucuagcaaugcagcacaucauggcaggaguccgaggcacagcagaucacuaaccucccaagcacccaguuccagaggaaggcuggcuccauuguccuuugcagaagcauacccucacugaccugauggcuuccuacaagacugcacugucucacaguugugcuacccugcaacccaggccuuacuccuguaccggcaggggauauucagcuaaaccacaguaguuaacaguguuuugauagucuucagugacauauucuuuagugauaacuuuguccuucauuuggaugacuugugcacuaccuuauaguuguaacuguuaauaagguaauuucuaaucuaggugauucagaaacuauuucuuucauuuuaaagggauuacacaagagacacaaaacuguaagcaacauacgugaaagucuuucacgaccaacuccauuguucuucucccuaaguucccuuucaccugucuagugucccgucuuuuguagucaauuuauuggucuguuuauguaucuugaguuaauuuuaauaucuaccuguauguguuccuacagaagauagaacaugguguuggauucccuggaaauggaauuacaagugauugugagccaccuagugaguguauugggaacugaacucagguccucuggaagaauagcaagcuugcuauucucucauaaccacugagccaucccuucagucugacuucuugauuuucaaauuuauucuuauaaaaguaugcauaaugagaauaccuacuuacaaagcaugaggauaaagugaaggauguagaaaaauucuuuuauuaaacugauuuauuuauuuguaugggacugauaccugccaugguacauauguggucagaggauaucuuguaccaggcaguuuucucccuccaccauguuuguucuagggauuguacucagguuaucaggcuugacagcaagugccuuuaucuaccaagcaauaucacugacccaggagagcuuccuuuagugggggcuuuccuaugguacuaggagcagugcuaggcauugaauccaggccuuugugccugcuaagcaauuaccguaucacugagcuacauucccagcaguuggaacucuuaaauguugacacuaauguugauuuuauuauuauugaauauuacuaauuacaauuacugcuaggacuucguuuuuuuauuuuuauuuuuuagauuagaguagacuuuauuaagggcauggggagggaaguuaggaggguaguagaggcagagaaaugcggagagagagggagaguagaggaguagaggcuggcugugaguuuggagagaugggggaaaggaauggggaaugggcgaggggacagagcaggaacaagaagggaagagcaagagaagaacgagaggacucuucauucuuaauauuauuuacucgugacauuauuuuuacaugguacaacuuuguguguguauguguauguuucaugucuuuucaaaguacuccuuugcuuuuauagaugaaugccauuuuucugauuauauauuuaauaaauuuuaauaugcugacuuccuuugauaaccauucuuguuuucucauauuuucauguauaugugcauaugucuguguguguguguguauacuuuuaacaucuuuaacaucuuuguuagucauucauugcuuugcccaugugucucacaaaaagggaggagggguuuauuuauagucauggugucagagauuucaguucauaguccuuggcuaugaugaggcaacacaugauggugugggagugugugguggaagagauucuuuugauggauaggaacagagaaugaagaagggucugaggccuaaguaugaccuucacuccaccuuuacaccuagaaccuccucccauaguacagcccagguaugcuuggauagaccagcuuguggugaacaccucauauucaaacuauaacuucuaucaucccuaggaucuugaaauaaguauacauauuuguucauucauuuagccuguuuagagcuucuuauuugugggcaguuuuguuuuguuuuugacaggcucucgacuaugaugcccuggcuagccuguuacuugcagugaccucuguguccugaguaugugccaccaacaccuggcuuuuuauuuguucuuaaaagcuuacaguugaguagagcaguacacauuugugaucccagcaauugggagguagggaggagguucaaaaguuaaggccagccucaacuguagccaauuuaaggugaaccuagauuauauaagacccucauuauuauuuuuuaaggcuucaucuguccauggcucuugaugaauuucccgucucuagcaucagcuucucuaguugcacaucuagagguugcuaacuguguccucucagcauaguaguucccuccauucuuuguuuccaucuucugucagccugcucagucuguuuuuuaauguguuacaguaacacuucagauucucuccuucacccucccccuuuaucuucacaguauuucaguaaugaucuuuguaagccauggcaaacucguuugcuuaaaagcuuggagugauuucuuacugucuguugaguaaauaucaggcuucuuuagcaugugagaaacuuuaugcauuaauuccuaccuauucuuauucuuacccccuuguauguaagaaaaucauaauugcuacuauggugguuuguaguuugauggucuuacccuguuaugcuuuuguuucugauucauagcuugcaauucuguuuauucugucuuuuuauucaagcauuauaucauuccauuaucugucaucaguguuuuaaagacaucucauacuagcuccuagauuucauuuuacuucauguuuugggcuuugaaguccagcuccugugcuuuguuguuaaacauuagaauuuugaugaucuacuagcauuuucucuaccuuguauccacuuuuacaccuacuugucaauguugccauuaaaucaaacaguaauaguagccguauuuuuuauuugcuacuauccacaguuuuguagccauauauucuugguggauuucuuuuugaacagcuuauggacauuaucaugaaaguuauuuugaagccagguguccuggcacacuuuaaucccagcacucuagaggcagagguaggcagauaucugugauuucaaggccagucugaucuguauagugagauccaggccaaugagggcaauagugagacugucucacagcuaucacaagaaagagagggaagaagacauaggacguggucuucaguaggucuguggcacaguaugagaggcugcauuucugagauggucgcacuagcuuugacuagcaagguggcuaauacaaaguuuacuuauacccauuguagccuuccuaaccuuuaauuaauuuagaucacaacuuuccuuuugaaggcugugguuuuuaaaauauguacccauguagugacaauuuugaguuuugguuucuuugaaaaacacauaaauaugggaaaugugguuuccuuuuaaccccaggugugggguacauggcugcuucagauuguccacagcagcugacuaugauuugccuugugcucuaacagggaugugauuuuuuuuuuucccagcugcagauaguuucugugauuaugugacauuuggaauuuuggggacuuuucagaggguauauaaucaaucacaaagaugugaagagaaagaccacugacccaagucaccauuaccaaauuaauuaaaacaagcuuuuuaauucauguacguggaugggcugcuucccccuaaggugagauucaaaaggcuaacauuggauaugaaaacaaggauuuuagaaguagggggcuuucaaauaggggguuuggugggcaaaauaggccaacuuacaggagcagaacauaaguguaccaaguuagucauaaagaccuccagcaacaaaggcguagauugcaagugguuggaacaagguagucuuaauaacugguagucauagcagccuuuugaaacaaaguuagaguugcaagaugguuauaaacaaguuuugaaacaaaaacaugguugccauuuucuggaacagauaguauagaaucauuuguaaucaaaguuacagguaggguauagcccaauccuugaguaaaagaaguuuguaccaaaggagugguguguguguguuuguguuuguaugugugugugcauuuucauagcuauugaacuaugucauuuagcuuuguauaagucuguggcaugguuaaaaacuaggcccauuauuugcugugaacaguaauuguuaguuagaggauguuauauuuacaggcagaagguucacuaugaauuugaaacuagccuggccuucuuaagugaguucuaagucagcuuggacuacagaguaguaucauaucuuauaauaaaaccaagaggauggaauaucaaaguaugccaagugcuaaagaaaaaagccuggcuggggauaacaggaaagcuuucaaguagcagugccauuacaguuugaauaggauaggguaggaucacugaguaagacaaguguuuuguuguuguuguuuuguuuuucaauuagcucagggaccaaguagcaauacaucuuuucuuauauccuggggaaaggaugcagguggcaguccuauacaugugccaggcuuagagcaaaggcuuuugugucuuguuuaaggaagagccguggguagugcagcuggaguagaagaggaacuggagacugguggacaucucuagacuuaagcuuuuacucugggagaaccaggcuaucacuggaggucuuuaaacagaggugugguuuaccccaacauaauuaggauugcucugccuguguggugaauaugugguguauaaaaguauuuguagaccauuuauaagacuguuccaaucauccaaguaaagguugcuagugucuuaaauuagagaacaauggaauuagugcgaaguguguaggcucaggauacaaacugaagguagaaacaauugauuugauggcaggagaaugaggggaugucuuuggguuucuauugcugugaagagacaccgugaccacagcaacucuuacaaaagaaaacacuuaauuggggcuagcaagacuggguuuuucucuauguagcccuggcuguccuggaacuuacucuguagaccaggcuggccucaagcucacugagauaugugugccucagccuccaccuccugagagcugggaucaaagguguacguaauuacugcccaggcugaccuggaacucaugaugcucuugccucugccucauucagcaaaucuuacugucauaugccaccacaacgggcaguuuacugccuccucaccaaaaaguucuaaguaauugaggcuucaaacaagauugcuugcacagucaguauuucugaggaucugguuugucuucuggucuuaucucagaguagcugccagcagcuucagagacuguuagcuccuguucauauucaaacugaaggauuuucuuuuccuuagaugcuaaaccagguuuguguuguuacagauacacucacagcucuugaagcaaaauauuuucuccagauuuggaugagaucggcuuuuuacuguuagaaaaauaaucaugacuagaauaacccugaccaacgcugcugcaguuguacaugugcacauugggguuagggcugcugggaaagaaguuaaaauucgggaaggaaaauggaugaguugcuuguuaaaggaaaagacgauauucuuaugcuaauccaggcucuggauaaggagcagagcugccaugcaaacaauggcuguggagccagaaagucugcagccagaauaguauuucucagaaagcuugucaggccgggcgccuggagcugcuuaggggggcuuuccuuggaaggggggcuuucuuugccgauuuauggaacuugcagcuggccagcuugcuggaaauucccacaccuuucuaguauuaaguaaaaaugaaggguaugggggaagcuugacaggaaaaggaaagaaugacugcagacuuguuuuuucagcugacuucagacuuucccuauuucguuaaggguuuucuuuucuauuuguucuuuaguuaugauugaacuguuaguucaaccuucuuguuugugaacuuuuauauuuuuuuaauuuaagauauucuugggguuggagaguugucuccacaguuaggaguacauacuacucuuucagaggacuuagguucaguuucuagcaccuauauagucuacucccagggcaccagacacacaggcaugcauccagacagacagucauguauaugaguaaaucuuucuuuagugggugguggugguggcacacaccuuuaucccagcucuugggaggaagaggcaagcagaucucagugaauuugaggacaguguggucuacagagugaguuccaugacuaccagggcuauacauaaaaacccugucuugaaaacaaauaaacaaauaaaaauaaauaaaaaguaauagauaaaucuuucuuuuaaaaauacuuuauauauucuuguaauuucauguuauuuucuugaagaaacuguaucaguauggguauaugcaauuguuaguuaccaauuugauagcuuuuaaauuccugcaucauuuuacuguuuugauuaagugguguuuuaaauaucugccugcgugcaugcaugugucugccacugauuccucugucacuuuuuuuuuuuuuuuuuuugagaucugaucgaucuaguuaggguauccaucauguccucacaagacuccugucucuaccuccccagccuggguuuuuguuuuguuuuguuuuguuuuguuuuuaauuuuuuauuagguauuuuccucauuuacauuuccaaugcuaucccaaaagucccccauacucacccccccccagccccccuuuuuggcccuggcauuccccuguacugaagcauauaaaguuugcaugaccaaugggccucucuuuccacugauggccgacuaggccaucuucugauacauaugcagcuagagacucgagcuccaggguacuggugaguucauauuguuguuccaccuauagggcugcagaucccuuuagcuccuuggguacuuucucuagcuccuccauugggggcccugugauccauccaauagcugacugugagcauccacuucuguguuugcuaggcccccggcauagucucacaagagacagcuauaucuggguccuuucgauaaaaucuugcuaguguaugcaauggugucagcguuuggaagcugauuaugggauggaucccuggauauggcagucacuagaugguccauccuuucgucacagcuccaaauuuugucucuguaacuccuuccacagcacuggguuuuauagacaugcauagcugcacaugguuuuuaugggccuacugggaaucaaccucagguucucauacuuacaccuuacaggcugaaccaucuccuuaugugagugacauuugcaaauguaguuguuguuuuuaaacuuuaaaaauauuuuauuuauguauguauuucuuugaauguugguccucugucugcauguacaucuacaauacagaagagggagucagaucccuuuacagaugguugugaguuaccaugugguugcugggaauugagcugaguacuggaaaggcagccagauggcuaacugcugaggcaucucaccagcccaaguagauagucuuaauuuauggugaaauuucuaaugaaugucagugaaauaacuuagcuguuaaaggccuggcuucucaaaccugacaaaucaaguuccauccucagacucagugaucagacaguauugauuuccccaaaguagucuuaacucccuaacucaagugccacaugauaauaaauaaaaucuguuuuuaaagauucgggugaaauuucuaggaauuuaaaaagcauguauuuuauuuuuaaagguuaggauaaaauaccagucuugguauaguuauaaaauaagguuacaaaggguaugugguauaagccuuuaaaaucccaguacucaggaggcagaaagcaaauaggaucuuuauaagugugaggccagccuggucuacaaaaugaguuccaggacagcaaggguuauaccgagaaaccgugucuuuaaaauaaaauaaaauaaaauaaaauauaaccagguaauuugcuguuguauuaugauuguacauauaguuaaucaugagacaaagaagucugcaacauuauuuuugcuacuaaugauuauagcaaugacaccuauuuauugaauauguaauacugggguacacaguacuaacucaucuagguuaauaauauucucauuuugugauuaaguaaaaagggaagccuucauaaauuaauuaacauuuuuaaagucaugacucaaguaaacuagcacagacauuuggaaccaagcaaauugcuaucauaguuaccccauaaaaauuguucucuggggcuggagagauggcucagugguuaagagcacugacugcucuccagaagguccugaguucaaaucccagcaaccacaugguggcucacaaccauccuuaaugacaucugacacccucuccuagugugucugaagacagcuacaguguacuuacauauaaaaauaaauagcaaauaaauauuuuuuuaaaauugcucucugguguauaauaugaaaacugucuuuaccuugauaacuaaucuaauguuacuuuuauggaauugaaucuauaacauaacauagagggggaaaucgauaauaaugaagaauuuaagagucuuuucuaucucucuccaaagugggucuuguggaaaucauguuaaaacagccugcucuuggcuauuucuuugaagaaaccuauccgugauguuagaguuuucugggcacucgguauggguguugcuguacugcucucucaccugacuccucuuuccugguggugcuggugcugaucaagcuuuuauguuucucacaaauuaguuuaucuguuaccccaauguaccguuccaaaguuuacuaacucaugacugcugggauuuaucaucacgugcguucucaagaauccacccaaagcagcaggacgcuguggcacaugccugucaucccagcacuuuggaggcugaggcaggagaaucaucaccuauuuguugcuuccuaaaucuugagggacugcuuuaauauccuuagaauggcugcuggcuucaguaggaguacauccaugaccuagucaaaaaagucacuuauguuugcaucuuauuuauuagaaaugagucuugaaaucuaguccuagauucaaggaggggaauuagacuucacucuuugagggauguaucaaagugacugugaacagaagucaggucuuaacagugaucuuuugacuuaauggagagggaguuuagauaaggggucuuacuguguagccagugcugaucuuuacccucuaccucuguguuggccauccguguugaaauuauagacguguaccauuaugccuggccauuagugcaauuucuaacuaaacggugcuguaggacucuuucauccaagagccuuagcuuuuaguaucucuaagcuguugacauaauggaagauuuguaucuucggccccagauguuuccuuuaagcuugaugcccagcagacauuccuuuuggguaaucucagcugucuaaaucugaacccuuacgcucuuuuuuuuucacuuuguccaaaaaucugcuuauucacauuucaguaauugcucagacgggcagcgugggagucaccuuugacuccucgcgcuccuugaccccugcauccagccauuaccaaguacugcagucuugcuuuuuaauuguauucacucugugcuccugcccuucugaucccagcacugucgucacucucuccauuuucaccgcagucuucccacuccugcuacguuucugcucuugcccucucugguucauuauguaaaaacuggauggcugacaccauccauccaucuugcauuuuaaaacccaaaucuuccuaggguccuugaccuuugugucuuucaaccucuuuuguauugcgcuacugugcucuccagaguucagaagcuucgcccucugcuucucugcuccucagagaucucuuugcacagacuguuaguucugguuguguaucucacacaggacccgaagucuugcuccugaggauuugggggagggugcuuuuccaucuggaauagaucuggaaccuccaggguuucacauuuauuuuuccuaccuuucacuuagugcgaauauguuuacauuuguuacugucuuguugugugucaaaaguauuuccaucuuuucuuucuuuccccugagaugcagaaccucccacaaacagcucuaucacugugcucugacccgcuaugcuagaguauuuaaaugucucauuuugaugacuaugaacuuccugaaagaugagucuguuuuucuauuaugacuauaguuuuggugugugauauguauuucauugccaagugauuuuguucuguaaggaagccucccucauucauaucaaggggcugaugcaugaaauaagccccuuaugaauaauaucuaauggcaagaacacuguuacacaggacuugagcuuuggagggauuuugugacccauuccauuaguauugucucccuuucugcugucuguuccucuuauauccugugacccuugguuauuucauuuguauauaaaugaaguaauuaguauguccuuuccauuccuguaagcuagccucuaugguuauagcaguguguuucaaucaacaccuggugagauuacaauucauaguuuagaacuguucugccuacagauaauguauugaguuuauaguugucacaggcuucuuguuuguuuuugcuuucugagauaggauuucucuguguagcccuggcuguccuggaacucgcucuguagaccaggcuggccucaaacucacagagaucugccugccucugccucugccucuugagugcugggauuaaaggccugugccaccaucuccuggcuucuguuuucuucuuaauauuugugguagagguggugauuacauugaaacagauucuggcuacauagcccagacuggcuagaacuuguaauauuuuugucucagauccacccccacuccaagugcuagaguuagaggcagaggcauauacuaccauacccaacugaaacauucauuacagcaguaaauacuuuaauuacauuagugcaaacagagaaagcuauugaaggagacuuuucuuucuuucuuucucuuucuguuuuucuuguuauuuuuguagagcuggaguugcuuugcuguugcccaucuugccuuagaacuccuagguguaagggacuuuuguccuguccacuucccaaguaguggagaccuaacauguauacaacacuacugagauauucagauauucaguauguuugucuuggcugauuugaaguuaggagagauugcaacuuucuacuaaauuauuuaggcuuuguaaauacagugccuuuaaaaaaaaaaggauagcuguaaucucuaaaaauauauuucagcagagcuaagacuguagcucagcuacagacuauagaauaugcaaggucuuagaguugaucacaccacaauuuuuaaaaagcauauuucuguauuuaaaagucuggcuaugcuuguuuucuucuccacuccuggaaauguuccaguuuuucaguauauucauugccuuguucauuuuucuuuuccagaauucugaagaaagcagcaggugaaagucauugccaagugauuuuguucuguaaggaagccucccucauucacuuacaccagugagacagcaggaccagucauucaaagggccguguacaggacgcgugcgaaucagacaaugacucagcuauacacuuacaucagauuacugggagccugucuguucaucauuucucauguucaagguaaauugauacuuguuucuguaagucauuucuauauauaaagcacuuaaagucuuugaucugcucucagcucauguuccuuucuaaacaggccagccauaucacuacaaccuuaaguaaagaagcaaagaacaaacaugccaaaagaaauugugaacuucguguagacaccuuuuaaacaucuuagccucccugaaccuuuuucuuaacuuaggcacgauacauagcuugagauucaccuugugaggauaaucugcaacuuaguaccuaaaccaggaaacgauagguauuugauacugagcuuuaaaaauauccuguuuuuuucaaaacacaacaaggaauaagcacaaauaauaauucaaaauuguuuaauugucaugagaauuuagaaaauacauuuguuuaucugugauaaggucuaaaauuucuccauagaguauuaacagucuauuugugaccucuguugcauacuguguauguauagaucaaacuggaacuuaaaauuugaugaacuauauuuucguacagauuuucccugauugguuugguuagggcaguauuuugaacggaaaaguuagcauugcuuuguaagagauuuugagauagaacuuaccaccaucuucguuuucuuuucuuucuuucuuucuuucuuucuuucuuucuuucuuucuuuuuuuuuuuuugauuuauuuauuauuauauguaaguacacugcagcucucuucagacacaccagaagagggagucagaucuccuuacggaugguugugagccaccaugugguugcugggacuugaacucaggaccuucagaagaacagucgggugcucuuaccugcugagccaucucaccagccccuguuuucuuuuuuaacauacauuaaauuuguguauguauauguguuauguuugugcauacaugggugcaucuacauguagagaccagcagauggcacugggcgucucccaaggcucucugagugaaccaggggcuugcuaauuggcuagacuggcuuccaacagccccagucccuagccugccgucuucguuuucugaagauuuugguuuauaaauuucaauuucauauuuaguucugaaugcugaggauuauuuguccacgugaagaaauuuggguaacagcauaaagcuuuuuuauauuuuugaguuacuacaauuaagucugagcuuugcucacaggccccaguggcucaagccaguucuaucugugaaauacgagaauacauaauacaauaccuuucuguuaaguuuugaaguaucuuugaaggcuauuccuuuucaguauuuguuuucauuaacaaauacuuacucggagguaaauuuauuuucugaauauuaaguauaagaaacuuagggaugaccaaccaaugaacauauacaagcuaguuugaguccccuggcacauauguagagaggacagccuugucaggccucagugggagaggagguaccuaauccuguagagacuugaugccccagaaaagggggauacccucucagaggcgaaggggagaggggauggggagaaggacucuaggaggggaaaccaggaaguggggcaacauuugggauguaaauaaauaaaauaauuacuaauuuagaaaagaagaaacuaaaggcuggagaaauggcuccagugguuaagagcaguggcugcucuucuagaggacacucauucaauucccagcacccauguggcagcucacauaggguuugccuuagaccugagucaauuccuccuccaguuccaaagaauaugauacccucacauagacauacaugcuugcacauaaaauaaaaauaagucauauuuuuaaaaguauaagagacauaagaucauuaaauuuuaaguucuggggugauagagguacacauuuuuaauccuagcacuugggagucagaggcagucaagaucucuugaguuggaggccaguaaaaaaccuaaauacauacauagauuauacauacauacauauauacauacauacauaugaaucaaauuauggaaucucuagcucuuacauucuguuuuccugcugucaguguaugcauauguguuauuuuucuuauuuaguaguacgauacuauugcuaaauuuacaguugguucacauuacugaaccacuucauauuuauagugaaauucauacuucuuuaauccuuuuggcuuuaccauucuuuccacgugauuuuguuuaaaaauuccgugucauguuuugccauuuaaggccauaaacucuguaaugcaagauccuggcuuuacuacaugccuucugcaaauuuuuuauaguguggucuggauucagaccaaugacccuggcaugaaagguagaggacaggacuauuucaugcuuucaguucccuuacuuaggcaauuaggguucucugcaaggugcuuaguaacucccuuuucacggagacauucaaauaugauucuuuuuaaaagcuaguuacaaguuuugaaccaaaaaauuaaaguggaaaugcucccuaccacccaccuccaccauacugaaagcauuagaaauuaucucagccuuuccugaagucuauuuuauacccuaguugacuguaacugucacacaugacaggcuggagaucuguuugcauggguaucacaaauaugggggaggcagacuccucaguguuggcagcucugaacucccuagaagacuuauuccaggcuggaaauuagaggcuuacugcucuagggacucagaucagagcacacucugggccuugcaaggcaucagaauccuugccucuuguuguugguuugguuugguguuuguuucuugauugguuuuuguuuuuuuguuuuuuugguuuuuuuggguuuuuuuuuuuggagacagguuuggaucuuaaccuuaggaagcuucaggaacucuuccagcuaccugggauagcuagcuuagcuguucauacuuuccauagccucuucagucugccucuguuagcaaccuccucgcugugguaauuuugacuugguuccuaggacuagcguuuuuauuuuuuaaaauccuuuaugaauaccuugaugauaaaugagccuggagcacggugaggagugaggcuuucugaagccgggcuguaacuucugaagcagugguuucagaggucccugcagcugcugugguaucuccucagaggagucccuggcauguuccaaacagccagucgggcacagucagggcacugcugguugugaaagagcugcuuuuuugacaguuccucagucaaggcaucuaggcaccagggaggagucuuccaguugucagucaaauggccagcuggcuguuucaaauaauuuauuuaaagaaaagccaagggugcuucagagaggaggagucagaagguugggguggggguggggcggggagagaagggaaaagaagagaagagaugagaaaucaaaacacuagaggaccauuagaguaggacuuguccuggaauuaacauccucaaaaguucuccggugcuuagcccuuagccuuuagggagagggauucuucugccugcucuuuuuuugucguuuuuguuugucuuucauuaguuaguauaaaacuguaacuggauagucuccauauaucucaguaucugguacaguaguucuguauauaauacuuuauaaauugauauuauaugaaguuuacuuuuaagguauaucagcagauacuaugauaaaggaaacuuaacauucuuuauugaagauuguaacuaaacaaauuuccaagcaugauugucuacaaauuucauuuuuuuuaauacagggcagaaucuagauaguaugcuccauggcacugguaugaaaucagacuuggaccagaagaagccagaaaauggagugacuuuagcaccagaggauaccuugccuuucuuaaagugcuauugcucaggacacugcccagaugaugcuauuaauaacacaugcauguaaguauuugguccaguccuuaagaguuagaugaauaguaaacccagacaaggguuucccuuuguauaugguaucuuuccauggaaagaaaggauucuuggcuugaauauagaaauacuguugucugucauuaaacaacugauaguuauuaguuauaucaugauacagcuucuuuuuuguuuaucuugaguuuugagacaggguccuuucuacauagaccuggcacucacuguguagaccaggcuggccuugaacucacagagugcuaggauuaaagguaugcaccacuaugccugacuuacuuuuuguuucuuugcugacuuuuaaaguaaugaacauaaugguacuuacuccuuguagcaaauguuuucucuuuuguagauuaccgaaacaaaaaaccaaaauguuuacucauugcugccuuagccaguuagagcagaggguagauacacaagaauguacugugaugguuuuguuaucucucucucugaauuucuaguccacaucugcuuuauaugacauaacuguauguuaaccauucaguccacuuacagauggucauguaacuugaguucauaucuuuuaaacguguauguauugugcaugugugcaagauauguguguagauauacauaaagagaucggaggguaacuugcagaagucuucuucuacuaugugggauccaagaguggaacucaagauuagcaguguagacaagagcacuuuuacaugcucagccauuguguguccacaguccauaucuuggagcacauugaagaauuguucauguuaccauacuucuuggcuacuuuauuagcuucuuaauaucuacuacccuucuccaccccaaucccuaccaacccuccaacacuagguaggagagaaagggcuacaggagaauggguaccaucggucucauuagcuacuuccuacugauuagggacaucaaguuccuuggggcagauucaguuuccguugucaggguaucuccaaccagcaauccagcaaaagcagcagcaggaaccagcagcaggggagcagcugcugccgcagccuccuggggcucugacauuuuuauacccucucaagcgugcccagaauuccaaacaucaacuuucuucagcuggcagaaucaucccugcuagagcaugagacaaauuguagccagcugcuguggacaaucugaagcagccucccaccccacaccugggauuaaaguaaaaauauauucacauagcuagguuguuuaggaaaccaaauuuccacuacacuucuggacaaaaacaaacaaaaaccacaauucagucucaucagucaauuaauugucuccuuguuguagaauuaaaaaggaaggccaaauuuuuuaguuuucugugcucuuugaguaaacuagauauaauuuauaaaacuuaguguaugaaauuguauaauuuauccuuccuauauuugcuaagggaaaaccucaaggacacugauauuaaagugguaaaacuugggcugaagaaauggcucagugguuaagagcacuaacuguucuuacaaaggucuugaguucaaaucccagcaaccacaugguggcgcacaaccacccgucaugagaucugacgccuucuucuggugugucugaagauaccuacaguguacuuacauacaauaaauaaaucuuuaaaaaaauuauaggggcuggugagauggcucaguggguaagggcacugacugcucuuccaaagaucaugaguucaaaucccagcaaccacaugguggcucacaaccacccguaaugagaucugacgcccucuucuggugugucugaagucagcuacagugaauuuauguauaauaauaaauaagucuuuuuaaaaaaaauuauaaagugguaaaacuuuguaaaacaaauauauuuauguaaaaaauuguaaaaugaacuauucauaccuucucucugcuuuccagucacauuuauuaugguguacuuucagaaucuaagucaucuguucuucccaaauauauuuugcugugucauuagggucugcugaacuguuuuucagaaaagcuuguuuucaucuccuaccauguaucuauagcgugugauugugaguaugacuagcagaggaguuagcaugaccgcauacacauggggagcauuuaauaguagaacccccuucccacuugacagaguucucaauacuuuacgcacacuacccuugauguaacuuaaaucuaaauugguuuugcuaauaaaucacaugaaaaugcaauuuaaauguaaaaaacaagguauugaaggcuauauucaagucauauaucuucaguccuuuuguaugacuuucaaauuuuuacauucauuuauuugguauguauguguguugugcacaugugaacacaucagcuugucagaauuaguucuuugcuucaccauuuggguuuaagagaucaggcucgguguccagugccuucaaccacuaagcuauggccuucuuuaucagacagucucuguguagcucagggcgaccuggaucucaagauucuccugcuuuggccucuugagugcauguguaccacaacucucugcucuuucuaauaugaaauuguauuuuuguuuuucucucuuauagaacuaauggccauugcuuugccauuauagaagaagaugaucagggagaaaccacauuaacuucuggguguaugaaguaugaaggcucugauuuucaaugcaaggugaguucgaauuuguaaccuaucaccagaaugucucaaucugccaucugcccaaguaaugacacagagaccuuuuauuaauuaugaaacuaggccuuugcuggcucauauaacuuuaauuaauccguucauacuaaucucuguucuacacauggcuuguuaccucuucucagucuuggcacauguuucuuucuccauuucuggcugacaaaaucccaugccuaggucuuucccagaguuccuaucucugcccagaagucuugccuguccucuucugcuuugcugcugagcucuuuauuaaaccagucagagguaauggagaagaguguuacaaaacaccgagacaaguggugcuuccuaaaaauaacacuauuggcccuguacagaaaucagccugugaguaacacagagacagacagccuuuccacagagcacaagagacugucccagcagcaacucaagaaggaaaggaaggcagaacucugugagcagaguugagcucccuggcagaagcagacugcgcuugcacacacugugcucacacaauuuucuaaagaaagucuuucucaucacguaauaggguuuuacucauugaaguucuagauugcuuuacuuucaguuuugaaucauccugauugugguugaugcaaaaaaaaaaaaaaaaugaauguuauauuuauguauagaguauaaaauuuuuugaaaagacuuuaagauaguaacaauuguuuuccccaugacaacacuauuaaguccuuguuucagaauguggugauuuguauaagaugucgccacagucucggcaucugaauacuugaucuccgguggucuguacuguuuggaaagguguagggcaugugaccuuguuggagaaagugugucacugggggcagaucauaagaggauaaaaccuuaccuggugcuaauuugcccucugcuugugguuugaaguguggggccuuagauucuguucugcugcugcuaugccuuugcucuacugucauggacuacuuuaacucuagauccauaaacacaaaggaacucauuguuguguaaguugcuuuuggucauggucauggugauggaucacagcagucaagaacaacuaauacaggguuucuguacagcuacuugagaagagcgguaauagagaggauuccuucaguuuuuuucuaaaucgugugaauuucuuaagcgauccugucaguguuuuugaaaagcaucucugaauagaacuauuuauaaaugucacuuaugucagaaaauuagcccuauugagaacuggcaggcuugauagaaaacuugagaguuaagauuuauacuugaagucacuggacaagaaucuguucccugaccgggcagugguugacacauaccuuuaaucccagcacuugggaggcagagacaggugaauuucugaguuugaggccagccugucuacagagugaguuccaggacagccaaggcuacacagagaaacccugucucucugguacaaacagaccuaagcucuccucagaaugcuuuuuagugugagagugaaguuguucuaucuacuccccaaaggucuuuuccucuuagggaaaucucagugucuuuagaagccucuuacauagccauucaguuauuacacuccagagugccaguguaguguacaaucaagugugcuguauguagagaaaaucuuccucuuauucugaaugcagccacauguauucuagcagcugugcuguauuaaggcagugaacuuuugccaacuaaacccuugugucucuaacucagucugcuuccaugccagccaucccaccccaccccacucuucacuggugaugcugguccuuugauguaaguauauaggaaugaggugguuuuauaauuugucacauauuugucaaauuguaauauguuaagauuuguucagauuugaaaggauuuguuucuuccaguuuuaugucauuaacaaguuaucaacuauguaugccuuuguaaaccacuuuuaaaaucucaaggaggagcagugguuacaggcucugaguuacaacaagauuagcaagaauccuacaaacuucuagacugaauuggucccaaacuuaguauaaguuaguuuucaaguuuaaucaucuguccaaauucauaugcuuccugauaagagcugugaaacuuugggcaaggagcuuauuuucuuaggaauuuuauauaucaaaugaaauaacauaggaagaucuuaguaaauguuaaaguuuaucucaucuugagcaguauccaguaaugucaccccuaucccuaggugugcgcauacuguugcacgguagaaucuugagcacauggcuuuaauaucuauacuugcugaguuucuuuuguuaaguacggucugaacagagcuucucaagucccauuucuucccuuccauaaucacccuucuucuaguuaagagaucaugggccugggaugucaauaucugaaaauucuacucaguucugugcuuagaaaugaaaacaccagcaaaaagacauggggauauugaauauguugguguuagguggcuguaggcuugauuauuuggggguugcauuuaugcauuaagaguaugugcagcaaaucguguggaagucagagaacacauguggagucugcucuccugcccuguggguacugggggucugacucggggugccaggcuuggcuguaagcugaugcagaggccauggagagaugcugcuuacugcuuaccggccugcuucccauggcuugcuugcucagccugcuaugcuagagaacccaccagcccagggaugguaccacccacaaugggcugcgcccaucaaucaguaauuaagaaaauacuugacaggcuggcccacagcacagauuuuaggaaaguacuuucuuucuuuuuuuuuuuuuuaauuaauuaauuuauuuauucuuauuuuuuauuuuacuuuuuaaaaaacauauauaagaaauaaauguaauaaaccaaauucuuggacaaaaaauacaagaaucauaugaucuucacaauggaagcaguaaaagaaaagaaaaaguuugauaagauugaacaugcauucuuaauaaaagcccaagaacaaguaggacuguaggaaacauauuccaacauaauaaaguuauguaugacaaauucauggccaguaucauccuaaaugaauaaaaccauuaauaaacuaaaauuaggaaugggagaggacugcccacugucccuacugcucauccauaaugugauugaagcauuagcuggaacagcaaggcaagagaagggauacaaaugggaaaauauuaagucaaauuauucucaguugaagauuauauuaucuuauauacaauguuccugagcuucccuccucucagaugauuuuaguuugagucccauugacacaagacuauucagcaguauuacaacuacuacugcuccucggaggucaucucuugaucucacucuugaucuugucucagugcuagguagagguauagauaaaugauuccuaugcacuucguggucuugcuaccccaccucuagagcacuguccugucuucuugugagaggagucaguccucagacccucacuccguucauugucacuuggcuucagugcauucugaguacuaucuuuggcccaagcacauacuguuuacuuaagccagacucuuccauuucauagcugccaaauaaauuguucucugggacauuaauuaaauaauuaauuaauugguuguguguauaggugauuuuccugcauuuuuguaugugcaccaugagcaugccuggugcccagagaagccagaagagugugucagaucccuuggaacugaaguuacagaugguuaggaacugccacauaggugcuuggacucaaaccugcauccuggaagagcaugcagugcucuugacugcugaggcguagagcuucagguucccuccccucacuuccauagucuacagauagguaagaugacuuggauggaguguaggaaagagaaagcuguuaccccauuccacauucuagauacugcuuuuuauuuuucaaccugaugcaccguuaacgcguguaagaaaggugugaggugggucugcuauaauuuguuugugguaaagacacaucaggucuugaaaggcugccgaagguuucuucuggcuuauuuaagacccuggaauucaugucauacucaacagagaaugaagaaaugaauuuauugaauauuuucuauuugcauuuaguuugcuacguauuugguacauuccaucuuguugccgugugguuccucuguaaggcaaacugaaacggaauuagguacucaggaucacgaagugaggaacuggcaaagcuaguucuuuuucuuuuuuccucuuuaaauuauuaaauuacuuucuaucuguuaggaaaauuuuucuuucccuuaaaugaagucauugauguguggcugucuaguuucccaaccacuguucaagaaucuuuuaaguuaugccugucuuugaggcauuaugcuuaaaagugucuucaucuuccuuccucacuuagaagguaugaacucacaugacugucugcauagcuguagagcauuaguggccauugccuggugcauagucugcuuuuauucuuauagucaucucugguagagaagacagaugagagaaauugagaauugggucuucaucuuucauaucugcuauuaagugggcaguaauccaugguuuagagaucuuucacccaagacugccaaagauauccaucuuuguuuuccugucacauuaauguacucaaggcgaucuucguucagccuuccugggaacgacugcuuggcaccucauuuauucaucgucaguuaugcaaucauucuucuaugcugauugucucuagguggauuauuucagaguuugcaacaaaaacccuaucauaucucugucuuugugauaauuucaaaggaauuauuuuaaaaauauacucaguuaaaauguagaauuuagcugggcgugguggcgcaugccuuuaaucccagcacuugggaggcagaggcaggcggauuucugaguucgaggccagccuggucuacaaagugaguuccaggacagccagggcuacacagagaaacccugucucgaauaaauaaauaaauaaauaaauaaauaaauaaauaaauaaauaaauggcagacucugaauuggucagucuaaauucuuuaaaaaaaaaaaaauguagaauuuauacauuuggacauuucuaaauguuacugucuucccaggugggauuuaagccauagacucucagucacccuucuuagguaacaccugauuauuuccauucugaaugucugauauuuaaaaauaauguggucaauuuuugcuuacauucuugcuaccuucauaaugcuguacaggcucuuucuauucauauuuuaguucagaauggcauuugacccaggcagcacugaaacaucagcaugcaaucccuaugucugccuccaugacuggagucuuuguaccuguuuaucugguugguguagccaccucucuuaaccaguacuccucaccccacuugacuaaaaccccccugcuuuguagucugaucucaaaguagucucacccaaaucuuauuucugcugugauuauauuuuucauaccaguuuaugauucuaauaaaauacuauguuuucuagcagauaauuaccuuuuaaagcuaaaaaaguagcuagcugagugguacuuuaaauauacuaauguaugaaguaaaaaaaaaaaucaccaaaguucuucauuccuuuauaauuuauaauuacugucuuuaucuacauauaugaucuuaaggacaauuauuuuacaaucuuauuuucauaaaaaaauuuaaaauuucaguaaaauucuuuuguuauuuuuguuuuuuggaacaagguuucucuauguagcccuggcugucguggaacucacucuguagacccaggcuggccucagucucacagauucaccugccucugccuuuuuuuuuuuuuuuuuuuuuuuuuuuuuuuuuuuuuuuuggguuuuuugguuuuucgagacaggguuucucuguauagcccuggcuguccuggagcucacuuuguagaccaggcuggccucgaacucagaaauccgccugccucugccucccgagugcugggauuaaaggcgugcgccaccacgcccggcaugccucugccuuuuugagugcugggauuaaagguguaugccaccauacccagcuaauauuuuuugacauguuuggaaauccuugucucuggguuauaaauuauauuuaccaauacuaaagauauucauauucaauuuaauaugucaagccuuuuaauuuuuccauuauuuuucuuaaaggauucaccgaaagcccagcuacgcaggacaauagaauguugucggaccaauuugugcaaccaguauuugcagccuacacugcccccuguuguuauagguaggucagcccagagaaguccagguaugauucucuauaaguucuugucuguaacaauagccauacuaccuagaauucagugcuaugaauuauuuucucacccucuuuguacgaugcagcagaaagauacuauaccuuauuguugacuuugguccucagguccguucuuugauggcagcauccgauggcugguugugcucauuuccauggcugucuguauaguugcuaugaucaucuucuccagcugcuuuugcuauaaguaagauucuuauuuuuauacaaauauauugcuaauuauucuauauuagucuuaucuuuaaaaaaaaacagguaaaaaccaaugacuacugaaugcaauucagaaauucagaaaccacuaauuuauauucucuggcuuuucagcuguguuauggccucccuaggaggaaaaaugaacuuaauuaccaauuaauauuuuuuaauacuaauuuauucuuucauauuuaagaauagucauggcuuucuuauuuguauaauagugagcuuuguuauaucugaaucucuaaagcagauuccuggauaacaucaccacuuuucuaguuuaauaauuugggauuuuuuucagugagaaaggguuaucuaugaaacaaguucguaaucucguaaauaaaucuauauauaaagaauucuacaauaugauaaagcuaucaaauuuaagaaccuggaggaaaagauaaauucaauaaguagauuuguuacuggguugcuauauaaaaaaaauaaauuugggacaauuucuacacugguauaaauuugaaccagauauauucauaugcacaauuuggagaaccuuucugggucuggaacuuggaagcaagcaaggaaguaaauaaaauaugaguaguaucagcuacauaaaaccuucagcugggcgugguggugcacgccuuuaaucucagcacuugggaggcagagguaggcggauuucugaguucgaggccagccuggucuacaaagugaguuccaggacagccagggcuauacagagaaacccuaucucgaaaaaccaaaccaaaccaaaacaaacaaacaaaaaaaaaaaaccccaacccuucagaaauguguggcaaaaaaaaaaaaagaaagaaaccaaaaaacccacaagcgguuagaagauggagcaaaugaaaacuccuggcagcugaugcugcaagggagcuuauauacaugaaaagagcaucuacaaaucaaaauguguaauucagcaacuagacaaaagugaauacaaguuuuaaaagaaauagcauggcuuucugaaggucuuuauuuuuugagauaggaucucacgcuguaacuaacccuggguagcuuugcacucacuguguagaccaguuggccuggaacuuacggagaugaacaucaccucuacuucccaaguacuagaauuagaaguaagugcaggccacaucagcuaacuuccuuuuccucaguuauucugcacuguaguuucugagacaguuucucucacuaaaccuggagcucacuguugugggcuagaagagcuugccaguaagccugggccccuccugucuuugccuccccagugcugggauuacagguuuacccuagguuuucaugaaccugguauuccgcuucagguccuuauuaugcuuguauucacugacagucaucacccuagcuccucacauguuuuacagaagauuuuugucuuuuuugguuucucaagacaggguuucucuguguagcuggccuagaacugagaucugccugccucugccuccugaguucuggaacuaaaggcgugggccaaaccaccauccagcucaaagauuuuuuucuuuagauaaaaauagcagauugagcaagucagccugaguuagagugagauuguguuucacaacaaacaaaaauguauucuaaaaacaaacaaaaaccaauuuaucaguuaugggguaagacaugaucaugaaaaugaaagauagugaacauuuaauuacugauuaaauagccuuggccaagccuguauccuauaaaccagauaggauuagggaaacaugagcagggugggagaaaagaccuaaagaaacugaugggaauuaagugacauggccucggcagauuaaguuuaugacaguuagcucugcaaggcucucauaguaaacacugacuccuggaaauagaaaacaaaggagguacgcauuaagauugcugugcucuugccugaagaguguuuggcuucgugacacagggagggagcauaggugcaguccaugagagucucagaugagaacauauaggugagagucugggagaugucaucagcuguauucauggaacaggguacuagagaauagagggccucacaggagaaaacuugaguucugcagaugaccccaugcaguauucagcauguucauucaaaaaaucucccaaggcuggagaaacauuaaaugacugaaggaaauaguauuggugcucacggaaagcuaggaaugguaccuguuaaccaccgucucugagagugugaaaucguaggucgugguuaaaguacucagugcuuaccucagugacaguaaugauuagugccagacuaaaugcggcugaagucccaccugaaaaacaagacccaacugaacaugguggugcacacccuuuauuuccggcacucaggaggcagaaguagguggauuuccaagauagaggccagccaguccacauaguaaaagcuagucuuuuuaaagaaaaaaaacugaagguuuaugcuauuuuucaguuuuguucugugaaaaauaacacaauacuuguaagaauuuaucuauuauucucacagucaggugauagaaaccagaggauuaggaguuuagggucauccucaacuauguaacaaaagcuucaccaccagccugggcuacauaaaacaacgaacacaguaucaguuagaauauaaaauauuccccauccaaucaaugaaccaaauugcaaaguaggaaaauaagaccuauaacaaggaaaauuaaacaauaaaaaccaccaguucagacucaauacaauuuaaaauugucaugcaauaucauuaaaguaaucauuuugacuacucuauguuaucaguaauggggcagggaguacuguguaccccguaccccugucuguccuggaacucacacuguagaccaagcuggccuggaacucagagauuaaccugccucugccuccugaguacugggauuaaagucuaugccacuacugccagacaguguuaacaauaauuuaagcagaaacauggugagacuuuuuaaagaaagauccaaauaaaacuugaggaaaugaaauuaaaauagaucaaauaaaagugugcauuaguuaagaacaaugacaaaucagaucccacuuaagagaugagugaauauggagacacgacaauagaagcuaugcaaaagaauuuauaugagcauguaugcaugugccacaguaugcacguagaaguugugggacaacuuuaggucuugguucuuccaccuuauuugagacauugucucuuacugaugcauauaucaagcuggcuggccagugagauuccugggauucuucuaucucugcaucccaucuugauguuuuauguguauggauguucugccugcauguaugucugugcaccacauguauguaaguguucuugaaggcuaggaggguuguuagcugcugggauuugaagcccauguucuuaaucucugaaccaucucucuagcaccagagacaaaauuaaaugcaauuggaaaauggcagauuauagcuuugacuggccuaaagguuucuauguagcccuggcuggucuugaacucacugagcucagcuggccauaucucucuaguacugggauuagggcauauacaguuuugguauaaagauacaguuuuuaagaguauguguguugggcuggagagauggcucagugguuaagagcacugauugcucuuccaaagguccugaguucaaaucccagcaaccacaugguggcuuacaaccauccuuaaagagaucuaaugcccuccucuggugugucugaagacagcuacaguguacuuacauauaauaaauaaaucuuuaaaaaaaaaaaagaguauguguguuuauagcuauauaaguaacuuucuaugcugaguauccuuucagauuuuuaaaacacacuguuaaaaguuacaauuugaauacuuuuuacagcuguaaugccauauuacauucuucaggaaaggggauguuugggggguuuguuuagcuuuggauugggggggggcgguagaaucuuaacuauguagcccaagcuggccuugaauucaagaucuucucaccuaauucuuccuagugccaucaccucuggccucuggggcaggaguguguauugguguuggugggguuuguuuuuuguuuggucuggguuuguuuuuugucguuuuguuuuugagacaagaugucacuucauauccaggcuggcccuguagcccaagcugcucuaaucucccauuccuccugcuuccugccucccaacugugggguuacagaugcaugucaccacacacacuaugcuauuuauguguauguguaaaugcaggcauacauacauacauacauacauacauacauauucacuugcuaauagacuauggccaucucuucauguuaguaugacacacagcauucugucucauauauucuauuucuacuggacuauaauagaauuuuuaccuguggugaagauugauuaggcuacaauucuuccuggaggcucagguuaucacagugcuccaauuuuaaaguagauuguuuucugauuuuuuuaaaggcauuauuguaagaguaucucaagcaggggucguuacaaccgugauuuggaacaggaugaagcauuuauuccaguaggagaaucauugaaagaccugauugaccagucccaaagcucugggaguggaucuggauugccuuuauugguaagcucaaagcaucuuacaaauauaaauuuuguguugauaaggaugugacguuguugcuaagugggaaucuuagauauugcagauuaggaaauaauagauaauuuuuuucucaagaugaaguuaguuaaaaaugagaaaugugagccaaggaaaauaggauaggcaagauaaagccauaaguaaaaagucuagcaguugcauaagauaauaggauaugaaguccuguguaaacgcagguaagcuacauauuugcauaagcuuuuuuuuucucccuucuacuucaaugcugaaguuugagccaagaacucaagaaugccaagcaagcauucugccaauaaacuacauccuuggcacuuggaauuuugagacaaggucuuguagaauucagguugcccuugaacuugagauucugcugucucugcuuuggcuuccuaaaugcugggguuacagucaugagccaccagggccagcuggguacucuaacuauuuuguaaccaacuaagcaaaaaaaaaaaaaggcagcaagaguaagauuccuucugucuuuaagguuaaacuaauuggcuaaggaaguacaccuuuuaggucuaaaagggguuacagaguaauuuuaauggauuggguggguggguggguacaaggauggagaugaucagcuccuaagaacagcacucugaggcaacucuucucaucacaacacuacauuuccaaguagguuuuuaacuguuuaauagcacuacuugaaaguaaaugaaggaucaucuaaaaguaauaugugauagaauugagcaggugagaauagagcuaucuuugaaugugcauaguaugauuauguuaaaaagaaaugcuagaguugccauacauaaaccuacuucaacuaaugcguaaucaguuugcagaguacaaagucauuauuucaguuuuacugaauuuauauucacuggcaacuuaaaggugccagucugaaauuuuaaaguuaagaaguaguauuauuuaaaauaguaccaaaaaacaugaaauauuuuagaaauaaucuuagcaaauauguacauuguaaaauuuguacauugaaaauuauuaauugggcuggagagauggcucaguggcuaagagcauagacugcuuuuccagaaguccagaguucaguuuccagcaaccacaagguggcucauaucaucuguauugggauccgaugcccucuucuggugugucugaacacagcgacuauauacucacauauauaaaguaaaugaaucuuuuuuaaaaaggaaaauuaauugcuaaaauuaauggagaccuaaauagauggaaguguuuuauucuguuuaugaguucgaggcaguaguauugcaguaucaaguagccucacauuggagcauuguuucauuucaauccaaaaagaaaucagaccuuuacagaaguagaugaacagauuuauuaugagcuaagguuguuuaaaaagaggacacaggacuaacugcauggcuucuggacuuacuuuaaagcuacuaugguuagcguugccuguauaguggauagagcagagccuagaaagggaugccuagacacaaguuuauguguaugggcauuugcuugccuguauguaucuaucuguauaccaguuagguaccuggugcucacagaggccagaagagggcguccuaucacguggaugaagaguuacagauugcugugacuuuccuuaggugcugagaauugaaccugaacucuuuagaagaacagcuagugcucuaaccacugagcucucucucuaacccaaucaauugauuuuauuguuuggaguucuuuuuuugagauagggucucucuguguagacauggcuggccuugaauucauagagcucugccugcaucugcccuggaguguccagacuaaaggugugcacuacuaccuacugcuuaauugacuuauaaaaauuuauuauaaaaaguuauaugaggacauuguuuuaaaguaaugaaguaauucaguguugaauagauuauuaaacagauaaugugggauaaaaacaccucagguauucacuugcuaaaaaguaaauacauuccuauaccucacucaguauauaaaacuaaguugaaauggggguagacuuaaauguaaaaguuaaacuagaaaaaccuccaaaagaauuuuuaagaaaaaucauugugacuuauuacauaaaaaguauucacagcacugguuaggcagaagcaggcagaccuuugugauuuuaaagacagccagagcuauagauagagacacccugcuucaaaacgacgacaaaaaagaacaagaacuaaaagaugaguccggggcugguaaaauagauuugauaaguauacagccuauacaaagacaguugacagcuccauaauaagaugggcagcuccauauuuuugacuggacagaagauuugaaugaaagaguaagagcggcacgugagcucgucugcaccaucaagggcaugaggucaagugcaccacggugcugaggauacuggagacgucauacucagcugucacgugcaaagugacaaagguugauuaacaaguuaacuguauacuuucuuuuuuauauuuauuuaguuugauuuuuuugggacaguuucuuuguguagcccuggccuggaacuugcuuuaaaggccagauuagccucaaacucaagagaucugcuggccucuaccucucaagugcugagauugaagguguuugcuuuguauacaauaaaacaguucugccauuuacccuaggaauggaaaacuguauuuacccaaaagaccugagagugacuguccauaguaaauauagucuaauaaauaaauaaauuagaaauagcccaccaauuuggcaaguggauaaacaaaucauaacacauucaucaguauuuagaaacaaaucaauaacagaugauuucaaaggcacuuuaugcuuggggggggaagccagauauagaaaacuacauaguuuaucuauuuaugcuacucuaggaaauauaaaacuguagggauaaaauggauaaguaaugucagcaaagcaggaaggaauuaauaaugaaagugggaauuguuuuaggaaguggaaauacuaagucucaagugagauuuggguaauuagaugacuagacauuuaacagaauauacuguccagucuuaaaaagggauacauuuuauuguauauuuaaauuauauuugaauaauccuggcuuuaaaacauuacagagucuaugcuaagugaugcaugauguaagccaguucagcuuugcauagcuccagccucagauauaccauucuuuuuuucauuuaaaauuacugauagucugaaaaugaaugaugaguauauacuucagguauuauucccaauaacuaauuaccuguauucugagccagaaauagaauuuaagugaagcuguguacaaaaacaaaauuguaauucugacaagucaaguacagccgaggaacgggaaggggagggggaaugagaaugaaugaguaaagauguugaagcuggacaaacggcacucuacagaaaaugaggccugcagugagauccacgaggaauaaacacgugugucacaggcagccgguguggaacuucagaaccggcuuagagguucagcaggggagccagcugcuuccauacccucaugaagaccagcccuccucuaucuggggaagguucaagagggauaaauguuuagacaugcagcucagcugaaucgacccuggcaguuaaccuguugauagaugucauagcuagaucagccucacagucaaacuauuguaagagccagaagugguggaugccuccaagaaaaccauaucuucagacacaauaggacugauaaacguaugaauucagaaacugaccacaggcacagcuaagaccaaaaccucagcacagaggaaaguaaacauaucucaccucuaaccaaaaaaggacugggaggaauuuggggaggaaaaagaaugaucaaaauauacuguauaaaaaauuaaauuaaaaaaaaagagaguugaaauuguugaagagaguguggguaaguaguaaaagcugggacugugucggaucagcuaggaucuuagaggcugcguuuaguaaaucaccuguaacucagaggcuaaagccaaaagcauuuaguauuucucaugauuaugagucuguuaggaaguuuguuaagcuacauagcuaguccauggggugacaguugauauggugcuucaugagagaagacagaaaggcagguuaugguacagagucugugaggaccacuuguuacacauuggcuacucugcagcccaaaagaagucaaccaaaacccacgagugugggcaagcagaguucccagcgguggccgacuagcccgugugugguuccagaauacauguucauugcugcuuuuauauaccauaaaccuuggagcuauuugguuaugccaggcuuuuaauggauggcuuuaauagauucuuuucauaaagagcucaaacccauauacuuuguuuucuguauagguucagcgaacuauugccaaacagauucagaugguucggcagguugguaaaggccgcuauggagaaguauggauggguaaauggcguggugaaaaaguggcugucaaaguguuuuuuaccacugaagaagcuagcugguuuagagaaacagaaaucuaccagacgguguuaaugcgucaugaaaauauacuuggugaguuucuuacgcuuugguaagguccucacucuggcaagguucucaggguaugcaggauagccugccgugugcauguggauucaaaugguuguguagcuaaaaaucuaguagacuuuacagugaacuauacacaacucuuuccuggaugccaagaaagcaucuuacgacucuaaacaacauugaguuucaaaaggagaguaagagcugcuuuguugaacucagguaauaacggaagccaaguguugggcagagaacuucagugcuuuucucggguaguuuuaacugcauggagcuuuuuccuuucgucauuagagacucucaaugugugacucuauuguauuuuauacccaauauauguuccucucaccaccucauuauauaggaacgaaguacuguagguaucugaugaguggaguguaaauagaucuugcuuuucugaguuuucuuuucagcugcuauuucauuaucucuuaauuuguaaagugcauugccuauugccauguacagacauuuauauucauuuccuguugcuacuagaaaguaucauaaacugagugguuuaaaaacaucagaaguaugagugggugugaugguacacaccuuuaguccuagcacucagguggaucucuaaguucagagauagccuggucuccaggaugaguuccaggauacccaucacuacacaagaaacaaaaaacagaaauguaucugggagggaggaacggacagacggagggcgggggaaagagaaugaauugagauggggagaugguuuacuuguugaagggguugccuaguuggugaaaaccuaaguuuagaauguauguaaagagugaaguuugauggugugauauggaagguuggagacauguagaauccuggagcucugaccagcucuugccuaccuggcaagguuccaggccagugagacacuuaggucuccaggggugugaagcagcagaggaccgacaccuuagguuguccccugaccuccacaucuacucacacuuccaugcguacauggaccugugcauacauaaaaggagaucaccccucaguuuuaggguccagaauuuuaaaaugaagcuguuggcagggccaugcccucucugcaaguuucuuccuggcuauaggggucguuaguguucuuugacuuacagacagcccuccucucaauauuucauacgaccuucuggccacauucccaucauaccaagggacacugaugagggaauugugcccagucuuaccauggaaauguaauuuuaucuacgaagaucccucuucugaugugacuuaaaauaucuauuuuucaacuugcaauugaaagcuuuuauuuugaggauucaggguuuugggguuguuuuuuucccuuguaauugacagucuuacucuguagcuugggcagccucaacuugugcggucuucccgccucgucuccugaauacugggguuacaagcuugugcuccacucgcugauacagaaccuuuucaagagagagucauguagguaaauagcacgugcaggaucuuauauaauauaugauuuuuuucuuagucauaugauuaucacuguugugauuaaugguaggauuaucauaaaucagcucuaugugguacacaugcuuguaaucaaucucagcacugaagaggcggagucaggaugaccacaaguuugaauacagccuggacuacauagcaaaagccugucuuuaaaaauacuguaaauuuggacuggaaagauggcucagugauuaagaccacauacuguccucgccgagggccugagcgugauuccuagcacccauaucaggcagcucaccacugccuguaacuccagcucuaagggauucaacaccccucugaucuccuucacaaacccacacacacaaaauaaaaauacuguacguuuauuguaaaccuaaaucauagaaaaugaguucuuggugauacuuugaaaacaauuugcuagucaaauuaggauaauauuuuuuauacauaguucauucccaauacccuaaugugcaucuguaacugccuagugucucugcaaacaacuaaccuuuuaacucauuaacuaaacagguuuuauagcugcagacauuaaaggcacugguuccuggacucagcuguauuugauuacugauuaccaugaaaauggaucucucuaugacuuccugaaaugugccacacuagacaccagagcccuacucaaguuagcuuauucugcugcuuguggucugugccaccuccacacagaaauuuaugguacccaagggaagccugcaauugcucaucgagaccugaagagcaaaaacauccuuauuaagaaaaauggaaguugcuguauugcugaccugggccuagcuguuaaauucaacagguaaaugguucuuuguccacuguuuggaaauuauuuuguuaucuaacagguacucaggguuguuucuuuuucuuuuuuuuuuuuuacaaaacugcauuuuaugauuauuacagauugaacccaggaucuuaugucugcuaagcacacacucuacuacuaaaugacauuuccagccucuacauaauuguugauuuccuuuuuuaugcuuuuaguuuaucuuuacuugcucuuuuugcagauauaguuguccauguuaaauauaaaauaaccuguagccuaaauaaugagcauuaaguuugcuuccauuucaucuguauuuuaaagaaaguuauaaagcugcuuagugguggcucacaccuguaguccuagcaguugguaggcagaagcaguugaaucugugaguucaaggccagccugaucuacagagugaguucuaggacagccggggcuacacagagaacacugccuccaaaaaacaaagcaaaaacaccacagcaaaaauaguuaucaugaacauuauugaaucuuauacaugucacucuguucuugagcacuugcauaaauauuuuugacugggguucaggagucgucccauaagccacaugcgugaacacugaucucugucagacagggagaguuuauugacugcacaccccaagaguaauugaucacaguucagagcugaagcuaagaccccuaauaguucucagggccagcuuuuaaaggcuggcccuuuaaaaaaaaaccacaaugagcucauauacaggugcuggaagcacugcccaguggucagcccugacucaagguauucuagauauaagcgcuuauauuaaccuuuaauuuaauggguccuaagugaagcuuaugguuguggaauuccuuguuuguuuguuuguuuguuuguuuguuuguuuuuccagacaggguuucucuguauagccuuggcuguccuggaacucacuuuguagaccaggcuggccucgaacucagaaaucugccugccucugccucccaagugcugggauuaaaggcaugugccaccacgcccagauuuuuuucuuuaauaauuuauuugauuuuaugugcauugguaugaggcugucagaucccuuagaacugaaguuacagacaguugugaguugccaugugggugcuggaaauugaaucuggguccuuuggaagagcagucuuuuuaaaccucugagccaucucuccaaccgcccuggaguuucuuaagauuaacaaaccucauaacaucuagaacauaacagaguuuguggucagccugacccugcucugagucaaguuucuuuucuacaucagugacuggcaggcauuuuauagcaacaauaugaaauagcuggcagacauggagcaaaaugacuauaaauggacaagccucaucaauuuuuauucauaauagauuucuagauaaaggaggcuacuggaagagguucuauauauuaacuuaauggcauauuguguauauauacugcuucagaacaguuuugugugugaauuuacacuccuguaaauaggggaaauaauuagguacuuucuuuugauguugucaguuuucuaaaacaauuucaacuauaaaaauuucaaguggcuguggcucaagacagugcaugcagucagaaagaagagagaaauacuugucuugcuuuucccuuuucauuaagucugggcuccaguugauggguggugcugcucauauccaaguuaggucaguccucucauaccgaaacaccuggaaauacccucaacgacacacacagucccgugugugaaaugauccccgcucuguucaguagacaguuaaauucugugaauccaccucuugccaacuugacacccgaacuugacauuuaagcuguaguauuccacccuugauuguuaacauucaugacuuaucuuaugguaaucauacaaaaugaaccuagcucucuauaagaguccuugaagucuuaacaguucuaauguugcucaaaacgaagauugaaugcaagguuugauggcacagaccgcuaaucccagcauuuggguggcagagguguguggauccucuugaguuuaaggacauccagagcuauguaauagaccuugucuccaaaaaacaaaaucauauaaacaaaccagcaacaagaacaaaagcccaaggucagaauuucucauacauuuggcacaauuccuuaacuguuagcccuauacgagaucaaaacuaagguagauauuucuaauacacugugccacagaguagccauuuggaaacuugacuagagcaugacugaaacccagaacaagcauaggccuugcagcuccaugucuaguaccugacucaggauagcaucaucugggcucuggggaaccuagguagcccauccacuguuuugcuaccugcaguaaaggugcccucucuuaagcuagcucuguuucguacuuguagcuuuucuuuauuggacauccauaguccuagcaucuccugcuuccuggaugucuuauuuuagggacuuuuaacucugcuacauaguccauugaggagccuggauaaagccucuguggcugugucaccuuugcgugugcucuuccugcagaaccacauggcaauucuaaucaaucugcuuucucauuauguagucaguuucgcuccuuucugcuucgucuauaggggccugucugugccuugacagcgcacacugggcagggauaaaucaaaaauguuucuaaaaccauucuuuucuaauuaaagagaugauucuauaguuaacugcaauuucuaguuaagagauuuaaaauucauaaauguauauauaaacauauagugauauauauacauauauaguucauaaauauauagugacauauguuauaauuuauuugcacaguuucuaaagacaaaaaucuuaucacugucaguagcucucugacucaaagaaacuugacaaguccugguuuuaauuaaccuaagugagcccauuccuuuacacuaagugcaaaucagugcacugaaagguaaugauuugugggauaauaaagacaguucauggaaauauaaucacaugauugagacgccuuggcaacuuagaauuuggcugccauaaaggaaugaacagaauaccacaguaugacuuaguggccuauacuucaacucauucuuugcauguagauucuaccuuuguguguguuuguagugguucagcaaaaaccaugaaaauaauuuuguaguaucagaauguuauucaacuuugucuuuuguuuuuuuguuuuucgagacaggguuuucucuguauagcccuggcuguccuggaacucacucuguagaccaggcuggccucgaacucagaaauccaccugccucugccucccaacuucugggauuaaaggcgcacgcacgccaccacugccgggcuucaacuuugucuuauuaaauaccuguguuguguauaauggugaacaguuaacaguaguuuuauacuccuuuagaaaauagguaauauccacccagauggcugcauaaguaaaggcauuugccaccaagccugauaacucuuccaucccuggaacccaaaauggaaaaaaaaaugaauccugcaaguaguccucuacacauguauccucuugcacacaagaaagaaagaaugaaugaaccaugccacaguuagaaugucauguugucuucaaauuuccuccaccaaacaauguaguacuuaggguuagagagaugacucagcuguuuagagcuguucucagcacccauaugaguggcucgcagucaccuuuauaacuucagcuccaggggauccacgguccucuucugcccuuggcagauaucaguacugacauagcauacauaggaacacauaaaaauaaaucuuuuuuaaaaagcaaaaaauuuuaguuaguuguguggcaggugcgcgugugugugugugugugugugugugugugugugcauguucaugagugccuauauaugagggugucuuguuuuucaaaucauaauucucuguguagcccugacuguccuggaauugacucuguagaccacuaggcuggccucaaauucauaucccccacuucugccucccaggugcugggauuaaaauuguguaccaccacaccuggcuuuauuuuuauguuuauggauauuuugcaugcauagaugucuauguaucacagucaagcaguuccugcacaggccaggagaugacagcagauccucuggagcugggacuacaggugguaguaagccacugugugggugcuagaaauuacacccagguccacugaaaacgcaucaaguacauuuaacggcuaagcuaucuuuccaguucuuacuccauuggucuuaauucauccucacaugaguuuucaggacagaugaagaaugcggccuuauucgggccaagauagaacacaaguagccucuagccuaauucuuaauaguccuuuuucucugaaacuucaugagccaggccuccacuuucuacauuucucuuggcauucuauucuuccaaacucccaucaguaggcccaguacgcucugcuuucaucguuuguaggcuucucuagcaugcaaaucuaaacucuuccacauuguucccauaagucaguacuaaaggcauaucaaccacauugucaaguuuaucauagaaacaacccccccccccuguaugcuguagacugacacgcaugcagaagcuggaggaggaccuccaauauccuauuuuuaucauucuguuauucccuugagaaagcgucucucauuauacuaggaacuagccugguggcuggaagccccaacgaaccucgucucucuuauccuccauagcucugggguuacugauugacacauggacauacucagcuugauugcuagggauuaaacucaggcccucggauuuguguaacagguguucuuauccagugagccugcccuuaaccaacuucauacauauguucuguugcugugacagaugucacagcuuuuaaggaaggaauggacuuguucugcuuguuucuggguguaguccaucaugaaagggaaaacaguguggggagugaggucacauugcaccauaguaaaaaggcagaaagaguugaaugucaaguggggguuccuuuggcuucuccuuuuuccauuuuuauuuaggaaucauucaggguggucuguccuucucuaguaaacuucucugaaaugcccucagagacagcgcacuccuacccuuauccccagcucuguuuuuuuuuuuuuuuuuuuuuuuaguugcuuccaaaucuagucaaaaugacaauggaaaaauaaccaucagagauguuuuauaacaaaauacaauaccuuguaucgguuccacuggaaagugguuuccagacccucccagucaguaacaaaacauucaugucuucaagucuaaaaaucagugcaaaccucagaaaacuaaaaagucagccaagugugguggugcacgccuuuaaucccagcucuugggaggcaggggcaggcagauuucugaguucgaggccagccuggucuacaaagugaguuccaggacagccagggcuacacagagaaacccugucucaaaaaaacaaacaaaaaaagaaaaagaaagaaagaaagcaagcaagcaagaaagagaaaacuuaaaaagucauuuauuacugauugacuauuuuauagauauuacuuuguuuauaauauaaguaaauuaaauuggauccaugagaaauaaauuuuuuuugagaaaucaauuuuaauucuacaucuuuuuuguuuuuuggguuuuuugguuuuuuugguuuuuuuuuugagaaauaaauuuuaauucugcaucuuuuuuuguuuuuuuguuuuuuuggguuuuguuguuguuguuguuguuguuguuguuguuuugguuuuucgagacaggguuucucuguauugcccuggcuguccuggaacucauuuuguagaccagguuggccucgaacucagaaauccgccugccucugccucccaagugcugggauuaaagacguguuccacuacugcccggcuuaauucugcaucuuuaauguuaagaugauuguauaagaaugguaaaaauaaauuauuuuucuuuuauuuuuauacuccuuucucagauauaauugucugcaauuguacuuuucuuauauaaaauauugucaucuuuuuuaaagauaggaucauauguagcccaggcuggacuagaaccaacuauucagccaagauugaccuugaaauucugaucauccugucccuacaucaucagugcuuaguguuaggaugccaggcauggaucaccaugcuggauuuauguggugcugagaauggaacucugggccuccuguauauguacaaaaaaccacugugccagcugagccacacccuaggccaguguuguuaucuuuugaugaaaacagagcuucuuuggugacagagccucagcugaauuuaugaaagguauuuguguuaauccaguuuagugugaaaaaguuagugauuuguugcagacaugguaccaaggcucagaacaguugucccagauccugcuugggauauuaguguacgcagcauauaaaaacuauaaagguguuuaacuucauaagaauguacagagaugaaauauuguuugguccucaaccugacuguugucuucccccugucuuagugauacaaaugaaguugacauacccuugaauaccagggugggcaccaagcgguacauggcuccagaagugcuggaugaaagccugaauaaaaaccauuuccagcccuacaucauggcugacaucuauagcuuugguuugaucauuugggaaauggcucgucguuguauuacaggagguaggaauuugaaaaguguuucugauuguauuuacuugucauuuaaaaaauaauuaccuaauuugugucaccugggucaggguuucucaggaccacucucagauccucugguuucaucagaaugguugucuaaggggaaaagugucaagagcaaagcucagaaaauccaagacagguguccaacagccuucuccaguguauucagaggucaugcuucguuccucccucagucggcugugaccgagacucggucugcugagcacgcacguuugcguuugugcuguggcaugggcuagagccccauccucucaaggaaguagguucagcagagcagcgggguuugcaccgaccgccagccagagacagugcucggggacucccaggucccugcuuugugagcuugcccagucucucucccagcagagagccauagauauucucuaguaggaacaaagaaguaaauuugcacuaaaaguuuuuuuuaauuaaaaauaaucuuauuucuacucauuuccuuuguuuuuaaguguuucguuucuuguagcccaggcuggcuucaguucacaguccucuugccucagaguguucuacccucaaaagaaacacugucauugcgauagacuuucauucugucagagguagggaaaguaaugggucauaaauaauagagaaacauauuuacuauuauucagauuguguuucuucuuuauauaggaaccauucuuaguuccacaauucagugagaaaugcuguaugucaacugagaguaguccuacuaccauggauuugcucacuguguuuucucacucccugcaggaaucguggaggaauaucaauuaccauauuacaacauggugcccagugacccauccuaugaggacaugcgugagguugugugugugaaacgcuugcggccaaucgugucuaaccgcuggaacagcgaugaaguaaguuggagccaagucccuguaaagugaugagugagugccgaguuacucugugcucaccacacucuguuugcauuuauuucucuuuagugucuucgagcaguuuugaagcuaaugucagaauguugggcccauaauccagccuccagacucacagcuuugagaaucaagaagacacuugcaaaaaugguugaaucccaggauguaaagauuugacaauuaaacaauuuugagggagaauuuagacugcaagaacuucuucacccaaggaaugggugggauuagcauggaauaggauguugacuugguuuccagacuccuuccucuacaucuucacaggcugcuaacaguaaaccuuaccguacucuacagaauacaagauuggaacuuggaacuucaaacaugucauucuuuauauauggacagcuuuguuuuaaaugugggguuuuuuuguuuugcuuuuuuuguuuuguuuugguuuugaugcuuuuuugguuuuuaugaacugcaucaagacuccaauccugauaagaagucucuggucaaccucuggguacucacuauccuguccauaaaguggugcuuucugugaaagccuuaagaaaauuaaugagcucagcagagauggaaaaaggcauauuugccuucuaccagagaaaacaucugucuguguucugucuuuguaaacagccuauagauuaugaucucuuugggauacugccugguuuaugauggugcaccauaccuuugauaugcauaccagaauucucugcugcccuagggcuuagaagacaagaauguaaagguugcacaggaagguauuuguggccagugguuuaaauaugcaauaucuaguugacaaucgccaauuucauaaaagccauccaccuuguaacuguaguaacuucuccacugacuuuauuuuuagcauaauaguugugaaggccaaacuccauguaaaguguccauagacuuggacuguuuucccccagucaccauuuuguucuccuuuugguaauuauuuuuguuauaaaaagccaccuauccagaauuggagcucucugucuugaaccauacuuugaaagaaacgccucuuccguacugcaucugaucacaaugugcauaccuaugaucaaauucuggagucuuuguucucgguaccuccuaaaaaggaaaguugauucuuguguaacaugcuuuuauuuucagaaccugcacagcugucauucuagccauguuuuaccuacacacucaguucuauacaagacagcccauacacucugucucacaucugauccuuggugggaaguguuuuaaaguagaacuauguaugaauuucagaauucaugcauuuuaaaacuucacuaagauauugucucauaucuuuaugagaaugucagcugacuuuucaacuaacaguaaauguauuuuagauaucuaaaucuuuugaaauuugguuuuacaauuucuggucccuaauugugaagacaagaggcagaaguacccagucacuacccauauuuacacugaacguuauuaaauaaaaugauguguauuuuauuauaaaauaaauauaggccuuguuaucucaaaaaacagaucugguucaaacuuauuauaccaauaucauacuauuuaaauguucuaaguaaacaagccaugugagcaucaaguggcauuggcucuuuggaugaaacauaaacuuaaggugauuguaucaacacauagagugacugaaauuaaaugggaggcagguagagcauauguccaucuguccaccuacaggcaugacuaaacuacagcucauauuccacaaauuugagauuugucuugccugguuuguuuagugagucucaucugauguaccuaaagccugagaguacugaggucugauuuuauaucuuuccugaauaaacuaaaucuuuuuugucacuuaucaucuuaaugauauaccuaaggaauaauucuuuggcauguuucaguuguguguggcagccacuguaaugacucuucucuaagaaaggcugucaggaguuaauuauaaggcaggcagugagcgcucuagucacugccuucccacgcugccaucacugcauucaugggaaucagugacguucucgaaauggcaaacgcugcugcuuuuccuuauuuggaauccuaaaaucaaaaguugcauuaaacuuacuguguucucuucucccucucagccauaaauguaaaauucaguaaguaaaaauauuuaaagaguguaucagcccuuuggccagugagauagcucaguagauaaaggcauuugcugccaaguccucaaccucaauucagacucugggggacacauggcgaagggaggagccaacuaccccaucauuguccucugacuuccacacacuccauggcuugcgccccuccccacagacacacaccauguacuccacaaaaguaguuuaaaggaaaaaaagaauagaacccacuguguaauggaauaaguauuauguaguuacuuaacaacuuguaaaaaucuggaaacuaugauuugguuccccuuugaaucuagaguuuaaaaaacagauggcuaaaaucagccaucauuuaaauaauuaaaaauaaaagccccaaaccccaaacugccuaaauaaauaccaaguaauccaggaagccgucaugugugguuuguaugaccaguaguucucugguacagagcauguuaagauuugccccagccugauucucugaggucucugcauuacugaguacuguucugaguauaaaaucugaacugauuucucuagaaauacuguaacaaaaagguauuuuagucagcauguuauguuaacccuuccacugucuagaaacuugaauaagcacauaaagacaccuuuugcugucaucaucuguuguccuggaaugugccaguuuuaauuuauucauucuaaugauauucaauuugcuuuucuuuuuuagauguuuuucuuguuuagaguaaaaggacgaauuuuucaagaaccuugcaucucugauuuggccuaaggucaaauuggauauugaguagucuauuccagggcagauuuccuaagcaauacuugucuuuucagcuauguauuguuuugaaauguuuccauuucaacagagguguaagucaugugaaaagaaaggugguguagcccuugugguaaugacacaaguugacuugcgucagauguuaagcagggacaguucucccaccuccuggcuguaaggaguggaaacuaggcaagcaguguaucaguccacagaggacaggaagggucaucccauaaagaaagccugugaguauggcuuuggcaaaaaauuagacauaauacuguccuuuuagguugugcucuguucuuuccuuucaguggaauuauuuaagcucuuuaguggccuuuguuuuucccacuuaaaaacuaaaauguagcauauauuguauaaaauggaaauauuaauagcuuagggaaacuguacauaaggcauugacagguuuaaaaaaagcauuuuuauuaugcaguuguaaaacaccaaaaauauagauucaucuugauauguaacacuaaguguauuuuguacagcaucugauuugaaaggugccuuaugaaguuuaccauuaauugcuuuguucuauauacagauuauguccaauguaucauuuuucaguaaauaaccuuauuuuaguau

SEQ ID NO: 12513 - RNA, 8072 nt, Mus musculus
guucaguuuccucuauaguuuauugucacagcagaaguugugugagacaggaggucacgcucuacacgucacaguauggucagagccugagguagcucuucccacccugaugccaagccccaagcagucggaccuaagcucuuucccuuagucccacuuuaggugcacgcugacagcuauccaaguuaguguggccaaaggacccgggccccucccuucuaccccagcuucaauguguuuaccacuguucuucacgggccaccaucucccauccuuucuuuuuacaugcuggauauuucuaucacauuaaggaucacugacccaccagcaaaccuucuccugauaaacauucauuugggacuauugccuucagagaggccugacacaucaaggcaaagccacugucagcuuuggggaaggagcuccccaucucucaccaucaacccuacacacacacacacacacacacaacacacacacacucucucuccuacccuugcaaauaugggcuaaagagggggagugauggaggccccgugucagcuagaacagcucauuguuccucaucuauagaaccuaggucagggagagaacauacaagccuucucaacaccaaaauggaagaggggguaauuuagggggcccagaucucuaagagauauuaggacaccucaccuaggagcuagaggauaucacagguuaaaggucaagguuaggguagcaauuaaagaucaaggucaucucccugcacaaucugcccauuuuccuugcuuacucuggcccagugcccugauaacaccucuuaaauuaguguugcaggaggugagggcugggauccacaccaaggcaaugagggucauucaacaggagacuuccauggugugcccuggggguccagaagggagagucccagacucgcuacucugcgacagggugcgggaucgggaccgacugccaucgauggaugcugcacuggucagagaugcugugcgagaccgagauaggcgagucaugcaggaagaggccacuguagacacacaaugauaagcaagccaucagagaugaguggggaagacagcugguaacuucuaguggggccuaggugaagacaagagcugcggccagagaaucagcgagcuugccuuguaagaugaugaguccaagaauuagccuaaaacaggucuacccucacagugggaagcccuuccuaauacccucugucccaauacucacuguagcccaugccuugcaggaaguacuugaaagccucugucagcuugccgggcugugggcauauuacaaggaaagagaagagagagaaagagaugguuagauaucuugaaagucacagcaauggcaaagggcacaacacgucccauuuccucgucccaagaugggcacuauacucaccugagucagcuguggcugaccuccagagucggccaucugcucaggaaggaaacacccagggaagaaggauacauggagauaucagacgauccaugccgcgggaaaggggcucucuccucccaggucccucacucagccccuuuguucuccucucccuugacccacaaugaacccacagggcuuagacacuggaauuuagaguauguaugcuccuggacuggggagcggggagcaagugaggcuuaggaggcccgcuaaccuugaggaacgaggucugugugggguccagcuuugaguuacauuccaccuggaauagguaggagacugaaugaaucaggucgcccucuccacagcccuccaagggaccccgaucuuuucccuuucgucagccccuacccaauuacaucuuaacccaagucaaauuccuaagguccuagaguugcuccuccugccccagaguuuucgaguuugcagcuuggcaagguccacagcuugggugaacccaguguugacaagaccccaacauucccucacuaccccaaaagccaccacugaccacggcaucuucaugaggugcuuggucuccaaccaccagcaucacagggcaccuaggggcacggggucagggagaagacagugagccuuguacucucucaccgacacuucccagaaaagcagcuaaacaagugucugccuccgaggaggaggaggaaccaguugccuuucuccugcugacucagcaggaggaucgagagggaagccccaaaggaagacagcuuguuacacagaauggaaucagggagacugguaacuucuccacaaagguuaagagauguugguaccaaggggcagggcagagacaggacaaagccacaugcaucuaccaaugucuuacuugagggucgucucaccaccucgcucaaaguucaggucucggcggcugcaggggguucaaagagaaguuguuuuugacaggcacugcugucuaccuagauaagcuaccuccuccacaggaagcuaucucccuuauuuauagucagcagcuacuggugauuaagagaaaaauaccaagggcugggguuacaacuuggugguggacuaccugcuuagugagcagcuaugagguuugaucuccaaagcgguuaaaaagggaggaggggacaccauaaaaauggcaggcacgguccaagagcacaccaccuguaaucacuugugcccuagaucucaggucagaggcagcuaagugacaggaagggcccaagaaugagagcugcccuuacuccuguccugaagcugaggagcucgcccugccugcagugcacacugcuuacaacccucucucugcuuccgguucuccacaugcacacaacccacucacuuguuguagcuauuccaguagaguucaauguucuccagguugggugcguguuggaugauaccucuguacuuuuguaucaauucagaauuuccagaaagcucuuccuaaagcacagaagagaugaaucaggauuggaaagaggagccggccaugaggggaacuaucuaacacuucagauccugugccaacuaaggaagucaccccgaagcauucaacuccccgcuggucaccucuacuucuccugccucuuacaaccauuuaccuggcugaaaagauguccaagaaucauguccggaauggaagacguaaggccaguuaacuacaaggacaggcgaacaaauucaggauauuguggagaaagagacccaggcgaaacaacccaacuucauuuuugugcccuacuaugcccucucugaagguccagaucuauucaguuacacugguaguaucauccaaggagaguccccacccuagauaucagcacacacagcccugcaaaccuugugggcugcccaguccauccagcccuuggcauugggaucaauguugaugagaacaagaccuucaacuguguccgggugguucagcuaagggauaacagaaaggagcucagaaaaggccacaccuuuguccccgccucccugagucccaccuauccccccagauuccuauauggccuacucucuacccugcucccuaucugcuuccagaauccuggaauggcaggaacucggaccauuccugcaauauucuaucuaacgugggggggcccaccauucccucaucuagcaguuuuugcuccuuacagcauaucgcgacagaauguaggcuccggcuccaacaccaacuccaauuauuguagagaaacuguaaaaaguaaacgugugugucacaggcucuagcagccaaaaaguugucacggcccaaucucuucaaacucaucauccuuccugaggucacagccacagaagaggacagcaaaggacuuuccuuuggggguguaaaaaaggcaccaagcaugccugguacuugguguagaugccugaagucuagccucggcuaucucuuggagaacugguguguggaagacaucucuuccuacacacagaguuuaucaauucucggcucucugaaacgaguuuaacuuguucugagaccugguucuacagaggaacuggaauuauggaccuuaaagcaacguaugaaacaggugugcuauuagucauuugggagaauggaggaggcaagaaaggaagaaaaccagaguugcugagauccauggugcccaggaaagcuaaacccaggaaacaggggauggcaagauggcucagcagucaagagcaccugcuucuuucacagaggaccuaggugggauucccaacaccuccuugguggcucucagccaucuauuaugcaaguuccagagguugcaaugcccucuucuggccccuauagucaccagacauauguguggugcccauacaugcacgcagcagucaucaaauaaaaauaaauaaaucugagaaagagaaaacgcccaagaaucagcauuucccuucgcaugccagagguccuuguggggcuuauuuuucuucucccacugucuaacacaccugucuucugguauaccaaaugugaucccgggagacaggaauggggaccgagacaggucugucuaguuccucagggaugaggucacacguaccuccucuugccuaacuuccagaucagagaagcuuccccuaagccugagacggggccaagaacaaacccuuuccuucucuuucucccuaucaguaguaagauuccucugaucauucguuccagacaagaguccaagcccacugcccuuccuaacaauccaggugaaaaagccauagaaggggaagauagacugagaccaaaaucagaccaggaaccauggugaccacacucugggggcucccugaugcugaaagggaaaguuugaaggacuccugaagccucucacuuuagguacugcaggaugcaaggaaucaugucagcaagcugguccagagauggguacugauaucuggaaaagaggaaaauacuaguuaccagucuguauucauauaccucuucucuggagcaaccuccgcauccucugccagagucuucuacgccuccugguucacugcacuugugcacuaccuugcucacacacaagccccaacacacacaccaacauacacacacaccccugcuuaguaaggaacucauucuuaccccagaggaaacacaggcgcccccucuuccaugccaggggcauccacaugaacccgcacgaaguucuguaugaucucuugcauauccccgaaccgaaacaguggcuggaagcaagacuuaucuaaagagaacccacauuccccacccaaccacaaaaucagaaggaaaaagcauccgcucgucagaacccacccucuugcucugaugccaccacacuagaggagaaucucucucugaugugccaccacugggcucccggucugaccauacugacuaugccccucucccccaaacacacacacauugggcuuucuccucccauggcucuucccagaaagaggcaggagaagaaaugaaggucuuacaguugaggccuacaucaugguaggugaauaucgccgggcguuuggguuugggggugccauacacaguaaaagugaccgagccauaaggugucuccacagagugagucuguaagaaaagagcuuaccaucaggggagaaauauacugagaguucuucaaagagggaaaggcaaaaauaagugaaccaucuguugaaaacaggauuaaugggucuuuagggaaauaugacgguggaauuggaucugaggguagaaaaaucaugaaagaccagagauuaaggaauucaaauagaaaaaaggagggaagagaggauaaaugggagggaugcagagggccagauuggggcccucucaguugggggacagaagagcuucuccucccacccuagcacagccccccaugguuaccugucccugguccaggaggaugcgggcagcuaacucggccuccuggagagacacgacacacagacacacacagacacacacggacagagacagacagcaaauggagagacggacacaaaaagguagguaaagagagaccaacagacaccaaauacagaaagagggacaaaaaacaagacaggagaggaugaagguuaguguagugacgggacgaggucuggcgggcucccuuguacagugucuaggccgagagaugggaggagauggguggagaggggcgugcauuagaaugagagccacgggccuggggagguggggaggcaaggggggauguucagagcaugggaccgaggcagggaagucagagagucucuguaaaccuuggcagucucggguguuuguccuggcaacagcggcuucuccucggugaucugcaccuccugaaguucugccaugguggccuggcaggauacaaaaacaguaaaccagucaggcagugguggcgcacaccuuugaucccaauacuaaggaggcagaggcaggcggaucucuugaauuugaggccagccuggucuacagagagagcugcaggacagccagggcuacacagagaaacccugucucaaaaacaacaaaacaaaacaauaagcccuggagggaggcagcuuagccucuguacucucaguccaaugcaaugcaaugcaaggugcagagcaacaccagagcugaaaacgccaagacacacggagagcuuuucuggcucccccgccccacuuccagggcaauaccaaacaggacagcacaucucuucagaccaccggccccauggcugccggcugccccucaaccccaacauucucaccucguaccucacaaugcuccucccucuccgccccuggagggagacaccgaggcuggggaagcaauguggcuccaguuucuuaagcuaucuuuaggggacgccccacacuaccucacugacugggcuagagugguaaggguucacaacugaccaugaccuucaacuauagcuccaaugucagcaucuugaggggcuaaaaaggacugaggcagugacuaucaagcacucaacagagggaccuagauauccaauccaaucaaucucucucucucucucucucucucucucucucucucucucucucucucucucucucucucucucucuuguacacaaaugagcgcacaccaacaaugguagaucuagagagcagcagagcaccugugcagacuugaaaaaaaaaaaagaagaagaaaaagaaaaagaaaaagaaaagaaaagaaagcaagccagcagcaugggguggguggggucaauuuacugagcuccuauugguuggauacggugagcguggaggucaggguucuuaguccugacucuagggucugagaaaacacaggaacaaggugaaugacaugggagacggaccugggucuuuuagggacauaaggccagagccaagacccaggauuccagggucacuaacccuuucuaaucuccccugaguccagagaacacguccucucuagguuccaaucaauacaagcuggaggggccugcgaggcaaaacaagcagguccaggcuggguagucuaugaagagagcagagagcugacauggcgauagagcaugacugugucaaaaccucuggguccuacccaagugccacuauuaggugaccuuguccaguuagucacuacucgguuuugacgguucucaguugauauguagguaguacagcaugaccuuuuccuucaccauuuaaaaacaaacaagcuucaagccuucaucucuccccuccacccaguguaauuguaggucggguggagaaaggagagggggggauagggcugcccguaaccuccgcacuuccccggacugccagccaugugccagccgggaaaagaugguuaggacuugacuggcugcucccagaacacgaaaccugaccccuaugagcuucucgcugccguuccucguccgaaccaacacccucucacggcgggcacguagugcccaggacccuguacaucaucucaagagcgccccaaacacgcccugcacuuugcagcucuucugccuuugugcgcagcagcggagcuccucgcucagccagccccuucccccgaacuacagccaggagaccagaaccacgaugcccacccuccgggcccgcgccuugccagcccagaggcgcgcuugccccucccccuaccugcugcagccgccgcggucgcugccacc

SEQ ID NO: 12514 - RNA, 8072 nt, Mus musculus
gguggcagcgaccgcggcggcugcagcagguagggggaggggcaagcgcgccucugggcuggcaaggcgcgggcccggagggugggcaucgugguucuggucuccuggcuguaguucgggggaaggggcuggcugagcgaggagcuccgcugcugcgcacaaaggcagaagagcugcaaagugcagggcguguuuggggcgcucuugagaugauguacaggguccugggcacuacgugcccgccgugagaggguguugguucggacgaggaacggcagcgagaagcucauaggggucagguuucguguucugggagcagccagucaaguccuaaccaucuuuucccggcuggcacauggcuggcaguccggggaagugcggagguuacgggcagcccuaucccccccucuccuuucuccacccgaccuacaauuacacuggguggaggggagagaugaaggcuugaagcuuguuuguuuuuaaauggugaaggaaaaggucaugcuguacuaccuacauaucaacugagaaccgucaaaaccgaguagugacuaacuggacaaggucaccuaauaguggcacuuggguaggacccagagguuuugacacagucaugcucuaucgccaugucagcucucugcucucuucauagacuacccagccuggaccugcuuguuuugccucgcaggccccuccagcuuguauugauuggaaccuagagaggacguguucucuggacucaggggagauuagaaaggguuagugacccuggaauccugggucuuggcucuggccuuaugucccuaaaagacccagguccgucucccaugucauucaccuuguuccuguguuuucucagacccuagagucaggacuaagaacccugaccuccacgcucaccguauccaaccaauaggagcucaguaaauugaccccacccaccccaugcugcuggcuugcuuucuuuucuuuucuuuuucuuuuucuuuuucuucuucuuuuuuuuuuuucaagucugcacaggugcucugcugcucucuagaucuaccauuguuggugugcgcucauuuguguacaagagagagagagagagagagagagagagagagagagagagagagagagagagagagagagagagagauugauuggauuggauaucuaggucccucuguugagugcuugauagucacugccucaguccuuuuuagccccucaagaugcugacauuggagcuauaguugaaggucauggucaguugugaacccuuaccacucuagcccagucagugagguaguguggggcguccccuaaagauagcuuaagaaacuggagccacauugcuuccccagccucggugucucccuccaggggcggagagggaggagcauugugagguacgaggugagaauguugggguugaggggcagccggcagccauggggccgguggucugaagagaugugcuguccuguuugguauugcccuggaaguggggcgggggagccagaaaagcucuccgugugucuuggcguuuucagcucugguguugcucugcaccuugcauugcauugcauuggacugagaguacagaggcuaagcugccucccuccagggcuuauuguuuuguuuuguuguuuuugagacaggguuucucuguguagcccuggcuguccugcagcucucucuguagaccaggcuggccucaaauucaagagauccgccugccucugccuccuuaguauugggaucaaaggugugcgccaccacugccugacugguuuacuguuuuuguauccugccaggccaccauggcagaacuucaggaggugcagaucaccgaggagaagccgcuguugccaggacaaacacccgagacugccaagguuuacagagacucucugacuucccugccucggucccaugcucugaacauccccccuugccuccccaccuccccaggcccguggcucucauucuaaugcacgccccucuccacccaucuccucccaucucucggccuagacacuguacaagggagcccgccagaccucgucccgucacuacacuaaccuucauccucuccugucuuguuuuuugucccucuuucuguauuuggugucuguuggucucucuuuaccuaccuuuuuguguccgucucuccauuugcugucugucucuguccgugugugucugugugugucugugugucgugucucuccaggaggccgaguuagcugcccgcauccuccuggaccagggacagguaaccauggggggcugugcuagggugggaggagaagcucuucugucccccaacugagagggccccaaucuggcccucugcaucccucccauuuauccucucuucccuccuuuuuucuauuugaauuccuuaaucucuggucuuucaugauuuuucuacccucagauccaauuccaccgucauauuucccuaaagacccauuaauccuguuuucaacagaugguucacuuauuuuugccuuucccucuuugaagaacucucaguauauuucuccccugaugguaagcucuuuucuuacagacucacucuguggagacaccuuauggcucggucacuuuuacuguguauggcacccccaaacccaaacgcccggcgauauucaccuaccaugauguaggccucaacuguaagaccuucauuucuucuccugccucuuucugggaagagccaugggaggagaaagcccaauguguguguguuugggggagaggggcauagucaguauggucagaccgggagcccagugguggcacaucagagagagauucuccucuagugugguggcaucagagcaagaggguggguucugacgagcggaugcuuuuuccuucugauuuugugguuggguggggaauguggguucucuuuagauaagucuugcuuccagccacuguuucgguucggggauaugcaagagaucauacagaacuucgugcggguucauguggaugccccuggcauggaagagggggcgccuguguuuccucugggguaagaaugaguuccuuacuaagcagggguguguguguauguugguguguguguuggggcuugugugugagcaagguagugcacaagugcagugaaccaggaggcguagaagacucuggcagaggaugcggagguugcuccagagaagagguauaugaauacagacugguaacuaguauuuuccucuuuuccagauaucaguacccaucucuggaccagcuugcugacaugauuccuugcauccugcaguaccuaaagugagaggcuucaggaguccuucaaacuuucccuuucagcaucagggagcccccagaguguggucaccaugguuccuggucugauuuuggucucagucuaucuuccccuucuauggcuuuuucaccuggauuguuaggaagggcagugggcuuggacucuugucuggaacgaaugaucagaggaaucuuacuacugauagggagaaagagaaggaaaggguuuguucuuggccccgucucaggcuuaggggaagcuucucugaucuggaaguuaggcaagaggagguacgugugaccucaucccugaggaacuagacagaccugucucgguccccauuccugucucccgggaucacauuugguauaccagaagacagguguguuagacagugggagaagaaaaauaagccccacaaggaccucuggcaugcgaagggaaaugcugauucuugggcguuuucucuuucucagauuuauuuauuuuuauuugaugacugcugcgugcauguaugggcaccacacauaugucuggugacuauaggggccagaagagggcauugcaaccucuggaacuugcauaauagauggcugagagccaccaaggagguguugggaaucccaccuagguccucugugaaagaagcaggugcucuugacugcugagccaucuugccauccccuguuuccuggguuuagcuuuccugggcaccauggaucucagcaacucugguuuucuuccuuucuugccuccuccauucucccaaaugacuaauagcacaccuguuucauacguugcuuuaagguccauaauuccaguuccucuguagaaccaggucucagaacaaguuaaacucguuucagagagccgagaauugauaaacucuguguguaggaagagaugucuuccacacaccaguucuccaagagauagccgaggcuagacuucaggcaucuacaccaaguaccaggcaugcuuggugccuuuuuuacacccccaaaggaaaguccuuugcuguccucuucuguggcugugaccucaggaaggaugaugaguuugaagagauugggccgugacaacuuuuuggcugcuagagccugugacacacacguuuacuuuuuacaguuucucuacaauaauuggaguugguguuggagccggagccuacauucugucgcgauaugcuguaaggagcaaaaacugcuagaugagggaauggugggcccccccacguuagauagaauauugcaggaaugguccgaguuccugccauuccaggauucuggaagcagauagggagcaggguagagaguaggccauauaggaaucuggggggauaggugggacucagggaggcggggacaaagguguggccuuuucugagcuccuuucuguuaucccuuagcugaaccacccggacacaguugaaggucuuguucucaucaacauugaucccaaugccaagggcuggauggacugggcagcccacaagguuugcagggcugugugugcugauaucuaggguggggacucuccuuggaugauacuaccaguguaacugaauagaucuggaccuucagagagggcauaguagggcacaaaaaugaaguuggguuguuucgccugggucucuuucuccacaauauccugaauuuguucgccuguccuuguaguuaacuggccuuacgucuuccauuccggacaugauucuuggacaucuuuucagccagguaaaugguuguaagaggcaggagaaguagaggugaccagcggggaguugaaugcuucggggugacuuccuuaguuggcacaggaucugaaguguuagauaguuccccucauggccggcuccucuuuccaauccugauucaucucuucugugcuuuaggaagagcuuucuggaaauucugaauugauacaaaaguacagagguaucauccaacacgcacccaaccuggagaacauugaacucuacuggaauagcuacaacaagugaguggguugugugcauguggagaaccggaagcagagagaggguuguaagcagugugcacugcaggcagggcgagcuccucagcuucaggacaggaguaagggcagcucucauucuugggcccuuccugucacuuagcugccucugaccugagaucuagggcacaagugauuacagguggugugcucuuggaccgugccugccauuuuuaugguguccccuccucccuuuuuaaccgcuuuggagaucaaaccucauagcugcucacuaagcagguaguccaccaccaaguuguaaccccagcccuugguauuuuucucuuaaucaccaguagcugcugacuauaaauaagggagauagcuuccuguggaggagguagcuuaucuagguagacagcagugccugucaaaaacaacuucucuuugaacccccugcagccgccgagaccugaacuuugagcgagguggugagacgacccucaaguaagacauugguagaugcauguggcuuuguccugucucugcccugccccuugguaccaacaucucuuaaccuuuguggagaaguuaccagucucccugauuccauucuguguaacaagcugucuuccuuuggggcuucccucucgauccuccugcugagucagcaggagaaaggcaacugguuccuccuccuccucggaggcagacacuuguuuagcugcuuuucugggaagugucggugagagaguacaaggcucacugucuucucccugaccccgugccccuaggugcccugugaugcuggugguuggagaccaagcaccucaugaagaugccguggucagugguggcuuuugggguagugagggaauguuggggucuugucaacacuggguucacccaagcuguggaccuugccaagcugcaaacucgaaaacucuggggcaggaggagcaacucuaggaccuuaggaauuugacuuggguuaagauguaauuggguaggggcugacgaaagggaaaagaucggggucccuuggagggcuguggagagggcgaccugauucauucagucuccuaccuauuccagguggaauguaacucaaagcuggaccccacacagaccucguuccucaagguuagcgggccuccuaagccucacuugcuccccgcuccccaguccaggagcauacauacucuaaauuccagugucuaagcccuguggguucauugugggucaagggagaggagaacaaaggggcugagugagggaccugggaggagagagccccuuucccgcggcauggaucgucugauaucuccauguauccuucuucccuggguguuuccuuccugagcagauggccgacucuggaggucagccacagcugacucaggugaguauagugcccaucuugggacgaggaaaugggacguguugugcccuuugccauugcugugacuuucaagauaucuaaccaucucuuucucucucuucucuuuccuuguaauaugcccacagcccggcaagcugacagaggcuuucaaguacuuccugcaaggcaugggcuacagugaguauugggacagaggguauuaggaagggcuucccacugugaggguagaccuguuuuaggcuaauucuuggacucaucaucuuacaaggcaagcucgcugauucucuggccgcagcucuugucuucaccuaggccccacuagaaguuaccagcugucuuccccacucaucucugauggcuugcuuaucauugugugucuacaguggccucuuccugcaugacucgccuaucucggucucgcacagcaucucugaccagugcagcauccaucgauggcagucggucccgaucccgcacccugucgcagaguagcgagucugggacucucccuucuggacccccagggcacaccauggaagucuccuguugaaugacccucauugccuugguguggaucccagcccucaccuccugcaacacuaauuuaagagguguuaucagggcacugggccagaguaagcaaggaaaaugggcagauugugcagggagaugaccuugaucuuuaauugcuacccuaaccuugaccuuuaaccugugauauccucuagcuccuaggugagguguccuaauaucucuuagagaucugggcccccuaaauuacccccucuuccauuuugguguugagaaggcuuguauguucucucccugaccuagguucuauagaugaggaacaaugagcuguucuagcugacacggggccuccaucacucccccucuuuagcccauauuugcaaggguaggagagagaguguguguguguuguguguguguguguguguguguaggguugauggugagagauggggagcuccuuccccaaagcugacaguggcuuugccuugaugugucaggccucucugaaggcaauagucccaaaugaauguuuaucaggagaagguuugcuggugggucagugauccuuaaugugauagaaauauccagcauguaaaaagaaaggaugggagaugguggcccgugaagaacagugguaaacacauugaagcugggguagaagggaggggcccggguccuuuggccacacuaacuuggauagcugucagcgugcaccuaaagugggacuaagggaaagagcuuagguccgacugcuuggggcuuggcaucagggugggaagagcuaccucaggcucugaccauacugugacguguagagcgugaccuccugucucacacaacuucugcugugacaauaaacuauagaggaaacugaac

SEQ ID NO: 12515 - RNA, 2185 nt, Mus musculus
cccccaauaugggaggaugucugcccuaaccacucgagagaggaagcaaaaacaggacagauugcaacagccacuacacuuccuucauauccugcucuugggacauggcgaccagcagaaagaagcuugauuguggagaggugcccuagcggagggaugucugccacaguccaggcaaccacagagguaacucuaacucuugcucuuuuucucagggcagaagugaaugagguuccuuccuuuccuucagugauaucugaugcacauacuccuaagagugcuaugguccaccuucugccucucuaacuuucuccuaaguuguagauaguucuuaggccuucaugguuagaauucuuuaaaacacacacacacacacacacacacacacacacacacacacaaacaugcacacgcacacaguauucuagaggcuuuuuauaugguguggaaaaguucuuggcucugacucaaauuugccugaaucagcagugguugucaguagguacuggagagaccaaugugcagguccugggaggaguucuaagaaguuagcauacccugaccuggcuucuccacucucuggaaugcagugugcugccacuucugaguuuaggccccaggaaggaaacaggagggucagagaccacagagugagaaaugaaaaugccuuucugcagccucuccugaacacgguuggucggcugcugcuuccuucgccucuacuuuaacuacuuaggaaggacgcuggaguucugcaucuucaggugguucuccgccagcaccagaggccagucagcugcuguugacucacacuuccucacuuccugggcuuuucaggguccagccugggucugaaacccuucccuaaaaugacuuguuuuguucuaggguaggagcucagugcaugcaugcauggauuugcauuucuucagaaaagaguagcugaugugcguccucagccuuucugcaggaggauuuacuaggggccaucaugggcucugugaauuccagaggucacaaggcagaggcccaggugguaaugaugggccucgacucugcuggcaagaccacaauucuguacaaacugaaaggaaaccagcugguggacacccuacccacuguugguuuuaauguagagccucuugaggcuccuggacaugugucacugacucucugggacauugggggacagacccagcucagagcuaccuggaaggacuaccuggaaggcaucgaccuccuuguguacgugcuggacagcacagaugaagcccgcuugccugaggcaguggcugagcucaaggaaguccuggaagaccccaacauggccggcguccccuucuugguacuggccaacaagcaggaggcuccuggugcucugccguugcuugaaaucagaaacaggcugggccuggaaggguuccaaaagcauugcugggagcugcgggcuugcagcgcucucacaggacaggggcugcaggaagcccugcagagccugcugcauuugcugaagucccgcugaaaugcaguaaccucugacuccaggcuggagcaggacagggagcagggucaggcggaccccgugagcgggcagaacagcuuauccuggcuaugaacagacggggccaguugaaccuugagaaaaggaagcucaguuuaccacacgagaaaccacaauucucuuggacaguauauuuucuucucaggacuuauucucaguggcaguuaugcugaaaaucaacuguucuucaaguaacaauagucagagggaauauaaaaauucucacaauaccccggguaacagcccacuacaaagugccaauguaacaaaguuggugacauaguaauugaccaaguucacaaaugaaaagagguuccaaaacugcaucugagugucaccuggccuaucacugucaucugagugucaccuggccuaucacugucaucugagugucauugggccuaucacugucaucaggagcaacucuuccugcugggcucugggcaggagccacugucacuuuuguacacuuagcugggcugacagcagugaggggcaggucugcucccaggaugcugcaggaauccucccagaauucccccugcuuuccaacuccaacuaacuuuucucugcccuacaucauauguuguaaaaaaguaaaaauaaaacuccacuuauaaucuc

SEQ ID NO: 12516 - RNA, 6389 nt, Mus musculus
caguuggcugguggaggugagcagugugcuccgaguagggaccgggggccgggagucgcuggccccgcugccgcggccgggggacaccugcgugggcggugacgggcggcacggccuggcggcagcggugcuacugucgcggucgggaaggucagcgcgccgcuggggaggcccccuggcuaggagggggccaagaaugcagaucugugccugugacacucuuucuccuuucucuacaguguucuccaguuuuaccgucaaaacgugagggaaaacgaacuggcucucuccacagaaaauauaguaagcuugccaaaagcauauacuugccuggaacaaagguaaaccguauuauuuuucuuuauguucugguauuuaugaaggggaaaaauacccgauuuuauuaguccuaggaccauuccagauggaaauaaaaagaauaaguauaucuucaccaccuccuuuaauaauagggccuuuguucuuuucauauuucaaaacucauggauucaaaaauccaugcuugccauucauuuuuuugguaauuacuauauauaauuuaaaaaaaguaugcucuaaaggaaacaaauccagcaacauuucuucugugugguuugucuuaguuguccagcuacuggggcuguagagcagggcuuuagauuccugcagcuuucuagacauuuguaugaggagugcuuuuaaaacagaaugucaauauauaggcauucuuugugcuaggacucaauggggcuauuaaucaauuaugcccccccccccuuuuuuuuugcuuuaaauuacaccuuggaguaugcuaucacagucuacccgggaacuacaccucugcccuauuuaaugcuaagcaucaguuucacacagccuaauaucaccugaaaacaaucugaacugaguaauuguuuuucagauuggucuguggauaugucuucauuuacacugggcacacugugggcagcucuaucuuuaggcugaugaaccagcuaagcaggagcccauuauggacaggcagccauccacauucuugauggugucugcugguugggaguggguuccaugguggaaggcauuguuguggggaauagagagcaguuuguuuugccuugaguuccugcucugacuuaccucagugauggacugauuguaaccugcaagugucaguugauuuuggucaguguuuugcacugaaaguaacagguccaggcccagaagacccaugucuucagccuuccuucccaacuguucuuuccauccauguauuuucugguaggucuggaaguugcucacucugggcaagcgcuuucagugagcugcaaccucagcccugcucugugaaagggucucugacccaccgcaguucaugcuucuguguuucugguacccuaguuguauuuauuuucaaguaauaugaagauaguauuguaaagauccucauuuuguaaaagauaaaacauauuugugaaaacuauaagagauuuuuagaaaucuauggaguaaacuuuguuuugggaaucuaucccagugccuuuagcaugcuaaguauaccucugccauuagcauauucucggcuccuaacauaggaaaaucaucuuuuuucccccuuuuugugacaguuuccuaguuagaccaggcuggccuugaacuaacguaucugccuuccucugcauucagagugcuggguuuggcuuaaggugucugccacuacgccuggguuagaauacuaaauuuuugacuuacuuucuggagaguuuugaauccuagaacuuugcaaauucaaggucugugcuuuggugguagaagggcaaggagagucaggccccauguuuuuccuccggaaguugggggcuugguuagcuacuuuggguuuaagcccagaacuuacguuuuauuccuaccccuuuguucucaagauaagugacgcaugcuucuaguaacugauuuaaguugguuuacguuuuaaguccaggcggaaacaguaagaaugagaccuguucaguguuugcuaaggugaggaaauacguggagagacggaguguuuuagaaaccaggauauguuuguacaaacuugugugugugugggucgagacugguauacacaccccaacacucccacacgccauuuuuacuuuuuuuuuuuuuuuuaaggcaggguggcuauguagaccaaguucagguuaucagucuuccucccaagugcugggauuaaagccaugugccaccaugugcagcuauacacacucuguuuagaagaacacuugacaaucuuuuucaaguugggugucagugguacacgcuuuucaucccagcacuugggauccagaggcagguugaucuuugaguucgaggccagccugggccacaaagugaguuccagcacagccagggcuacacagaaaaacccugucucaagaaaacaaacaagaaagcauagcugagucagcaagcgaucccacugcaaacaaggaaagguggagaagacugaggaaagacacgaguucuggccucggccuugugcaagcaguguacgugcauugcacacacaugccacagagagaauaagugugccugggcaugugcacugcucagugguaugcucugcucaucgugggcacugcuggaccuaaucccugucuccagccacagaugguugucugauggccaguagagugccaaguacuccauccuaguuuguuauuuugguaauauuuuuguauuccucaguaaacugacuaaagaaauacuuauuacugauuuuggaggucuuagagguuaagguacauuagcaaauuugaauugaguacuauauauaauauacuacauauauaaauauacauuaguacuauauuagaaaugaaaucagaggucucuaaaacauguuaaacucauuuaaagcaacacugauaaaagucauuguauguuaccaaaaaaauaauuuaguaaaaauagcuccccuacuuugaaagcgguggcauucuuuauagauugacagcuuucugucuuugggggacuugggagugcugcacuggugauuagccuagggcaugucaagugugcuugcuaacagcuuuugagcuauauucccagcccuggguauuuuguuugauugaaaaaaacuguucuaauuauuuugauacacgcacaagaaaaaucugguguuacacagauuuguaguugauaaagggaguagaaauguuuugagauaauuuguuguucuucuucaauacuguaaccaaaucucaacaaauaguauuuugucauacaguaguguaugagaucauacuuauuuuuuauuucugcaguauugggaauugaacucagggucuuggcaagugcucucccacugagccacacuccaacccuuucuuauauuuuaaacaagucuucuaugauuuauaacauuauuacagagaccuccaaacauugacauauuucauuauauaauuccccaauaacccucacauuuguuaacuuuacuauuuaucagcaucuuuaaugggaagauuauaaguacauuuugcaaaaauucaaauuuuaacauaaaaacccagccuuuuuccuuuucauggucaagaaguaucguguuucuggaaguacccagcucauuuuauucauuuucaggauuugucagcucccuaaaucuacauacugcuggcuuccauuguuuuccuaauagcagcagcugucucagcuuguagcugagucacgugagccuguacuccuuucugaccgcacccacuggccacacaagugccuuuguguauaguucaguauacaagaauagggauugauaaaaugaguaauuuuugcagcuucaucaagcuuuuauuauuuguuucugaaauagggucucaugguccauacuggguugguacuugcuuugaagccuuguuggccuugcgcugauauccuucuuccucugucuuucugaguauugggauuauaagugugugcuuuagucagccucauugauuaaucacacaacaguucucauuggaaggcuccucccacuuucguuugugugcucuggaagaacacugauuggguaguggcacagcucagugcuucuuauagacuuguuugauucccguuaaaguuccagcagugucuaccuggcuccuguagcuuugacacaguugguaaaugucagucgguguagcgcaucauuaugagaaugccuuuggcuucaccagcucucuggaagaggaacacguagguuucugcccgagagagagaauuaaugcuguaaaguagaagagauaggaugaguuugauuguuacagccaaccaacagaaauauaaaaauucucccaggcagcaacagugaaaaucuaccucauuuaauccucuagucaagguugaccuacaacucuugugcuucuuacacuaugaaucaaagugaucaaggccacuccuuuccacccucugauuugcccacaagcccuuugauaccaguuugugggaggacauuaaacuaguugauguggauaaauuguaaucuugucuuugaaauagaaaauaugcccguuuccaguaaaagcuagaagagagcaugcuuggauuuauauaugugcuucugucuuuaaguagcauaccauuucauauuugugggcccgaaguaaagagccuauucugucacagacagugagacucuuuguuucugacuucuagaagucagcucuuguuuuaaaacaauguuggguccuguuggcucaguuugcgguugucccaguccuaacccuguuucagcaaaggcuguuguugggaggcugucacaaaggccuugugugcaggaguguucuugucccagugaguuaaaugugccuuagcauccaggccuuucccaagugucucccauauauucuuugguuauuucaguaggagaucaucuuauugggaaagaggauguuuucuacuuauuccagaguggcucaccagaacuaaauguuuucuuucucuguggcaggauguaauggagcugcuugaagaagaccucacaugcccaauuugcugcaguuuguuugaugacccccgaguguugcccugcucacacaacuucugcaaaaaaugcuuagaagggcucuuagaggggaaugugcggaauucccuguggagaccaucucccuucaaguguccuaccugccguaaggaaaccucagcuacuggagucaacagucugcaggucaauuacucccuaaaggguaucguggagaaauacaacaaaaucaagauuucucccaagaugccagugugcaaaggacauuuggggcagccucucaacaucuucugcguaacugauaugcagcugauuugugggaucugugcuacucgaggcgagcacaccaagcaugucuucucuucuauugaagaugccuacgcucgagaaaagaaugccuuugagucccucuuucagaguuucgagacuuggcgccggggagaugcucuuucccgcuuggauacuuuggaaacaaacaagaggaaagcccuccaguuacucacgaaggauucagauaaaguaaaggaguuuuuugagaaguuacagcacaccuuggaucaaaagaagaaugaaauccugucugacuuugaaacuaugaagcuugcaguuaugcaaaccuaugacccggagaucaacaaaaucaacacuauuuuacaggagcagcggauggccuucaacauugcugaggcuuucaaagaugucucagaaccuauuauauuuuugcaacagaugcaagaguucagggagaaaaucaaaguaaucaaggaaacuccuuugccacacucuaauuugcccacaagcccuuuaaugaagaacuuugauaccagucaguggggagacauuaaacuaguugauguggauaaacugucuuugccgcaagacacagguguguucacuagcaagauucccugguaccccuaucugcugcucaugaugguaguucugcugggucuccucauauucuuuggccccacuguauuccuggaauggucuccacuugaugaauuggcaacuuggaaagacuaucuuucaagcuucaauucuuaccugacuaagucugcugauuuuauagaacaaucuguuuuuuacugggaacagaugacagauggguuuuucauuuuuggugaaagaguaaaaaauguuaguuugguggcacugaacaauguggcagaguuuauaugcaaauacaaacuauuauaaagucuuucaauuacacaguucugcuucuugaugggauuguuggagaacacaggaauaauucagaucugaucaagauuucagucuguuucuuuuuaaaguauuucuucaaugucauuugaaguuuaguaguccuaaaccuucccuuccuucuuaaagacaguuuuaaaauaaauacuguuucucu

SEQ ID NO: 12517 - RNA, 6389 nt, Mus musculus
agagaaacaguauuuauuuuaaaacugucuuuaagaaggaagggaagguuuaggacuacuaaacuucaaaugacauugaagaaauacuuuaaaaagaaacagacugaaaucuugaucagaucugaauuauuccuguguucuccaacaaucccaucaagaagcagaacuguguaauugaaagacuuuauaauaguuuguauuugcauauaaacucugccacauuguucagugccaccaaacuaacauuuuuuacucuuucaccaaaaaugaaaaacccaucugucaucuguucccaguaaaaaacagauuguucuauaaaaucagcagacuuagucagguaagaauugaagcuugaaagauagucuuuccaaguugccaauucaucaaguggagaccauuccaggaauacaguggggccaaagaauaugaggagacccagcagaacuaccaucaugagcagcagauagggguaccagggaaucuugcuagugaacacaccugugucuugcggcaaagacaguuuauccacaucaacuaguuuaaugucuccccacugacugguaucaaaguucuucauuaaagggcuugugggcaaauuagaguguggcaaaggaguuuccuugauuacuuugauuuucucccugaacucuugcaucuguugcaaaaauauaauagguucugagacaucuuugaaagccucagcaauguugaaggccauccgcugcuccuguaaaauaguguugauuuuguugaucuccgggucauagguuugcauaacugcaagcuucauaguuucaaagucagacaggauuucauucuucuuuugauccaaggugugcuguaacuucucaaaaaacuccuuuacuuuaucugaauccuucgugaguaacuggagggcuuuccucuuguuuguuuccaaaguauccaagcgggaaagagcaucuccccggcgccaagucucgaaacucugaaagagggacucaaaggcauucuuuucucgagcguaggcaucuucaauagaagagaagacaugcuuggugugcucgccucgaguagcacagaucccacaaaucagcugcauaucaguuacgcagaagauguugagaggcugccccaaauguccuuugcacacuggcaucuugggagaaaucuugauuuuguuguauuucuccacgauacccuuuagggaguaauugaccugcagacuguugacuccaguagcugagguuuccuuacggcagguaggacacuugaagggagauggucuccacagggaauuccgcacauuccccucuaagagcccuucuaagcauuuuuugcagaaguugugugagcagggcaacacucgggggucaucaaacaaacugcagcaaauugggcaugugaggucuucuucaagcagcuccauuacauccugccacagagaaagaaaacauuuaguucuggugagccacucuggaauaaguagaaaacauccucuuucccaauaagaugaucuccuacugaaauaaccaaagaauauaugggagacacuugggaaaggccuggaugcuaaggcacauuuaacucacugggacaagaacacuccugcacacaaggccuuugugacagccucccaacaacagccuuugcugaaacaggguuaggacugggacaaccgcaaacugagccaacaggacccaacauuguuuuaaaacaagagcugacuucuagaagucagaaacaaagagucucacugucugugacagaauaggcucuuuacuucgggcccacaaauaugaaaugguaugcuacuuaaagacagaagcacauauauaaauccaagcaugcucucuucuagcuuuuacuggaaacgggcauauuuucuauuucaaagacaagauuacaauuuauccacaucaacuaguuuaauguccucccacaaacugguaucaaagggcuugugggcaaaucagaggguggaaaggaguggccuugaucacuuugauucauaguguaagaagcacaagaguuguaggucaaccuugacuagaggauuaaaugagguagauuuucacuguugcugccugggagaauuuuuauauuucuguugguuggcuguaacaaucaaacucauccuaucucuucuacuuuacagcauuaauucucucucucgggcagaaaccuacguguuccucuuccagagagcuggugaagccaaaggcauucucauaaugaugcgcuacaccgacugacauuuaccaacugugucaaagcuacaggagccagguagacacugcuggaacuuuaacgggaaucaaacaagucuauaagaagcacugagcugugccacuacccaaucaguguucuuccagagcacacaaacgaaagugggaggagccuuccaaugagaacuguugugugauuaaucaaugaggcugacuaaagcacacacuuauaaucccaauacucagaaagacagaggaagaaggauaucagcgcaaggccaacaaggcuucaaagcaaguaccaacccaguauggaccaugagacccuauuucagaaacaaauaauaaaagcuugaugaagcugcaaaaauuacucauuuuaucaaucccuauucuuguauacugaacuauacacaaaggcacuuguguggccagugggugcggucagaaaggaguacaggcucacgugacucagcuacaagcugagacagcugcugcuauuaggaaaacaauggaagccagcaguauguagauuuagggagcugacaaauccugaaaaugaauaaaaugagcuggguacuuccagaaacacgauacuucuugaccaugaaaaggaaaaaggcuggguuuuuauguuaaaauuugaauuuuugcaaaauguacuuauaaucuucccauuaaagaugcugauaaauaguaaaguuaacaaaugugaggguuauuggggaauuauauaaugaaauaugucaauguuuggaggucucuguaauaauguuauaaaucauagaagacuuguuuaaaauauaagaaaggguuggaguguggcucagugggagagcacuugccaagacccugaguucaauucccaauacugcagaaauaaaaaauaaguaugaucucauacacuacuguaugacaaaauacuauuuguugagauuugguuacaguauugaagaagaacaacaaauuaucucaaaacauuucuacucccuuuaucaacuacaaaucuguguaacaccagauuuuucuugugcguguaucaaaauaauuagaacaguuuuuuucaaucaaacaaaauacccagggcugggaauauagcucaaaagcuguuagcaagcacacuugacaugcccuaggcuaaucaccagugcagcacucccaagucccccaaagacagaaagcugucaaucuauaaagaaugccaccgcuuucaaaguaggggagcuauuuuuacuaaauuauuuuuuugguaacauacaaugacuuuuaucaguguugcuuuaaaugaguuuaacauguuuuagagaccucugauuucauuucuaauauaguacuaauguauauuuauauauguaguauauuauauauaguacucaauucaaauuugcuaauguaccuuaaccucuaagaccuccaaaaucaguaauaaguauuucuuuagucaguuuacugaggaauacaaaaauauuaccaaaauaacaaacuaggauggaguacuuggcacucuacuggccaucagacaaccaucuguggcuggagacagggauuagguccagcagugcccacgaugagcagagcauaccacugagcagugcacaugcccaggcacacuuauucucucuguggcaugugugugcaaugcacguacacugcuugcacaaggccgaggccagaacucgugucuuuccucagucuucuccaccuuuccuuguuugcagugggaucgcuugcugacucagcuaugcuuucuuguuuguuuucuugagacaggguuuuucuguguagcccuggcugugcuggaacucacuuuguggcccaggcuggccucgaacucaaagaucaaccugccucuggaucccaagugcugggaugaaaagcguguaccacugacacccaacuugaaaaagauugucaaguguucuucuaaacagaguguguauagcugcacaugguggcacauggcuuuaaucccagcacuugggaggaagacugauaaccugaacuuggucuacauagccacccugccuuaaaaaaaaaaaaaaaaguaaaaauggcgugugggaguguugggguguguauaccagucucgacccacacacacacaaguuuguacaaacauauccugguuucuaaaacacuccgucucuccacguauuuccucaccuuagcaaacacugaacaggucucauucuuacuguuuccgccuggacuuaaaacguaaaccaacuuaaaucaguuacuagaagcaugcgucacuuaucuugagaacaaagggguaggaauaaaacguaaguucugggcuuaaacccaaaguagcuaaccaagcccccaacuuccggaggaaaaacauggggccugacucuccuugcccuucuaccaccaaagcacagaccuugaauuugcaaaguucuaggauucaaaacucuccagaaaguaagucaaaaauuuaguauucuaacccaggcguaguggcagacaccuuaagccaaacccagcacucugaaugcagaggaaggcagauacguuaguucaaggccagccuggucuaacuaggaaacugucacaaaaagggggaaaaaagaugauuuuccuauguuaggagccgagaauaugcuaauggcagagguauacuuagcaugcuaaaggcacugggauagauucccaaaacaaaguuuacuccauagauuucuaaaaaucucuuauaguuuucacaaauauguuuuaucuuuuacaaaaugaggaucuuuacaauacuaucuucauauuacuugaaaauaaauacaacuaggguaccagaaacacagaagcaugaacugcggugggucagagacccuuucacagagcagggcugagguugcagcucacugaaagcgcuugcccagagugagcaacuuccagaccuaccagaaaauacauggauggaaagaacaguugggaaggaaggcugaagacaugggucuucugggccuggaccuguuacuuucagugcaaaacacugaccaaaaucaacugacacuugcagguuacaaucaguccaucacugagguaagucagagcaggaacucaaggcaaaacaaacugcucucuauuccccacaacaaugccuuccaccauggaacccacucccaaccagcagacaccaucaagaauguggauggcugccuguccauaaugggcuccugcuuagcugguucaucagccuaaagauagagcugcccacagugugcccaguguaaaugaagacauauccacagaccaaucugaaaaacaauuacucaguucagauuguuuucaggugauauuaggcugugugaaacugaugcuuagcauuaaauagggcagagguguaguucccggguagacugugauagcauacuccaagguguaauuuaaagcaaaaaaaaagggggggggggcauaauugauuaauagccccauugaguccuagcacaaagaaugccuauauauugacauucuguuuuaaaagcacuccucauacaaaugucuagaaagcugcaggaaucuaaagcccugcucuacagccccaguagcuggacaacuaagacaaaccacacagaagaaauguugcuggauuuguuuccuuuagagcauacuuuuuuuaaauuauauauaguaauuaccaaaaaaaugaauggcaagcauggauuuuugaauccaugaguuuugaaauaugaaaagaacaaaggcccuauuauuaaaggagguggugaagauauacuuauucuuuuuauuuccaucuggaaugguccuaggacuaauaaaaucggguauuuuuccccuucauaaauaccagaacauaaagaaaaauaauacgguuuaccuuuguuccaggcaaguauaugcuuuuggcaagcuuacuauauuuucuguggagagagccaguucguuuucccucacguuuugacgguaaaacuggagaacacuguagagaaaggagaaagagugucacaggcacagaucugcauucuuggcccccuccuagccagggggccuccccagcggcgcgcugaccuucccgaccgcgacaguagcaccgcugccgccaggccgugccgcccgucaccgcccacgcaggugucccccggccgcggcagcggggccagcgacucccggcccccggucccuacucggagcacacugcucaccuccaccagccaacug

SEQ ID NO: 12518 - RNA, 5378 nt, Mus musculus
agagaguuuuuaggagucuguuauuggucuguagccacuagugugaagcuaggcaggaugaguggucaggaccucgucacuuugaaugugggagggaggauauucacaacaaggcccucuacccucaagcaguucccugccucucgcuuggcaggcauguuagauggcagagaccaagaguucaagacaguugauggccagauuuuuguggacagagauggugcuuuauuuaguuucauuuuagauuuuuugagaaaucaugagcuucuguuacccucggacuuugcagaccaucauaggcuucagagagaggcucuuuucuaugaacuugauucucuuguugaucucuuaagccaauuccugcuccaaucaagaucugcugucauggagguccauuuccuaaaccaaaauacucaagccuucuucagaguguuuggcucuugcagcaaaacaaucgagaugcuaagugggaggauuacaauguuuguagagcgacccacagcacugaccgggaacaggaacuccccucuggcuuuaccuccacaaagaccuucucaccacgaucugcuuuuccacuguggcuccgauggcgcugcugagaaccaagcuggagucagguauuuugaaugcugaagcaucucuucuauucaaguuaguuuucugauauuuucucucaaaauugaaaauucuuuaugccuaacuaaaacuccucuuggcaaaagaaaaaaaaaguuuagacuaauguucaauagaacaaguagucauuuucuaaacguggacacuuacagacuaagguacuguugaacagguaauaaaccaacacugcccagggaaacuagaaacugcucugugugguuacaacagcaacugguucuguggauuauauuccauugcuaaggaaugauuuagaaugauccaguuugcugcuuuucuucaguggagaagaauauuuuuaaagcugguuucaggcaaaucucauggcaaauuuaguguccugcuauagcuuuggcucuaucacuguuaaaaauacuggaauaggcugucaguaucucaagaauggcugccuuguucugauuuacuugagauaagaucuuacucuguaacucuggcuggccuggaagucucagggccucugucccccagugcuggcauugcaggugaguaccacugccacaccugccucugcuggaaucaaaggcugauuucugcccuguagucagagacacacuaccucacccccuguuaaaaaugucuuagugcugugugucauuauuaucaacugugaaaacuaguuuuaacuuuuaggaggaaaauaguuuucaugcauucauuauuuagaguauuuaaaagcaagucacguuuggaagagagacauauuuuagccuguacaguagccaucagguagaagccuucaaugcuucuugcacagcauacuccuuugucucagcuaccaacuagaggacaguuggcagugcaacuaagugucuacacuuccuuauuucuuggucuuccaaauaaauuauuuccuuauuucuuggucucccaaauaacucuguagaccaggcuggucuggaacucagaaauccgccucccucugccugggauuaaaggcgugcgccaccacgcccgguuugacuccuaacuuuuuguuacauguuuggaacagcgcggacuuauuuuuuuucaauucaaucuuaaaaagacauuaaauuuucauaacagauaauuauaagaccagaaaaaaauauauauauauauuuuagaugggucucauagcccugguuagccuugacugucucauccuccugcaucugccuucugaguacuaagauuauagaccucacccagcuuguggugggauuuuugguuguuuuaaguuuggaguuucuucugguguuuaauuuacagagugccaguuucaggcuagauauagaaucuauaaaaugacaugaacaagccaggcagugguggugcacuccuuuaaucccaucacuugggaggcagagacaugcggauuucugaguucgaggccagccuggucuacagagugaguuccaggacagccagggcuacacagagaaacccugucucaacaccccccucccaaaaaugauaugaacauaaauggugauugaguauauggcuaguuggcaauuacuuauuuuagcuaguuuuuggucuuaauuugucuguucagauguuuuuagaugguggauaugauagaauaagucuggcuggcuucaauguguuuguaguucucucucagguucuugguuuguaucuuuagauguccauccaugugacaauauacuuuaguucaaguuauggccucaggauucuagagucucuucuguagccauuuucugaucucuccuuuuuuaaacuagaugaaaaagcauaguugcccuuaaauuaaaaaaaaaaaaaaaaaggugugggggagaggcggggggguggggggggggagguguggugauggugcuuagugggagagucccugccuggggugcacugcgaggcccugggcucuaucugcagcacuagaaaugcaagcucacauucuccuuuucuuuaguucauccacuuuuuauauguaugaaauccuuuucaauuugaucucagagggaaucagauacaauaguuuuagcucaaugaguuauuguaagaacauucuacuuuuuguaaguaccuacuacuugcuauuuguauccuaguacuuuuaugauauucugugacuuucugacaaauaauuuagaucugaacuuggaagaugaagugcuuuacuacuguuaaaauuuuguaccaaacacaauaaaccuuucuugaaauguguuuuguagcuugauaauuuuuagcugguuguuguuuucuuugccaguaaaaaguuucugaacuuggcauccaguagucaccauuucagccaugcccucaguucaugacuagggcugugcucaaacauuguuuuacccccaagaaacuauagagugucuaccugacacuaaccuaagccucaugucacaguuuuagaacaaugggaagucacaaaaauauccuuguugacagauauuuucugugcuauaaugccaucauuaaagcaaacauggguauaugugcugacauuguagaauacuuaguggguggguaaaggguuuugcauuuucaaucagauuuugacuacuauauuuucucuucaauaacagguagcuauugaugaaaagauagcaauaaauuggagucuuagcauuuuguaccuucaaauuuuaaccugaaaaggcugguugacaggaauaaaucucaacuuacaauggcaguacuaaugauuagagcuaguggaaaauuguaaaaauacaguguuaguagaaacaaaucaauuuagucaaauuggguuaaagaaaaaugaaaaaacuggaaauguguuacucuauauuaacaacaacagcaaaaaaguuuaauucuuugaccaaguugaccaaucccuaaaauaauuucacugaaaagccaacauuuucaacuauauucuuaaauguaauugggaugaguuggaagcauggucucuuuuaauauucaguuacugauuuaaaauugaaaaugaagacucaaaagaaaaucuguuuuuaaaaaaagaucaugagccaggcaagguacgauggccuaagucuuuaauccuagcacuugggaaguagaggcaggcaaaucucugacuuugaagccagcaugggcacgccuuuaaucccagcacuuggugaggcagagguagacggauuucugaguucgaggccagccuggucuacagagugaguuccaggauggccagggcuacacagagaaacccugucucaaaaaaaaccaaaaaaaaaaaaaaaaaaaaaaaaaaaagaagccaguauggucuaugaaaugaaguccacccugggauacaaaguaagacuguauaauaaaaacaaacaaaaacaagcuguugccaagccuggggugcacaucuguaauacuagcauuuuguuugaggcagaaggaucaugaauuugaggcaaucaugguacacaguauaacucucucaaacaaaacgaaauuaaaaacaacaacaaaaacagaagagaaagguacaaugccuuuauuugaggguaugaauaauuucuauguguaguuuuguuauuaaaggaaugcuuuguaauugauuacuucuuuguaugccucagguacauuuccauaaagccugauaaucgaaaauuggccaacggaacaaaugucuugggccuacugguggacacuuuauuaaaggaaggcuuucaucuggucagcacuagaacaccagccucuggagaaaaaagugaaugcuaugucuuugaaaggauaacaaccccucaaguccuugggaugaguaaaacacccaaaucagaaacuaccaccaugccagcgccgucucagaagugacacuguucuuuggacauuccauaucggggacugucugucagaucuguacuguguaacuuuggguuccucgagcagugcuuaaagccacacugccucuucucucaaaucagcauuggacuuugugcucuggcccuugcuucuuucgccaugaacucucauaguuuuuagaaaugggcccuggacuuggacugugucuaauccuaguuuagucauuuauuagcuaugugacuuaauugagacauuuaacauuucuguguuuuaauuuuuaucuauuaacuagggacaaaaaaaaaguaacuccucaaaggagacaaaguucucauuauguugcccggcaugugguaggcauucaguaacuguuauuaaugauaaugaucaugggucacuugcuuucaaacccaucucuucuccagggccuuguuuucucccuugccuuuugcuucucugcagugucagugccuuagcguucuauuguuauaagaagacaccuugaccauggcgaugucauguucuuaucaggaaaacauuuaauuguggcuggcuuacaguuccagagguuuaguucauuaucaucacagugguaagcauggcaguauccagauagacaaggugcuggaagagccaagaguucuacaucuugauccuuagacaacagaaggaaacugugucacccugagcauagcuugaacauaggagaccucaaagcccgccuccauagggacaugcuuccucaaacaaggccacaccuccuaguagucccuacucccuaugggccaagcguucagacacaugaguccauugggagccacaccuauugaaaccacgagucagugacugaacccucaggcauacaaagcccucuaugacuaugauuguaccccucagcagaugauccuucuguauagacacauauuaucauaaaaccagguuucccucaaaaaaccaau

SEQ ID NO: 12519 - RNA, 5378 nt, Mus musculus
auugguuuuuugagggaaaccugguuuuaugauaauaugugucuauacagaaggaucaucugcugagggguacaaucauagucauagagggcuuuguaugccugaggguucagucacugacucgugguuucaauagguguggcucccaauggacucaugugucugaacgcuuggcccauagggaguagggacuacuaggagguguggccuuguuugaggaagcaugucccuauggaggcgggcuuugaggucuccuauguucaagcuaugcucagggugacacaguuuccuucuguugucuaaggaucaagauguagaacucuuggcucuuccagcaccuugucuaucuggauacugccaugcuuaccacugugaugauaaugaacuaaaccucuggaacuguaagccagccacaauuaaauguuuuccugauaagaacaugacaucgccauggucaaggugucuucuuauaacaauagaacgcuaaggcacugacacugcagagaagcaaaaggcaagggagaaaacaaggcccuggagaagagauggguuugaaagcaagugacccaugaucauuaucauuaauaacaguuacugaaugccuaccacaugccgggcaacauaaugagaacuuugucuccuuugaggaguuacuuuuuuuuugucccuaguuaauagauaaaaauuaaaacacagaaauguuaaaugucucaauuaagucacauagcuaauaaaugacuaaacuaggauuagacacaguccaaguccagggcccauuucuaaaaacuaugagaguucauggcgaaagaagcaagggccagagcacaaaguccaaugcugauuugagagaagaggcaguguggcuuuaagcacugcucgaggaacccaaaguuacacaguacagaucugacagacaguccccgauauggaauguccaaagaacagugucacuucugagacggcgcuggcauggugguaguuucugauuuggguguuuuacucaucccaaggacuugagggguuguuauccuuucaaagacauagcauucacuuuuuucuccagaggcugguguucuagugcugaccagaugaaagccuuccuuuaauaaaguguccaccaguaggcccaagacauuuguuccguuggccaauuuucgauuaucaggcuuuauggaaauguaccugaggcauacaaagaaguaaucaauuacaaagcauuccuuuaauaacaaaacuacacauagaaauuauucauacccucaaauaaaggcauuguaccuuucucuucuguuuuuguuguuguuuuuaauuucguuuuguuugagagaguuauacuguguaccaugauugccucaaauucaugauccuucugccucaaacaaaaugcuaguauuacagaugugcaccccaggcuuggcaacagcuuguuuuuguuuguuuuuauuauacagucuuacuuuguaucccaggguggacuucauuucauagaccauacuggcuucuuuuuuuuuuuuuuuuuuuuuuuuuuuugguuuuuuuugagacaggguuucucuguguagcccuggccauccuggaacucacucuguagaccaggcuggccucgaacucagaaauccgucuaccucugccucaccaagugcugggauuaaaggcgugcccaugcuggcuucaaagucagagauuugccugccucuacuucccaagugcuaggauuaaagacuuaggccaucguaccuugccuggcucaugaucuuuuuuuaaaaacagauuuucuuuugagucuucauuuucaauuuuaaaucaguaacugaauauuaaaagagaccaugcuuccaacucaucccaauuacauuuaagaauauaguugaaaauguuggcuuuucagugaaauuauuuuagggauuggucaacuuggucaaagaauuaaacuuuuuugcuguuguuguuaauauagaguaacacauuuccaguuuuuucauuuuucuuuaacccaauuugacuaaauugauuuguuucuacuaacacuguauuuuuacaauuuuccacuagcucuaaucauuaguacugccauuguaaguugagauuuauuccugucaaccagccuuuucagguuaaaauuugaagguacaaaaugcuaagacuccaauuuauugcuaucuuuucaucaauagcuaccuguuauugaagagaaaauauaguagucaaaaucugauugaaaaugcaaaacccuuuacccacccacuaaguauucuacaaugucagcacauauacccauguuugcuuuaaugauggcauuauagcacagaaaauaucugucaacaaggauauuuuugugacuucccauuguucuaaaacugugacaugaggcuuagguuagugucagguagacacucuauaguuucuuggggguaaaacaauguuugagcacagcccuagucaugaacugagggcauggcugaaauggugacuacuggaugccaaguucagaaacuuuuuacuggcaaagaaaacaacaaccagcuaaaaauuaucaagcuacaaaacacauuucaagaaagguuuauuguguuugguacaaaauuuuaacaguaguaaagcacuucaucuuccaaguucagaucuaaauuauuugucagaaagucacagaauaucauaaaaguacuaggauacaaauagcaaguaguagguacuuacaaaaaguagaauguucuuacaauaacucauugagcuaaaacuauuguaucugauucccucugagaucaaauugaaaaggauuucauacauauaaaaaguggaugaacuaaagaaaaggagaaugugagcuugcauuucuagugcugcagauagagcccagggccucgcagugcaccccaggcagggacucucccacuaagcaccaucaccacaccuccccccccccacccccccgccucucccccacaccuuuuuuuuuuuuuuuuuaauuuaagggcaacuaugcuuuuucaucuaguuuaaaaaaggagagaucagaaaauggcuacagaagagacucuagaauccugaggccauaacuugaacuaaaguauauugucacauggauggacaucuaaagauacaaaccaagaaccugagagagaacuacaaacacauugaagccagccagacuuauucuaucauauccaccaucuaaaaacaucugaacagacaaauuaagaccaaaaacuagcuaaaauaaguaauugccaacuagccauauacucaaucaccauuuauguucauaucauuuuugggagggggguguugagacaggguuucucuguguagcccuggcuguccuggaacucacucuguagaccaggcuggccucgaacucagaaauccgcaugucucugccucccaagugaugggauuaaaggagugcaccaccacugccuggcuuguucaugucauuuuauagauucuauaucuagccugaaacuggcacucuguaaauuaaacaccagaagaaacuccaaacuuaaaacaaccaaaaaucccaccacaagcugggugaggucuauaaucuuaguacucagaaggcagaugcaggaggaugagacagucaaggcuaaccagggcuaugagacccaucuaaaauauauauauauauuuuuuucuggucuuauaauuaucuguuaugaaaauuuaaugucuuuuuaagauugaauugaaaaaaaauaaguccgcgcuguuccaaacauguaacaaaaaguuaggagucaaaccgggcgugguggcgcacgccuuuaaucccaggcagagggaggcggauuucugaguuccagaccagccuggucuacagaguuauuugggagaccaagaaauaaggaaauaauuuauuuggaagaccaagaaauaaggaaguguagacacuuaguugcacugccaacuguccucuaguugguagcugagacaaaggaguaugcugugcaagaagcauugaaggcuucuaccugauggcuacuguacaggcuaaaauaugucucucuuccaaacgugacuugcuuuuaaauacucuaaauaaugaaugcaugaaaacuauuuuccuccuaaaaguuaaaacuaguuuucacaguugauaauaaugacacacagcacuaagacauuuuuaacagggggugagguagugugucucugacuacagggcagaaaucagccuuugauuccagcagaggcagguguggcagugguacucaccugcaaugccagcacugggggacagaggcccugagacuuccaggccagccagaguuacagaguaagaucuuaucucaaguaaaucagaacaaggcagccauucuugagauacugacagccuauuccaguauuuuuaacagugauagagccaaagcuauagcaggacacuaaauuugccaugagauuugccugaaaccagcuuuaaaaauauucuucuccacugaagaaaagcagcaaacuggaucauucuaaaucauuccuuagcaauggaauauaauccacagaaccaguugcuguuguaaccacacagagcaguuucuaguuucccugggcaguguugguuuauuaccuguucaacaguaccuuagucuguaaguguccacguuuagaaaaugacuacuuguucuauugaacauuagucuaaacuuuuuuuuucuuuugccaagaggaguuuuaguuaggcauaaagaauuuucaauuuugagagaaaauaucagaaaacuaacuugaauagaagagaugcuucagcauucaaaauaccugacuccagcuugguucucagcagcgccaucggagccacaguggaaaagcagaucguggugagaaggucuuuguggagguaaagccagaggggaguuccuguucccggucagugcugugggucgcucuacaaacauuguaauccucccacuuagcaucucgauuguuuugcugcaagagccaaacacucugaagaaggcuugaguauuuugguuuaggaaauggaccuccaugacagcagaucuugauuggagcaggaauuggcuuaagagaucaacaagagaaucaaguucauagaaaagagccucucucugaagccuaugauggucugcaaaguccgaggguaacagaagcucaugauuucucaaaaaaucuaaaaugaaacuaaauaaagcaccaucucuguccacaaaaaucuggccaucaacugucuugaacucuuggucucugccaucuaacaugccugccaagcgagaggcagggaacugcuugaggguagagggccuuguugugaauauccucccucccacauucaaagugacgagguccugaccacucauccugccuagcuucacacuaguggcuacagaccaauaacagacuccuaaaaacucucu

SEQ ID NO: 12520 - RNA, 84786 nt, Mus musculus
aguggugacaccgcuggggugcggagggagucucucaaacuucucucaacagccccagggccaaucuccccucagcccacuccccucuucgccagaucccugguccccacucccugcacugggggugggguggggaacugggcccgucucccgcggggacacacacaggguccgggaguggggacgggacccccaggccgggggggacggacggacagacggccgcgcggccgccccagcgggcaggcaggccggaggcggggguacggccgggaggaccugggcuggggaguuuccucucaacuaucgggggagaaacuccccauagcugguguuuuccucccgggggccgcguuccccgccccgcguaucggcgguugccgccgccgccgccggugcuuccaccucugccaucucuucaccaccucgggccccgguguccccggccagcacuaugcccaucuuacuguuccugauagacacgucugccucuaugaaccagcgcagccaucugggcaccaccuaccuggacacggccaaaggcgcgguagagaccuucaugaagguaccgacuaacccagccccgguggugacccggacccgguggcccgcggggggcagggcggggggcagcggguuuacugcgggcuccgcgggcgcggggaccccucccccaccgcgcgggcgggcgggcgcugggagcgggcucugcugggccuggcccauguggggcugcugugggugcggggggcggcggagggacggcccugcgugugcgguacugugggggcggccagcgacccuucugcgacugguaaccucgccucuguguuucccucucucccgcccguccccacccuggcccgcagcuccgugcccgggacccugccagcagaggagacagguauaugcuggucacuuucgaagagccgcccuaugcuaucaagguaacagcccucgcccucccccucccuucccugauccugccuagcucgcccuccccgcccccucuucauuaugcuccccucccccacggccgcucccgccuccaggucccuuccccgcggccucccaccccuccccagcccgggagcgucagcgagguggcaguuucuggcccaccgccguccccuccggguccugcucggccuggcggcggaggcgcuacgaucaacauggccgacauuuccccuccgcggcgugagcggcagcaaugaacugugggggauauuuauucaaguuagcccgagugacagcggggcccagccuugccuagcccggguuugcauuaaaagggaaucagccaaagcuggcagggaagccuggaggggggcuucgagacuuggucaucacagaguggaacuaggaaggccaccgaucggugggacagcuguggucaacuuaagaaguccugcugccaucugccucccacuagcaccgucgcaacacccgucccuugcacacaauuuggaggauguuauguuagcaaauuucccagugaaguuauuaaaguauuaagacgguuguuaacuuaacaaaagguguagggcaagcagguucauucuuggccaccuuuggaagaguuuccucaccagagacaacaguuauaacacauuccccaagccauaucaagcaaaagugaaguuaaauaugcaaaccugaaauggaauaccuacuugguggacaucacauuguaaucgguguccauguguguacaugacuucaaaugauaaaaaaaaaaaucuuacaucuuucuuuucaggcuggauggaaagaaaaccaugcaacguuuaugaaugaacugaaaaaccuucaggcagaaggacuuacgacucuuggccaaucccuaaggacagcuuuugauuuguuaaauuuaaauagauuaguaacuggcauagacaacuaugggcagguagguugaauacuaagguagaaaagaguuguuuuuauuuuuguguacaaaaccacaauccaguccaaaaguauguaacauggaaugcaaguauaaaacauuggagguugaacaacagugcacaccguucaaaacaucuaagguauuauggccgcauaucccccacgccccuuuaaauguauuugcauucagaauucaaaucugaauucuuggcuagaaaguugacacacauuugguuucagucccucagaguucauaaaaaagacauaaaagggaagguguccugccucaauguaucagucugaguuuccuguaggcacauaugcaaccauugaaugggccacagccauuagcugacuucguaguugcuucuauauuauaaagauauuggaagaaaugauuuuuagacaaggguuuagcuuaaccucgauuguaaacucaggcaagaguuuucaguggugugcaguaacugguugacugcauucaguacgaagcuugaaaucaaugacagauucagaaguucuaaaguuuaaaaauucuaaacccuugggaagauguuuucugcaaaacaugaaaauuugccugucuuccugaagcucccuaagguugcuuuuuucaucugugaggaugggacaagagcuuuaagucacaacagucauugaccaauguuacuaacuuaggacauugcucuccuagaaaugcaagaugccaaaggauaugcagugguguacacaaggaauaauauuacacccaaggacuucaguacgcaaagcacuauuaccauaaugcuauauuuaggaauauauguuauauacuuuucccaaguuccauaaugcacaguucucgugaauuuugaacauuuuaaagaauuuuuuucugugacuucaagcuauaugccucacuuggggauaauucuuaaacaucuuuagaaaugauugauuuuggucuuacagcauuuaaaguaugcauuacaaaucagauuucucuggaaaucauuuccaucauuuaaauagguaaucauuuuaacguacauuuuuguuguuguuacuuuauaacucuuugccacuuguuggucaguuuuuguaaaagcaguuuuuuuccuuuguuggcuauaaugcuacugucuuuaucauuuaacauuuuaauccaagguuacugaguucaaagacaccuuugaaacuugcuauuuaguuccuuuauuucguuugucaggucguguguuauagaacuaucaauuuccuguuuuucugugucacauuucauaagagagaaggacauuuggauauguccaccucucauauuuuuaaaacguggcauaaaguccuuuaggaggauuguuugccacggagagauuugagggcauuuguauacuuuuguaggaaguuuaaggcugcagggagaccugugcuguaucacuuugaccagaaggaagaaagcccuggagauugugaugcucucauugccaggcagcaaggaugcugccucuuaguuacuggagugagucagcuaggguucaagaagugauaguaaugcuuuugcuuauauccugaacuaauaaugaaacuagcauuaaaauaauuuaagaagcaaugauuucuaaauaaauagcaguuuuuauuugaguaaagucuaccuugaaggaaacaugcuucuggauuuuuuuucaucauagaaccauuuuuguuuauuuaaguauuugguauuucccauuuauacaaagauuauuagaaguuuggaugguugaaauauuuaauacuaaauaucauuuggauauuuggaaaauaacuuguaggauggguuuauucuguaacccuaguauuuuuuuuuuauauauauaagcauuucaugcugaauaguaggaauacuggauauauucucaauaguuggagagaaugagagaaggugaauuagcuggaaacagcauguuccuuuuauagagcaucuauacagcuuaauauaguuccaaaucauuuucuuaaauauggguuaacuguacacauuuauauauuuacaccaguaacccuuuuuuguagacauacagacacauaggugauuucauauaaucaauagcaagaacacauauuucuguauuacauuuauugcauuuauuuauuuauuuauuuauuuauuuuucccuuuuccuccccuucacuuucacucuggcccugcuugcucugcuguauuacauuuauuaacuuaguauucuuuuugaaaaauuauuuuauguauaugagugcucugcugcauguacaccugcaugccagaagagagcaucaaagagagcauuuauuagaugguucugagugggugcuggaaauugaacucagaaccucuggaugaacagccaguguuccauaacuccugagccaucucuguagcucccaacuuaguaugcuuaauuagauaggauacucagaauuguaagguuaaaaauagcugagcaaaaaggauucuugaauaauuuucucaaacaccuugaauauuccacuaacaauuguucuaccuauauagcaguccuuuuaaauacuugguaguuaguaccauuugcugguauuuucuuugauaucucuagcuauguaucagugcuagccucuaguaaucccuucuuuuaaaaguaguacauguuaacaguuucagauuaugcugagucugaaaauaagcucagguugauaagauuaagaauguggacagauugaacaguucuauuacauaaauugguguuuuuauauuguucuguguuuuuuuuuaaagauguauuuauuucauauauaugaguacaccauuacucucuucagacacaccagaagaggggacaucgaaucccauuacagaugguugugagccaccaugugguugcugggaauuuacucaggaccucggugcuuuuaaccgcugagccauuucuccagcccuguucugugggguuuuuaaaauuuuuaaaaauuuuuuuauuuuuuacuuuuuugguuuuuaaguuagguuugccugcugaaucugaaccuggcauccugauuuuucucaguauccucacucugcccccaucccccaauauaauagcauugauuggauuguuuagacuggugcaugaccuacuauguauuuuaaaaagaaaaauauuuagugcuuuggggauuuuaaugggaguagauaucccauuugaaaaugaugacuuuggugugagauguguuggaugauccuguuuguuuuuuucugagcugggcucaguguguagccauugcuagcuuggaacucacuguguagauuggcuggucuugaagucaaagagaugugccugcuccucccuugaguguucgaguuacagaucugcaucaccauaccuggccaggcuuccuguuaauguuagugaaguagagaaaaguugauuuccuauuuggguuuuugguuuuucuuuugccuuagauuaucaacaaguuuuuuugacuuaauauuaagcuguagauauauauugcauauauauauaaaguuauagauaacucaaguagaauagauuauuaugcuugccucuguauacuguguguacuacacugcugagauguaaccugaaauaguagugaagaguuaaguuuugugugguguugaguaugaaacccacaaccuugugcauuuuucccccugagacuugcacugcccagcaacucugugcguguuagauaaagacucuaccacagaguuacacuguuuccuauuaaaaaaauuaagcccuuaaguuaacaaaguaaguuuuaaaaauucaaugacauuuguguguggugagggauaguaugccagugaguauaugugaaguaaguggauaaccuguggcacuugguuuugucuuccaccaugcuuguccuagguucaagcacuggucuaaguuuuggugguggguaccuuuuucugcugagucaucuugcuaucccagaauuccuuucuuucuuucuuuuuuuuuuuuuuaaauguacaaagcaaaauuuccuaccuucuucauuucugaguguuguguaagcaaugccuagaacuuuuucaucucacaaaauuaaaauuuauugauaaccuucauugcuuauacucccuucaggauucuuuuucuauuuugugugguuuuguuuuuguuuuugcuagacuacuguauauaacucuuaauaaguguuaucacauaaauauaguuggacccuccacccguggguuugcuaauccagacaaccacagaacagaacuauccaaacaaacccugcaucuguaccgaacauguuucccuguugauauuuacuaaauacaacucuuagcauagcaguaagacugcauuagguuuuuaaaauaacauggaaaugauguaaaaaauacauaagacguguguagguuauagauaaguaucuggauuuugguaucuuuggggaagaccaggaaccaaguguuuguggaugcucaggacauaagaguguguuugucuuaugacuaaggauuuuuugcccaauccuuaagguucauccacauuguagcaaauagaauuuuugucagaauuuucuugacucuuaagaauaauacuauaauuaauguacauagauaaguuucuuuuuaagacucuuugaaagagaacaguaaaucuagucaggagugguuguacauaccuuuauuccuaguauucaggaggcagaggcaguuguauugucugugaguuugaggccagccugguuuacagagcaaguuccaggucagccagggcucuuacaugcagaaacucugucucaaaaaacucaaaagaggagaaaaagaguaguaaaucuuaauuuuuguuuuuuuggggggguuuucgagauaggguuucucuguguaucucuggcuguccuggaacucacucuguagaccaggcuggccuugaacucagaaauccaccugccucugccucucaagugcugggacuaaaggcaugcaccaccacugccuggcuaaaucuuaauuuuuugagaucuccauacuuuuccauaguuaauuguaucauuuuacauuuuucacaauaguucacaaacuguuacucugccuguaucuugcugauccacccaaacucaaguagccuuacuuagccaucuuaauggaugugagaagaugccauuauuguuuugauuugcauuuuugaauauuauauugagcaucuuuucaugugcugguuagcuguuuuagauacagucuuuggagauguauuuaaaaucauguuaaacauguacucgacacaaacacaguuuuuguuuuguuuuuguguuguugaaaguauugaggguugaacuguggccacauacacccuguucaaguacucugccauuggguuacaauccugcucuuuaggauuuauucugguuauuaacuccuuuauuagauaucucacacaucuucugucauuguguagguuaugcuuuuuacacuguugauuguauccuuuggugcauagaacuuguuuuuauauaguugaguuuauuaacuuucccugugcuuuucauguuuauaaagguuugguuacucuagcauuauugaugcauuucuuuuauaguuuuagaacacuuggccuuuuaucuauuuugagcugauuuuaauauacaguauauauaaaagauccaacuuuucuuuuguauguggcuguccaguugcuuuagcacuauuggguagucuuggcaagucuuuuucaaaagcauuuuuaaauaauuaguaaugagagaggacuuuacacuuauauuuucucugccuguaugugcuguuuuagagaagagcaacagcuggaaauggaaugcccaaucuugacuuugucauuaaaucacugaaucacacugaauaagcagcugugaacucacuguacccauguuguuacagaaugaaugagagguuuauuuaaaucugauauagguauaagaugucuauggaguguuuagagacaaaacaaacuaaaaaaaacaaaguaagccaggugugauggugcacaccuuuaaucccagcacuugggaggcagagacaggcagauuucugaguccgaggccagccuggucuacaaagugaguuccaggagagccagggcuauacagagaaaccuugucucgaaaaaaaaccaaaaaccaaaaaaaaaaaaaaaaaaaaaacccgaaguaaaaugggcuugguagcauaagccagacuuaaauuccaauaggcgagaaggccagccuggucugcccagugagacacugccucagaagcaagaacaaaacccaaaguaaugauguguaguaguuuaccucuaguuuccuguucuguuuuuguccuuuguuuggauuuacaauuauaaaaaucuagugagcauuaauguuggguucuguuauuacaugguuugcaaccuaauagcauguggagauuuuuuucccuugaauuuuguaguucauccuagaaaagcaggugugagagaaaaacuaauauaacuuugucagaguugucuuaaugguagcuggcuacuuugagauuguauuuuuaaagaaacacauugaauggaaacuggguuaaguauugggaggacgcuuuaaaagcaguauauugaacaaaaacuggguaugaguuuagcugacagaaaccauguugucuuuggaguuuuuguuuucuacaggucugauuuauaaagagcuuuuaguagcauauguuuucgucccaaaaaacugguuauaguauuuuuuuaauacuguaagucuguuuucuaaacauucaaaaaauugcaugaauuuggcauuucagaagaaaaaugacaaaaugguacccaaagaacaucauuguguuuuuaauugucugugaugucuuaaauacaagaggcaagaaauucuauacaguugaggcuucuacugaucccguguguugaauugauguaagauaauuuauggucagaaacaacuaaaaauuguuucaucuuguuuauguuauagguucuuuaaaaaguugugccauuaucauugccacaguuuguaauuugaaauuuaaaauuauuuuucagccaugaugaucugacauuuaugacuaaaaugccuuaauauaguuuuuuuuuuaauuuuagguauuuucuuuagaugacagaugcucauacaaugaccccaucuuuucauuuuuagaaauugauuuccuuauaugagcuauuuuugcuagcuggauuaauuuauguaauuaugcaugucuuacugauuauaaaccuaauacagaagaauuuuugguuuuguuuugcuuuucuuuguuucuauaacuuuaaaaauaacauuuaccuauuuauuugggaacaacauagaccuuuggagguuagagugaaauuuugcaggagucaguuuuguucuuucaccaugaaguccccaauagauugaacucaauucaauuggcuugcuagcauguacaugcugagucaucuuacuccccuccccucccccacuccccuuuagagucaaggucuuaauuaucucaggcuggccuuaauucacuaugaagccaagggugaucuugaacuuccuuacaaaagaauuacuuaucuccugcuuauuugcuagagccuauauguguauacguguacugcauuugugucugguacguuggcuuugguuucucuagaaaggaaggacaguuguaaauccaggagccucugcagaagcagccaguacugcugauucaucucagccuugcucuugaacucuugauccuccugccuccaccuccugauugcuguguuccaccaugaauguuugugugguccuggggauugaacacaagcuuuaugcaugcuaggaaagcccucuacuaagcuauaccaccucugcuuuguuucuuuauuuauauuuucuauuugaguuuuuuaaugaagguuacugaauuuuuauauacuuuugagcagaauucuggugacuucguuuuugugguuuaguuuaucaaaggccuugaaaaguuaaaaugcuuaauuuauuaccauucuugaaacauuggaacauuucaaaagaucacaauugauuugaaauaggucauauaucuuauaguaacugguaauuugaagagucuuauuuaaaagaguaaagauaaaacagcagacucuauuuuuuguuuuuugucuguaaauaauacaaugugcgaguuccuguuugaaaauagcauuucauuuagcuguuucauguaaccuuuuauguaacauuucaucuaaauauuacuuguuaccuuauuggcuucaauuaaauuucuuccucuaguuuggaaaaaaggauauggaugaguaaggggcaguugauaggauuuuaugacauuuuaaggacaagauuagguuaauauaaauuuuacaauuguguauguguuuaucuucugagccaucugcuuuagguaguuaacauacggcuaauaacuugucaguuaauuagcugaucuuugcauuugagccagacaguaauagggcuuacaauaguaacuuccguggaagcuuuguaguuagguaacugucauaguuucuuuuugucuaagaugguuuugaaaauacuacgccucuuguccugagucagacacaugugacuaaaggcuugcuuauggauaucuaccacacuggugaguccuugacaggucuuauagccucuaaucuugucugucuaccacgaaaauagaacucaccauagaugacugcugugaauguugaguguuacuuuauuacuguaaaauaauuauuuuguaaauuuccuuuuggauuuuaaaaauugaaguaauaggaaugggaagcaagguuugcuuuaaucuugcucaucacccuagaaccuuguggugauacagaaaagcaaaaccaaaaauaaauaaaaaucuccaacuucccuuguaaaguagauaugcuggucugucccacuuaaaagcuuauguuuuaacuaguacuuuaaucucucugaucuucaaguuucucauccacaaagugaugaaaguaccaaucuugaaaaguuuguaaggauuagaaaugacgauuguuaauuaaccuaacaaaauaacuaccuugcauaugguaggaacuaaauugauaaggauuauuguuaaaggaaacacuuaggauaaaagcuuucuauugugaaacugaccagaccuagaaucccuguauacuguauacugcccaaaccauggcaagcuguccauuacuuccugcugaagucauagauuuugcuguagggaacauguuucuugguuuuaauuuuuaguaucuuugaguucuaaaauuauauuuuaaaaaauuaacuuaagucuuuuacgaaauuuuuuaucuuuucaaaaacauaccaacagacaugcaaacacacuugugaauuucaaaauagaaacaucuuuagucuuugaggaaucucacaucagucuuuuucuaggacuguauauuuuaggaaucacauuggugaugguuagugugggguauauuagaaagaagacaacuuuggucaaggaguucaagagcaagauacucccuuuuuguagcuuuguguagaaaaagcuauuaauaggauaaaucuaugcuuuuuuuucauaugaaggauauuuuugguauauacuguuugaaauuugauuacuuauauauugagauacuguuauguggaaaagaccucuuaauuuggucagcuuaaugacuucauaacaaagcaauuuuuuuucuaauccuuauacacguuucacaaauguguaccuuuaaaaacuauggaaucuuuccuaucuguuugauuugcucaaauauaguaugugcuuaacaaggaucuuagaagggcuauauuuucuauaaaacuugauuacuaguuuuaaauauauguaagcaaagauuuauuacuuguuagcuaguacaguuuaugacugaugaaugacaaaacugauguugguuuguuaaaaaaauuuucuuagucuaaagcuguugaaccuuguuagauuuuagagaacguaaaauauuccuaaggguauuuuggaacuucaagacuaaacacucaauuuaaaaaaaaaaaaaaaggguuuaaaaagcuuugaaacuaaccuugucuuacccaguuaagauggacucuuaagcccuagcauaugagaacuaauacccauguugugaauuuuuuccuuucaaaaauguaaagcuuuuuugcuaauuuuugugaucuguaauauugacuauuuuuucacuauauauagagagcuguuguagaauucuauguuuuuaaaauuuuuuaauuuaaaaaaguaaaaauuauuuuacgugaaaagguguuugggggaguaugugugugcuugcaucacaugugugccuggugccauuguuggccagaagagaguguugaguuccuugaaagaguuauaugucuguuagccuccauauggguacugggaauuaaaccaagaaccucuggaagagcagcagccaguacuccuaacuuugaguuguuucuccaggacuccuguguuuuuguuuuuaaagacaguaauguguguaaauuuauucuuuugagggccugauuguggcauggauguuuaaagagaagaaaccagaaucuuccuauuuugacauacaauuaaggucugcuuguuagaguauuuaaaauugaauuugauugcugaguucaagaaaugauuuaugaagcuggagaagagagagauagagucugaugagagcacuguucuuucggaggaccuagucaguucccugcaccugcauggcagcucacagccaucuguauauaacuuuagucacaggggaucugacacccuaugguaccaggcauacaugugguguacagaaguaugugcaggugaacacucguaaacacagagugaacuuaaagaagaaaaagggaaaaaaaaagaaaaaagaaaggaaaacaacaacuagccaggcuuuuaccaagguagugcaugacugugguagugagaacccaaggagaucauuaaacuugaggauaggcuagaucuggaugaggcaaauugaguguuguccugucuucauuuaccugacuuugaaaauauguuuauaucuuugcauuuauuauacuuuuuugucaucaaacauauugcugcauugauuuucccacauuaauuuuaccuagucucuguaauacaauugauauauuagguuuuuuuauacauacgacucguauuucuucaguagaauuauccucauaucuucauuucucuuucugcaccaguauaaaaucuguuugccugcuacuaguuuuuaggaauuaccaaaaccaaucuguuaaucuuuuucaaacuuuagaauuuaguuuaaaugcaagaccgaauucuuuuuaaauuauuaaauuagauuucccacuuguuccuuaaauuagcuuuucacaaagucaagaauuuuuuuauuauuauuacuuuuuacuucuuuuauuuauuuacauuccaaaaguugccucccuuccugucacuccucagaagaguucuuuaccucacuaccccagggugcuccuccaccuggccacacccccccccccccccccagcuucccucuucccugaggcaucacguuuccacaggauuaagugcauccucucccauucagagacagcuucuuguuagguuguucaggcuaccccugauccauucugugggcucaaagcuacuaucucaggggucccacagauauguaacugacugacuuuaaauaugcucuacaaaaccacugaaaaccccauguuuauuugaaggaaugcuuauauaaagcuugaaaauuuuuaguauuagaguuuguagaaaugaaagguuuggcuacugaaggccuuaguaggaaaacuucauguaagaacagagauuuaaacggcucuuuggaaugaguaggaguuggauaggucuuaaacaaggaauauaacaaguauuuuacuagagacaaaacuuagguggaaauggacauuuccaacauguggcuuugugggaagauuugaacuuuuuaggguuaaggaucugacuaucucauguaacugguacaagaagcugaacaugaagagggaugccggugauuguuuccauucuguagggaucuugagacauuuuaaugcuguuguauauuuagagucagucucuauuuguguuucucugucugucugucuuucugcaugucugucugcauguguaugaaaguggguguggaugaggaggccagaggucagugacauuccuugguugcuucuccagcuuauuucuuuggaacagagucgcucaguacucucagagcucaccuauuccgcuugauuauuugcccagcaagcccaaggaaucaucuuguuuuugccuccucaguguuggacuuacagauguaaacacuacuuacuagcuuuuuuuaugugcauacgagaacugugcaaaggugguguucuaaccaacagaagauuucacuuuuuagaacuucuuuuaggcgucaauuugagaaacgucuacuuacaaguuugccugacuugaucaaaaugcuuagcagaucucccuccuuuauaaugauuagauucuaaucauauaauuacuguaacuguaaauuuuauucagucaauaguaugugcuauaauaugccaggaaucaagauuaguaaaugagaagggaaaacaaaaaaccccugcagaugauuuaugcauauaacccuuuuccuuacuacuggagguggucuguggacauuagcaucucccaaacuuguugaaaacacugaaugaacaacuauauuuuacuaagaucuccaacugauuuuuauaucacuaaacuucaucauaugcugguauaugucagauccaguaaacuucauucaauuuuugcuaccuacaguagagaguuuaaaugucuuugaauuucucuccuuuuuugagauagggaucuuacuauauugcuaggcuagucuugaauucagucucuuguuguggagacuguaaguauauguaauguauaagcaucuucaguuucagacaaguuauaccuacuugaaauuucuauauuuggucuuccuguuuauucuuuauuaugugcgcguguuuguguguguguguguguguguggagggcguugauuauuagguguucccaauguuuuugagacaugguuucauugaagcuggagcacauugauuuuggcuagugaaaucaaugacuaccucaaguaaaugcuuggagagcuuuagcgguuuggccagugaguuuuagagaucuguuugucuucagucccuucugucuuggcuggguuuacaguugugcuccauugugccuggguuuuuuacuuggguacuagaucuaaacuuagguccucauguuugugugacagccacucuacugccugagccaucuccccagucugucucuuuuuuaagaguuaacguggaggcugauucagaagccuucauggagggcugccuccaagucugguaauguggcaggugguggaaggagagaaugagcuacuaaaguuguucucugacuuaacacauguaugcuguggcauguguuuccuuuacccccaaauuaacaaugacagcaacaacaacaacaauaaaaaacaagauaauaauaaauuaaagggcuaauaucggaugugcuuaguucucaacuggguaccauuuguauguaaaaggcaagguugugugugcuuuucccaaaacuuaauaauaccuugaaaugaucauuguagcauugugcuagauuagggucugaauggaagacacugaaguauauucaucuuauagagagccuuugauagcagcaugccauuuuguuucuuggcuaucauuguuuuuauacauccuuuuccaagcauuuacuugagguguaguuauccuuacuuuuaacuccuugucuuagacuugugcuaguuuugcuaagcugaggauacccuaauaauuuugugaaauuaguuuuugaaguccuuuccauguacuagccacuugcugagacauuaugauuaugggcacugucuuuuuaaaauacuguuauuuuucuccuagcccccucccccccuaaggcaggggacaagggagcaagacaaugacugccucuaugcaggccuggaaaucccuugucuuccugacucaguuccuuagugcuagaacuugaguuguguaccauugcaccaagcuuuuagacuguuuuguauuuagagagagcuagcuucaaaugcauggcuaauuuuccacaugcugugaucacagguguggaccaccauauuccuagagucuaucuuuauuauuccaguuuguacuauacuugauuuuagccaaaagacuaagaggugauuaguacugguuugugauagccuucaaaaauucaaauuacuagacuucagcuaugaggauacuguuuaagaaauuaaauauugggacuguagaaauggaucaaugguuaagaacauuugcuggucugucagauuaggguucaguucccagcacucacuucgggugucucgcaguugucuguaaguccaguuucagggcaucugaacugucuucugccuuccuuuggccuuuguggcaccaaccaaacacaugaugcauauacaugcaugcagaccaaacauuauuauguguaauauaauuuuuuaaagaaaauaugcuuucuaacauacacaaauaauaauguaaaaacacaagaguauauaaaaaagugagaaaucugucuuuauaucucuagagcucaguacuauuaguauguauucuuuuuuuuuuuuuuuucuuggcuuuuugagacuggguuucucuguguagcccuggcuguccuggcuguccucucuguagaccaagcuggccucgaacucagaaaucugccagccucugcuucccaagugcugggauuaaaggcgugcgccaccacuguguggcaguauauauucuaaaauguguuuuaaaauguacaauauaugauauauguaaauuuuacuaacaggagagauuggguuagugagauagcauaguggauaauaaaaagguauuugauuacugagccugacaaacugcguuugagucucaggacccacauaguaggaaagaacagacuuccugcaagcugucuuccaaccuccacacauucucugacauuugaguauacacauacacaaauuaaaugcaauaaaaauguuuuaaaaaugaaaagggagaugauaaacauuccagagggauugugggcauucuuuucuaagaauugguuuuguaacuaaagguuaaaccagaacuuaagccuugauauccuuuuguuuuguuuuguuuugacuuuagggaagaaaccccuuuuucuuggagccagcaauaauaauuacaaucacugaugggagcaaguugacuacuacuagugguguccaggaugagguaagucaugugaggugugucacauggaucauagaugaaauugagaccuauuuguguauguguguaauaggguauuggaugcuuuguaguacauuuacucuuuaguaauugguguaguuuauaauaauucaucuccaggguccucuaccuuuguucauagcaguugucauuauaauauuuucuugaauaggaauccuuucugugcagaguuuguaaguguaccuccugcuuccauuaaaaacaucaguugauagugaggacagugucagugccuacacaauaguaaaauucuuauuuucagguuaaaaagaaaaccaaacaauucuaauaauuuucuuauuuuagcugauuauggugauagcuuucuuauuuucagguuaaaaagaaaaccaaacaauucuaauaauuuucuuauuuuagcugauuauggugauagcuuuuaacuacagacagaacaacugaaguaaauaagcuuauaacaaggaaauguuuauuuuaacucuucaaagagguuucaauguauaaucaguagccuugagaguuugagcacuuuggugagacaaggacggugggacagugggaaagaauaagcugcuaacuucauguggccaguaagcaaagggacuacagucagauaacacuuucaagauucugcuccaagugaccuagcuuucuccgaccagaccccuuuucccaauguugccagcaucucccagagcuugaggccaagacuuaauacauaggccuuucauagacauuucugccugaaucauaugucaguugagguuuuuaguagaguccaggcgggaacacaccaccaagaguagauuaaaacuagaaagagugaagacuuuucaacaguuauguuuucucuuaagucagauguaguaucgauaauucagagcuaauguuaauuacucuguaagugaauuauguaugcuguagugugauaaauccauuagguuaaagaaagcaagcuuuauaguguuuuuacuguauuugaacuguuguuaaguguuuuaguuuuuucuuaacaugcaaaugcacaggugaucuuuuacagacucauuacuguuugcauuuguucuuaguuucuaugauuagaguuugaaauggcaaagguacagauuuuaaaaauuuagaauuaaaauuuaaucaaagauuuggaauucauuuccauuccugugacacuguugaauauaaauuauauggagucagagcauguggguuuuauucuuaauucaaguacuuccaccgugaacuuucuaccaguugaccuaauuuuccuaagcucuaccuuaucaaugaaauacugacaauaauucuugauuuccuucauaggguuguugaaauguguaaauaauggaugugaaaauguacggugggcuauaaagacaaaguguauugugucauuccaucaugagauaauagaaccagugcagaacuuagauuaccuaauuuuacuuagggggcaaaugcuagaauugcuuuguuucagcaguuaauauuuaaaagauuuuaggaauaaauauugagguagcacugaaaaaaaguagccuacuugauacagccuuuuugaaagugagauguaauggguuacuggacuuccuucuuagacuugguugauguguauagcuccuuauaguucugccacucauaguaguagacaagacacuguaucuauaaucacaagcaauagcaauguuacuuagcuugaaccuagaaacuaucaaauugacuuuucuuucuuaaccauacuaauuuuauuauuuguauucauguuaauuuuauagaaauuccacuucuuuugaugguuguguuuuaccuuaaugauuuugauuaaaauauuucuguuuuuuucuuauaaaauaugccuauuguaagguuauucauucaaggcacucuuucucaugccuuuuguaaaaaugccuucagggauguaguucaucccaguauaccuggaucugguuuauuuauaaaaucuguuuauaggacuucuagcuucaagauaucuugaaauguacaugaggguuggaauuguugaacuuucuuucugauuucuuccuuaggaaagauauuagagaaaugucacuauguuuuuauauuucaauauuaaauugcaaauaagauuaaaaagauuuuccugugggcagagaucucaaccuuucuguucuuuuuaucugugaaauauuuaacauaguucuaagaauagaauuuacaugaaagauauuacagauguugauguauugaaucugauaggaagcuuaaaauugauuccuuuuguugcuucuuaccuaaagcagaaaguugauuuauuuuuaaggcaaacauuuuugauuaugaaguuugagcauaggccugugaauuauuuugguauuaggaaaguccugcauguuucuuucucuaacucucucucuacaacccaauacuguggauccacccagggccuaggcuagugcucuagcauugaacaguaucacuacucuucuugcucccuuauucuccucucuuccucccuuucccccucuuccauucuccuccucccucuccucuucccucucauccucccucucccccuccuuucucugucuucuuguggaugcguauaugugcauuuauauucaugcucagaucauuuuuuucuacuaggggguaucaauuuuaccuguaugucuuguuauguuugccuuugccaaauccgaaauucucuuuuuguauuuguaaugaguaaaugugugauaaauuuucauuuaaggaauuuuacagaauauuguguauguaauuuuuggugguucauggcugcaauuuuuucuuuuucuuuuuaauagacuguagcacuggccucaaacucagauccucuugccuccaccucccaaguaguuagauuacagguauacacuaccacguuugucuagcagugacuacugugauguaacuuauuuccauuuguauguuucacucucauauuuuuugcuugaguggugugauaucuacugugguaaaucauaucuguucuguuaguacaaaaugagugacucugcugcuuucacagaaaccucauugcagaucauauaggaaguaguucauuuagucuuugucuuacaguuuacaaauaaggaaauugagauuuaaaaaagaaccaaagugauuugauuggguucuggucuuuguugcugccaaaucuauauuagaauucaucuaaauuacaaugguguaccagcauaauggugcucuccuuuguccuggaucuacccaacaccuuuuugauuguguuguugaauguguuuagaauuuaccuucuauguguguuuguguaugugcagguauggauuuaguucagagguugaugcaggaucucuuccucuauugcucucuaccuuauuguuaggggcaggguuucuuccugaauuuguggcucacuaacagcaagauggucagcaaaucucagggaugcucugucuucaccucucucccucuggugcuagguuuacagauacucacugugcccagcuuuuuauguugaugcugggaaucugagcucaaguccuugugcuuuugagacaaguacuuugccuucuguuugaauuuucuuucuuuucuuuuucuuuuucuuuuucuuuuucuuuuucuuuuucuuuuucuuuuucuuuuucuuuccuucccuuuccccccccccccuuucuuucuucuuccuuucuuuuuucuucucuuuuccuccuccuccuccuccuccuuuugugguuuuucaagacaggguuuuuccguguggucauggcuguccuggaacucacucuguagaccaggcugaccucgaacucagagauccgccugccucugccucccgagugcugggauuaaaggcuugugucaucacugcccagcuugaauuauuuuccuguuuuagcuuucugugccaguaugauauagauaauucuguucuuaauuuguuuagucuccuugaauaacuacuaagcuaagcauuucuaggcaaugaguauguaacaggauaaguuuuugguguucuguuucaugacaguuuuuuaaguucauguuuuuugagugagagaaauggugauuuuuaaguauaagcacugaaaggguaaacucaucccaucucauagacacugcuuccucucaagcaguuggcaaauucuuuguaacauauacaaucuaguuugaucuaaagaucuuaggaaaaccacggacuguguauggguuacugcauacauuugugaaguuuauaaaacggcccaguguucaacuguuuugaauauagaaaaaaguuaguugaaauauuuagagccauauuauaccuuggccugaguauguucaggcccaauuuuuuuuagcaauguguuugucaaagggauaauaaaacuguucugcacucugugcacuuagcaauauguugagguaggagagaagacuguuuuguaccguggaugaaaaucuugugcuauaugugaucaucuuacauuaauuaauuaaaugaaacagaacuuaaguuauugcuugagguaacaugaauauuguccuggaccuuugaugacuuuuagauuggaagcauuguucuggccuuuuguguguguuuguguguguauguuauauagccauuuagucaaacugauugucuccaguauucucacuuaagggaaaugggcuauuuauagauuugaauucugaaauacaaaggacacuauuuuucuugauucuauaguucuuauuuuaugauguugauaaauauguggccaaauacuuauaaugcuaaccauaucagcauucuuugugucucaaauguuuugauaaaauuaccaaauuauaauuagaguuguuuuauuuacuuaaguuuuagagauagugucucucuuugaagccaaguucaccuugaacucauggagccuaggcuggcuucaaauuuggggaagcucuucucagcuucagcuucccugaacugaagugaaagugagccaucaccgugcuuugcugaaaacuuguuucuuuuuauuuuuugcaaagauucucuggaguccagagcugcagugggaauguguuuugaacuuauuucagaaguacauuaccaagugcauuguucaguaaggcagcagaaaaaaauucugcugaaacacuucacuguagugaaaccauuauuuuguucauucccaaaggugcuaacacuaguauucuauuucaaauauugauauuucuauguauagaugaaucuguuggcauauuuguauugugauugccacgaagguaauguuuuugagaaggcauuuguugucaaaauuaaccauuggcucugcaauacuagcuagguuuuuaaggccaagcuggacaauuacauuuucuuuuucaaauuaauuacuuuauuuuguauacaguauucugccuacauguaugccuucaaggcagaagaggguauggaugguuaugagcuaccaugugguugcugggaauugaacucaggaccucuggaagaacagcuagugcucuuaaccgcuaagccaucucuucagcacccucccccuuuuuaagauuuauuuauuuuauacauauacugucacugucuucagauacaccagaagacagcaucagaucccauuacagaugugguugcugggaauugaauuaagaaccucuggaagaacagucagugcucuuaaccagagccaucucuccagcugccacccauaacuacuuuuauaacuuucuggagagauguucacuuaagacacuuguauagaaaagugucagcagucucagcuuauggguucaguugcucuuauagucugacucaucaguuuugaaaguuggcacaaaaggucaucaagcuuugaguuucuggauuugguagcagcaguuuguguuuuucuggaucauucuauacacuacacacugaagaugguuuuacuuuacuugacaguugugugucaucacacauuugccuucuuaaugauucaaaaguaauauagauucucauaucugaagugauugagaaacuguuucuucacuccccaaaauguucuuauucacugaacacaaaaauguuugucaaagguuacuauaacuauuuuacagauaaagacuuaaauaugcauuuagaguggguucccuacucucugggauacuuagaacgccagacaacauucuuuguuuuaaaaaagagugaaagaaaucuugaggaauuucauggugugauagguuucugaguauuguguuauccuguauguaguaacgucuucauauuggcauuaauggaaccugguaacuuuuaaggagucauaucuuuucugugaugaaauauuuagauuuauacuuuguauguuacuucuacuaagucaguuuuguaagaacaccuaagagaauuuuucaauauauauagaucaccuauauuuuauuuuucuaucuauauuuuugccucuauuguuuguacuuauaguuaauaguuucuugaaaaugcauauuuauaaaguuugacacaauuccuuacagugcauauucagcaguucacguauauauuacugcugaaaauaguaaacuauuuucaauauguaauaagaauaaccccuaagagaagcuucuagacaaacaauuaauagaaauguugcuucuuagccuaaugaaaguggccuggcagcccuuuguuugugguaagguacaucuaaauaguuuuuauucagagcaugugcuguguuggucuugugggccaagucucaccuagagacaucucugucacugcucguagccuuccauacauagacugcuguuauucuuacuguuaugcuaagcuuuuacauagcugcauuagaaucaugaaguaaguuuauaaaauauacaggucucaggucuuauuauggaucuguuacuuuagcuuggaaauggagaagucuguauuuuguuaaacauguuccaauugauuuugaugagaugaacagucagauuucaaaacacaaacuaauuauauagauacuuuuuuuuuuuacauaaaagcauguggaaauaccuuaauaaacagaauaaaaaauguuuuuaacuuaacgcuagccuagauauucuaagauauaaguaauucuugaucuuuacaguugucauacuugggauccucuccaagguuuggaauucugcuuaugugacuauaacaguauuguuuuucuaaucuguuaauaugguuuagaauaauuuuuggauggucuuaaaacacugacuucuugucagaguaaaguuaacugcuuagagugugcuguucaaguugaggguagagaaggugaguugccaggagaggugaguaacugauuaauuaaucugccauuacuuuccuugccuuagaauuuugauuacaucuaaaggauauuagaauuuggguaguuuuacuaugcuauauuuauugguuuuugaauggcuauguaacuagcgucauuucaaaaauauguaucuaugacccugaugauucuguuugucaaaaauugaugacaauuaaugauugacuuucuggaguugcuacuugguuaccuuccagaauggauucuuuaaacuugagcuauuaaauuaugcuuuaguguagcauuauuucccuguauauuuggcuauaccagaacugugguauucacuguacauauguauaggucucucucuauauuauagcuacuucaggaacaaagauggaaguaagacucuugcccuuagaaaacauacuucuagggguccuauaaauaaauuucuuaaaguaauaucuaagcauuauguuugugugcaugcauacuuuccuggggauaaguccauagauuugucuugucuuuguggguuuuauuuauuuauuuauauuuauucauuuauuuuuauuuuuuugugucuuaguuaggguuuuacugcugugaacagacuccaugaccaaggcaacucauauaggacaacauuuaauuggggcuggcuuacagguucagagguucaguccauuaucaucaaugcuggaacauggcaguuuccaggcaagcaugguacaggaggaacugagaguucuacgucuucuucugaaggcugcuagaagacugguuucuaggcagcuaggaggaggaucuuaaagcucaugccuacagugacacacuuccuccaacaaggccacaccuacuucaauaaggcuacaccuugggccaagcauauucaaaucaucacauuuggugacaguguucugguauuuaagucuaggcuacccugaaaccuuccugccucagcuggcccagugguuggaucacaagugugcauuguuaugcccaauuuauuagcuuuuuuuuuuuuugguuuuucgagacaggguuucucuguauagcccuggcuguccuagaacucacuuugaagaccaggcuggccucgaacucagaaauccaccugccucugccucccaagugcuggaauuaaaggugugcgccaccaccucccgaccaacuuauuagcuuuaaaucauuuucaagcacauuaaauaauggucuaguacuauuccuaggcuuccaucauaagugucuauauagguaguaauauuguugccuggauauggaggauauaaaaaaguagaaauaaggaaaauaaaauaauuguuuuuauauuugguuaccuuccagaaugaauucuucagaucugagcuauuaaauaugcuuuaguuuagcauuucuuccuugugauauauauguuugccuguauaccaggcaaauguggcauucacuguacauauguauaggucucaauauucuagcuacuucaggagcaaagauggaaguaaauaagacucuugcccuuauucaguauugaauagguuguuuacuauuuuaaggaugcugucuaggaauuaaaaucuaacuuguaaaacagucaccucagucaauaaagggcugaggaccuaugaaaaugaaaaugcugaggguagagacagaaggaucucugggguucccuagccaacuagucuagccuaguaggugggcucugggucagugagggguagacagauaauccuuuaguuuucauguguguacacugaaaaaaauaguuagcuuaaaccuuuacagaugauaguauauaagccuucaauuuuauauaagccuucaauuuuguuauucuucugcuuuauccuucuaagugcugugaauauugcuacauauacccagaguggucaaggucauccccugcuguccaguuguacuucccagcuagucaccagucuggccuauuguuuguauuuuacuuuuaaagauuaaguaauuuucagacagggucucauuguauuuccuuaucugguauagaacuggcuauauagaccaggcugaccucucagagaucugccugucuuugccuuccaagugccggaauuaaaaguguaugacaccacaauccagccccauuguuuuuuauuuuuaagaauauaaugaugugaaaauuuaaauuugcuuauuuaaagcagcuguuaguauugauagucaaaaaaauguuaaaaccagaauauucuucuguuucccugccaccgucuuuguccauuugcgugcacgcgugugcguguguguguguguguguguguguguguguguguguguguguguauacauguuuaucaguauguacaucuauacccaagucaauuuucuguuaaauguagucuauuuugguuauuuuucugacuuccugagucagauuguaaucugagaaaauuaaaaugucaguguuuggauuccugauggccauacuaauaaaaacguuaggcaccuaguuacuaauaaauauauugauuauaucuacuuagcucucuucccacuauuuuaaaauuaauuuccacuuuugcuguuuuucggguauaauacaguagauuuaaguuuucuagauuuauauauucagaauagauuugaugaggugauugaaacagcauuggaacuuuggccuuuauaccaaagcaaggcuacauuuugaucuagacaaggcuguuuugguauauuuuccccacacucuuuucagauugaauuacugauucccccucccccuuguuuuguuuguugugguuuugauguuuuuuuuccuuucagcuaaaggagcagcccagugguuuucaagaagugccaaagugcacugacuaucucaugaugacuggugccucagggagggucaugauuccuggauacaggaucgaccugauccuggaugucacuucaagcagucauaucguggggaaaagccuugucuaauggcuagccuuccucaaaagucugaugcuagucaucucggaaggccucagagaaagccuuaaaggugagcagaguagaguguaguucucucuggggacugugccuuuuuguuggagaauaugauucaacauagaaugauaacccuaaccugacuuuucaggucuaagugguaaauuaaccugaagcuuaaaaauguguuguugaugaugaucagaccccaacuuuugaguuacuagagacuaucuucugagcuuaacagccaauauagggagagauuugguauuucccauauucuucagagauuuagcuuaauauguguuugucuaaaaggacaucuccuuucuauuguagcuaaaugauaccuugaugucaaaauugcauucaguuguuagcuacagauagaauuauaaaacuuaguucgugaaugaauaucaggcaguuaagcuucagagguugguuaggacaaguuuacauuugauuuuuuucuaucauaauguuuuguuuuguuuugugcuuuuuuuuuuuuuuuuuuuuaauaaacauaguuauugcugggcaugauggugcaugccuauaaaccccagcauuggggagggaggaggauuaccaguuugccuaugcuauauaguaugaucuugucuuaaaagaaaaaugaaaagcaaaccaaaugaaaagcaaaccaaaugaaaagcaaaacacacaguaguuaugaagcaguuccugucuuauugcauugaacuuggagaauauuaguauugccuccuugaucagcaucuauccucaccgcuacgauucuuaagagauguuuuguuuuaauuuuagauuacuuucucuguaaugugaagcacuuaaagaacccaguaauugguuaauaaccucaguuucugaguuuaaguuaacugaaagauauugagaacuacuaauuucuuuuuauugaauuacuuuuuacuggugauaaauuauaugggucauauaccgauccaagugcauguacauuuuaaaacuuaguauauauauauauauauauauauauauauauauauauauauauauauauauauacacauauauauguauauauguguuugugcauauauauauguauauauauauauauauauacacacacacauacauacauacacauaugcacauacauauauauauguguguguguguauaucaggacauacaauauagcccaguguaucaugcuuguagauaguuaggaggcccuggauucaauaucuuaucauuugggagaaaaaucaugugcuuuaucucuguguguauauguucugaaauuuguuuucuguacaacaugaacugugauauaccagagauuuguguucuauuuugcuuuuuguuacuuugaugaaaauacugacaccaacuuugggaguuuacuucauauuauaaguuaugugcaucauugaaagccagggcaggaaggagcucaagacaggaaccuggaggugagaauugaaacagagacugcagaggacugcaguucguuggcucacuucccuugacuugccucccuuggcuuaccuaacuauuuguccucugcaugacaggccugccuguccaggggugagacuuccaacaauuggccuggguccugccauaucaguuagcagucaagaaacugcccuuuagacaugcccacagaacagucugauagaggcaguucuucaaaugacauuccuuuuuccuucugugucaaacugauaauuaagaauagccuucauaguuuguaaacuuuuugagccugcauggugacaagaauacccacucuugaaaguuguucucugacugucauacauggaccuuggcacacacacaugcauauauaugcacacacacaugcaaaauguauaauuaaauguaaauuuaaaaaaagggauaacagacauuuucagguaacauggucuuuauuagaauuacugaauucagccgggcgugguagcgcacgccuuuaaucccagcacucgggaggcagaggcagguggauuucugaguucgaggccagccuggucuacagagugaguuccaggacagccagggcuauacagagaaacccugucuugaaaaaccaaaaaaaaaaaaagaauuacugaauucugcuguuguggaaaagaaccacucaaacaacauauuaaggaguaaauacugauauguuuaguacaguuuuguuuucagagcuagauugggcugcaguagacuuuggaccauaguuuggggaauccugaaauguccucuauuuuguacuccacugcuguagaccaugggcuguguuacuguauuagaugcuucucacaacagcuuuggagucgucuuuauccacacuauuacucuuuaaugcagugagcacaauaauacuaguagccagaauguacucaggucuuacugaauaaguaacuagaggacugcgcuguaguuuagguacuaguuuugaggaggugacucuuuaugugcuggacuugugagcucuuaauaggucauuuuaguuugagagcuuauauuaaguucaaaaauguuauuuuuuuacagucuuuccaggcaucgcucuuugcaaccccuacccuauuucuauuauuucuggcuaauagaaguuugaauugaacuuccauuuucauuuuuguuuuaaaugcauuuucuuuucugcuggcacaauggcacaugccuauaaucccaggacucugcagguagagucagacaggggaaucucugugaaguugaggcuaaccuggucugugagcuccaagcaugcuugcugggccuacgcugagacccuuuuuucucuucuaccacucuguccccacuguuugcuaauuccccuuucucuuacgcucguuauuguuguuugggggaauuuucuuuaacugacuuugaugaagggcugugugugugugugugugugugauguaugcauaugugcaguuuuuauuuuaacguguacuuguguggacaugcauguaguggcuagagguugauguucaagcgucuuccucucuugcauuccacuuuauuuuuugagacagggccucuaauggaaucuggagcucuaauucauuuggacuuccuguccagaaaaccacaggaaucugugucuaccuagcaguggacuauagguaugugcugcugugcuugacauuuuacuugggcucagaggcucucagguccucaugcuuguauggcaagcacuuuaccaacugagccauuuccucagcucuguguguguguacauuugaggagaaauuuuauaauagaauuaaucauuuugaggugaacaauauucuuuggaauuuuuguauauaaauauugaauguguauacauacauauuuuuugguacagugcugaguauugaacucugggacucacaugacuucuguagcaagcucuaccauugagcuacaacccaggcccauuucccuaucuucucuuuuuuaauagauuuauguuugguaccaaugaaauccauaaauucuaggauaagcaaauaacuuucucauacaaccagaugauuuuaguuugaauaucccugccuuuagguuuguuguucuuagaaauaauuaggaaaauucuaaagauugagauuauuagaaagcaaaaccuuagagaauugauguugagggucuuugcuugugauugauaauaugaaauccagaaagcagaagacccagcagaagggaggcaucuauugggaaggaggaaauaagucuguaaggacuaaguacaacuuacuccuccuugucucugauuuguguucgauaaaagaccuaacuaagauaguauuguauuugagagauaaacuuuaagaaauguugaagacauuaaauucucuuuugaaaaaauuuuaucuuuauuaucuaagcaaaucugagaaacugggacuggagauacuagcuuucuguuuagaguuacauaagcacuuccauuaguuuuauaaggacauauaaguucgugcccuuccuauaguagcauaguaccuugauugcuuuuugagacagggucucauguagcguagauuggaucuccugccucuacuuuccaaguguugggauuacaggugugugccacuugcuaccauacaggguugguuucucuuugaaugcauauuuucuccaguaaacaaguugacaaauuaaccaaccucuaguucagagguccucaaacugggguuauauaucagauauccugcauaucagauaaucacauuauaaucauaacaguaggaaaauuagaguuaugaaguagcaacaaaauaauuuuaugguugggggucagcacaguaugaggaacuguauuaagggguugcagcauuaggaaaguugagaaucacugcucuaguucaaucuuggcaggcuuuuaaaaauugguuuacuugucuaguuggaaagcaguaacaacaaaaauagagagacuuguauuuuaaagacaggucuaauuggguaguagucccugaaguagagggccuugcuccauccugugcuggacuccauugcuucucuuaggugaauaguugaugacaaaugggcuuuuacaaaacauccugcaaccaggguuuggcuuucaagaaaagcagcagacuaggagagugagaggcuucuuuauuuacauggcuacuccagacuuacacaggacagccccuaucaucauucaccaaguagaacuugacaacuuaaccaauaucugguuacauugagauuggggcuuggagaauugucuaguagaagugggaaggagagguugauuagacuuggaagaaucuggacugaaaggaauauaaagaaauuauacuuuaaaaacuugaguguuucuuuguuuuuuuuuuuuuuuuguguaauggcguguucaaagcuuacauuuuugucccaggcuuagauuuaggucagguuucucaugcuuaacaaaugacuauacuccuggguuuaggggugauucuuguuauuguauuugugucuguaugucauaaccccuccucuuugucaauagacagaauuaggauuuuuuuaaaucugaaagagaagauagauuauguauucauauuuauaucaacuucaaauuuaaguuauuuaaaaugcacuguucaaaguguuguuaaaaacccaaguuuugaaucguggcucugcaucuaauuagagauuuaaguguauucucucuuguuacaagguuuaguguucuuuagaaugaguauaauaaugacaucuuaagguuacuuggauuuuuaguuguucccacuaucacugaacaaagaugagacauuuaaaucuuaacagggguauaaaaguugucuuuugagguaaucuguguaccuuuagacgaguggguuaaagguggcauguagcaguuuauuuagucagaaaugccuggguaagggaccauggucugcauuauuuaaaacccagagaacauaggauucuguuuuucuaagucuugaaaauuuccaacuuuuucaaauugcuuuaucuaacauaggggcuuuaaauuuggauuuaaacuuggacucaggauugcuaaauccuacaagagacuuuacagacauucugauugugagggaacucaguuggggaaggaaugccuuuuaguauuuuguuauucucauccauuauuaguguuuauuucucauauuuucaacaucuuuaauuucucagcaguguuuauaguagucaguaugugagcuuggcaaaccugcugugaauuaguguuuuacaagucuaguaccucuaucuguaucugguuacaccaggccagugcauacucucccaaaaguagaugguaacuuagugguaccuccgcugaauauuugcuuuagaguaauaccucaaaaugaugagaauguaaauucuguuuuaaguuuaugauuuuuaacagaacuauuuugcugagcuuaacuggagaggggauaauaaaaguaaacuucccuuccuguucugucuccuuuccgcagagguuuagauuugcauuuccaguuguuuguucuaaaaagaagguuaaaaaccuuuuuauugucgaaauuuucaaauagguacagacuuaaguaaagugauggacauugagaaucuuuguucaguuucuguaauuagcuguauuuugcuguacaguuuucagcuuauuccacacagcuauuuaagucagagccccuagcuuuaagucuuacagaaacuuaacauaaaauugcuuuccuaauucuuagaaagaagacaaaacaaaacccaggugcaguaguguaugcuuguaaacuuaguacucuauuguaaaggccagagaggauugcaaccuggucuauagagggaaaggggaucugaaaaaaauuggccauaucauuaccuggaucaaugaacauguaccagacaguguaaauaaauccagguuaaacccccaaguuucugagguuaaauucaaagcuuuuaagugguauuuuaacuguuuuaguaacuaugaaaaauuauuugaguaaucgaaaaauuauuucaagcuaacuuaaaaguuaagcauuauuuugacuuauaguuugcauuucaaguaaagcaaauaugaaacuauucuaaaauuaauccauuagaaaauacuaagcaaauacuaauagucuuuaaaauaucauuucuggauguacuuaaacuauaagguguuuuaaaagucaagauaacuacauacugugcuuaaauuuuaauggccaaaaggaguuuagaaaagcuuuagaccaguuugucuacuggucuaugaguauggcacagggagugcaccuguggaacgcagaggcuaacugaagagucaguucuuuccuuuaccuuuucguguguucugguggucaggcuagugaggacaagcucucacugcucagucaucuuacugcccagggaauuuuuuaugugugcucaaucuuaaguuuggggaagcaaagaaacauacuaaauuguugcuauuccuuagacucuuaaguaauagguaauagauuuguaaagagaguuaaauaaaacaggcaaucugauggaaugacauuuacuauauaaguucaguaaauggagaaaucuuagccaacaaugauuuuuggcuggcuaaaaaugauauauaaagcuuuugacauugguuuucuuuaccuguaugcuuuaaauuagcuuucugacuuaauaguuuaugauuuauuccagguuaaauguuuuauuuauauucugaauaguuuggauauaguuaacaaaauauuuauuuaucauauguuaaguacauuguagcugucuucagacacaucagaagaggacaucagauccuuuuauggaugguugugagccaacauguaguugcugggauuugaacucaggaccuucagaagaacagucagugcucuuaaccacugagccaucaauccagcccccauaguuguacucuuaagaguugauaauguugcacaucuuuugagaaacauguucugauuuguguugaugggagauguuuaaaacuuagaucauaguuuaagucauaauucauauaguaugguuuugaauauguuaaccucucauuuguagagguaacacuaaaguuguaggacacaauaccaggcuguauaucauuccuuuguuuuugaugucuaucagguucuuaccuuuaguaauccuuagucugcuuccucuuuucuuuuuccauugccacuaguuauuuagugccgcagcucuuacuccugccugcuugccuuccugcuuucccaccuuucucucucccuccauuccuuccuccuuccuuccuucccacccucccucccucccuuccccccucucuuccuuuuuccuucauugagagaucucaggccuaacauaugcuagacaaguguuugugcauucugucuacaacaaaccauuuguuuauuuuuauuuuucaacuguguaugacugugugguuaugugcacaugaguacagguaccugaggaggccagaagaagguauuggauccccugcacuagaguuaugggugguuaugagcugcaugauauggguguugggaacugauuucaggucuuuuagaugaucagugaguacucuuuuaacagcuuagcuauaugucuggcccucuuuuucuucuuuuaaauuuuauuuaguuuuuguaugaaugaauacacaugagugccauggugcacgugcagagguuguuuuggaaaucaggcuugguggcaagcaucuuuacuagcacucuugcugucuugguucuuuucaugacuaccuuuaaucugccacauguggcagaaugucucuaaaauaugccauuuguguauaucauucugcucacacuauuucauugcuuucaguuguucaguagaguccucagugcuuucacagcuuagcuagucacauuauuaauccuuucauuuucauugagucauauuuauugaacaacucauugucuagauacaccagagucuaagauagaauggauggcaaagugaaccggaguccugcuuuugggguacuggagaagauagcaauuuuaaaaaauaauuagguagaugaaaguaaacuugcauucaccacuuauucucucaaaauggagggauaugaagugauaucuagcucaggcuuugagguacugggcuccaccucuaguacuguaaacaaauuaggguagaguagggaggaaugugcuaucaggucuuauaguaacuauauuagaucuagucagaggucauggguuguaauaugugaagagaagccagugugguggcucagcucugcaguuccagggcuugaagcugagguaggacuccugugccagcuuaggcugcagaaugaggcuuugucuaagagaagaccagaagagaguaagguuuauuauauagaauauauaaaugaagaucauaucaggcaggggaguccuuuucucuaaaggguuuguuuugagaaugaggaacugaaacaaggcuaauggcacuuggagcauugacaaaaaaggggauuauaguauaugguggaaaagaaguuugggccucauugugcaaggagcuugaaccaugcuaaguaaugauggugcuaauacagaagaaucaggagcuggcaauguagcucaggguuugagagccugccuagcaggaacaagacaggcagaugucauucagaguucugugcagugguaaggaaagaagagaagacgacaaguaaguguugaaagaccagguaggugcugcuguuaauuuuagcaauuuucucaaguaggugguaugguaguaaaagagauaauaaaccccacauuuuaaagaaauauuuaggaaguuaaauuaguaaaauucacugucauaaauuguauuuaaggcuuaaggggcaguaaaauggcuucuaaagaacuguguagaugaugauaaugaugccauucauuuccuggccuagugaauguuggaaaacuuacagaagaagagaaaucaugacuuuagaaugcuuagguuucaagguaucuuggaaucauuuaggaaugaaugucagauagagaauuugguauucagaggagagaauuuggcugggcauauucaaguggaauauuaucuaaauuuagauaguaauucaaccugugaguagguuaguuugggccaaguauaaacuggcaagggccucugauuauuaagcccuacagaucuuuaacauuuuaaaguuuugauauuugggauugagguugagcugaggcuagaagauaucucuagauuucaugaugccuguaguuaucaauugaugcauaacauaccauuuugaaacuuacuggcuuaaaacaauuuauuauuucuuuggaguauauggcugagguaccugguuucucuccuggagcuucuuugucuucaucauucagcaaucugguucaaauuucuuuacaugguuugcauuuuccacaaaggaggaauaagccucuuuagacuuaaucagacucaguucagaauauuuuggcuauacuauagcaguugaggaagaauggauaagaauuagugccguuuggguaaguggagugggagaugaagacaaguaccuauuauuuuuuuauauuuucuuuaagcuugaccugaauuguucugugauuucccugaaaguuaagcuguuucuuuguccccuuacuaaaauuguaaccauuuauuuguaagcaacuagcugaagucuacuuggggguuaugguaaauauuugcuuuuauucuuucuccuuucuccauccccucuuccucuuccuuccccucuuccucacuuuugucucuuuuucuucuugguuuccuuucuuuucucuauggcucugcuucuuuuggagggaaggugcuacuccauaacccaggcugaucuggaaaugaugguaacccuccaccuuuagccuuuugcccagguuauagguuugaguggcuaugccagccaggcuuaaagagguucuuaaagucuuuccuaucuguucugaaguuuaguuuucagucuuaaguguguguguuuguagggggcuguuguuccuccucugucuuuacuccaucaauuccccagucuccaugcaguuguaagccuuagcaaagcuuuucaguucuuuacucuugccuggggugccuuuccucauuuccccuagguauuauucuguacuacugcuguaacaugcugcaguuacuuacuuaagugaucuugaagguaaaaaaauauaauguguaacauguuaccuuucauuaaauaacccgagucacaacuugauuuaugaucuauucuguucuaaaaaggucucacuugauaacauuuagaccuaauuacaucuuugaugcucugccaggccuauggguacuaggccgcagcagaaacuacaaaaaaaaaauuaggguuugcuuuguuagguaaaacauuacaacaaaugauaaauggucuuuguauaccucaauaaagugagaauuuaagagguuguauuuugaguggucuuaaaaggaauuaugcccaauauaaguaaauuuucauugugaguacuaaacaggauaaaauugguuuugugucaucugcacagggaauauuuuaucuacccuaucuguguucuaggaguugggcagcuuuuguagcuuauuacuuuauccucugugucuggauacacauaaaagugcuauuuggagagauagguauguacacagaguagaguuuucauguauuuauggagaugggacuccuugguuucaugagcuaucgaauuguuuuuuaaaacucuguuuuccaugacuggcagggaaccuacuaugaagaucaggaugaccuugaauucacagauaaucugccugccuucugaguagugagauuaaagacaguuaccaccaugcccagcucccucacacuuacuuuauaaaaacuguuuaugucucuguguguguaucugguguugagauggaggacgcguucacugaaaggugcuugcacuccggcuuaccacucucauuauuuucuucaguuucauuuuggagaugaaagaaaagaaucagauugucuuuucuucccucacuaaacuaguaagauaggcagcuaaguaacaggccauuaaagcucagaugggaaguacuguccugaaaggacuugcaguuacuuuaguaauagagcugguuagcagagcaugccgagaaguguagugucccaaguguuagugcagacaaugguguguuuucagcugggaaccauugagguuacaacugagaaaggucuaccuagaugccagacuuagagauugcuggaaaacaauuucccuuuuauuguuuucuggcuucuguuuauuucuuacauuuugcaauuuaaaauguagauaauguguaaaaauaaugguuguuugagauuuuauacauuuuccuuagaaacugaaacagcuaaaaauaucuucaccauauggcagcugacaccauucagaacucuaguugcagggaaucugacauacucuucugaucugcaggcacacacaguacacacgcuuuuauguguaagucaaacaaucauguacaguaauaauauaaaauaaaucuuaaaauaaucaaaucaauuuaaaaacuguuaucucuaccuuugcuuauuuggcuuuuaauaucuuuauauauaccugucccucaaacaaacagucaggcagacagauagaacuuuuaguucaauuuuagcaagaucacagacaaauagaaucugagccauuaucaaauaagacccugaagaaugggagauaagccaguaaggugcuugcuauauaagccuggggacuugcauuuugggacagcaacaagucuguaacuugaggacuuugguuacuuuucccauaagugacuggccagucacuccaggcaaaaccuuuugucuccauguucagcaagagacugaccaaugaagcuaugaaacauuaacuucuaccacacacaauugauaaucaaauaggcuccugcacuuuaauaaagacuagguuugagcaaguaauaugauaaguugucaucagcuugcucugccaguuguuucuuaacaauguuugaaaguuuaguuuuuguuuuuguuuuuguuuuuuguuuuuugagacaggguuucucuguauagcccuagcuguccuggaacucacuuuguagaccagaaauccgccugccucugccucccaauugcugggauuaaaggugugcgucaccaccaccuggcgaaaguuuaguuuuuuuaagaacucaaggagucccagggaaaggagaaggggaguaagggagacagcuuuccuuacuucagaaugaggcuggauuugcuuuuguauuggccaccaaaagaacaauguauuuggauugaugcuguuacuuguuuauaguaacaauauagaaaaccucacuuguacccaaguuaaacuguagguauaaguaguaauuuccuuugcguauuuagacugacacuuugacaaguauugugaagaccaauaauaagguuaugggaaaaguaauuaagucaugugauuucuccaauuuucaaaguuuacaauccauuuuugacuuucuaaauuuaauuguauagcagggguuguuugagggcauucuacaaacugaugguucugaauauauaaucucauuacaucuuaucuuucucugcaaguauaguaauaauaguuuuuuuuauccccauuuacuuguuauaaauauauggaaaucuuguaaacuagugcucaaaagugccauuauuaucguucauuuuuaaucauuguuucuacccaugcuuugagaauuagaaggggaaagaaagggaagaaacacuguugcuguuuccuguuagcugcaaggguaacugggaagaguagaggauaaguguacagcagugacccugacaugcucagaagaggacuguaggcacaguaggugguguauagucacuagcaugacucagaaauaugcacauguuaagauaguuauuuuuaugaaguuuuaagcuuuuuccucauuugauaaaguuagguuuuuuaauaguaauguuuuaauauuuggauuuuuaaaagaagucuguguguguucuuuuaauaauaguuagguuuuaugauccaguguuaaaagucauagaaucaggaagcagacuaaccuggacuuuauuucugucuccucacuuacucugugucucuuccaacaagcuacuaaagugcuucuauacuuuaaaucuuuaaguggggauuauauuggucauuguuuuauuugugcuuuauggcuuacgugaauauuauauguggguuuagaacaauguguagcaucuaauaguaacuacugcaaagguagcauuguuauucauggcuguuauuuauugguagggccuaacucauguaaauuauguauacauuuuaccauugaauuacaucucuagccugguggcuggguuuaguuuaguuuuguuuuguuuuuuugagauguagggucucacuauguagcucuaauugcccugagaugcuuaaguuugaauauucuuauacuaaaauuucucaagauuagauaauaucucuuacaaaaauaguuuuuaucaaauguucaaauauagaaauccugcuaaauaccaugaaagcuugcugguacuaugauuuuucaguuuuuucuuucuguuagcuuaauuuuaaguacaucuaugaaagaaauuccuaaaauauuaugacucccuuccucgcacaccaagcuuucuuaaugcugggaccauauuuuacuguucaucuuuaaaucacccaaaccuaaaguuucacuggcagcucuaugcugcagggaagguuaguacguuucacacacuuuuuuuuuuuuuuaaaaagauguauuuauuuauuuuuaugugaguccacuguagcugucuucacacacaccagaagagggcaucagaucucauuacagauaguugugugggaauugaauucaggaccuucagaagggcagucagugcucuuaacugcugagccaucucuccagcccccuugcacauacuuuuagguagaugaucaaauagaaaucuuuuggaucuuaauagauguaugaccuugggguuaguuaucuaaucuacuuuguauuucuuugaagaacaugugaaguuuuguuuuugguuuuguuuaaaauaaucagauuauuuuuaaaaaaucuggauaacuaccuaaacacuugguugguuuauacaguuaccucaguauguugcagcauuuccaaguauuuuggauaagaauaaggaauauagguauuuuugccauauuuacuuuguuguauucuuuagcauaugggagagacuccugcagaccuguguauucuuucuucucuuacauaaugucauuuuugugccucuuguucaguuucuggucaguuuuguccuucacuucauauauauaugcugggcauacaggaaaugauacuuguuugcuuuaccccuauauagagaugguguucuguucaaaucauuuccauuuugccuuuauguuuuuaauugaagaauacacuuaauugcauguacagccaucuaacagaaaaguggccauguucagauuaguuaggucauggaauuucuaaaaaauaaucaaacuguacacucauguguuuauuuuacauaguaguauauuauaaaagguacuauuguagagaucucuucauguuggaucuuugagauuuagauuacucuuuuuaacuggaauaaaugaacgauagaccaguuuguauauuaauuauagguggguuuucaauuuucauguuucagauaauaucauuguauaaguuugugguaauuggaccuagggucucaugaaugcuaaauacugauuauacauucuaaaacucuuuguuuaaacuuuuuguaaagaagagagugccucuaggugguggcauucucugcuuaucuucaacagugccaaaugacauccgcauccuccagauggccacauauuuacccacuccccagcagugugggguguucucacugcuuuguacucauacuauuuaugcucauuuuaucgauauaaaauagcauuccuugauauuucaauuuguauuaucugguaacuaauguacuugauccucuugccacaugaugcagaccacaugaauuucuucaugaguauuuuuccauuuuuaaauuuuagaauguauccauaucuauugcauauuuuuaugaugaucaguuuuguguuuuucuugacuuauuugcaguugcuuuuaauucucaaacucaugaagguucuucuccuuugugacuaauguuaacuaggacuuuagcuauuuuagguugaauaaugcagucuucucagaauuuuuuuuuuaaccuguucuugccugccagccauuucuguuccucacuuuacucaaacauuccuaucuccugggagaugaaaugcugaugauacuaagggaaaagaauaaauaagaaaugcagcaaaaaaacgaauaaaaaagggacaguucuauaaaauugaaauaaccauguuuaaaauacuugaaaauauucucaagagccugucuuuuuuucuuauuuagaaguacauuuuaaacuuugugcaaccaaagaccgauuguuuaauguugucauugcugcaggaauuuaucauuacaugaugaguuguguaugugagguuuccagcagagccucugaaugcuuaaagugguucugugccuuucuuaagagcacaaaaauaacaauuaaaaaacgucuucagccagucucuuugagucauuuaaaaguaaaucuguuuauuuacuucuuaucuauaugcugugugugaaaucucacaccaagguuucugaaauuaaauuggguucuuuugucaauucuaccuugauuuaaaacucaaguuucuuuacuaacuuaauaauuccuuacuuuuaaauuuucuauucuagaaagugcgcuucuugugaaauuguacuuauuuaaagacuuguacaaguagacuguacuuuaagacuauacuagggauaauuaucugucaagguuuuuguuuuucuuaagauuuguucuuuuaaauuuuuuaaaaaaaaauuuguuuguauagcucuuuugccugaguguaacucuguguucuuuguacaugacuguacaugccuagugaccuuaacgucagaagaaucugagaaacuugaguugcaagcaguugugaauuuccauaggggugcugggaagcaaaucuagaucuucugaaagagcaaucagugcuuuuaaacucugagccaucucuagccuccuuaagauuuauuuuuguuuuuaugggagugugguauguguaguaguauaugcccaaagaggccagagauguuggauccccugagacuagaauuagaaguuguuguaaguaaccccugauaugaaguguggguuuucugccagaguagucuaugcuuguaacuguugagccauuuauaguaauucaaauuucaucuuucaacuuaagaucuuuauaguaaaauaguaugugcuauuagauauauuugaagcuuuuauuugugaaacuuguuuuuggaugugauaagagagugugguuuugauguguuuuuaaaguugcuuuaagaaguaguguguguggcuagagaaaugacucaagguuaaaguucacucuugcagagaaccgagauggguucccagcgcccaucuguaacuccaguucuagaggaucugaugccuuuccaggcugugaugggcgccaguguacaugugguauacagaccauacauacgaccaaacaccccauacauagacaacaauaagauaauccuugugaaaaacuuacuuauuuuuccccauuacuuucagcuucauuuaccucugaauucgccguugccuggaagugaauugaccaaggaaccuuuucguugggaucagagacuauuugcuuuagugcugcgguugccuggcaccaugucgguggaaucagaacaguugacaggugugccuuuggaugauucugcuaucacaccaaugugugaagugacaggagguaagguuuuugcuaaaaguaacucaggcuuaaaacaguuuaucugaaugugcuaaaaugaacaucucacaauuugcauguuuauguuugucaaacaacauugacauuccuguaguuuuaaaauugcauguguuaauguugggaugcaaucuugauaaauacuguuggauuucaugaauguuagguuuuuguuuuuaaccuacguaacaaaugaugguauuugaaguuguuagacgaacuuuccugucuacaaaaaaaucauuagugauuuugcuggcauagugacauacaccuuuaguccuaauacugaagagucagagguaauaugaaguaaaauugucaaagauuuuuacagaaauuagaaaaaaaugaauuaauaaauuauuuuacaaaaaaauuaccauuaaucuaaaauuaucugaaaagaaaaagcaauuuuuuucuauacuuuacaaacugagcuauguaauguuccuccuaugauuauuguuuaggucuaaucucauccguuguaauguuugauaauuucuaccaaagcauuaaaaaucuacaaugggucauuuuaacugggagaacgaaguauguauaauauugcacacuuucaagucaagagguuggcuuauucucagcuauuuagagacacaugcaugcauacauuagauagaccacacucuauaacagaccuagggucaucacuaacaccuggguggaacagugaagaaucacaaacuuuuugaguugggacaaaguuaaauuuauuuaaucuagaaaaaucuguaagcaaguuuucauaaaauaccuguuuguuuugaguaggauguauguuggaugcuuuuacuacgcuuucauccccaaaguaccgucugguguguauuauugaccagagcccuguagcuccuuucuccaauucaggacaaaugaagcaugugggaaucacccuugguucuucugugcaucagagcaucucuuaccaucuccagaucugacagacgagacacacuaaaguauuaaugguucuaacugguccuuuuccacuguacaauacucaugucucauugaaugucucacugaaaagcugauccauaagaaacagaaaccugaucucaaggcuuauaaaauggcuuuccauauuugacaaauaaaccauacguauuaaggccuggaagacacuuaaucaauauuaggucccugccugucucuaucuaaaucuauccgucuuccacauguaagcucacagcagugcuuucacaugcauccauauguccuuuucucccugacccuuucucuuuccagagcuucuuguggauaauucuauuuuucagguuccugauucaagugucaccaccucagaagaaacuuaccaaaauauacucacucucaaccuuauuacuaccaucuauauauuaaaauaaauggaaauaauuaaaaaucugugguaacugccaggagaccaguugaauaauuauucucuccucugcacuuguacuuaucaucuuuuauuuuguucagcaagucugagaguuugaggaguuauugcuagauguguguauguaugucuguuaaagauuggcaaacaguuggagauaguagugccuuauaaagguggauagauacuugauauuuuuuccuuugugauuugcucaaccaggguuucuaugguccauuuaccuuaccuauacuuagaagaagaaaauuguauacucaccuacgaugagauuguugguuggaaauaauaauuuuuguuuauucuucguuaaaauugggaaauaccgaccacuuaguuucuauuaauauugucauuaaaaaaaaaaaaaaaacuauaguaguccuuaugggaguuugacuuuuuacaacuaauuaguucauucuuuuuaucucaggccggucauacucuguauguucuccaagaaugcuuaaucagugucuggaauccuuggugcagaaaguacaaaguggggugguaauaaacuuugaaaaggcaggaccagauccucccccugcugaagguauuguauuguccucauagauauucugaguuugauuuaugaauuauugaccccuaucccacccccauuguguguuguuuauauguguguugguccaagcauuugggagguagaucucuaacuugaggccagcaagaccggcaggacuacauagagauccuagcucaaaauaaaauuuaaagauuaacaaggccaguugucaugguuacacaauugcuauugguauagaagaggaaguuauaggaauauuauauucaaauugaacaaauuuuuacuagcuagugaacugcaguuugucuaacaaagcagucaugacacucuccaacuuaagaaacaggaaagcccauaaucuacaagcauuaggcuuuuuuuauuguugaguaaaaaaaauggauguguuuuaauuuuguuugccccccuaauguauuuuuuuucuuaaccucuuugcagcagaggggcagccagauauaucaagaccuuuuggaucucagccuuggcauagcugucacaagcucauauaugucagaccaaauccuaaaacugggguuccuauaggccauuggccuguuccagagucuuuuuggccagaucagaauucuccaacacuaguaaguaccggaguaaccaugaccaguuacuaauaaccauuuagaugauuuuguuugauggagcuccuugacuuugagagaagguccugcucugcaguucaggcuuuguugaacuguauagcacaagcuggcuugaagcaugaagugauauuaaguccaauuguuauuuaaagguguggcucauuuacagaaauuagauaaauacauaauaugcuuauaauaagccauuauuuuauagaaauuagauaaauauauaauaugcuuaucauaauaagccauuauuugcuucuacauauggucuuaugaagcaacagaaaaaaagauaucuuguuucccuuggaauuuaauacuagguuaccuuuuuguuacuuacauuuggauacugaauuguaaauguaugaagauuucuuuauuuuaauuuuaaauguaauguagcaugaauauuugucuuugggguacaaauugaaauuuauaugaaggacuagaauacuugugauaauuuguauuucaguaacuauuauuuggggguuucuacuccaccuuaaaucauuuaguucccaaauaaaagacacaaaauccuuauauuuauaauaagcuuuaaagaaauaaauaucagcccucuaugcuauuuugucuacuucccugucuguaacccugagauaucacuuuccauguucauguugggcugcuccugcuccaacaggcuggcccucaugccaugugcuuaugauccaccuacuccauggcaauuucuuccuuccuccuccucucucuugucuuugcuccuaacugagacccccaagccuggggacauucugcccagcccagguuguaggcaucuuuauuaaccaauuauggauaccuuggggaguugggggcaggggcacaaggguuacgugacaaaagcugguaugcaggaggcuccgccugucuuggagcaacaagcagcaccagaccaaccgccuacaaguuggccugcagucuuucaggccauagucuuagaaauucauguucacuuguacaacuuuagaacaacuuuauuaguuaauaguauugcagcuuggaaguugagcuuguggggauuuuucucauuuuacccacaugaauuguuuuuaugaauauugaugguuguugagugaucaugguacguuauaaguauucuuuauaguagaauacaauuaaacaaaaucauaucuauucagacuuguuuaaucuguuuuuuucugauuaauguuuuuguagcgucuagggcaugacacuuauuauuaauauuacucuuagaagguagguuuuuggggcuggagaaauggcucagugguuaagagcacuaaaugcucuuccaaagguccugaguucaauucccagcaaccaugugguggcucacuuaucuguaaugagauccgaugcuuuuuucuggugucuggaaacagcgacaguguauucacauauaaaaguaaaucuuaaaauaaauaaguaaauaaauauuuuuaaagguagguucuaguucagagauuuugagcaaguaacuauuauucauguuaaaauaagccacuuguacuuuuuuuuaaacuauauguuugacuuucaugauaaguuuuaauuugagagaugaacuucaagucuauggcuacuaauaaggucuuucuccacaguauaguagcacauaguauaguacaugaaaguaaaaguuaaaaguuucauuguauuacuuuguuuaaucuuuuuucuuuuucugauuaaauguauauaauuuuugauuugcguuuaugaacaagcuuuucauuucuuuggugauauuuauuucuuuuuuccuuuuuaaaauucuucccauauuuuuaugaaguaucuuuguugauuauucaugccauuguauugacauugauaccaaagguaucuaugguauuuuauggaaagugagaaaaaauauggaaauaaaaaagaauaaaguguauuuagagaauggaagauguagcuagacugcuguuaaguaaacggaacuagacuacuguuaaaaaccaaauuguuugcaguuuuaaaugcaaaauuuagggaaugugaguuguuccucuucccauucagagugcauuugaagucaguuuuaaugaaucuccacuuuaggaaaguaacuuagugcacauuagaaggauguaaguuggaagggcagguaggcuaccugcagggcuaguaauaugguucauuuaagagauacuaaaauguuuuuccuagaauauggaucagaaugaucauaagaaauaguacuggauauaacuuuaaaauuuauuaauucaagucuauccaggggaaugacauuucuacaaauucuaauuuucauauaaguagcuccugaaguuaaaaagugauuuuccuauuaacugugagccuguugaccauggcucuugucuuccaaaauuguuuggagacuuaaauagaaauacauuuaagaauuuucuuuaccuaaauauauagaagauuuucuucccagaaaaggaaaaaaggaaauuuuaagacuggccuggaagaugguaaacaaacuauuaaaauauuuuacacacacacauaccccacacuccaaauauauuuaaauaaaaugcagcuaguacaucuugaacauuaccagucuauugccagauucucagacauacauauugcagagcacaguuggcuaacuguaauggaaggcagggugcagguaaugucaggaaauaggacuuaacugcuugguguacguuuugagucuauauauugggaagggguacuagaaaagucucccugaguuuaguuccuagcaagucacucguuuucuaaaaguuuuuaguuauaaaagagaaaauacugaaguagucaguaagauccaggggcaggaaagaugaugacguauuaguacaacugcacauggguagcauagcugaaacauagagucuuuauaggacaugagugaggaaugccuuagagaccaaagcagugaggcuuuuauuugaaauuaaaggugugaacccuucuugccuugugauuggcccaacuuuaacugcauacguuuaaauagggaacuacaugaaaugacaauaggauuauuggaguagaguaacuaguaggaauacuaguuagaaagcaguuguguguagucuuaacuugagaaacagcaaagaucugaguuaaaaugguaagaaauauuaguuucugaaauuggggauugauuucauuaauauugucagaaagaaagccgcaacagccaguacugagcaugugucccaucauguguucuaguaagugccuuccaguugcacugugguuucauuaagucuuugauaguuaagauggugaggucuuuagaagagaacuugaagacuggagacagauuagauacaauguaugugaaggcugaauaagagucagauuauguccaguaggcagcuguagacaugagagaaaugagauaguuuugauccuuaaaguguuguguuuuuauggcucuagaacaggaaucuuuaaaauaaaguguuagguaccuuaggaauauaccaguggaauaaccagccauaggaauccauugggaaauagagaaaaggcuaacuuauaaauacaguuuaugucuuuuauuagguauacauugauuauuuauauuuuuauacccacaguuuguaaauagugucugaauauugccugugcagaaauuaauaaaggacugugauuagcuuggaaguuacuacucuauaaguaauugccacaaaugagguuuagugggcuuuuguacaucuuucuuagauaugaaaauaaaaauuccuuuuaauuauaaauuaguugaaugcuuuuuuuucuaaaauuugcaucuaauuaaugauacauuugauuuuagauagauuuucauuuuauggauuuugaucuuucucuuuuucuugguaauauuccauaaauguuuguuuuuucagcuuaaugguauuuccaggaaaccaaacuuacuaaaaagacugaggcauuaagcuuugauaagagaaagguacuuaaaauguguugauaaaauguguucugguauuuuguguaaauaguaauaagauuuuccccucuagccaccucguacaucucauccuguagugaaguuuuccuguacagacugugagccaaugguuauugacaaauugccuuuugacaaauaugaguuggaaccuucaccacugacucaguuuauucuagaaaggaaaucuccucaaacguguuggcagguaagcugaaaaacuguagugaagaaaacauuuaggcaauguuucugacagagcuaaacuggggacuagagagaugggucagucaauaauguguuugcuguaagagcacacaaaccugauaauacaaauuuuggauaccuagcaccuguguaaaaagccagcuacaauagccuaucucuguguugggaaggauauaggaggaccuugggauucauuggcuagauagucuggcugaaauggugaacucuagguucagaaagagacugugucaacagaacaaaacagagaacaauugaggaagauacucagugucaacuucugccuuccacacacaccugcauguacaugcaugugcauauacacacaagcgaaacugaaucuauguuuugcauaucauucauugcagguuuauugaauaugaguuuuaaccuuccuuuucuacagguguaugugagcaauagugcaaaguauaaugaacuuggccaucccuuugguuacuugaaagcuaguacagcacugaccugugucaacuuauuugugaugccuuacaauuacccaguccuccuuccucuauuagguaagucauucuugcaugugcucuuauggaaagcuaagaaauaaaccuaucuuagcucuaaaaauugagaauguuaaaccuacuguaaaauucuuauauuuuacaaacagagauacuacuauauuuaaauuuuaaaauuaaauauucuaacuuuguacaaguaaguuuccuuacucagugguacuuucugggguagccuuucugucuaaugcauaaaagaugcucuauucauaaaaaaccugaauacauguucuaagaauuuaccuaacucuucauuugaaaaacaauuuugugugaguauguacauguuaaagcaacagcucauucucagacauuguucuuaagaagcuauucacucagugguuguccaguuguuuaaauuuaugugagagcauguguuuaugugaucaugugcucauaugugccauggugcauguucggugguuaaagcgucacuugugagagucguucuugccuucuacugugugggaauccggagaaugaacuuaggcucagguugucaggcuugacaacaaauaccuuucuuugccugcuuagccauagcuggccacaccauaaaucucuuacuaggaccuggggcuuucugcuagcuggccauaagccuuggaggucuguucaccucuucugcucugcgauuacaggcauguaucacuauaccuacauuuuuucguuguuaccaguaauucaacucuaguccucauguucacaacagcaaacacuuuucucaacugagcuauguccccaauccuggaaaauauuuaaaacguaagaaagcacagcgccuguuuuuagggucaagcugguugucauuuuugagcaguacugagaaacauuccuuuugcaacccaucaaauuaaaaaguuguagugaagauauuaguaguuaauauaggaacuauuguauguuguacauacuugauuuuucuaguaggacauaagauuuuuccuuguguauuuucugauucuacuuaauuaauuauuuuuuagaccauaauugacagccuuuuaccuuuaaaauugaguuacaaacaaaaacugcuagagcuaaguuuacuacucuuaauuuugcuaauaagguuuucugguguuaaguaacgaaguagacuugaaagaggaacuuuaacuagagguagaacaaugagugaugcuacucuguuguugacuguucuagaugacuuguucaaagugcacaaagcaaaaccaacucugaaauggagacagucauuugaaaguuauuugaagacaaugccucccuacuaucuugggguaaggagaauauuguuaaaauagaucuugaaccuuuugaucaucucuauaaauaacaugaaaauugaauguacagguaacaugaauguaauuauagauuuuagugguuuguaggauaauaguugugagaauauaugaauauugugucgccaagcccagguacugucauaagcaugauguguguauuaaugguguuuaauacuuaaggucucucugugagguaaaaaugauguuuucugccucaaagauaaagucaggaaaugaaaguaaguggucauuucuaguucuaguuucuacuuuugaugcaagaauuuacuaucucugucuagaacuaaucuuuauaagugcuuccuauaucauuagaagauuaauagcuugauuuuaugguuguaaaaguuauaguuucuuugaaagucguguuagaguaagaaggaaggagcucguugacuccguucucuuuagcaaccucuaagacuuagccagagcuucaugaguauuacauaagugugagcucuggguuuugauucugggauucagcagagcuuaugcacuuuccaugccaguuuuuuucugucuuugugucuguuggagauauuauauuguauaaagugauucugaguuaguccauccuuacuccugaagauuuuuuuacuguuauauauguguuuuaaacuuuuuacucuguuuguucuccuguguugucccugcacucucauucauagcuuguuugcuauguuauuggggaggggaccaggggauuuuaagguucaugaguuugucugagcuuucccaguuggcuaaggucccugaguuucugagccuuguaaauuucaugagcaauuucacgagcuucuaagacuaaaaaaaaaaucuuauuuauauacauaaaaaacucaguuaaugauaauaauaguguggaucaaaaucuauugaaugcuuacuauaugccaaaugcuuuuuauaaaugcauuccauguuuguuuguuuguugguuuuggggggguuguuuuguuuuguuuuguuuguuuuuuccagacaggguuucucuauguagcccuggcuguccuggaacucacucuguaaaccaggcuggccuggaacucagaaaucugccugccucugcccccgagugcugggauuaaaggcauuugccaccacugccuggcuugcguuccaugcauuaacucauguaauuccauaacaacuuguuaaagauagauguccuuuccuccuucuaaaaguaagagguaacucaggacaaguuguaucacuagcucagauuguguguccagcccccuuacccaauguuacacucagacuggccccacagugugucuucugucuuccaaaugaguaccuccccaugguauugagcauuucuggacuucauucuuaaugccccgauuauuacucuucuaauuuauauuaacuaccuuaaguugcuuuucauggcacugauuaaacauuuuacuaacauacuaacauauaaauaauauuguuguuuuguguuccuuuuaaggcaaagaaugcaaguuggggugaaaaaacuuuuaaaaguuacuauauagaacauuuuucuuuuuuuuuuucuuugaacauuuuucaacaacuugauauugaauguuguuucuuuuucuauagccccugaagaaagcuguuagaaugaugggugcaccuaaucugauagcagacaguauggaguauggacucaguuacagugucauuucauaccucaaaaaauugagucaacagguaaugucagaaacuggaagugaacauuuaaggauuugacugcuagcuaacauuuuuaauagucuaaaagcuaucuaguucuugaugacugucuuuauuacugagguacucgggucaaaccagggcuucucaugugguaggcaguuugccacugagguaauaucacuagcuaacccuuucauuuugaggcaaguuaacuugcaucagacuugaauuuggcaaaccuccugccucagucuugaguacugcgauuacaagugugcugcuauccuaucuaacagacuguaaacaagaucuuguugauuccucauuguauaauuucucauuuaugcauauggacuagcuuccgguauaugauuauuguuguuuccuuagggggaaauugccauucuguuuugcuuuguguuuuaaaaccuguaugcauuuucuuucaaaccucgacgcuucuuuggaacuguuuauaaaaccauggaguuuuuaucauuuuggcuauaaguucuauuaagauacggugaauaucaagcaguuggcaguuuacuuccauccaaauugugaaugucuuuuuaaguuuucuaguacuuuagacauuucucugcaauuguguauguaguucugagcuaaucgugucuuuaagcgguuuguugucucauuuccuguugcuucugaauugggaauguuuucuuuuaugagacauacuucauaguuugugugugacagguauuaauuaauaaaauaacuugaaggaguguuuguccugcuuuaaaaguuuugaguuguaauuauuuuaauugagaaacuauuguuauuaagguauguuugguuuaccuaaaacuaauguaaacucugauuacuugauuuuaaauucaauacauaauuuauggaagaguauggucacuagcaucugauuuauaaauuguagauuguauuaagacaauuuuuguuucuuuuuacuuuaggccaaaauugaaucugauagagucaucggauccguaggcaaaaaaguaguacaggaaacuggaauuaaaguccgaagccggucacauggguugucaauggcgcauaggaaagguuuucaagugcugcaggguauuucggaggaugucccccacagguugcuagaccuuaauaugaaggaguacacuggguuccagguugcuuuacuaaauaagguaacagucaguuuaacauugcuuuaguuguguuguagucugucauagagcaaguuauaguucauauuaacuaacaguuugucgaggcuucaaaaggcucacuucuauauggcuguagaaugauacuuaauauauuaccacugaaccuuugaauuaaaacagaaauuguauauaguaugugaaugaaugaguugauugauagugaaaacaacggcuuaaagauuccaucaaguuacagagcugauauuagaauucacuuacacuuaagaccuuagcaugcuuuauaacucauuauuaaaauuauuuuuuucagcaaccuuucuguagacaauagaauagccgagcugauauaugggaauacaaagagucuggaauagcugaagcaguuuuggaaaaggaauaaaguuuggacaauugcagaugcguaauuuagaacugaaaaacugcugugauuauggcaaagugauugugugguuaaauacagaggcgagguagaauggaauagggcaggucacacacagucauuuaacaugccaugggaaucaaagugggaaaagccucuuaaaaguagcuacagcaguggguaucccuauacaacauaauuaccucauauuugauguaaucauaaucauaagaauuaaaccuuaagcauacagaagaaaaaaagaaaacaucuucauaguguuuaaagcuaaugaagauuuuuguaguauaacacaaauccaaaaagaacacaaacccaaaaaguugguaaauugaaccuuuuuaaaauuaaauauccucucuucagugaacugguauaacuugagauguaguugaauggucgaaugauugccuaacaucugagagccccugguuucacucucaauacuauauauauuuuaaaaaagaagaaaagaaaaccaaaguaggcaagguacaggucagagaagcacagaacuugugauaaaagacuggaaucaagauauugacauccagaccaugaaagugcucuaagcuaugugugacgaugucagccaacuguaagcucacaugcuugcucuucaggcccacaugcucagagagcagagugcugaucaaacucuucuagagguuaaagaagggcuuuuguuaacugauuugcuucccuuacccagagcauacuaaaagaucuuaaaacuuagcgguugcuuuauuuuguugagcuuaccagaaaacgucuuaucuuuuggccuuaaaauguuguaguuaauauuguaucgucguguguuuguuuucuuuugcucuuucaaagcugccuaguuagcuuaguuauuuuaaauuucauuuuugagccuaugcugcaggcuaaagagauuuuaaauucuuuuuagaaauauuuuauccuugacuguguuuguguaggauuugaagccucagaccuuuagaaacgcuuaugauauaccaagacggaaccuucuggaucauuuaacaagaaugagaucgaaccuuuuaaagagcacccgcaaauuucuuaaaggccaggaugaagguuagaguaugauuuuaaauauuauuucuguuuuuaaaacaaccuuucuuuauaauugguaaggagaugauaauauacauuguacaaacuuguaguauucucauuaauucaaguaggugauguaaagcacucagauauacauucauauaauuaaaaauaaaaauguuuaaaagggugauucaucccuuauuuucuacacuucuccuucaugucauuguuaaccacaacuccucuuaccaguuuauucacacuucuucaggcaccuggacuccuacggucauuuuauugggcuguguuagcaucugauaguuugacucugggugaccauuucauggcauauucugcuacuuccuuguuucuauggcaucuguuguaauucacaccaugagcucuugcuaugacuaaagccuucucaucauuacacgucuuuauucaugugcuaguuucacucuacuauuuucuacaaauucuacuuuauuuugccuacaagauaaaauuaguacuuuaaauuuacuuuugaagaauuaaaagcuguuacauuuauacaugcucuauacuaacuuccaguggguaguaaaaugggguugguauucauauaugggauagcuagaguaauuauuagugaugauaacuuuuguuugauauauucucucugaaaagaucaagugcacaguguaccuauagcacaaauggggaauuaccaggaauaccucaagcaaguaccuucuccauugagagaacuugauccugaucagccucgaagguugcauacauuuggcaaucccuuuaaacuggauaaaaagguaacucugaaauguucuaugauauaauuuguuggauagcuguggucaauuuagcuuaaguuauuuuuggggaggaauaucucauuaaaguauuaauauuaagaguuuaauuuaucaauuaaagaauugagguuagccaggaggugguggcgcaccccuuuaaucccagcacuugggaggcagaggcagguggauuucugaguuugaggccagccuggucuacaaagugaguuccagcacagccaggacuauacagagaaacccugucucgaaaaacaaaacaaaacaaaaaaacaaaaaacaaaaaaagaauugagguuaguuguacuacuuaaaaguuggguagaggggcuugggagauggcuuaguguggguuaagugcuugucaugcaagcaugagaaacaguucaaauccccagagccuauauagaaagccacacacaguagcacucauuuuuaauuccugcacuccucuggcaaguugggaguuagacaauugacucccagaagcuaaugagccagcuacucuggcaugcacaguggugaagaagagaccuugucuuagacaagguagaaggugaagacuuguaccugagcuuguccucuuauuuccacauguacaguauggcaugcccauauucacacugacaaaaaauggaccccuccacccccaacacacauagacaaaccacauggacauucaagaaaaugucauuuucuuuuuuaguauagaguaggaagguagauaccagaggguaugagaaggaugaagaagggaaagauaagauuaaaggguuacuaagucccagcuucaggaauaaauuuucauuagcuccugacaacauuguuauccuaguuaauaauaaaauguguuauauauuucaaguugcuaaaagaacauauuuccaacauccuuaccccaucaaaguugguauguauuagccauguuaauuacauuaaaucuuuuuuuuuuaaagauuuucauuuuuuaaaauuuacauguguaugugagccuaugagguauucccacacauguagaggagcuuuggugcuagaggaguguucugggucaccugcaacugcauuuauaaauguuuguaaacugucaugugggugcuggaaacagaaucuggauuaagagcaguaagugcucuuagcuucuaagcccauaguuaaaucuuuuuuuuuuuuuuuaauguauuguguguauaugugugcaugcgcacuuaugccauggcacacauucggaaaaucagagggcaaauuuuuguggagucaguuuucugguucucuaccuuucuuguaaugguaggcuuugaacucaggucaaccaaagcaccugcuauucuuccuugcccauccuuguuuaacccuucuccugugugugcauagaucaagcugucaaaauugcauaccauaaauguguuguuauucaucaauuaaaauauauggugcccauuaaaauguaaaacuuacuuauaaacccaacauuuccuaucuguuaauaggguaugaugauagaugaagcagaugaauuuguggcuggaccucagaauaaacacaagcggccuggagagccaagcaugcaagggaucccaaaaagacgccggugugccucuccacucuugagaggccgaaggcagagcccugcugugaacagucacaucggagggaaaggaccaccugcacccaugacgcaagcacagccaggucuuauuaaaccccuuccucugcauaaagguagcacuuuggggcuuucaaauacuacuugcuauuuugggguuccuaagggaagagauuuuuauaauagaaacaaaaagauuguucagcagaguccagugaguauuuauugugaauuuguaugaaguaguuuggaugucuuuuugaugaacauucuauaaauucauacuuugccauguucuaaaaugacauuagcaaaucuuaaaguauuucaaaaaugguuguggaaggaauauugucacugccagcuaaaauaaacauuuuucuguucaguaaaaccuaacagcuaaacccaacuauuaaauguuuauuauacugugcuacagaugugagcaaggcuguaguuacuucugaccucuuaguaggcaaugaaagaaaaucaucuaaucaauuacaaguguguuaaauguuagaguguauucuagaaauauuugacaugaagaaugucuauggaugagugggaauuaaagcuuucccugugcuaaagagucuaaagagaguaugcauagaaauacauagagagaaagauauuaagaccugaaagaauucuauuauggcauugguauugggcauauuugguaagaagagaguggaaagacagucaaaguucaauucagggguggccuucgacccuuuuauaaaagauuuuguauuuuauuccaagaucagugagaaaccauugaaugcuucaaaagagguggcaacuugguuagcauuuuauguaugggguaucauuuuauauaugggaauauaggaaacuuaauaagucaauguuuuuguuaauuuuacauagugaccucauuugcuuauauaacaucuuaaacauacggauguuaaacauauggagagaaauccaauguuauguacuaugugauagaauuauacaguacucuucucuuaaauauauuugacucuucuccccuguucuguauugaauaucagugugaucaagccucuagaucuaguaauugcaugggaaauaaaagagacagaaaaagagguuaaauaacaaaagugggguacaaucagaaaauuaagaucauagggaacucuaggacauacacccaaaaacgaaucuguuguguuguuuuuguuauugaaaaauauaaugaaaagagagaugcagaaaggcuuuauagagucaaagggccaguuacgaugcauggaccucacuuggauccagaauaaaauaagauuaaaccuucaaaaacaaaauguauaaaauaacugaagggugagaaugcugacuggguaguugauguuauacuguaacuguuguacauccauagggccuaauuaguaaaugcagaugauuugaccugacugugccuugagaaacagucggcaaguuaggaaaagcaguaagugugaguuuaucuuaauaguguguugaugguuugaaaagcuuuagaaacagaccaugcaaguuagaaacaucuuuuggucuuugucugucuuacuaucaccaauacauuuuugugaaguaaaggacagaaagcuuuuuuuaaaaaaaaauugagaaagaaagaaggaugaaaguacacuuguaugaaaacccaguuuugaguuaagcuguaaagggcagggaggcuagugaguaaucaguccaucaagaugaagauggugguuuugcucgagaauguuuaaaugcuggcaucauggaccuaguauacagaaagguuaaaauaaagaugagagaggcaauuaucuccaccaagaaggcaagaggaaauggcccagcuugcuaaugaaggaaugcuguuucuguugaacaaaaugaguguggguacaaauucauaagaaauaagugaguagaagaguccucacccaggacuuugcuucuccaauaaauagaaaguagguauacugcugagauagagaagaugauuggaaaaguuagaacucggaaggaagagaaggaaggauauggaguaucugggaaagggaggaggcauggaguaggcuugcuaagaaguggacgauccaaaccucggugguaauugggaccacucugguagaucuggcuccuauuuuuccagcuauugucaucacuccaauuaaauggcugcagcuaacagacaguguaaacuggccauuaagucugguguuuacuugauagauaccauagugugggauguuagaacuagaucauuggaacauuguugaaagugaccuagcaugggcuuaagccucauaaagaagaagguggaggaguugcuggagugaaaguugguagacauuggugcuacagaacuucauaaauuuggagcaugcaaggggagugcuugggguccuuguuaaacugcuuguuaucaugcaagucaggacugggccacaaaggaagcauuucagaggcuuuccugaggcuuccuuguaagaaccuccuagaauguuaggagggacuuacgaauguacagugaacgaggugccagagcaugugcacugaacucaguaugaagagaauuguucaaaagugcaggaguuuuuuugccuuuuuuuuuuuaaugguuuuagaguuuuauuguagaaaggcagagagaaagagagaagguagaaagagagaagccagucaugaccacguggagagagggggaaaaggagagcuagagaugagaguaagaaaguugagagcguaagagcuuuuuuuugguuuuucgagacaggguuucucuguguagcccuggcugucccggaacucacucuguagaccaggcuggccucaaacucggaaaucugccugccucugccucccaagcgcuggaguuaaaggcgugugccaccacugccuggcugcuuuuuucuuuauaaagaauuaaauacaagagauuuuaaaauuacauuuaagaggugaaagagucagugacuaucucacuuuuacacucaugagaaagcaauuucuacuccacauuugagaaggagagaaguggcuuguuuguuuuauuuuuuaaauaggagagugugguuuucauuaaagcagaaauuaccgugauuuucagccuuaaccuuagacaaaggcugagaaacaguuguggagaauaaucagugaagaaguguuuucaaaucaugggguauaauucagaaaguaugagagagggagauggaaggaguagaaaccaggucuuuacauugagagguagaauagaaggguuuagcuggugcccuggaggcuggugaauaaucaaacuuaggggucaugucuaagaaucuuauauuuauuggcaagcuaguaaacuuuugggucugcuggucuaaugagcugaagugggcaccagauuacuuugcauggcuaggaacugaaaggauagauagaaaacagugugcucugaaauguaaugugccuuauuugguguuccuugcagaaucuugagcaauaaacaccacucaguguuuacuuuucucuuuaaagaauaacagguuuauaaagauaaguaggcuuaagaugagguagguaggacucuuaagccaaaaauggcaauuuuagugguguauaaacugaaaacugguuuaguuacuuugcuaaaauaagguagaaaacaggcuacaguuguuucuauuuuaaauaugucauaaguuuaaauuuuaguuauuuguaguaauuguguuacuuuagcauuuuuauucuguacuuugauaccagaucucacuuuucguuccguuucuuugguuucauuucagaagccacuaaugauucaauaguagaugaugugguugaaaaucauguugcugaccaacuuucaucagacaugacaccaaaugcuauggauacugaauuuuuaacaucucccccuaaucuuuuggaaccaucaaccaaucauacagaggcccuuggucaugaacauuuaggaaacaaugaccucacuguugguggguuuuuagaaaaucaugaggagccaagaaauaaagaacaaagugccgaagagaauauaccagcaucuucacucaacaaaggaaagaaauugaugcauuguagaagccaugaagaggucaacacugaacuaaaagcacaaauaaugaaagagaucagaaagccaggaagaaguauguauaauuagagacaaaacuuacuaauuucuuugucuucaauuagggaaaaccaagucaaaucaguaaaagcauauguauuaugcuagauuacucaugaaguaauaucugaauucuuuaagguuuaauuucagauucagcuggaaaacacuaaauaaucuugguacucaagguguucuaguaugggugguagauagcagaaagucuuuaucuagagauguaguacauguacuugccaugacaggggcacagaaucuugacuguucuaacuaggaauugaaauuuuacaacagcuaacccaaacagauaggguggauaauacuacaugacuugguguucgguuaacaguguaucuaagagguagagcaccuguauagcccaaauucaauucucaacacugucuuguguguuugcaaaguuccucucuacugacugucacuaugaaugaauuaugauagugaccuucaucaugugcuuaggcuccaaaccaaagucguaaggccaucacaugaaugcaagagaacucucgugguacaagaauugugcauaauauuggcauccauucagaacauagcugacucugcuguggugguguaauaagaaaguggaagggucuugagcacacacacauacaaagugcuuagaagguuuuauuuuuggugauacauacuuucaugcacauacauguuaacaguggucuguaaaagcuuugaagagugguaauauuuuuauguaaaauauuuuuugucugaguauagaggcaguuaauugauuuuccuucucucucuuuuuuuaagaauaugaaagaaucuucaccuuacugaagcaugugcaaggcaguuuacaaacaaggcuaauauucuuacaaaaugucauuaaggaagcauccagguaaagaaacuuguguguuucuaaacaauaaugaaauaguuuuugguuugcauauauacuugaauugcauuaguuaggcaguuggguuuauguaugugcauggauuugauuaauugaaaugugaauuagcuuaaaagaggaaaaaauggaaaaaaguugcacacgucccuuaucacucaaaauaucaauguagaaagguaaaagaaguuaaagauguacaacaccaccaaaaagcaauggagaaauuaaucaagaauuuuagaagaauauaauaauuuaccagggaaaaguccauaauuucucaaggauuuaugugccuacuucagcuugggcacacuucuacuuggaaugcugaagauaaggcuauguguuuucauauaaguugaaauacuuaaguuauucuacuuuuaaugaaaagucuguucugucuuuuguucaguucaaagcaugccuugaauuuuuaguguuguucauuuuugagauagcaucuucccacauagccaagcuagccuccaucuuagguuucuucugccuuagucuuccaaaugcuggaauuauagguaugugcccacaugcuaaugcaucuugaaucuaguuguguuccuugcaccugccuuucuguaagaaaguaguaggaauagaauguccagaaauauuauaaagagcauaaaugauauuuaugauuuuauauaugauuuuagucuaccuauauuuguuacugauaaauauuuugugcuauauauccugcuauagauaccuuaugauacuugauguccuggucuucaaguuauaguagaacacugauuguuuaaaugcuacuaucaauuuuuuauuuucauuuuguagggacuucaauuuucaaaaaggacuagaugauaccacaguaacuguuuugcaguucaacuuuacuauaauguuuagaauccuuguguguauuaguaucuuuuuuauuuuuggugguaggaagaauaaccauucuucccuuguuccuaagacaagaugaguucuucuaagaaaaacuguaauucaguucugguuugaauaguaacuuagacauuuuucauuagauuugugcaaguuuuuguguuuggcacacauguggcaaucaggacaacuucagaagucagucucuacuuccauaugaguuaagaggacaucagaguuggucaaaguuggcuuuuauagccucauuaucuucugaguuauuuuguuaguccucaacagauuuuuuuuuuuuuuuuaaauguuccuuuuuugagacuauaauaccauggcaucauuucccuuuucccuuuucucuucagaaccccucauauaucccacccuugcuuucuuucaaauccauagccuacuaacuauuguuacauacauacauacauacauacauacauacauacauacauuguguguguuuguuuauauuacaaaacuaucaucugguuggucuguauaauguuacuugaaaacauaaacauauuuacaacaccaccaaaaagcaauggagaaauuaaucaagaauuuuaaaagaauauaauaauuuaccacggaaaacguccauaauuucucaaggauuuaugugccuauuuaauguuaccugaaaacauaauauuauguuuucagggcagaccugaaacuggaagaagacucuuuguccugcucucagcauuccuugguuauccauuaguucguuguuggagcugaaaccuccugagucuucauccacucuagccugugucuguuaguacuguccuuggucagcucauguuuagguaguugccaauagacuuuacguauugguuuuuguuuuuuuuuaauuaucuuuuuuauuuacaaaucagacguugccacaccuccagucuccuaccacaguucuucuuuuagccucccccuacccccuucuuuucuuuuucauuuuacuuuaaaacaaacgacucuuucccaaagccaguuuuucucuuugaaacaugcuaguauauacuguucauuaguagguaauuaagaaugcucuuauuuuucuuacacagguuuaagaaacgaaugcuaauagaacaacuggagaacuucuuggaugaaauucaucgaagagccaaucaaaucaaccauauuaauagcaauuaaaagaaaauagaaugaggccacuuauuucauugucuucuccaaauacaaaguaaauacaagacuguuguaaucuuguauucauucuuugacaugcauuguuggcuauuugagauacuaaaaacauucuacaguuccuuuccaucauuuuacagugcccuuuucauuuuagcuuacuuuuguaaagugaaaaguaucacaaauuuuuuuucuuucuucccuuuuuucuuuuucuuucuuucuuuuuuuuaaccaacuaaaacuauucuucaaauccucugcuugucauuggcucuugcgugucaguuucccucagguuauauuuucuuaaaccaaccuuuaaaauugucagcucuguuaagguugaacuuugccaaaaaaagaaaaaaaaagaaaaaaaauuaaaaacaaguuacuuuguaauuuuuggggaaaaaaagcacauacauuaaaaacuagguaauguuuuguauauacaguuauuuuggauauauuauuguaaguuguacaaauguauuuugaagaauauuuaagaaaagcacuuuuguuauuccaucaauaaaugcucuauuuuacucuugugugguuuaggaaauaaucacauuuaaaguaacuacuuaaaaacauucuaaaacaauggaauuuuaaaggccuugcuuuuuagcauuaaaaaauacacaacuuaauauuuguuaaacuaauguaauuauauguuacauagccugcauugucuuuuuaacuauuauauguucuuaguuuuuguuggccaugccaauauacuccacucuugccuggauaaugguaauacuuacuaggucuguggcagauagacagaugggcaguuuuuuuuaaaaacaguuuuaaaaguagaugaguuggggcauuauuggcuucuuaacaccuuucaaccuuucuuacaggauuuagauggcacucuagcuguuaguuaaggugugauagcuuuaggguauaucauauuuggagaaggcuaguaugccgacauuugguccccucccucccccgaugcuuaggugaguuuauaauaugauaauucagaguggaucucuugguucugcucccugauucucagaaucuaacuggagaggaaacagacuuagacggcuguacucauuucuuucccccuuauuugcacaggaugaggauaucuggcacuccauucuccauccucacagggcugcacaucuuuacuaaggaugugaccauguguccugacucaugcacauauucauagaucacugccgugccuuuuagugguuuggagggaaccaguagaaaagguuagaguuuuuagauuuggaauaaccaaggugaaaaaaaauacccuuuaaauuauuuuuuuaauugaauuauuuuuagauuaauaauauuuggaaaucacauacucuuaaaagaaauuguaaauauuuaugaaggaaagcauacauagagaaaacauucuugaggucugcuauuuuagucaaggggauuugaaacucuuccgauacugaagacaaacccuguaaagaaaaagaaacauuucaugugacuugugguauuuucauaaaacaauucauuaaacauuucuaacgucuucacaauuucuggaaguaaaugaagauauaauuuagagauggaauuauuaaaauaauugccuguaaucacacugcuaaauuuauaccaaacuauacaaaauccagauuaacuuugugguugugaauuauguguauuaagagugagaucagugggaacacuggagucauuuagauaggaauuauauuuagucagcacaugggggcuguccuuggaagggucuuuaugucauaagcaugguggaauaauucucagaucuucuuccuuuacuacaauuuccaaaaugaacccccaaggaguguaaaauaacaggaucuucugugucuguguucuacccuucucccuuuccccacuccuccucucuguuccuuucucugucuggcauaauacuguuuacauuucuaauacuaaaacuuagucugaaaauuugcagccuaucaaaaacuaaagcuuaagauuccauccaccucaggcuuuugccuuucaaagauggugggcaaguuagucaagcuagugaaguuucuacagaauccuuguuagccaaggcaagggaggauauauuuggggauggguauuuuauucuuugagaucguggaaugauguuguguuggacaagugcucuccaaaggguuaauguuagaguucuaauuuuccuuaauguuccccuauguguccuauuuguuaguugauucauucaucaguauaagacuuguaagcuuuuaacagugaaggccgagacuuuuuuuagguuauuuuuauuuuaagaguuuugucuacauguauguaagugcacuacaugcgggccuagugcuuguagaagcccaaagagaagagagugugagauucccuggaacuggagcugcagacuccuaggaguuuccaugugggugcugggaagcaaaugcucuuaaccauggccaucuucuagccccagcugaagggucuaagggauuuaaaaaucccuuaagugauaucagaaaauuauccacuuugccuuggguaaugugaacaaccaucauccagaaaacuaaaaagcuacaaggacggagacuggugaguuagggaacugguuuuuuuauuagacuuguauuuucauuuugauacuugagcgguaaaaauuauauuguugaaaguguggugugucuuuucuagucuaacagcuuuacaugguuuuuaauacaguugaauuuuaaggaucuguuauuugucuucuaacuguccucuuuacuggauaugagcuuuaggcaguggcccuucuguucaagguuaguccucccucuuugagaguuuaauuuaaaacuugcuuuuuguuguuacaauuauuauuuuuauuauuuuuuacauaaucucugcugucuguucuuagugaccagugccguuuuguguagucacagucacuguggggucgggauaaucauggugaaguuauguuaugaacuccuucuucccaaauaaucuccaaguagauaauuuuccaggaaaugauuaccuacauccuuuugucaagaaauguucuuuugauuucuagcacaaauaugacaguauacaaaugauucucagauaaaaugauguugacaguauuuucuuuuaacagucuguguuaaacuaugcuaauuuucauucuaacuuucgauauucuuuccacaaauaaaagugaugccugauguuuaguuaaaguagguccaccuuggcuugauuuuuuuaaucuuguuccauacuguuguuuugaacacuacugagaauugccaacagcucuuuacugagaaucucuuccuuuugaggccaauaauuguuacagggagacuaagaaaagaaaagaauucaaggauuauuuucaauacugcugaauucguagaaacauuuguuucuuauauugugcuagcuaggcuaaccugugucugccaucuuuucauugagacacuguucuguugugugcaaaaguacuaggaguacuaaguagcuuuugagaaagacaacaaacaggacagaaaucugugcauuacuaaaauacuagagccugggucuugaucaucuuggucugaagaaaccaucuuuucuaaaacaauaggacagcagcaagaaaugcaagauuugauagaaguguguuuucauggcuuuuuaaaaucucucuagaagcagaagccugcugaacuaaaaagaaucagcauuagcuacaaauaaacagaugcaaaaguaaaagacauggaggaaaaguuuccuuuguacuaugaaacaauuccccuuuauuugagauuauaauagauuaauaaacguaaauuguuagagauggacauaaaugucugaauccaguuuuuuuuuuaaaaagucaguaccugugcuguguucucucagaagaaagaugaagggccgaucugcuuuaaaagcagagguccgagaccuccucagcagcagcaccgcugugagaaagaacaggcccugucagcauugaaaagcaugcagauaacauaaaugcagaacauaggggcagaacuugauuugucuuuaaggaaucaucagcaucuuaaugacauucuaccguguaguguuacaggagugcaaauugggaaauuaaagaggaaagcuacuacuuaaucauuccugugucuuuuuuuuuuuuuaaauaguauuccaugacauagcucccccuuugaaggugggauacuguaugauuccacuccuuguugauggggcaaugauacuuguuaaaaauuaguaucauugauuuucauaagauuuuguuuucuuucauuucuuuuaaaaugcuacaucacacucagguuugggcuuaagugguaugguuuauaacugaagagucacugggcagacauaacaagggucgaucuuggugagcagcuccacggggcuaagcgcugaauguaccuguggcugcagaggaccugguacccuccucugaaagcuccaucuuggccuuguggguuaguugagaaacguaaaagccaucuuggccuaauucacaaaugacaaaaauggaaagugauuuguuuacauuuuugugcacauaguguauguuugaagacucuugaguaaaacuugagcauucagugccacaaguauauagggagugauuguacagaaaauugccaaguuuuauuuuucuacaacucaaaggcuuuuuucacuaguaagaccucccccaaauuaguagagacugaaucucauaguuuuaaauauuaauauuaaaaucuuuauccuauauuucuaaaacuuagguaaggcauuaagguucccaaggguguauguuacaaaguauaaccuaaauauaauuucaaugagcuuuugagauaauucuuguugggcugcaguuuuuaggaagacacugguaagucagagguuaguauuaggaggauaaucugguguuaaagugccugcuguuccaugacuagauucuguggagcugguuggcuaguuagcucaccuuaagggcuggaaccugcagagaaaugugagguuguagcuagaugugugugcugacaguuucaaagacaagcuuaguaaauaggaaugagagaacuuagaaagcuugacagauuucugucauugaacaguucucuacagaugaaaugacauguguugcaguaaagagugaacuucagcauguagaacuaagauuugaaacugcucggcccuucuguuucagagggauugcaaagucaucugguaugacacacaccccaucugaacugagaauauccagguuugacccagagccuguuucuacccagcccuccuuuuaagaagcugcugucuagucagcuggagcacaccaucagagagaccugcauauuaggaaccauuuugauguacuuuagggauauggccccugacagucauguaagacuaaaauccaacccaggauacuaaaacaaugggauaucaggagaugguugucccacuuuucacuggcaguagagaaugggcaagagccaggaagaagucagucagcauucacuuggugcuagcggagaaucagauuaacaguggucuuucguugcuugucuuugagaaaagcaagauuaucuguuaaugcuuagccccuucuagcucauugagcagagugccaaagucaaaaaggaguuuauaaagagauguuugccagucgaggguuuacugucuuugacuuuaugacuuucacauugucugaacauuuccauaugauuaaaugagugcagcuucacugugaaaccccuggucagcuaacauacagcaaauccuguaucuggaucauuguaagaagugggauugcuacaaauucaucuucaguaggcuagguagggcuguuucagugucuuuguaaggcaugugaaaagcuuaaauauccuuccuaccccauucuaagaauggcccaaugucuguugucugugcauaacccuuagacuacucauugccuguaugccaccaacugucacaucucugaagguuuuaucuuugguuaagacuugacauuuuuguagacuaggcuguguucuuccuuuaucuucuauucugacgguaguuggccuccuuuuguuauguggcuauugaaauguuauaccauuaaugaaauaacuggaaaaggugagguuuuuccuggcuguuguuuuucugaauuguuagcauuguaaaagguuauacaaccugucgccccaaaauuugcccuuagaauccuuuauaaaugcuguucuguaggcaggcuccuuaauuaguuagaugugagagaugcagguuaauagauccugugucuaggaaacuuuguuggagcugcugauuugcuaauauuugcugugcaggacugcaguacauggcucucaucccugaagccacuuccaccucucuuuaaccucaguuuacuaacuaaacuuucuggaaggcacaucauagucaacuauaaacaucugugccuacauuacauguuugugucagcauauuugggauuaccccucccacccccuaccuagacuauuagcuguagcaaguaggaauuauggcaugcucacuuuaccaugcccagcuuucagcuuuuacaugugucaaagaaauaguuaauguguacauccaaaggaugaagcacacaagguucuuuaagcaaggauuuaauucccaccacugguugguagguagcuuuuauguacuguuggccacacauuuauaaauugucugcauuuggaccucagcuucuuccucaucaggacagaguggacaucaguugccuccuuuugucccugacaaugauuuucuuuggaaagagcuaguugcuuaucuucuuccaucguuucaguuagcuaagaaaugaagaguggguguauauacgcauugcagcuagccuaguguaaggaaacuggaggaaucuuagauggcucacaaacuaacuguaguugguugcuuucuccaccuuucucuacuacuuacaucuuucugugcaguguugacuuauuguggcucaaguuaauucaugcacuuuagacaguuggcuuauucaagucccguaggauauagcuugcacuauggacagaaauugaaguugacugcuacuuaugaaagcaaagacuuaaauaguuucuaaaaaguguugaguuuauauacaacaccugaccuggaggcacaaguuuaugucaaaacuuggugguggucuuucaggaaagggauuacccagaacaggugccuaccugcucuucucagugagagggagauuggaacaauucauuagcuauguguucuguaggaauaaaagaggauugggaggaagggugagcuacaugggggcucaguugagcuuugaaauacuucuuaaauaaaauuaugccaagaaggagcagacaugcuuuguagccugggaaggugaauugugauucuggcuuugaacugaauuggaagguuuucuuagguuuccucuguauuguaaaacuugguaaccccuuguucauugaggagaggguggcucuguuuaugaucauuucucuaauuaaaaaacaagcaaacacaaaacuacucugcagauggggguggugagauggcucagcagguaauguagcuugccucauaaaucugaugaccuuaauucaauccauggaauccaccuacaaguggaaggagaaccugacuucccaagaguuccccucaccuccacaugugugcugagagcaugugcaccccacuccagcaugcacacacaauaaauauguuuuuaaaccaauauacugugucauugaguggugguucuccacuuuaggaaugaugacacuguucagugauccugucuguagaguaggcagaaauguacuuggguacaggcaugaguggucuugcuacuggaaagaauuuguuggcaagccaucaauaaaaauauuaauuuuagcaaucaccaauccccugauguccaucucagugacacaacuucacuacuguagcaagaaaacagccuuagauuaauuuuaauaaauguaaguagcugcuuuuuuaauaaaaucaggugacaggucuuaauuuguugacagugggagaagaucauuggguugcaucaauaagcaugaaugcaagcuccacauuuagcacauggcuggauuauuaaggaagucagaucugugagcuuaugauuauuuugguuugaacaaacauaaguaaaauaauugcauuauauguagaccauguagguauucauaagacuuggugauaggcuggugugauggcucaaucgguaaaguucaugcuguacaagcaugagcacccauguuugauuccuuuaacccauguaaaaaaccaaggacaagggugcaugcuuguuugcgcacuugaggggugggguaagggaaaaaggcagggaaguuucauagcuuaauaccccagacaguguaacccaacgccagugagagauucugucucaaaaacaguggaucacaagguaucuuugcuuauagucguucugcaagauacagaugaagaccacuacuguuuaaggacacgagauuggcauuugaguauguuuuuuuuuuuuuuuuuuuucagauucugggguuuggggaguaagguagggaauuaaaaaugaagaagaguaaaacauuaaauacaauggcauggaagaaagggccaaaaauagcuucaaaguuacuucccccacccccuucuguaacuggcuacucaauccagcacccucauauuuuuaauuugaaugacuaaaagagcaauagaauuuccauuagccacagggauaccaaagcugaacucugaagccuugagaagacauaauugcccguuacugaaaguagaaugugguaacuuccccugcuucugaucauuaugcuguuuguucuacuguuccuuuccugcagugucaaagcaugccugucaauaaggaaaaauuccaacgaggccaccaguauugccuugugucuaauuguauaccaagcauugugaacacugccaaaacuugacuauugucuuaccuaucccuguacauuuagacaauaagaagugguagauguuuguuuguuuguuuuugggggggugauguuggcgauggaacccagaacuuucugcacacuuggcaagcacucuacuaugaaggcccacagccccgagauggcaaguuguuaguacccugauuagauacucccuguuacucuuacuuaauaaguagcuuguggugguucugucugcucacaucuaaagcacaagccaggacuugaagaucaaacuccuguuauuuucugugauuaagaggguggauucugacuaaaguuuuaguaccauauguuccaguggucugauguuuaaaaugguaacuuucaaauucaucaaguaaaggcagucucaagaccagugagauagucugcaaaguagaaacaauccaaggcuuccuagcuuggcagaaguugagccagugguucccucuaagguucccaaaguagauguuagcauucguuuuccuuccggugugcgauggaagcucagaucacaggcaaacaugguuccuguugaucagcaguagcauguuaacuauggaaaauauggagcauggaugccaggaaagagaacaucuuagugcaaggucaugaaagcauggguaaucugaggacugggcuagggaaagguguguguuuauuaguccauuacaaaaggcaguaagcguuaaaggcaaccaggaaaggaaaggguagaaacgggauggcccugacgcuggcgugauagcagggggcauaaugaaggugcuggugcugccuacagucuccaugagagucuggucacggcaaagggaggcucuguauugcauccuauggccacuugacgcacugugaagugguuuccaaaaaccaugcuccucaaggagcaccccucacccaacaauucuaaucaaaaugugacuguuacuagaagcuccacauucuuacacaagguuaaccccuuuauuuuaggcaguguuuucuguccaaaacucugaaauaauaaggaucccuuagaguauggcaaaacccccaaacauaauacucugcaaagauaggaagaauugaauaauuauuaccugaaauuccuuucaaguuagcuuugagugggucaaaaagaucagugauaccccacgaucuuaaaaugcuuuuuacgucaaauugauuuuggaucuuaaaccugcaaaacaguggcagaugaucaguugccauuuagaauucacacucuucucauacauaccacacgaaguauaagguucuaaccggagaucaaugcacacugggcccccuccccacuguccuuuucauuguuccuucccuugaaucauaccugggacgaaccugaccccucugggcuuucccccagcuuuguccauacuacucauuugggacggcucuguuucccugauugccuuuagauaacgccauuccucagcuguuaccuuccuacucagcuguuuucucacuuuuucaaaaugguacuagagauaagauccaggaccuccuacaugcuagagaaauauucucuuacuggagcuucaccuccagccccgugacuccugguucugaaagcccaauguguauaguugaacucaaggugcacagaaaagucugcuuccuauugauacucuuuaugacaccauaaauaaccuagaagcuaccucagcucauuuuuauuaauauuaauaaaauaaauauaaauuaauuaaaauaaaugaauauugcugacaugguguuagacauuaugagagcuuuguagaaauugcuucauuuucauauaauggcuauuauuaucucuuaggugaaaaauucagagcauaaaguaagaaaccugcccaagaugaccuaaugaguaugugguguaccucauuccaaaucugggcucugggaauguggagccaugccagccaguaucacucucacuuggcuccucacauuuggguagaaucucacacacaguggaugugaauaaauaucuauaguuccuuguauagccccuuguguagcuuucucuacuauguaacacauuuucauguuuacugugugcaguaugugcccuugauaugcagcagaaaaagaacucagccuuuguuugcccaguaaacaacugagaucagaaagaaucagcacaccaacaugaccccaggacaaagcacuuuacauuagccauccaagaagcaaaccuucaaagaggaugcugcugcuauuugucuuugaaaauuaaaaaagaaagaaagaaauauaauuugucuuuuguauaaaccaugcauaacuuuagaaaaagagguauguugacauuuuucaaaauauuuggcucacuuagaaauugucuuaaguacagaaaacauccuuuucaaaaaacauaaaugcuaaauguaaugauuaaugcuauggaccuggcuuuuuagucugauuccucucaccagggacgucuuacuuuacagauucaguggcaagcuacuuuacccuauauucuuauugucugucuuugagaaauaaacacgauggcaguagaauuuaaauaauauugugauaauuaaaugaaaauucuuguaguguucagcacaaugcuugguguagccugugcacuuagcauugcguuuugacugugguuucucaguaauauugagaaaguuaaaaucuguuugaagcugaccauguggugggugauaagcuaaauaauauccuguuuaagugcaguaaaagcgacaggugaggugugauuacaugucccugcacagcuauggaagcagaacuagaaggaaugaggcggcacauuaacucaaggaaacaacaaccagaaagcugccugcccuuuacagaaacuaucaagggcaucacaagaaaagaaagccauaguccauaugcuacauaguagggaucgacuggaaaugaguuagguucaaacugaguucauaaauccugccaugaccaagcagagcuuaacgcaagaaugcaagaugugcucuacauggcaauaagaugacacauuuguuaacaaaguaaaggauuaagaucauguggucaucucaacagauguagagaaggcuuugacaaaaucuagcaucuuuucgugauuaagaaaacaagaggacuuggagguauguucagugauagagcacuugccuagcuugcuugaaccucacuccugaaaacaacaaaauccaaugcccaaacaaauaaaaagcccaaagacucagccaacuugggacaugagguaacuuucaauaugaugaagaaagccuacaaccccacaccuugaauauuuccuucaaguuuuucaucuaagauuaagaacaagacaaggauggccacucucuaucacuucuguuuggccuugugcaggaugauaggaaagacaaaagauagauaaaagcauccauauuauaaaggauguaauggcuagggauauagcuaagugguauaacacuugccuaccaugcaaggacccugaauuuaauccccagcaccaugaagaauuugugaaauaaaauaugguuuaaaaaaaaggaaagaaguaacuuucuguauucacagaugacuuggucucguguauagaaaauauugaugaacaauaaaaaacccuauucgagcucauuugagauacgcuuucuuauaaaaagcaaugauauuucuaauacaaugugaagaaguucagaaaauauuuuauuucuaauuuaucagaaauaagccaaauacuuagaaauaaauucagcuuuaaguauaacauaaacaccuagaagcacaaaacacugucaaagaaacagugagcugaaugguagacacacaaagcucaaagcacucccuggcugacacacaagacauacccaugucuaaugccaaccugcuuguuuuggagagaaacugguaagcuggucuuauaagacacucuuuaggaagaagagaaugaaguuagacucacuuccugauuucuagccugacuagaguucuaagagccagaaugauacaacacuacaaaaauacuagaaucucuauguauggaaucaaacagaguuagaaauaaaccugugcauuuggcaauuaauuuugggagugacgugaugucaagaaauaugauggaggaaaaaaaugauccuuuaggcaaauguuauaggacacugggccaauccccacauacaaacacaugaagacuuggccuccauuuacaccaaaugcaguugacucucaaauaacaugggcuucaucugccuagguccacuuaacauagauuuuucuuuuucucuugugaaaguuugcaacaauuugaaaaccuccaaaguauagccuauuaaguuuuucuagccuaugcagacgagaaaaauaauacuaaagguagacacaaaauguauggucuaauuugucauuuacugcgagaagauauguacaaaccuguuagaacaaguuaagcuuaacauacacuuaaaaacugccacaugcagcaccuuucacucuugaaaaugugagcagaugcaaagaugcuguguugaaucauaacugcaugagugugugaucaccuuacagcugcuucuguuaagcaucugcagugccccuacuaugcuauguugaucaucucuguaaagugacauggccuccugugggccucauuuauuuuuagccaugcauaauacagaucacacacaaaauacauguuguauaacuacuuacuauugggaucagagcagucaagaacaggcuaguaauaguuuugugggaguaaaaguuacauguagguuuccuacaguaagggagguugguguccccuagcacucaaguugucaagguuacaguaauucacaguagaucaaaaauccaaagagugaacaaaacucgugaaaaauaagcauagauuuuugagagaaaguuuaaguaggcaaucacaugacagucuuuucuagauuggcugcauaagcaagaccacaauaauaacgauaucaauggaccucuuaacauggaaggggaaaauuuccacuauuagggggucacacccguagauaaagaacuauaggugugcuagagggugguagcagaugccuuuaaucccaacacucaggaggcagagguagccagaucucugugaguucaaggccagccuggucuauaaacagagugaguuccaggacagccaggacugcauagagaaaaccuuccuggaaaaacaaaacaaaacaugaacuacaagcaguuaaugguugcuauauguaacaguaacaauuugaagaggaucucaggagaggcucaaaagagggucgcuggaaagaggggguguuauuccauaucaauuaaaaacauuuaaaaagaaugcuuaaauaaaauauaguauauccacacacuagaauauuauucagucauuaaaaagagaugaaauauuaaaacuuugugcuuagugggaaaaaguccaauaaaaaggcuaacauuguauuuguugauuugcaugaaaaaucccuaagagauaauccagagagagagagagagagagagagagagagagaaauagugguugccuagcacugaguagugaugaccaaugaauguguguuucuuuuuaaguuaauaaacauuuuuuugcuuuuuuuuuuuuuuugagacaggguuucucaguguuauaaguucuggcuguccuggacucaauuuguagacuaaguuggccucaaacucacagagauccaccugccucugccuccugagugcugagauuaaaggugugcaccaccaugguuggcugauggucaauaucuuuuagaauuuggaguuggggguagagcucaguugauagaaugcuugucuagugggcaugaaacugugcguuugauucccagcacuauauaaaucaaaggccuagugcacaucuaugagcccauuauucgggauccagaggcagaaggaucagaguucaagguuauccuuggcuauaugaaacauuuucucaaacaaaaaaaaucaaaauuauuauuuauggcugcaaaaugcuguaaauauauguuauccauccaucuauccaucucuaucuaucuaucuaucuaucuaucuaucuaucaucuaucuaucuaucuaucuaucuaucuaucuaucuaucuaucuaucuaucuaucuaccuaccuaccuaccuacguagacauuugccaccuuacccagugcaaugugcacuuuaaaaguaacuuuuauaaggaauauauauauauauauauauauauauauauauauauauauauuucaggauuuuuaauagucaaauacagaggucugguucaugucagcuccuucacugcuaaaccaguggguaggacugcuucaaguucucugccuucuccuugucuguggugaccaggguguaaagguaccugcugcagcuaaccuugaacuucacauuauccuuguucuucuugaucuugacagauugggcauccuuccacuggccugugagcagaaagcccugauuuccuccguuuuccgaggcuggugacaggcacuuggcuuggacgaccacacccaaaacacucacggaggagagaaccgaagagaauggggagaaaaagcuauaucccauauuuuaaaaagaaagugaggaaauauccuuggggaaacugcugcacuuuaugauaaccaggaggcucuccaaggaggagcaagacucacuuuggaugugugaguuacauaguugggguauuacuugaguguuuccacaaagcuucuucuuguguuggaagcuuggcucccuggguaagugguauugaguggguggggccuuuggaaaguugggccuaauagaaggugaccaaucuggacagcccuugggagguuuaaacauaguucugcuguugguucucaugagagugggucucuaugcagacccuaaauucugucacaucccuucuugcucuguggcugcuucugccacugugaugccaccaucuguguccugauacagagcagagagacuuucagaacugugagcugaauaaaauguguauauuauauaauguguguguguguguguauauacuauauucuaacauauuagggaauaaacugaaaagcaaauugauuuauaucuggauugauaccuuggaccauguuagacacagccaggguuuuguuguuugucuuuuagacagggucucacuaugcagccuuggcuagcuuggguuguucuauauuucuaaacauacugcuuucuaacuucaaacauuguuuuuccaaccaauaaaaugcaggcuaguacaauaucauaaucuaauuuugugaauguuuucagcuuucuccuuucucuacccagaagcaagcauuuuauucauugaguauauuacuugacaguguuaaucuucccuggacuauggcugugauuguaggauuauggauacaaauguccuauaaacacccauucuugauuauuuaacagauuacauguucuuaaugaaaacuaacuauccuugugcauuuaauuuuauaaaaaauaauuacucuggaagauggcuucauaggucaccucagaauacugcuuggugguguucaaacucaagcucacccucugggcucgugccaaguaacauguaacauugcauuggucucuacauugggcugccacucacugagaccuguaugaugagcacagagcacggaaaaugaauaauuugagagagcuagagguaaguucuuacucaaaagcuggcuguggagugggauguaguaacccccacuuuuaauccugccacaaaaggcagaggcaggaggaucucugugaguuugaggccagccuagucuacauagcaaguuacaggcuagccagggcuacauagugagccucugucuaaggagcaaacaagcaagugaacgaacaaacucuugaucauaucuacugugguucaagcuauaugucuaaauccaaaccuaaagcaguauuagcuuuucagauuagucccucaaacuuccuaaugcugugacccuuuaacacaguucuucacguuauggugaccuccaaccauaaaauuauuuuuguugcuacuucaaaacuguaauuuugcuacuauuaugaaucauaauguaaauaucugcuaugcgaucccuaagcagucaugacccacaaauugauaaccacugcuuaaagaauuuauaucuuggcuuuuuguuugauuggguuuuuuucucuuuggucuggucuggagugacugagugaguguguguuucuguuuguguaagauucguuuugcuuaugaaauaaauggcuuuauuuuccuaaa

SEQ ID NO: 12521 - RNA, 14401 nt, Mus musculus
ugaauuaggaggaaaauuuuuaugugauucaucugacacaaaggaacuuuuaucuagaaugcauaacaaacuuguaaaccuucauaauaaaaggucagacaacccaaugggcaaacacccugaagucucugaagcagauacacagcaaacaugaggaaagaugcuccccagccaucagagaucgcaacuacagggcaaaugagaccuacuccagcuuccucagcuuaagagggcagagagaauucguuacaaaccagcccucaccugcugccggugggaguagaaaaugggacggcucucuuagaaacagcuuggcaaguccccaaagggcuuaaaauaauuaucauaugaccuggaaaacagacuccaagguauaugacagaaaaucaagagacacagccacacaaaacuugcacacaaauuucauagcagcagaacucauaacagcuaaacacacugcaacaagccaaauguccaucaacuaacaaguugcacagcacauucacugcacacgauggaaucuuacaaugggaaggacagaucagguacaaguuacacuaggaauuuguguuuacaaaagcucugaaagaaacaugucaguugugggguaagucaaauuuuucuaagagucuaggucauugaaauuacccuauuuaagaguuaaggugaaaauuaaaaagaaagaaaaaacuuuuaaaaacuuauuauaacaguaauuucagagaguuucuuuaaccaaacacauacauugcaccaggcgcaccuuucacauccguggugcccaagcaucugacacucacaagcuggcuugccaacacugucccugcucccggccuggccugcaccaggguuucuucugugucuccacuuguuagauaauccacaagugcacaugacccauuuagagccaauuaguggguaaucggcgugguuuaaaacaagucuuauguaaugaggggugcaggcugaaauugggaugcuagguccuaggucuugacgaugacagggcaccccugagaugguauuuuuuccuuacaacaucucuugggauuugguuaguuggcaauuagacuccaucuacaggcaugacugagaaagaaaaggcagagggacacauaaaggaaagggguggaaucugcagagagcagagcaaggacaggcagguggaagccaaugaagacaaggccagcaaggccaggacucgucucccagaccaacagucacugacugaagcagcauucucugaggcuccuucucauaccuuccuccagugauuuccaaggacuagugucaaaucacagauguggaaacacagguuuaaaaaguguucuagaaaacuggacaauuccagaggaaacguucaaagcaugaggugaccaaccagugucgauuccgugccgaaagacugaguaacagaguggggcucauguuccaacccagcacuagcugucuucucacucacugcauucuggugcuuuggccucuauggcacuaacuugaggcuggucaguccuuaaccacugccaaaggcccuggagcugccuuuccugagacacccacaacucugagcuguauuccagaguaccucacacccuacaguguucccacagagagagucaaggacaauccuguccuaggaaccaacacggggacuccugguucagaccagaugcuaaagccaugcaugcucagugaggcuggccaauaccuaacuuguccuacuggggugggagagccuaggugaaggcuuugcccacucuugucucaaaccauccuggggcuucccuguguggccugacaaggaccucuuccugggaaacauaaaugacaaauagacucaauaagaggcaucuccugauaggcuggcuucaucaucucuaaaaauagucuacaccuacauuauaaugccauccuacaaagaaaacaguauaccagcaauccaagaacagaaaacccacauccugaagguagcaugacuguagacagagccuaggcucagccaagcaccuccuggguggcuccuaacuuuggagcuacagaaaagcuaagacaggauauaguaugcugcaugugucaggggugggcagcucagauguccagcucuucuuugauggagacacgcagguggcagauacgcagagguuccgggggaccgucaccucgagaggcucccagguagaaguagggccucaccuccccaaagugggcauggaagguauacagauggcaguggcgcucagagucauagaaggauagcucacccuccucacacuccagcuccacacgcagacggcgcggcauggccuggaccagaggggcuguggcagugucggaagucaugcaguggucuccauccacacccugcgugcggcacagguaccagaagccugagcguguaucaugguagcagcugugugaguggccuucaccaccuacgucagccugagccugcgccugugcaugugccugcacccgaaccacacccacucgccagguuggcaggccacccacauccaccucccaagagugggagcccuuggagaacacuugagagccuagcaggcagggugccgaggagaagcgcucuggauucuccacuugcacgcgguagccaugguugaugacacucgugaggucaucagccacuuugagccagccagcagcuguguugggauccaagcugaagggcacuggggacagagagagaagagagagucagcaaacuggacacccuucuucugccaggcuggcugaggucccacauacccuaacgcaugcagggagcugcccuggguuguugggguaguauaggccaaacuaccuccacccccaaaaagauauuuguaaguccuaaacacuaguaccucaggauauaaccuuauuuagaaauagauuagagauaggcacagagagagacagagggagaaaaaagggagcgcaagugagagaauauaugucauuuaaccaaccaaggcaggggccaguugggcaguuacaaccaaggauacccaagcaaugcagcaaaugccaaggucuaagcgccuucccacagaucagaggagcacgguuuugacuauuuccugggaaugagcuuuuagccaucaagaauaugggaacaaauuuuggucauuuaagccaauuuaugguucucuguuacagcagccaaggagacuaacauaggcagggacuaugaagcaggacgguuuacacacucccaggacaccuaagaugaucaaguaacauuccacugaguugaugccacuucuggguauaaaaccagggcacacuggcaggagagaguuggaucuuucaucaugacuguuagacuuaugaagacagaaagaagaguuagccuuucucaagugggucagagcaggaaggcccuuggccccgccuagaaagggcugcagggagagcagcugagaugcuuggccaggccugugcagcacaggaugguuuccauucuccuggagcauggugcugcauguccuuaccagacucaacggauccaagcaucuucuuccagacucgguacugcagggacuccagauacuugcaugcauccauuagcaagccaggcuggagaggagcuggcuccacggugcagaagagccugguaaaggaaggcugggcauuggauggggccacgaccccuggcugcauuuacuacaagcagggaacaggacugcuucccuuaucuccaaccuaaguuuccuggacagcugucccaaagcaggagcccacugggcugccacagcccuucaggauucagcaggaggaucaauccugaauagcugggagacacacagggagguucuccaaccuagcugcugccauccucauggauagaaaucacacuuaggcucaggagagguccaagcugggccuuaauugugcuugaauucaaaagagccaugguguuacauggccuuugcgagcucccacagagacugggaacccaucacaucagcccagagcacuuucucucaucuugacaggacacaacucuuccuuacccaucuuggagagcccagcaagcauccacccacagcaaagcaugccaacgcucuuucccagagguaggaagccagccaaaaaccaagccuguugacgacugagaaacaugagucaugugccuggugcugucaaucccuguggagaguaucgacccucuauguucugaaacaacucccugucuccaugccaaccagaacugggaugucuuuaaagcgcuccccuuggcuggccucuacagcucccucuggauuccacccaguuggacacacuaccugccuagcccuuccaccacuggacagugaaggccuggcuuucuaucuauuuacccuuucccauccccauuggguuugccaacuuaccggcguuuucggcucuuguguuucuggaaagaaaaaaaaaaaaagcagagacaaagacuaagaaacugcagguaauuucugaccaagaauugccagaugucccacacucauggaugagaagaacugacaucauccagcugucacauaccccauggggaucucaucucagauucagugucccccccucaccucccauugaaagucccauggugaggaugcagccaugggagggagaccuugcucgguauacacaaggccuugggccuucuuuggcaaaacuuaaaacugauccuaaaguucauauggaguuucaggaaaugcugaauaaaagcaaccuugaaaaccaccaaguuggaggacucauacucccaaacuucacacuuguuacacaagcugcugugguagagauaucaggaguaaugaggacagaagugacagucuagauaacgcuggaguuucuacaggaccaagguaaguuaauagaacugccuucucagagaacaugucaauacaaccaaaauggggaaagccucugccuugugucagauucaaaacaaaaacaaaaacaaaacaaaacacccuuaaaauacauguaagauuuaaaugcaaaucuaagacggaagagguaagagucauacuggagcagaaaaggaacgaacucucacagcuaaacaaugaacagacaacccuacugaaaacuggauagcugggcacguuagcacacaucucuaguuccugcacucgggaggcagaggcagguguucugaguuugaggccagccugguacagaguaaauuccaggacagccagggcuaccuacacagagauaccccaucuuggggguggggggaacccaaacaaacaaacaaaaaaaaccaaaacaaaaaaaaaaaggaaggaaaaaacuguauaaacaaauuaaacagacauuuaagcaagaacuaguaauguccacaaagccacugaaaagacagaugcccagugucaucagcuauccagagagugcacacuggaagcacaaugagagcccaagugacucacaaggaaagcuauggagaaaagaaguggccaagagguacaggaacuugacacccagacucugcuggugggaagacaaaauaguguagcuacuuugguaaaacugccuagcagcccuuaauggguuaaagcagaauuaucaaguaauccagaaaucccuuggguacacaucgaaaaguucauguccacacaaauccaguacacacacgcuuagagucuuacugcccauaaacagcaaaagcagaaguaacucaagugagaacggaaggccaacugacagguaaaaacgccaugcacgaggggaacacucgccaucaaagggggcugacugauaaacuagcugucaagucugggaaacugcucugcaaggaaggacaaaaucaguaaagggaagaaagacaaugaaucauguuuuuaaaggaagaacagaauuucuuuccugugcacucaugugugugugugugugugugcgcgcgcgcgcagcauuaauacauacgucucauggggccagagguaaaccacagcuuauuccugccuuguucuuuaguacaguguguuucacugcccuggaucgcaccaagcaggcuaggcuggcaggccacuuaguggcuuuuuuuguuggcugguuaguugguuguucucaacuccugaaugcaauagucaaauuguauaauaauuucagcuuaaaaacaaacagagugagccaccaugcucagcuuauuuucuguggcaucuagggaucagacuggcuccuccuacuucacaggcugagccagcuccucagccugaaagcguuagagaaagaaggcagagugcaauccuguacccucacacccauccccaaaacuaaggaaaagauaaaagauaccucagugagaguacuugucauucacaaagccuaagcuacagauccagcacugcacagugagggagggagggagggagggagggagaaaagcaagaaagacagaggagaaagcaaacaacaaagcaacaaauaaacaaaacaaacaacaacaacaacggagccagcuaaauggcucagcagguuaaggugcuugcugucaagcuuagcaacuucaguuuggucugugggacccacgugguaaaagaagaccgacugacuuccauacaggcacucugcaauguguacccauagagacaguuugacauggcccccauagguccauagagaggggcaguauaggagguguggccuucucggaggaagugugucacagggggaugaagcucaagccagacccaguggcucacucucucuuccugcugccuacugauccagauguagaacucucaacucccucucuagcaccaugucugcuugugugcugccaugcuucccaccauaaugacaauggauuaaaccucugaacuguacgccagccccaguuaggcauuuuccuuuauaagaguugcugugguaauggugucucuucauaguaaaugaacccuaagacacucaucuacaguaaauaaauaaaaauguaauaaaaauuuuaaagcuuaaauuauuacacaauuugacuauuucauuagagauagagagauaaccaaucaaagaauaagaaagcagcaacaguaaggggcggaggugaagguaagaggguauucucaaccgccaagccuugcucugccacaaggcaugccaauaaggcccuccaccaucacagaaagacuguugaacauggucuguggucugagcugcuggccccugacccugaccccacccucaguucacacgaugagccucuuaccaugaggaaggucaugucaucuuccuucaucuccaucugcagacgcucaaucucccgagccagcgccucggucuguucugcuagcugcuucaucuucuccucagccugcaggugcuucuuucugcucucuuccuucauggcauccaagguggccuguuccuccacccucaggaaaucacggagcuugucaaacucaucccggaugcggccuuccagccaagucguuugcaccuacaccagaggagggagaagcaagcaaggucagauguaauggcuuugggacgccccagcuggggaccacuuucagcaaagcaacucaaugcucuaggugugacaugaagagccccaaagacagagaugggugggccaaugccagggacucauccucccuccccucucgguccucccaggcuuccuaccuggcccagccauguugagguuuggucuuuugcuauguauuauaaugcuaaauacugcccccuacccacccacccaaggcugguugacuucaggaccaagauaaucaguaccuagaccugacugacucuguaaccuugucccccaaguuaucccugauuggugaauaaagaugccaacagccuguagcugggcaaaagaaagaggcggguguuuuugguuccugggcucagucaggguuaaaggaagagaccaugagaaaggagaaacagaagacagucuuaggguagacucaugaaaacauggccaugagggcuggccaaguggaacuaagagcugcccagauggaacaaugcaaauuauaacucaggguuauugaugggaaguaaacucucauagcuagaguaguuagcuacccagcuuuagugcuaauuaaggcuuauuauaaauagagaaguugugcaucuuuuaucugggaacugaacaaccaaagguggggcagaaaccucuacugagauuaaauauuuacaaagcaaucucaccucauugugcuuggcaauggccucauaggugcgccucagggcccagaaggccuuggcuuucucucgcaauacaugcuccauguucuuacacuuggccuaauguggggaauacaggacaaauuagaacuagaguuccucuguggaguccgaccacaagccagugugcuccaagugcuguucagcauagccccaaccuugaacggcgcugcuucccaccucagggucucuaacccagcccuggagaggagacaccuggugcagguggggagcagggcucagggguuccaggagcucugcccaacuggccacaguacagcagagaacagcaagcuccagcuuaugucugcuccuagaaggcuagaccuguggggauaccaucaagaugccauggccacugguucacucuggagucuucccaacuggacucuucuacagccuuuaugaaaaggguugucaguguggacuguugcagucauuucccaagagguaaaauauucaaaugaacuuucaccuaaacauggcuccacauccaccuuuucccgauaaugguguuaggacaagaaacacagcaaacucacuuuuuuuuuuuuccuguauguuuuacuuucugacauggggcuuacuccagggcacaggcuagccuaaacucacuaaguggccaagcuguucuaggacccacagugagccuucugccaaguggugggaucaugggcauaagcaaucacacccaacucuuguccuuccuacuuuuuuuuuuggggggggggguccagacguacucuguggcaugcauggccccacaugcucuugaaagcuguguagguaggugucccacucuuuucauucccaucacaaucugucauuuugucuuuuuagagaauuucaccauuaucccuugccuuucucuccaagcccuccuugcuuccuuucaaauucauagcccuucucacauaucaucauaugcauacacuuauauacacauaaucuccuagcuaacccugcucagucuguguauauuccuuguaaaugugcuguucaggaguggauauuugguauuggauaaccagcuggugugcucuucccccagggaacuacacccccaccacaucaguugccuauaguucucuguguagggcugcugguccgugaccuuccgccauccacucuggaauguccacucacgcugccccuguugagcccuugcucaggcagucauuggcgagacaugggguucacucuugacaaucccaggagacagacccacagccaacucacugauugucuggcuuuuccucaauguccccugagccuuagacuaccauaauccagacaaaguaucucauuaaaucuagagcuaggccuacccagcaauuccuaagaaccuccuuauucugccccauaacagagcuaaaguugagguaaucaugugaucucacuuuuuauguuagaauuggaacuugagccaagcacucaguaaguacuuacccauuuagccaucuaucuugcauccugcuuaauuuuaaaaaauaaaaucacuuuuguuuuaaugaacacacauauauaucaauuuaaggaaggugcucaaacacuugguuuuuugaagauuuuuauuuuauguguguuuuucccacaugugucugugaagugcguuuguggcuugugcccagugcccagaagagaauguuagauuccuugguacuggaguuucagacuguugugagcuuccauguaggugccaggaacaagacucaggugcucuguaagggcagccagugcucuuaaccgccucagcaacucuccauccccucaaugcuuuuacauuuuuuaauuguugcugcuaagcuggaauucggaagaaacacuuuugaguuuuaaguuggguucuuauuaccuuuugcauccaaggccuauuaacuucucuccacuuuuauccuuuccucucuacauuccauaaauguguuauaggcuuuuccagaaacaaauccaguguuaauuacaauggcgaccuccguccacugagcacucgcuaugcccccguccgcacucauccgcgcacugugggucacuucguuaccacauucguucucuccaguaaguacauuagaggccacuccagggaagggaaucggaagugcaccggggaagcacccugcucucuccaagagugugaaccucaauuuggauuaagguugacagaaaacucacaacucuuugccaaggacaaagauuucauuucaccaaugcaaacaaccucaaacuaaucucccagcuagaauggcacugauucuaguuuuacugagacgcaguaugccaacuuccuuuggucacugcuuauaugaggaacuuuauccguauacacauaagcaauagcacaucuaagccauacugcugggauacuuuucccuuugagaagaaacgugggguuggggaggcgagucagccaguaaagugugugaaguaggagaaccucaauucugguccugagcacccacauaccuguagucucagcucuggaucccuggaguucaauggccaaaccuagcucaaaauggagauucagaucuagugugaggcccggugucaaaauuuaacgagagagagaucaaggaaaggcugaccuugccuaccucuagccccugcauacauacacacaccacaaccccauuaacacacacacacacacacacacacacacacacacacacacaaagugugucuaugcaaaccugugaccacuguacucgaggacuuccucuggucccucugagcauucagguuuuuuucuugagcucuggauugauccgcuaugacauguuccaaaaucuugucacccuuccuuccaucaggucccacugcaucaggacaaagucccagcucaucaccaucccccucagugucccaugaaugugucugccccgccguagugauagaaaaacgaacacacacaaccuuuauuacuuuugcaggacugugaaccacaaacccaacaggacaaccagagaaaagaauucuucauuuugcugcucugaaagugucagcuuugucccucacaggggugggaguauggggggggggggaccagagguggccaagaagcagagauaggagcuuuaggacacagccuccaagaacaguuccacaaacugccuuccucaagcuaggcccugucuccuaccuuaccuaaccuccucaggaggccaucaagugaugaaccaggauucacucacagggucagggucccauucuuggaacacuugcaggcacucaagaaguuguacuuuacugccacagucaagauuaacccucauacagcuucagggguucuguggacaguaaauuuuguuaauacuucagggcaccuaacacagaguaagaaauccucagagauuauugcugcuggguuaucaacacggaggccaaagggaucuuucuaagcacccaccucugggauuccugaggguacccggcagggccaagcuuagucaaucucaccauucuuaccugacagugggucauuccuaugcugccugcucccuuaacaagccauacccaucuccaaccacacugaaccagcuuaucuaaugacugccucaccaacuccucugaaaugucgacuacugcaaacaguguucuuguuugguuucugcugccaugacaaccaaaaagcaacucugggaagaaagggucuauuacagcuuauauuuccuagucauacuccaccacugagggauaucagggcaggaaaucaagcaaaacuaauguagaaauuauggaaauaauggagguaugcugucuauaagacauccccucugauugguauggaagagcccacguuggccuuacacuacccaggcaggaccaauguacugggcccucccacacccaucaccaaucuagacaaucucucugacuggcugauccauuugaggcaauccuucaacugaaauccccucagacgacccuaggcugugucaagaugaaauugaguagaacaggggggcugucuugcggacuuaagcagccgcaauaucuagaacagggugugagaaucaaagagguucuuaggauguuuauuucacacaugaauacaucaugaagaggccacacugcaucuggcugagcacacagccugaggacuccugggaucuuucagaucagccccacucccugcucuucaaggcucacucacacugagcacccacuggcuuugcaccaccauucuaagaugcagaauaagacuucagccuucuggccucaccugguguccaaagcuuccucucuucuagaaucuucuauaugcugcagcaucuucuugcaaaaaccuccccucaccuccuucaccugguuaaugccucuagguucuuuagauuuuugcuagaagcucccagagagugggaauuauuaccaccuaucucacuuccagugucccucggaccuccuaaucaaaacgaggcagccagcaagaacagaaggcagucuccaggcccacacgcucucuguccccuggaucacaggccuucgguugauguuuuaccccauucugaggacaccacccaugcuaaucaguaccuuugcuagcccaggggaauucgaaccaggaccuaaacuucuaggcugucuauuucagcuaugccaaauaagagaucuagcacuaaugaacgagggaacaggcacuaugaaccacugcugagcuaauaugauggauaacuggaggaacguggauguagacagcacccaucugcucugcuuccaaucuguauggagcugccaucaacugcugauucucaaaaaaagacauuucaccaaguggagaaagggcgucugaagaucaggcccagugggcucuuacaguaccuccuuuucacuaugucaggcuuccuaguggcuaacccugggcccucccaacugugggucugacccguguguuaguggcugaugaaacaaauuuagcuguuucaguacaucaaugacuuuaaacgagaaaaguaacaagauacugccagaguaaaauggacauuucagaaacccuuuaaaaaaagaaaaaucagucaauaugucaguaugaauguuuuggaaagcaauggagcaugcauaucuaagcgauuaggucaaauuguuaucgaaaaugucugccuuuuuuuuuuuuuuuuuucuguuuuagaacaaagacuuuuucacugggccugguggcacaagccugcaaucucagccacucgaaaggcugaggcaagcaaagaaaaguucaaggccauccuggcuaauuuaagagcuuggcucaaaaucaaaaguaggcuuggggugcagcugcgagguaaaguacuugccuagcgugaucuccuacagccccgacacccacccuuccccgccaugcuaguuuugcugugucagcugcucuugguuuaauuauaaccacuggaacuccagauauuuggauacuaagaguaagaggagcaaggcagcaggcaagcgccacaggccuuucuuacggcucuguaacccguugaucaaggcacugcugggcaggggaaaucucaaggccuuagaacucugcuagguccuggccucuuccauuucuaaaaugaccgcgccaagcccaaaugucugcagaccauacuauuccccaucguuguucagauuggccuggaccgggggcaagaugguugcuaggccuggaggagggggaggggcaggccggggguccccagggcgggcuggcgcggugcucacccggaagucuugcgcaguguccuugaugggcugcacacgaugcucuuggugccgggcgucggccuggcaagcacagcacagcagcuccuuguccuccaggcagaagagcgugagcggggcacggugcgcacggcaggggcgcggggaccggcgaccgguccagcgcgcgcccucagccuccucgcgcagcaaggucuccaccagguuguugagcgugugguuggugcgcagcuccccgggcaccgcucguuccuugcacaccggacacgagggcgucgucugcaccucccagcagccgcucacgcaccggcggcagaaguuguggccacagcgcagaguuacugcgucgcggaacgggucguagcacacggcacacagcagcuccucuuugaaggagcgcgaaggccccggggacacagaagggcccggcuccaucgcaggagcagccgccgucaccaccaccggugucgccgccuucaugccuagccugcgggcguugucccugcugaagaucugggagcuuaag

SEQ ID NO: 12522 - RNA, 91942 nt, Mus musculus
acuggagggggaagugaauggcgaaggacugaaggggucccccuucgguuccccagccaccugguucacccgguucauccucccuucccgaaguuagcccucgaaggcacgagcagccggcgccuucggcagaggaggaggaggaggagggaucgcgucgggcggagcuucagguccuguucgucucuccggcuucuccauacaaagauuacggugcagaaggaaauugcacuugccuccuccgccccccgguacccagcacaaugcaccagccgccggaguccaccgccgcggcggccgcugcugcagacauuagugcuaggaagauggcgcacccggcaauguucccucgaaggggcagcggugguggcagcgccucugcucucaaugcagcagguacgggcgucaguggugcugcuccaucuucugaagauuuuccuccuccuucgcugcuccagccgccgccuccugcugcaucuuccacgcagggaccccagccuccgccuccacaaagccugaaccuccucucgcaggcucagcugcagggacagccucuugcgccaggcggaacucagaugaaaaagaaaaguggcuuccagauaacuagcguuacuccggcucagaucucugccagcaucagcuccaacaacagcaucgcggaggacaccgagagcuacgacgaucuggaugagucgcacacggaagaucucuccucuuccgagauccucgacgucucccuuuccagggccacugacuuaggugagccugaacgaagcuccucagaggagacucugaauaacuuccaggaagcugagacaccuggggcagucucuccuaaccagccccaccuuccucagccucauuugccucaccuuccacaacagaacguugugaucaaugggaaugcccauccccaccaccuccaucaucaccaucacccucaucaugggcaccaccuucaccaugggcaccaucauucaucacaugcugcuguggccgguccauccauucccggagggccacccucgagcccaguguccaggaaacucucuacaacuggaaguucugaugguggugugccagucgcaccuccuccugcaguaccaucgaguggcuuaccagcaucagugaugacgaacauccguacuccaaguacuacaggaagccuagguauaaauucgguuacuggcacgagcgcuacgaauaauguuaacauugcugcuguggguaguuucagucccagugugacgaacagcgugcaugguaaugcuaauauaaauacaagcaauaucccuaaugcugcuagcauaaguggugggccuggaguuaccaguguuguuaauucgaguaucuugaguggcaugggcaaugguaccguuucuuccucuccuguugcuaacaguguccuuaaugcagcugcagguaucacugugggagugguuuccagucagcagcagcagcagcagcagcagcaaccaacaguuaacacaucgagguucaggguugugaaguuagacucuacuucugaacccuuuaaaaaaggucgauggacuugcacagaauucuaugagaaggaaaacgcugugccagcuacagaaggcguggccgucaauaaagugguggagacggugaagcaaacccccacggaagcaucguccucggagagggagagcacuagugggaguucugugagcaguagugugagcacacugagucacuacacggagagugugggaaguggagagaugaugggagccccggcugugguggcgccgcagcagccgccgcuaccaccagcgccuccaggucuucaagguguggcucuccaacagcuagaguucaguagcccugcuccacagaguauugcggcgguuaguaugccacagaguauuucucagucacagaugucacaaguacaguuacagccucaagaguugagcuuucagcagaagcagacucuucagccugucccucugcaagccaccaugagugccgcaacugguauccagccuuccccugucagcguggucggcaucacggcggcuguaggucagcagccuucuguuuccagccuggcucaaccgcagcugccauauucucagacagcuccucccgugcaaacuccucuuccaggggcaccaccccagcaguuacaauaugggcagcagcaaccaaugguuccugcgcagauagccccaggccauggccagccagugacucaaaauccaacuucagaguaugugcagcagcagcagcagccaauauuucaagcagcauuguccucugggcaguccaguuccacgggcacgggggcaggaauaucagugauuccuguggcucaggcacaggggauccagcugccagggcagcccacagcaguacaaacacaaccugcaggggcggcugggcagcccauuggccaggcucaaacagcaguguccacuguaccaacuggcggucagauugcaaguaucggucaacaggcaaacauacccacugcaguacagcagcccucuacccaaguuacaccuucaguuauucagcaaggugcuccuccaucuucacaaguaguccuaccugcuccaaccgggaucauucaucagggaguucaaacccgugcuucaagccuuccacaacaauuggucauugcaccccagaguaccuugguaacugugccuccccagccacagggaguagaaaccguggcccaagggguuguuucccagcaguugcccacaggcaguccucugcccucugcuagcacuauuucuguuacaaaucagguuaguucagccgcuccuucuggaaugccuucugucccaacaaacuuaguuccaccacagaauauagcacaacccccagccacccaaaauggcaguuugguucaaaguguuagucaaucucccuugauagccacuaacauaaauuugccuuuggcacaacagauaccacuaaguucuacucaguucucuacacaaucauuagcucaggccauuggaagccaaauggaagaugccaggcgcccagcggagcccuccuuaggcggcuuaccucagacuaugaguggugacagugggggaaugucagcaguuucagaugggaguagcagcagccuagcagccccugcuucucucuucccguugaaggugcuaccgcugacaacaccccugguggauggcgaggacgagagguaagaucacgugcuucugcagccaucgggcaguuccaaguuaaucucucaaguagcaauacaauacgugugggugcaguuagucugaagauauauauauacacacauauauauguacauauauacacacauauacauauauacauauguauauauaccuacaccuuuucguuugcaugugagaagugcauauucaugguaaguuucccagaggaagaaugucacggaaugguuucagagugguugggaggcagacuagguuaugacaguaauguucacgguaguuauaaaguguaaguguauaugccaaauagacuuggggcuaccagguagcuuuuauuaguuauaaagugcuuuugagaagauuaugaaaagcggcuuaccuuuuguuaccccacgaaauaguuaaagcuauucuuuggagcuacuagaaucuuuauggugauuucuuguugggggugugguugccacgucuguucuugcgguacagcccuuuucuuuccuaguauguuugaucucacgcugugaaagauacaguuaccugcuugcccuccuaaggcacugugggaaagaugaccuaaucugggugauauaggcugcccucagacuguuguuagcuucuguaaacucugucggaacagaagaggaaugugcgccuuaaagcguauuuuccaagggcagaauaccuacauuuauccuugguagucaguaaugcuguacagucuugucuucugauaguagauaaaagugguagccauuuuaaagagugaggucagucuuacaagggcugauuuuauacugguuaucugucccaccuguuuucucuucucgccaaaagacagacaggcuaaaaggcaguauuaggccagcauuuuuuuuuuuuccaauuaugcuggaaauaauaugcuaaaucacacuugugagucagacugugaacuuugauuuuauauuacuuuaagauucuuucuuuuuuuuuuuuuuaaaaaaaggaaaguucuuuuugcaaguuugccaguauauauaaacagagaaguauaguaguuguaaaaagacuucuuuuucacugaaguuuugaaaaaacauuuaagauaguuaauuauuuuaggauuuuuuuuuugagauauuugacauuaaacuuucaacuauucuaguugaaacauuuauauucuauuuguauauuuguggguuuacuuugaaaaacugaaaauguugcaaaagaguuuuauaaagagaaaacaaggccauguguucuggugaaguuuucacuauuuuuuucccaagucauuuaacauugaaacaggugaaaauacuuuuuuaguuuuuuuguuuuucuaauagucauauacuuaaauuuuguuacuaacuaaauguaguccuuacccuccuacaaaaguaccucacaagauggacuguuucgugcaauuauaacuauuguucaaccuuuaauuuuaucuuuaucauucugauccucaccuguaauuuuaguuuaaggaacuauuuacucuaauuuuuuuguuuccuaaaccaaaagggugugaacugagugaaguuccuuguuaaaauaacuauauaauacagaugucaaccuaagaugugaaagacagaugacauagagacaugacauuaccacacacugguaacaaaccugggaagguuuucuuaauuacugucugugagcuccugggagggcuuccuccuuuguuuuuccuccuguugguagggagauggcaggccugggaagaccugcuguccacaguuaagucagaggauacugcacacugguuuuuauccguagagugaaucccagugugagagugcagagcaguuuccuaaacagaugcguagugacugaggucaaggcgggucaggagucacugggguagagcuguguuccagggaagcacugggaagcaauugucugcaguaaccaacggaagcaguccucagacggucuuugaacuuuauuacaaguuugugucaguugacaucagaguugagucaucaagaguggacacacuguuugccagguguccaaguucucuaaggucggagugucguccuccccccucccccucaaggagcaugcuggaccaaccauccaggucuaguuuuaauugugauuuauuacagauuguuuuuaucucauuguaguuugauuuaaaaaaaaaaacuuaaauuugcccuugggagauaauugggaaauaccuaggagaggcaaaagugaaccaaccuuagagcuacugccuguccuccgugccagccugugucaccugcauccuucaggcuuugucaccauugauauccuuuggaagaaaggguugugcccucauuucauuuuaugacccaggaaguaauguuagcauggaaauguuugguggcagaagagagagauuauccuugaguaaauauugcgauauacucuauauauugugauauacucuauauauugcgauauacucuagcacuuuagauguaaaugcucagucagacacguggaaagugcuuucaguugugcacuuaccaacuguaauacucagaggagacuauaaacauuacagauacggggauggaagauuaugugacuuauuuuuuuaaaaggccauuuuauuauaacgaucuugaugucuuagccuuuaaugugaacuucacguuugcaggaacaggaagauaguuauuuuacuauaauguucuguacuuguuagcacaguguuaugugaaauucuuguuuauaagcaaagcucagauguucccucugaaagauuguucuuccccaggggguauuuccuuagcacauuuuacugucucuauuuaaguacuguauauuuggugauaauuauguuuaccagucuuucccacaagggcaggaacaaaaaaaaaauuuuuuuuuuaaacaaacuuagcagaucuuuuucuguuuuuccuaucaaggcacaguuccuauugucugucaucuuaaccacaucauuagaaaugcagguguuauaauuuauguaauagaaugaaaugagcaauaugacuucgcuagcuucuugcuccuuaaggugaaaugaugccagcauucuaaauagugucuguuuuauaguaaguccuuaaauuauacaggaaugagugggcuuuuuaaaaaauguuuacuuuuguguuucaugcauguaugugauuaugaagucaggagucaacuucaguugucuuccucaacuguguccacuuuauuuuuugagauuccuucucauuagauuggagcucacugugucggcugggcuggcuugccagugagcuucaggaauacuuacaccugucuguaguuccucggggcugagauuagaagcaucugccucugucaggcuuuuauguggguucugggguccaaacucagguucacaggcucuguagcaagcaccucccaucuuguaagaugggagagugagccuucuccccagccuggaaaucagggguuucuuacagaaaaaggaaccacacuuguuuugcuuaucuacugggagugguaggacggaucaauuaaaauaauguaaaacaccaaauaccuuuuaaugguuuuuguauugaccaguagcccuggcuggccuugaacucacagagaucagccugcuucugccuccccagugcuuccggggucagagguguguguucaccaucacgccugacaggaaguauuuauuuuuuagauguacaauuuaaagaauaaaagucuaccucccaccuccuuccuuuucagaucuccuuccuagaaucccuuuaauuuuguguagaugguucgucuuugacaagccugucuuacucccgguuggccaacagugugccggucaggagcagcucagaaggcagaccgcccagccuugucuccucuguccucugcuccuuuccuaggacuucagggggguuguuugguuugcuugugccucaguucccucauuugaaaacaaugaaggcgauagcaguucucacagaaucagguaaauuaaauugaauuuagaagacucucugaacuuaacucauugugucccuaagaguuuaucaaauaagaacuauccuuacuuuguguucuuaaauuucucagauaaaaauggaccugccuguugguuguccuuguuccgggaguuucucccaacugcuaugucacucuugaauauucauaagccuuguaaaagaucauuccuuuuucuguccacaguacaguguccaguggcuggccugcuacccccuccguccccagauacuugguguauuggaaggggugggucccccucuuaagaauuucuucauccuguuucuccuggucuccaaguugugugugcuuuggucuccgccuggauagaggccuuccucagcucucuggugauugugugcuugcaugucagugccagaggaccggagagcuacuuagaacauuuguugugguuguucuuagcguggaacuuggcuuggggucagcgucaguggcuggaguguaugguccccauuuauauugcauuuagucaccgcuuuucacgaaugguccguauuaccugccccucagccuuaacaucgggguauugacucggccuuucucuaggaagucgagugucacucuggccaccgugguggccugucaccuaggcucgcuacucauugcucuuggauucucucacuccuccagugguccaucuucguuuccacagccaguguugacaucauucgugauuugcuugcuguuuuuaaauggugucagcucaccuuuacacucgguugacuucugagcuuggguugagggugacaggucgcaaaccuugucuuacagcuucacugacaccacugacuccacugacucaagcuuccauacugcuuuugagaauucuagagccguuuugguuucuuaggccuuauguggccuuagugucuuuccucucuuucauucuccucccuuccucucucuccucauuuuuaaaaaucuaugaaagcuuuuaaaguuugcuuccaguggugacuuguguucguggugggagggugguucugcuucucuucaugaaguuuugcugugugcuauuucauccuguaaaguuugggguacugaguuugaacccagggccucucauagacuuggcaaaggaucugccaggugaacuacaucccagaauuuucuccucaaacuuauuugcauaaugggccuuucuggcuggucugauuuccuugguuucuauuucugcuccguuuuucuuauguuuaauuuccaagagcuuuguuguuuuugaucuuugcccuuuuuuuuuuaaagcuguguaccgcuccauuuuaauuuagcagagcuuuuucuuagcuccgugaacauguuagauuuguuuuaugacaggguuucucuguguaguccaggcuggccuugaacuugccauuauccagcccugccucuguguagauguugucgugugucaucacgcuuagcucuuuaaaaguuuccuuuguguucagucugcuuuuuccagguuucauuuucuucuguaccugggucuguaucuuucauguucuauucccuuccuuuaaacaguuggcaguugugugcaagguaggagauggaaguguuggguacagguucucaacagagcuuuugucggccauugauggccccaauagcugguacccugacugggcuguuugacuaggggucgggauaucuucguacuugauuagcuaugguaagaaggagugccuaggcagaaaggcguguccacaggggcugcagggagcagaggagugaaaagucuugggagccuuggguccccagcaggccuucauucagccauguuccacucuccccgcuugccuucugcugagcuucgcccacucgucuuggcuucacaaggccccucucagccugcagacuuggcccuuggggaaggagcaggccugagagcugcuuacaccugccuuccucagagccuccaugccuacaguggcucuggcugccaguuccugggccuuuggggcuuugugaaguuuaaguugggauguuuuuggcuuucuccacuguuuaccuaaucugauuguuuuuauuacuguuugcgaagucagccguccacuuuccagcauccagaguuguauuacuauugucuuuucauggccuguuuuuuuuuuuuuaaauaggcuucauuuuuauaucuuuccuuuuauuuauuugagauagggccucaaaaauucacuuuaacagcaaaagaauagauauuguuucuugucuagaaauuuaaauuugagacuugaaacugaaaagccccggucuggagucacagugggagccuuguuccuuggguucgaucguuaccaucaaggcuggaugucauggcagaacgugugcuuguuucucauccuugcuugugaggucacauucuccuugcuuagcagagacaagucuuucacagcaguucuccugccucagccuuccagaugcaggaauuccuggucaggccuaccacacacagcucauucaaaggaagguacaggagaagaaaaaaaacaagcccuucuucccuauauuguaaacagugggugugaucucacagacagauaccuuuuuccuuccgccauuucuuccuucccaguccuccugaccgcaaagucgucucugcugccuucugcuggccgaccgaccucccaccugcaucacucuggcugacugcgacacccuucuuuguuuuuuauuucuaguuuuuauuuuuuuguucuuuuguuucccacuuuucuugcuauucuguguuggucuuuuugagauuauucucugccagacuaucaaugucagcuuuccucggccuuucugauucucacaggcugcucgguguuuuaguacuggcugggcccaaacuugaguugaggcagccacccugcuucagccucccuggugcugggcucacaggcacgagcugcucugccuacggagggagcgccugucuuccccaguggucaaccuaacuaacgcuugcuguccucauuuuggagacucacuauuuuacuuuagacacuaagauggcauucuucaucuccuuuuccucuccggcuccaugcugacuguaaaaccccaucuuucuuuugucucccaucucgucucugcuggcacaguuccagucugagagaaaacagccuucacucagggaaguaccgccuguggcagcucucugaccgagcgaugcgcgcccgcgcacacacacccugccuuucucugguacggugcugcagcgcgaaugaagcuguuacuguggcaguguugccugucuguaacgcacgugcccagguccccugagcccuuccccucuuguguaaggugauccuuuugucuuggccgcuccuggccucccgucaggcuccauuucccuaggagagguuuauuuuggcuccugguuuuagaagguucuguccugguugcuuggccccaugcgccugguggugggagcgagcauguggcaagggcucacuguucuuggcagacaagaagcagauaaaagggaaaaguaaaacguucgcuucucuccgugcugggcauggcgccuagggucccgugcgugccaggcaagugccccacgcugcgcucugcccagggcuuccacucccacugcuucauuccuaaugacacuugaugaccuuucaggaacuuucucaccugccacccauuccucucugggcauuuggacaugcaguucuugaacauaaauguguccaaggucaccuccccaacucuuccuuaaaguuuaauuguccuuucauuuuauuguauuuuauuuuucuuguuuugauccaagauauugcuauguagccuaggccaaccuugaacuuagcuguguagccccagcuggccuugaauuugugaucuuccugcuucagccuccagagcccugggauuacagguauguaccacuacaccccgcuaaacuguuaacuuuugggagggccucugacauaccaauaugaauuuagguuguuuauuaaaacuaauuaaaagcaccuuguuauuuuuguuuauaauacuuguuauaauuuauuacuugaugugauuaucugauaaaauuuuaaccucugugaagagggauguuuggaaucuacucguacccaaaaacuauuucaguuuacagagauggugaaagucuguuuaaugaagaaaaucuacucuuaaucaugguguaagaacagggaaaucagaugcagcuuuuuagaagauagaauuaaauuccuuagaggcugucaugugacgucaguuuuuuccuuugguagaugugauugagacuugcuuuucgcugcuugugaguuggcugggguuuuuuucuuuuuucuuuuuucccuaaacaagcacuguguuuuguuuauuuuguauucucuaaagcuguuaaaaauucuuuuaacuugaaugaaacaacaacaaagagcccuccauuuauuuuguaaucggaauaaucaguauuuuucccacuuuugacuggcauaguuauuuuccauaaaauguuucuaaaauaccuagguauuaucuuggaaauccuuuguagucagcuauguaaaaacaaucuuugagcuuguagaaugcuacuugcuucuguugagggggucuguuuguuuguuuccucuaaccaguuugguaaacauuugcuuacaguuucugugaucuguuuugcuuguggccauuauuaguugccuguuauucagaagaggaaaguaggggcucuucagagggggaaagaaccaugaaagggcuggcaguggucagaacucacaguagcauuagugacuaucugugugugugucugagaagcauugggagacagaugaggccuccgauuuuaagggugggcuacugaugauggugaugauaccagaagcagcacccccaccaccaggaggggaaaugauguaauccagggaucaccagaggcuaguccaagagugucccuucaugucugugaaccugucaguguuuggccugguugccugucacagaaccacuucgugcugacuggggagacuuacugugacuugguuuccugacagaucaguguuaggccgugaugcaugccguggcuuugcucauccauggauccacggagcagaguagcucagagcucucugugguugagacagaagaaaauaauggcuuacucuuccagggcccucgaaguuuugcaguaacaccugacuguccgguuuggggaauucuugauaucccauguacauuucugaguauucuuugaaugacuuacaaauucagaauuguuuguuaguaaagacuuaauucucucaauagcuuauucagguuauuuaguuacuaccuuuuuuuugucuuuaggcuuucuuagugugccuauacauacuaacaaauaguauauugacuggcuaggagugcuuugaaaggauacucagaguugaaaugguacuuacccuuaaaaucgccacaugauuaugguguaucucaguagcagcagugauaaggguacuuucauguaguuuuuaauuuguuuuuaauuaagcacuuugaguuagauuaugcccucuugaggcucuguccugccugggaguugguaguuucugccauauguugugugcuguucagacuccaaucacaucagugguggcguugguguagaguaguggagaaccagcaccacuguucugaguugucugagcacaugggugcuagcuacuuaaucuucugaacaucuauuuuggcuucauauuuauccccauuuuacaggugaggaaacugaggagagagagagaagccuuuuauucaguauggugggaucugggauuugugcauggaauucuuguuuuagggguuugaauuuugacuuucuucucaugguugcaacaauguaacugacaggaaacaguggguguggguguggauacaaaugccacuacucagcccacuuuccaauuucuagucaccaggacccccaccuauggaaugggaucccccacauuuaguucauccuagagacugcuucaugcccaaagauuucacuuuguggucccucuccuucucaaguugagccauccugcugugguggcauguggucaggagacuucugcuuucucaaagaguguugggcggcacuggggcaaagggcauuuucuguuaccacaguagaauuacugacuaauaaagauauuuugauauaauagagggccccuuaguuuuugauuugcuggguugaaagggguggcuauuucagguauugucguuauaagcaaguuuuguguuuaacuugaggcucauuuccuugcuugcucucucuagauaaccugguuguauuggugacaguuguacacaguuucuuuuuguugaacacaguccgcuuuugaaauguacuuuauaaagaugauguuggaugacuuugccuagcaaauacaguuuuaaaaauacgcugcuaagugaacacuuugcccugaguguuuaugucguugggcguuucuuaaguauccuuugggggcagagauaaugaagcuggugaguggacacagcagcuguggugugagcugacgugcccagccuggugugaggagcccagcgaucugcaacucucccgggcaccaucaguggguguuccucucacagccuaccugcaucucuuagaauccaucacgggccaugucuuuaugcuguauuuaguggcgugauggucaggagcuuccaucagaucugccccucucuccccuuucucuccugcacucgccccagcugcucuuuacuguucuuguccuucauggagacccaccacacacuccucaguuacugucugaaguugaguguucacauuguuuaccugcuaaaaucgcuaacauuugguuccuagcgaguacuucuuacaguucacgagagaacaguggaucuagauccaggccucuccuauccucgugcccuguuggauuaagacuacuccacaucccagaccuuuuagcuucugaacuuuuggcagcuugaugauaaauucauaagggcccauggacaccugagaggaagacaguggacagugguggcucccauugcuguagcuaacaguuccaaguguacugccugggcguuaacuuggaauugugggagucuagucacaauucagaagaguaacuggagacacucuucucuucuugucuucucuucucuuuucuuuuucuuuucuuucuuucuuucuuuuuuuuuuuuuuuuuuuagacaggcucucacuguguaacccucacuugucuuggaacuuacuauguagcccaggcuguccuaaauaucacagagcucuaucugccucuugccucccauguccagggagacaguuuuaugccacggaagaugaguagaugggacugucuguucucagugcuaagcuuacugagggugucugccuuaugcucagcauagcuuaacaguuaaauaggcuaaaagcagaaaccuuacucuaacuaauugaguuguaauagcguauuuaugacucaggucuuuaauuuuuaguuguugcagcuuauguuuguuaaugaacuacaaaagugcuaauuuauaugagugauuaauaaugcaguuuaaaaauggaauucaucauuuuccuccuuucuguuggaaugcaaauuucauuuguuguuggaaagguugcauuaggaguuguuguacuuaagaguuguugcagaaguuagucacguuuucuuuuguuuucgugaaugagcauuggagcuguugaaagugacagcugggguuuuuggggugcagugaagcccagaaaugaggugcuggcuuaggucaucacuggguacugauuggacccugucugcucccuaauucucacugucacuagugggagggaguagcugcugugaaagcucgucaguuuaccucuacgcgugaccuucccagaccuucugucuccgcgggccaggccacgaguuaaguguguggaagguaaggcuccuuuuggaauuuuucuuaguuucaguuauuuuucaaguuguacucagagucuaagcccaugaggcuuuacaguggcuuauuauaaauagaucuaauauguaaaaccaaaagcuuuuaagaauagagucuacucucacagagccaagcuguacuauauuugagcuuuugaauaugaaacuuaaaucccauuagcacugagucuacauaccaugaguagugaauaacugaggucugaguuagagguuaaacacaucacuaggagaugaacaaacaccagggugggugguaaaccaguagagagggugggaaggaaagaugcaguugugacaguuuuuguggaguaacuugguacagcccacucuccagggaugcccuccccucguugccuacaccuggaggucuacccauggggagugaaaaugacagcagcuagcuuaaggaguugucugucagucuagaaagcucucuacaggacucuccauagaaauguauugucucagaaauaccaagugcuugcuucauacauaccuaguguuuagcagaagugcuaaugauacaaggaagggaaagcccauaagaucuccacaaguccuaagcaucuuagaucuuggugucuuccaaguuaaguauuugcucaauuguugucccauauauagcacacaugacagcuuuugcauucaaguaauugaucaacaaagcuguucgugcugucagcauucaaugauuuuauuggaacaucaguuuuagcaucagaccuggucgcuagccuuguuuuuucuaccucuuuuuuuuuuuuuuuuuuuuaaagauuuguuuauuauaucuaaguacacuguagcugucuucagaugcaccagaagagggcgucagaucucaucaugggugguugugagccaucaugugguugcugggauuugaacucaggaccuucggaagagcagucggugcucuuaaccacugagccaucucuccagcccguuuuucuacuucuuaauugacuuuuauaaacgaguuaaacuuuguuaguccaguuuucuuagcuguucugugggggcuagaauauaacccugguacuguuugggaaaaucagaggagacucuguacauggcuggugucccuagugugccgaguaagaagguuccuuuauagcauuguaaauuaaaagaaagcuugccuaccaggcuaagacuuguacauacuccagccuucucagcaagucauucugggucuuugugauguuugguguaguuuguaucgccagggaguguacggaagaacuuggcuucagaguggcuucuuucucacuucuaccaagcaugauacagauugucauuuuguuaaaaacaaaaccaaaaaauguauuccauucaguggggacaucaggggcugguuguuuuucugaaugccauucugugaggacuguccuuuaucugaguauuugaugagugcuugggcuagcuaaguucacagaugcaaaaguuguuacaaaacgugccuuccuuuuuuuuuuuuuguuuuguuucuaauggaagugaaggggacuuagggauauuauacagugucauguggcaauuuaacacuccaaaguagaaucaguuuccagaugacgggaucugaaacucuguaaagauuguuuuggauggcacagugcccugaagaccaucuguuccguucucagccccauaugggauggcaaccaucucagugaaugaggcugaucaauaaggcgauggaugacucggaaucgggauucuucaauucggagauccauugagcuggauuuggaaguucucuauaaacuuucaaaaugagguuuguuuuuguuuuuguuuuuguuuuuuaaauaauacuaguuugucacaugggaaaaggaaaguucuagagcccaguggcuuugccagaugguuuuuguguguucuugagcccguuucucuuacauuuauuauccugccauaacaauuggagauguuuccuaucuuauuuuuucuaaguaugcauucauauuagaaaugaaaguuugaauaucgccacaugagagcaccacagagguguuugccagaugcucggaacagugcugcguugacacacacgcccucgcucauccagcugccccugccuucguaaacagcucaguuauuagggauggagucuguaugugguaggcacucuauucuucaggaaacccaaauuagguugccagaaucuagcuaauacaaauguugcaauuuuguuguuugauuuuuuuuuuuuuuuuuuuuugagacagguucuugcucuguaacccggccauaguacuuauauagcucagacuauauauaaauaguacuuguuguguagcccaggcuauccuccugcaaugauccuccugaggccgccucugagggcagggauuauagauugagccaccauucgagguuuaaaaaaucucaaauuucaagguaaaauuugaaauucuuuguagcccaagacauuuuuuuuuuguuuguuuuuaaggugaaaaauuugccauagaagauguuugugaagauaaugcuacuuaauauggagagagcucuugacucuucugagcugccauaaaacugugaagucaacuuaggcuuuaaaguauuugcugaacucuaaauuugaggacagaaugauuuuuuuuuuuuuuuaguuuuuagaaauaccacaaucuggcauuacuucugaguaguaaguagucagugacuuccaaaaugugugaaggauacuagaggaguuucauuucauuaaaaaauuauuuuaauuguguguauguauauguauauacacacauguauuugggugcaaguaccugaagaggccagaagagacuucaagcucccuggagcuggaguuccaggggguuacagaccucuggcauagggcgcugggagcuggauucggauccucucuaagaaaguugcacggcgccaucccuccagccccucccacccccgcuuccuuccuuccuuccuuccuuuuuaauuuuauuuauguuugcaguuguuuugccugcacaguguuugugccuaguucugugggaugcuggaagacaguauuggaucuuccgaacuagaguuaggcaguugugaaucaccaugcgguguugggaacuaagccccaguccucgggaagagcagacagugcuccuaacugcugagccaucguccuagcaccuugcuuuauuucucuguggagauuugggucgcuggcuugauaaauacaaagaaaguggcacugucaaaugcacugugaacauaagcagucugucugucuuugguuuugcuuuuguuuuucagacaggauuuucauauagccaaggcuuucuucuguucgcccuguuuuuguuuucuccugaugggacgggauaggaguuuaguagcugaggagugcugcugcggucugucugccccgugccuagaacgggaauugccugcucuacuugccccauuacuggaguugucucagugaaggugaugaccugggacagcaucauguauucuguuucuuguacuuccugucuugauuuagcgucugacauccuugccgcaucagggccuuuucaguuguauucuucaucuucuuguuguuguugcuggguuuugccauaaauggauaaagauacuaaaggaauugauguaaucaaugaaacaugaauauuaccuguugucuuuucuuauucuguguauucauacaguguacaacuugggguccuaggauuaaaaggaaaaaaaaaacaauggaagggguauuuugucugaaaguaacauauauuucagagucucuuugauguucuaagagcaaggccagcaaaaggagcuuugggagagggaaaagguaggauagcucuaaaaaucgcagcugaguaacuugagacuuacgaucacuccgugaugugggcaggucaaacagacaguucuuuuuuuauucugugagagucagguucagggaugauugugucuuuccuuuccucugaggcugccuucgcuguugucacagcuagcuggcagaacuuaccaggucuguuuucugauugcccuuugcccuucagucugaguaagcugaccacuuuaaauacaucauguguuaaggaucgucucaguuuccaucucuuacuugauccuguaccuuaguucuugugaagacacauuugguuaguuaccuuuuaacaaaacuugacauuuaaaucuagugaugggacuucaguaucaauaacauuuugaacauuacuuuuucaaaaggaugaaaaaaaccauaauggaauuuuguuagauggugaggggguuuuguugucuguugggugguuuguuugagauggggucugacucugcagacacacuggcguggcagguagucugguuuggucucaucuccugucugaacucugauacuguggauaaaguuguuuccuuaagaauucaaguugaacuguguagugucuaccuguaugaaagccaggaaacgcaguccucucucacgguuuucuugacuagugcacuucauuuggaaaacauuuacugaauuauuuauucagcgugccacacacacuccuagggccuggagagcaaagauucugcauuuauuuaggaaaaucaguuuucuucugaugaccagcuggggcaguuauggacagaggagucuaugggaaguucauuuuuuaaaugggaguucuuuuaaaccaggaaguaucggugcuagaagguagauaagaaaaagaugcuauggcaggugaccaagucugcugucugcuuuauagucugcacacagguaagcaagcagcagguuuaacuggaucaguggcugcagagacuuuaagggagaaucccaugugugggcuaacucagacuguuguguggcacuagcgcuagagaggcagagagggagaccaaggcugcccucaaaagcagcaacgaaaaugugauucaagugcguugucuaaaaauaaguagguuuagcuuucucuuuuucuuugaugaugcauaaaaccaguaagccguauauccucauuugauaauauaguacugagggcaaauuuuacaaauagcuucauuugauagaccuuuccaaggaaugcgucuuucucaguaggauguguaaauguauacaaugcuaucucuaucuaucuuagcggccccacccccccccuuuuuuuuuauuugaacguagcuggauuuucugugagaaucuucagaaauguagacaguucccgggagcacgggugcauuugcuagcccguggcuacugaggccacucccguccuugugugacaucacucccguccuuguguuacaucacucccauccuugugacaucacagcgcgacagaguuuguuaccuuugguuugaaauuuauucucuaguaaccaggucuuagucuugcagaaaacuuaguuaugucacacagaggacaguggggcgagguggucugcuguguacuggugagauaacgccguugaugcccuucacuucaccaccccaucuugaaauuguacauuuuuucuguauaaaaucaucaaaucuaaccagaauuuuaacuuacaguaaaaggaacaccgccucccuugaaugauaccaaaguaauuuuuaucuggcgaaaucuacguguuuauugguuguugagucagagcaugcagcaggccuggugcugaggacagaauacaggacuagcugagagaagggggacuuugaggagcuugaauugaacuugcucuguaacugaaugcaaagauuuuaagguucucuuucuuuggcuuuugcuguuuucaagcuaagauggcuguguuuuuaacaugcauucuugaaggugugaaaaauaaagguuuugaagugauuacuuuagagcuccugcugaaguugugaacuuaaccuaauguucaaaauggcucuucaccuuuuccaguuuccauccagcucuggguuaugauuggucauuauuugauaauugggggggggggggggguaggacugggaaaauuggaaaaaaauacccaaccuuuguuuguaauuucugaauagaauuuuaaaacacuaccuugacucuuacaguuaaauuuugcuuagauuucauuaauguagaauucuuaaguagucuucagugguuuauauugaaguaucauaaaaggaaggaaggguuugccaacagaauugauuagaaagaauuggaggguucuugugggcuaauuauugcagaagugcaagggccgugcgucuaaggcgucuccaaugcccuggguccaugcuguugucacagacucgaccauuccagccaugggaacgucaguccuucuuuuuaguaaaggacuagacaguguuucucuggguagucuguacucaggucuugguucuagugugugcuuuuugucauuccugcucucccuucccaaugagaaggcccugggcagcccuuucuuuaaaaaccacaguguccugcagucuauugggcacugugagcuagggagggccacguguugccacuuuggcucgugaaguacucaggcuguugauuuccugucuuuccuaggugccaauuccaccuccucugcuacuuuuuuuuuucuuuuaauuuuuuggaaauuauaguccucacggguuuccuuuucuugggccacguuguuuuuauuccucaucugugcagagcuggguauguuccuaaguagaaggguucagcuugcucuuccuccucaggcuuugaaaagguugaguguaaauguuguuagauaauggaguaaccauuccuuuucagcuuugguuuguuuccacccuggcugccagagccaggaggaagugaaggcaggcgacacugucguggucacugccuccuuaaugcugagauguaaccuuuguugguuguuugguagagaacaggacagcacaacccucgguccacuaacagguaaggaaacuugugauaaccaguuggugugaggggaaaacaacuuggcugcauuuccccuccuucgcucacccagaauauaacaggucccagaaauaggacaccauggcugacugacacgcgccgcagggacacgcggcaccuuuaggaauagaggaggggcuucaggcuucagcggagcuuaccacccugcgcacaggcagcuggucccuuccccaaggcagugcuguucguuccuauccuuuaaauccgcaccugccucugcaucuccuuugagcuuuccagggaucagacacugugagcuuuugaaccucugucccacaguaaaacuguuucccagcaucuucaccaucaucuauuguuuggaauacuuccguguucuaaucucuacauucuggccacuaaugauuauuccuggucccucuugacuccaaauaaaaggaucaugcauguaaaaaaaaaauuuaaguauuuauuaccuaugaauauuaugcggcccuccaguuucaaagaugacugaccgcuggagaaaggaaaccuuuuucauugacauuagucagaguuuugauaaaacuccaguuuaaccuuuuuuuuuuuuaagcuauaauauuggccuauaguguugaucggucugucugaauuacuggaauuuaaaccauuaaauugagcucuguagaugcuccugauuaguaauauucuuuacugugauuauucuguuucuacuucccaguccauccucuucucuuucauagaagaauuaacuggggaucuuugguguaucaggcugagugccuucucccuggcccuuuauaacaacugcgaucuuguuucccauaauaauuuaugauuuucuuuuuuuuuugcuccgaucucuguuugaaguugagcgcuuugucacagaguauguuauggcuuagaccaguacaggccccuucuuaguuagcuaccgaggaaaucaaucauuugugguaacagacgacuacaauugaaauuaagaugguacuuaagaaaguuugcaccaagaucgcuccuuuuuguccugaggauaagccauuacaaacucaaaugaccagaguauguaauuuuuuuaaucagaauuuuuucuuaaaucuauauucagcucuauuucagugcuucucuccucccagagguacaaggagugauccuagagccacagcacagauacagccaagaccacggagagcuuuugacgucagggcuccacuuucuccacugaacccuuggagacagaauacccagcuucuggagagagugggaaaggauaauaaacaagugggugcuuuccauuauuuacuuggguuuaucuguagaguggaguguccuuccauuccccguuauucuguugggaacccccuuggcuucuuggaggagccaagugggacugcagucuguguguuugcggagaauacugucuagugcccauucacaaaacaaaccgaaaauuuaauuuucucuccagauaacugauucaguggcuaaucuggagcacacacacaauuugcuccaugccuguguaguucacaggaaugaaagaaaggcagucauuucuugcuuuggccuuuauuguaacaguagacuugauagaguucuugcagaguccagaaauugaaguuucuguucuuucucuuugaacuggacaccugaaaucucuaaauuuauacaguugacuauucaggugucacccugcccuauuagagaggacuuuuuggucuuuuuuccuaccguaaauguuaggccuucacacucggucucuuaggagauggaaugguagcacuguuguggcuuuacugucaaauggaggugucauccuuuaauaaaacaaauauguuucaggauuuaauguuccugaaagcuauacacauacucaaaaguaguuuucuagucccuaggaauguaauuuaugccaacccuagauuuuuccuagggcauuaagaugacucuuucuuaguuucuuugaugccaaggguagggugugagugcaggcgugucuuagauccgcaguggguagaaugugagguuggugcuuuggcaaguuuucauuguuuccuugguggcuucuucugugacuccagguaucuugauaaugggagaccgguuuauuuguucucuaauugcccagauuucuuucaacugguaaacauccuaccucuucagcaaaggaaguccucuagcagagcccucauggacgcuaucuguccccguggcagcaccugcaguguggaaggcaguggugaacggacccaugcacuaugucuagaagacacaaggaugagccagcccaccugaucuuguuacuuacaaacuuccaagauauacucggguuuauuuuuggucugaaaauggaaaggcucaaauaaugaaguaaucuuuucauauuggaguuuuacauggccaugaaaauauuucuuauucugaagacugaaauagaggaagcuugagagucuugucuuucaaagcagcucucuguaucugcuugaauuaaaagauuugugggacugaaaaucauuuaaucacauaggcaacccccacuuuaaaaagcagccuuuaaaaaaaaaaaaaaacaccacagagagcuugaggaacccguccaccaucucucuugucacccauugcuaaagcgaauaaagggugaacccaagucuugaaguguuagcagguacucuuggcucaucucuggcugguccugagccuuauucuuacuguaguuuaugaaaugaugaaagccauggagcugucuuggaggcccaguggagcccagucuguguuccuaagcaguaaacgccuguuaggguugaagggcugacucugcacugugggcauugcgccucuugagagaugcagagcagagguagugaacagucagagugaaccguaggugggaauagguuucaaggaauuguccaauuuaccaauuggccgcagcugucaaaauggugauucuuucuuugguuaucagguaacugaccagucaaagcuacuaaggaaaacggugacagucaccguuauuccaacaccuuuuaaguuggaauaagucuuaagaagagaaaucauagaauuaauaauaggagaacuaaaauguuagccucucaacauggaagacuaucagcuaagagauaaccugcuuuuagucuuucuuggcuauaaaaacuauuucuuaauuauaacucauuuuucaaaaguuuuaaugcuuuuaaaaguaaauauuaaagauaauuuugaacugaaaaauuccccacagaacucugaauuccuguagaaugaugacagcuuuguuguccugccuuaguaagauagcuuacaaguggaucuaaacaaaaguuggauuuggaacugaaacugggauuuacuagacauccuguuguauucuuuaaaccacaguaggagccauuuuaugccugagcccacuagccuuuugucucagcacugaagacagaaagugauuuacccuuggaaucucaagcuuuaaugaauuucagcucuguuccuuaaaguaugcaaacgagauguuagugcauuccuauuaccucauacgcuacaagcuacugcaaagucaaacuuuguguaucacugugaacuguuuuguuugaacuuuaauucugaugcauuuucuuucuagauuuuuaaagaacaauuucgugucacaauaugcaauccuauaucuuuuccguguuuacucuaugaauauuaauauaagugauuuuuuccuagaaugauuuauuguguaauauuuguauuaugugaucauuugaaaacuaauaaauauuuucuccauggaaaaaaugcacuuacugauaaauggcuuauuuuuguuucaggaguagaaagugaaaauugcaaccguauuuuuaaguguauuuaugugucuuuugcuaaguguuucugaauauauuguuuuuugauuuuuuuuuaaauuuuagaaaaaaaauccuguuaaaauucuagagucaguauaguaaauauuaagaguaauuugaucaaauuuuugagauuacauugaucaaaauauaaccccuuacaaaauagcauacagaaauuauuccucuacuuaaaacagaaacuauugaaaauaauggcugguuagagaacugcccaauucaugaggugucaccaagagaaguguuuucuguuuaauguucggcuugaacauauaguagaccuugacuugagagucccuugccuuuaacgucuccagacacgggugacucugaucaucacagccauacauucaccucccccagcagccaccauggcacuuucccaaacgugaggcucggacgguggacucugacacuaaaucacacacuauggagucccacacgagaaauagagcuugaggcuugacagccuagcgauuuggcuucccaaggaaaugccauucugagcaaaaugagcauuguaaguggaaguuuaacuugaaaugccugcuacacuggggccggcaggggauggagccaggauucuuuggucuuauucaucggguaaguuuggaaagaugaguuaaagcucccguuagagggcagaguuccuaauguuagaguugaguuguugaaagguccgcaguccugcuucagaggacggcugugguaggcauccgaaauuucaaaaugauugcaaagauaaugaugaagugagagguguacacgccgccuuugcagucuuccccauacugucguuaauaauaaucaaaucauaaucaaacacugcagaguggaaauguggguuuuacccacaugcucaagagucgggcguggccucuggcuugcuucaccaccacugaauaguuuagcuguaguauaaacagauugugauuuuuguacgugauaaaacgaggguuggguuuuggguuuuuuuuuuuuuuuuuuuuuuuuuuuuuuggagagggauagaucuuuggauaacuucuuuucuacgaaaagaaguccugaccuuuaaacuugcugcacgugugcacacaacacauucuccucugcccuggugagcagaaugucaaugcuugggcuuuggaaacaaggucuuuuuuuaaauuuuuuuccauuugguuauuuuuguuaccuguaaaaaaugauuccauauuaauuggguucuaaaugugaaaaaaaaaaaacaaaguaaccacacaggaggugcccuggagucuuuuuccacuaguauauacaucugaggcaaaauuagauuacuauaggaaacauccuacaggacuuggaagugcaucggaguuuucagaaauucuggucaaagagacucuccccagaagagguaaggcguggugcaggcagaggagcuucagcuguggccagcacggugucuccugacgacacaagccuaccagggcugccuucucugcagagagagaggagccagggucgugguuuucccggaaacuuuuccagaccacagaaauagaucuguuuuuacaugcuugcgguuuaucuagaaauauauccauagacacuguauucuuuauguacaaguaaccucuaauauuauaaaguuccaaggcaacgucuaccuuuccuuucuuagugucuaugacccauacuuaauuuaguggguuuuauuugagacagucuuccuguguagcacaggcugucuucaacuuguaaucuuccugccucagccuccugaguacgucccagguguguaucccuucuggccuuuaguguggugccuuguauccugugaaggaccguggaagcgcuguacuuggcauggaaaugagggcguuucccaguuaccaccugccuucacuuugccucuggcuucucauuucuauggcuuuacaccuaugauuuagaaaauauaaaaucuuuauuuugguuuauuaaauuaaggacuuuuauacacuuuaaguaaguugggaaacccauauuucuaaguaagaaauauuaccuacuauguaaaaguaauuggaaagagaaagcuauacuguuauauuccuuaaggacaguucaguagguuaaaaaacuugaguguuaauauaauacucgguguaucugagagaaaucagucuugacugguagaaaacagguuaaaauuguuaucuuuuucuuucuuucuuucuuuucuuuuuugguuuuuuucaagacaggguuucacuguguagcccuggcuguccuagaacucacucuggcuagccuugaacucagaaauucaccugccucuaccuccccaagugcuaggauuagaggcaugcgcccccacgucuggcuuagaauuguuuucuuaaggucacaagugucauugacuucugagagguaacagaaaacacugugaauuacaucacauuugaacuguuuggagaaggacuucagcuugucaacauacugcuuuuccuuagagggauuuuaaaauuguuguucuaguucuuaggguaaaacggcacaguugcugauacaaauccacugucagcucagccuuuggugagagaguaguucugagaagaacuugacccaggauuugcuccucucugcuuugugaaccaguuuaucaccccuauacauacaauugauugcuauauagaaacaguguaccauuucuaauuccacacuacucauaaauaauaaauguguggaauucucagccacagcugggacaggauaucauguuacuagguuggcaaaacaaguuuuuuuuuccuuuucauauauggcagucuugaugaugucucuauauggucuccuguuggcuuugagccuccuuccuacuagaucaagcacggccaugcccccuauuucugaagcaugucuuugagagccuuauaggucucugaacauguuuuggauuuucauuguaacauugacccagaacgguacagaugugucuggcuauuaagaacugaccuugcuuguccaugggaucuuauaucacugauauauaaccuauacaagucccuacgucuguauccaguaagcacuuaagucuauuauguugagguuguccuaagcagauaauuuauguaguauaaugcacaaagaaauuauuuguaagaaucagaucgguagucaaaaauuguacaaggcacauaguuuaguaaaagaauagaguugagguaauagggaagaccuuggaaaaugagacacaaaaguauaaucuccacuuaagguauuuuugguuugcuugcuuaguucugacacaaauaacugaauuguguguuaaaugaccgguauaauauaaaauguuauuuuuccaggauguccuugcagauuuaaggguaaucaggccuuuuggagccaaaguauuguuacaugacuggcauugaggaaaugaacuuguguuuaguaacagaauuagaaauguggagcaaugcuucauuggaaccauuugggaaaugaaccaaaccaacugaagacguugaagaaguagaugucgaagcccaaguucuagugcagaugcagaacuugugguguguauugaaauagaggccagaugcucuacagcacagcauccguagagcuuagcaugauuuuuaguugccaguuggaauauuuaagauuuccaccgggauacagaacugaccuccaggaagacaugaggagcuuacgggucucugcagcguggauggaugggcucaaaucgcagauacucaagugccuuuuauaaaaugaugcaguguguguguguucccaccuacaacuugcagugugucugagaucuucucuagaucagcugacacacugguacuuaggagcaacaauaagaccuguccucaugugucgugaagacaguuuuuaaccccuaguccuuuuagucugaaauguuggaucuauggcuacggaggaaggcugacuauccuacucuggcagaauuaggauuuuguuuacauagcuauaauggacacacuucuugggugcuuugccugugcuuauccaacgguucagcuaaccugugagaaagcuggggauauuucuguuuucuaugccaagcaacucagcuuauaaaaucugccugagaguauacugucagugggcaaaggagauggcauaugaaaguguuagucuaaagaauuaaucuauugucuuauuuuuaaaaaaucuuugccaaaagaagggcagguuauuuucauagaaugccguguugggucugcaaaaggauccacuuaguauauacucacaggcuuuaaaaaguuugggaauucuaggaaaauacauuagacaauaagguggacaucuuuccuauaauucccuucucaauuaguguggcacuuacuguuguugcugaguccuguaccagcucacacagugucacagauucacugaugacaucagaagaggucacugaccuagaaccccuaggggcuccugcucgugcuguggcuggguccuaugguaagcuaagcucagcuccuuuauacacaaaacugucaaacuucuaaaggcaagggcuuuacugccggagcuaucaccaccaccaccaccaccaccaccacucaaccccagaaaggguuugguuuuucucugaagugauaauuuucaaagugugguuugggucuagcugccccugggcaccagagagggugugggagggcgagcaagcaucuuagaaaugcagauucuuuggcccguuuugcaucccugccaaagugacuguauccucuccucagcauuugguggugucugguuugggcuuuuccaguaggaguugcaguggucgcuuauuguuugaauucacaggucccuggccauccuuguugaaagguccauuguauaugguggguuuuugucucuguuagcuucuuugacauuagguauccuaaggguuuuuugccugcuuggaaaucaguucauugauuuuggacaauuuauguuguguuuugaauaccaguccuuugucagauauauguuuggcaaaauuuauccacaauucuggcuugucuuuagaccuuugacaauguucuuuuucggaggaguguguuuauuuuacucauuuuaagugaaguccauccugacacucuccuguuaaugagucaugauuuggugcuguuuguaaaaauuuauuccaaacccauucacauagauuuccccuccacucuucguugucuagcccuguccuguccccucuuaagcccccugccccacccucaaggucuggcauuuuacaaguauuucuuugacuuugaguuaacauuuugcaaaaguuguaggauacaggcuugcuucccuuugauggcagaaauuugaagacuuugcucguugcuuuuucagagauaucuacucuguucuugguuucugucucuuggcacgauguccuguccugaugcugcgaugcuaccauuuccucucagccuggagcuuuggggaagaccugaagccaugcuauccuucacaugcuuugucuugugcucuucuccgucuucggcuuuccugugccucuuagugucucagaucuuugucuccauccacaaaagcagcugagcauuuugauuggcuacauugaaguuaaugucaguuugggaugaauuugcagccuaaaaaguuucggucuucccauucuugaagacgggaccugucuguucucacauucaucagcacuucagucauauauauauauauauauauauaaauuaugagauaauguaagauuuaacccccauuuuaaaaacucguggcaagcacuuguagcucaggcuagccuuaaauucaguccucugcuucagccucucaagugccuugauaguuguauaccauugauaguugcauaccagccuuuuguauuuuguuuuccuguaaaagcgaagcagugucuuuauuuccuuuccagugacuuacugcucaaagcagcuggcuuucuugucguguuauucgcuucauauccuucagcccugcuguagugaccuacagaguugagauuccccccuccccacccguguuccccgcgagguugguagggaguggugucuggggacagagauacucgugauuucuucuucuccagucuauccuccauuuccuuugcuuaugccacuagcaucugcuauuggacacgugagaggacauguuuuugugcagccaguauuaggggaagguguugugagcuuagcugcacagucuugucggcacucuuacgagacugaaguuccauuccagucgcucuuagugcuuuuaauccggaauugcuguugaaucuugacaaaugcauaagcaucuauuuacugaaggcugcagaugacucugauugacagcacuugcccuggcuccagcucucggguaccagaugcccucauacgaucuucaaaggcacccacacacucaucauacccacaccugucacauacagagauauaaaccccuuaaaaaccaaaucuuuaaagagcauuuauuuucaugaucguaugaguuuuucgacugcaacuugauuccauuaguucuauuaauugguuucugaguugagccagccuugcaugcauuggauaaaucauagugaguggcacuuaggugugguggguuuucauuugucaaggacuugcaucauuguugaugagagaagugaaucuauaaucuauaauuauaaucuauaaucucccuuucuuguguuaccauuguuugagauacuagcuaguguuucaucuuuccaaauaggcuguguguguuugaaugcaaugaguguugguagagaauaguguucaggaguguugucaucaguaucuagcgcuucuguuugggaaggcuacuaauuagugucuucauuuauuuaauaaguacaggucugugcauuuaacaacauuccgggacgcgcccccccccuuguuuaaguagauugguccuagaagauauuguuguauuuuauuuaaguugccagguuuggggacagcucucucaaugcuuacuguccuuuuaguguuugcuggaucucauggucucucuuucaagugugucauuagugugugcugucacuguggccaguagucagugcauugaucaaagaacuagaguuggguuuuguugauuccccccaccuccccauaagucuuuuuuugcauguguguucagcacugggcauuucccuccagguaguauucuugcugcucugauucccagaucuugaugaauuuccuuuuccuuuagucugaaauacuuuuguaaaguuuuguuuauguuggcgugugcuuggagaacagcuuuguugaguugcuccccccccccccgcccccuuucuuuguaugcguucuggggauuaaauuugggauuuguccagguuuguccaguaggagucuugacauggggagucacccuggcagccucuaguuugaaauacuuucaguuucucuucagacuacuacuugacuuuaaaagccucgccaaaauuugaggggcggcagcuggcuugaaguguuacuaaguuuugguuuaauuucauuguugucugaaaauauuuggauauccccgauugcucuaaacaugaacugucuuggugacugugcugugggagcuucagaggaagauggauuuugaugcuguuggauguaguaaccccaagcugucauuuaggcccugcugauugaugauguguuaggcugugccuucuucucucugauaggucuuggcaguuacucucauaaagucuuucacuggaauggaggauuugcuuguuuuucuaaucugucaguuuuugccucguagucucauuuguggggguggggcggggaguucgggggugagcacauacauacuacagauguucacagcuuacaauauugaucuuuuuaaucauuaauacuuaccuaucuugaauguuuuucguguucucaaacuuaacuuugaaaugaguacaaguacuuccacauuuuuagauuuuucucuuucaaaaaaagauuuauaaaaauguauguguaugugagagucugggggugggggaaugggccugugagcuugcaagugcaggugcugaugguggguaugggauacccuggagcuggagcugagggucuucugcaagaacagugauuucuugaccacugagccaacuuucuggcgucuaauguuucuuuuauguuaugauggcuggccucaaacucagcaugcagccauggauggccuugaacuugggauucuccugccucuccaaguguugggaauuauaagcaugugccgucaugccugauauaugugguauugggacacaaacucaagggcuucauguaugaucagcaagaacucuaccaccauccccagccuuccgauuucuuuugauuagugaaaguauaauacauacugccuuuucucuacuuaaaaaaaaaaauuaucgcugugcgugugauguguguucuugcguguaggcacgugucaugggacauguuuggaagacagaacaguguucagguaucagcucucucauauuuuugaggugagucuccuauuauuucugccaagcugcaggcuucaggcuagcuagcuggcccuugguguccugggcaauucuguuugcaccagccaucucgccgcgggagugcugccagaguucuagaugcagaucaucucauccaguuugcuugaggugucuugccuguccuuccuccguuuggucuagcaucucacccuguugucccaggcuagccuugaacuccagauccucccgccucugccucggugcuggcacuacaaguauauacccccaugccugucccuuagcacucugccuaauccagaugggccuuugaacuuaagcagaguaucucauagacagcacacaucuggaucuucacgcuuguuuuccugaugguauucgcgcuuugagggguuuguuuacacuguuagcagcugaagugauggcugagacggucgguguauuaguuaccuuguauguaacuuuucauuucuuucauguguuuucgacauuacuccgucucuccccucccccacucuucucugguagcaagcaagcauuuuaugaaauuccauguuucuuuucucuuagccuucuaacuaaagguuuauuuuaguccuggagauuaaaguauccgugucaggcaagucuaccuucggauuacuauuucaguuccugagcccagccgcugccucgucccagagcauccuagaccucucuccauccugugcuagcuuucccguguuggugcggucgccauucagaaaaggcuuagaucagcugagaaucgcagaaguauccuuucugcuuucccacugucuccaagcuuaccuuuguguagaccugccuuguuuuccucuuacaggaacuuuuaauguucccaggcgccuuucugugacccuucucccacccccaucucuucuugucugccaaagucuuuuuucacuuucccgggauaguuuugcuagacacaggagccugguauuuuuguauguucuuuaccacaagaaccuggagguggaucauguaggagugaggcccccauggugcuuugccaggagguuuucccuccuaguucccaguagcugcucgcucauucccuggccuuugcaccagcugggaagcuaggcagcagucgcuguuucugcauuugccugcuucuccuaguuugagcuggcccugcuugcgcuugccuugacuauauuggagucccacguggaggaagaguugcucugugcacuuugcaagccaucauugucacucggauuuauuuauuuagucuuuccugacucuugaaucugguuaagggauuuuuuuuuuaauguucucuuuccucuacuaucagguaguccugauaaaucauugcucuggguaucuucuaaaaauauuuuuucuuuuucuuuuuucuuuuguuuuuucacaacaggguuucucuuuguagcccugauuguccuggaacucacucuguagaccaggcugaccuugaacuuagaaauccauuugccucuaccucccaagugcugggauuaaaggugugugccaccacugccccacuuauuuuuucacuuuuaacuguguauuuguuuauauaaguguguguguguguguguguguguguguguagguguguguguaggcauuuaucagccguucacugugggugcugaguacugaacuugggucuucugagagcagcaugcauucuuucucccugagcccuggccccaggcccacuguaaguaucuguuagacuuucauacaccaguuuuuaguaaagaaggcuuuuggagucuuaacagguuuagaaaugauugaaaacugcccagugccagcuccgagaagcgcuccuuggagacaagcagcuucucacagaaaggcuuccuacagugcguuguugaggcuggaguugacuggcuccaucgaguuucagaccaaauggugaugcgggucagcucaccucccugugggcuuagagcagaaggaaguccacucgacuuuuccuuacacauugucuccagucaccgcaccuuggacacccagacuggucuauuuguacugucacagcuucucagauucugucucucuucagucugucccagccuggcuuuugcuuccugcaccugcaccaccgugaugacuguggacagucaucaaggcccccucuguugccaaacacagcagcucaugacuuucucugucugaccuugugcaagcacagccuugguuugaacucuuguacuuccugaagugcacucuguuggcuucugugacuucauguuuucucucuucucucucuuccugucucucaaguugccauugcucuccaccccagccauggaugagcuucagggcucggcguguuguccucgcuucucucugugcuuaaaugguuuuacgcaaaccaguggcuuucuuuggccacuggcuguccaccaguuuuuacccuuuugcccuucucagacccuucuuugaggaaaaggaaggugacagacguguagaccuugcucuuucucugccucaccucaguagcuccugaccucucccuugaugucacuccauuacuauccuagugaguggcauauuugucacaguuggagaagcaguuuuauacacaugaugcguaaguuaauuuuguagcaaauuuggaaauguguggucuuuggguauuaauuuuucucacugugaccucuggcacccaccaaucguuucccagccaguuugccugccuucagugugacggggcagacuggcuugcuuucauuggcacuauguagcugaaugguuuuuucuuucuuucuuuucuuuuugguggcagaucagcuccugucaggcguacauauuugcuacuguuuaugcauugaauggcuucucacagcggcuuuggggcugauaggaggaauaccauccaugauuguucagacauugcuuucuuuauguggacccaaguuugaauucuucuggcaaagugcccguucucagccucccucuguagcacaggcugcgacuguccuguaaaguggccguuuucauuuugcauucuuugccagcuguggcuaccgguucugucacuuggcgucauccccagcaucuggcagcgccagugucugcgucugucugcucacaguggcucacgguggcucacgguggcucacgguggcucuucauuguuuuaaucugcagguccccaguccacgucgcacucugucagagucuuguucucuugucucuuuggcgagcuauccauaacugcuacccaucuaaaagucauuuucucaguggcacugaagucccaguccaacgccggguccuuaccagauggccuuccuuucauggcuugaccuuucauucacccaguggugccugggagaagagaaagguuucauuuuaaugagcugugccucucuaauaugccaugaguuugguaguuauuauacaaaacaaaaaucaauaacaacaagaaaaaacuaaucuccacagcccccuguauugcuuucaauaaaguuuuaacgguugaguuuacauugacgucugugaucuauuuggaacggaaaagugaggcgagugagcaggguuuucuucuuuucuugcgguucuucucuuccugcuguaucccacccaguuguucccagcaccggguguugagagacuguuucccccucuguccgaggucucuaagcuuagcugaucuucacaccucuucucucagugucuuuucucaucagccucuaccccggaugggcaucacccugccucagccgcucccauggccuuugcucuucaugccugccuccugcuuaaacccaauuuuaaaaaaguguuuauuuuuguacaaugacaagccccaugauuuggccuuccagcuggcuugcuuaagacacgaugucuuacucccucuugucauaggggauuucugugacugggagguccccuacuccccuuuuagagcucagcuacauuuccucauguuagaaguaccuuugguuugucaucauauguaccauccaguucuccuuaacccccauccuuuguggaugggcuccuccguugggauuuuucucuauuuaaaaguacauauucuguguacugcccgacuuccugaggcccaugauguugucggucuuaucauugcuucucauuguaucuaauauaucuaauacacuuagcuugaagguaguuuaaaagugugugugugugugugugugugagagagagagagagagagagagagagagagagagagcgcuugucuauauguacaccaugaauauguaguuaacuuguggaguccagaagagggcuucagaucccuagggccuggagugacaggugguugugaacugccccugugggugcugggaacuggguugucuccaaggacagcaagugcucuucaccauugggccaucucuccagcuugaaagaauucucuuuuaaaauggaaguaaccagagccgugacuccccuaagcuccuucauuucucuaguuagugauaaaagcaguaucaguggguuuuuguuguuguuguuuuuuaagugugugcaugcuuugugugugugugugugugugugugugugugugugugugugugugaucugaauguuuucccuuucaggcuugguggcaccucaagaaagggauuggcacuuuuccauuuuucauguguucgaaagcugaagaaaguggacuuguggggaagugcccagaguaggcuuggcgggcuuggcggcagugugggaacaggaaacugggauggcuguuccugaaaagccuugugcauucagggggagcuugggaaugccacaaaccugccuagauucuguccaugccucucacugccucauuucuguuugcagggcgccacuccugccccccccaccccccccacccccccccccggggugagagaggccuuuugauuguuccugcagaaguggggaguacugggcagcgucaucagcucuuaccuuuguaguguuccuaaacuuaacucuuuggcgccuuuauauuauaggagggccuucuugcuaggaaacugugcgauaaaccguugguagucucacauuuauguagccuuugggauaaauguaucauuccagccucuuggcagucauuaggagugagucaugguuuugaaaucaucuacauuguaggucuuuguuguucuucuugcuugaauugucuuacccaguggggauguuuugugacaguugugaguuuaaugugugggccaccccucacaacugacgaaugccaaaauacauaucuagagcacaaacuauuccaaguaauaacagcgccugcggggugcccccugcagagcacagagcaggcuggagucuaguacucugccgcgcucaggcacuggcaaguuuauuuugggaaaagaugaucucuagaauugguuaacaggacccugggccucuccagcuugcuugacaacuuugaaguauuuuuuuuuucuucuugauaaaguuagagauguguuuauuuuugcgcugaagaaaacuuccgugcaaaauagcuuauuacauguuuccuaaaauuucuaauccuaaaagcaguaacuuuucccuaaguacuuguaacggaaacaucauaaguggauacuuccccaaauaugaaguucaccaucugagcguucugucaguggcaaauaagcuuggcuuauuuucccccauggaaaaugugauuguaauacuaucagacuuauuuuuucaucaguacuuuaaacgaucauaauaacaguccuguggagauaauguaguuuuaaaacacugcuugguucccacuucccguaucccguaugugcuaauaacaacuagcaaucccuuccuggauguuggggaucuagccgauacaauguaugcacauuuucuaauguaugcacauuuucuaauuagcaucccuuuccaaucgggucagcgcccugcccuaguagguggauuaggugggugguacaucagcuuccgguuuagauuguccucuccccacucagcugaaaaggucaggucacugcaaagauuguguccccugaauuguguagcuugggaacucuacuaaaaaugaauggguucauauacauuuaaacugaaauuuccaguggaaagcuaggugcuauuauuggcuccacuuuggguaucaccuucagguuuucagagaaccagauuuguauccuggauugauuuuuauuauuauuauuauuauuacuuuucucugugagucaagaguuuugccccccacuccuuuuuuuuaaaugcucaccacucauccugugcagaugugaggucuuucccacgucauucugacgucucaguacaacgcaccaaauaacgaugggugauuuuucuaaacacccaucccuguuuaacaggcuuuaaugaaaaguuuuucugaaugaaucuaaggugaguuugauuuagcacucauggcuuugguagcucaguucacacaguugagcaguccuaggagguggcacauugccucagggaucugaggcuuuaacaucgccuggcuugugccucugcuucccagggaucuuaccgcgugaauuuucucugcucugacuucaguuuucccuugcucccaauuugaaaauuauaagugucugucauuuuaagaaacuccuagccuggugagagcacaguggcuuacggcgccugccagcaagccugaagacccgaguucgaucccuggagcacacacaugguaggagagacagugccuggaaguugcccucugaccuucaaauacaaacacaaauaaagguuaaaaacauuuuuuuguuuguuuaaaagaaauaaaagccuaauauaaaugaguuuauaaagagaaauuaaauuucuccuuucagcuuuuugagcaugcaaguggguuuuuaaguuacuccuuccacguguucaaugcaaaucacugcgugauacagauauguucaagccucuauccauaaagcuuuuccacaagauguucgaggagcaacuacccccaugaacucucgaaaccuuuucuuuacagagaggguagauucagggugcuguuaagauuugugccacgugagagaaaggccuguagccuaucuuuauuaacuaauuuauuuauuuauuuuaugugcauuuuggccuugcccccguguauguuuguguggguccugccccccuggaauuguaguuauaggcagaugugagcugccguguggaugcugggaauuaaaccgaaguccucugaaaaagcaaccagugcucacuacugcugagccaucuuucccacccccuuagccugucuuuuaauucacacauuguuuuucaaguuauugauaguaagugacugguggugaacuguaggagagagaaaggggaauuuucaacuccacccucugacuaaaaugucccaaggauuccuuuguuuaaaggucuuccauaugcacaugcacaaaucuguguacguagcccacugaugggcuccugggcacaggucacacuucggcuucucaguaacuugcaucucucagugaaucaggguaauucucuagauucgcuuucuaagguuaucagagaauugccuuuugguuaaaguagaaguccuacacauacaguguauauuuaaaaggaggaauuuguuacugaguuuauaucuucaguaaaacuugccuucaacccaucaccaaguccuuuguguguuuguguuggaaacaguguugcaaaugccagaggccaagcuguguaagaaagaggucuuaagucuccugucucaucggccugccuuaacguccugaguguggugaugacaggcggcccagccagauccagaaucugugucuaauuuuuauaucccaacuucugugucucacaguugccaguacccccuggacugauacacuauugcaauuuaguuucaguagggugcuuuaaaaaaaaaaaaaagaauuuaaacagcaagucuuuccacaguguuaguaauauuuaguaaguauuuuaaaacguuaaaugagcuacauugagacuuguguggcuuuagaccaguuuguauccuuggauguuuuaauuuuuagaucugguugauggucaugcuuuuagugucuggagauggagaaugggcuuagaacuaucauuucauuggcggucagauguguuuccuauagaauucuugaagguuuggcuuucauggugcuccggugagcuggugagauuaacacgggacuugggucugacgugccauucuuccauuuucggcccggcauuaagugguccugacccuguguuccuugcaagagcuuugagaagcugcugcuuccuucauuaacagucuaacucagcccggugcccaccagcugaggggugaaagcucuguaucacagguuaccagauaacggccauuagagauccaucucacacccuggugaggccgcugggaaacagcuugggcauguguagugugaacuugugcacuauggauggaugugaggagaccugacaguggacgccaagugugcagugccaguuuauguguggauagcacaguguuaacuuauuuuucuuugguguuuuguuuuguuuuauuuuugguuuuucgagacaggguuucucuguauagcccuggcuguccuggaacucacuccguagaccaggcuggccucgaacucagaaauccgccugccucugccucccaagugcugggauuaaaggugugugccaccaccguccggcuuauuuuucuuuguuuguuuccucggaaaaaauaaagcuuacccacuagaaaccgugagcuugugaguaccuucuccacccuagcaagcuaaagcuaggcaaacacaguuuauguguuaaucucagaggcguauugucaacugucuuugaacaucccugucaaguugacugaacuuuaaauauuaaccaaaaauuauuuuccuguuuuaucugaagagcagaaaguuggguauuuacaguauguaaauagaaaggaaagcaauugucaguuucccuaaacuucaaguaccaaauucuaguauuuucuuacugcaccaaauacaucagucuauugcagauaacuggguaacgguauaauuaaaaaauugaguuuuuuuucacauacagcccuuugaaaucaaagugauuugcauauaaaaauaaauucuagccuuaccaguccauaauuuuuacuaccaucuuaaugccaugauuaagaaauagaaaucagucgggcggcgguggugcaugccuuuaaucccagcaccugggaggcagaggcaggcggauuuccgaguucgaguccagccuggucuacagagugaguucuaggacagccagggcuacacagagaaacccugucucggggggggggggggggggggaggcagggaagaaauagaaaucgggucagauagcuuuuucugaauuuuacaguguuagguuaaagcaagccccucacccauccuuggcuguggucucuaguuaagucucuaaauagaaaugaaagaaggugcugggcagugguggugcacaccuuuaaucccagcacuugggaggcagaggcagguggauuucaaggacagccuggucuacagagaaucccugucccgaaaaaacaaaaauaaaaaaauaaauagaaaaaaagaaagaaagauuccuagaaucuaaugagaagaacagucuguggauucauauuaagcccaguuauuccauuuugacagagccaguuauuguguacaggcaauuuuguguuugucuuaggagacauaaccucacuucacagccuaggcuggucuugaacuuaagagucuccugccuuaaccccuuuugugcuggaaugacaggugugugccaccacauuagguuuucggggacuucaaacuuuuuuuuuucuuuaaacuugucacugauacuccauuugugccauugggcuggaagaaaggagcuuggguuucauggaucaaggauggugcugccuacgauuccaguuuucaaaguguuuuuaguaauguuuaaugagaagggaguauuuucuuaaaguaacuaugguuuucaucauguuccugaacuugagguuuuuuggagcacagguuaauagugaaaacgauccauaaaucagacuuaauacauaggcagacaaucuuaucacgugcuguacacacacacacacacacacacacacacacacacacacacacaaacaaacacgugugugcaaauccuaagucagagagggugugauggaucugacagcugccauggucaguugcuuuuuauagcuugauuggcaugggagagcugagaaaugaggggguggccggaagaagaggggcguggcacccaacagugaagacuuggggagaggcuccagccccuuucucccuucauccuccauggugcagugugagauggaguguuucguuuucugcuuugagaugcucccguugauaguaguguugcugaaucuaagacauaaaaagagaaacgaggagcggauccugggcgagccuggcuuugagggaggaagcugcccgcuccucugccaaauucuuuccuauuggauuuuggaccggggcuuuucuaagguggcacacugaguuuuuccacaaauagaagucaaauaguauuucacuugggacguuugcuucuugugacaaggaagaauaucguuuauuugauauaaugcagccacugaguguacuucgaaaguagccuagcuguguuugcgauuggaugcucgucuggcugccguguaaauagugccugucacccuccugguacaugccugugugagccucagguccucaggaacacuuuggacauuaagagaccuuuuaaagucagacaaggagaaugaagaaaaacuguagcagagagcugguaguguugaccuauucuagugcccuccaagauucucaggcguaguaaugauguucagcaugaaacuggcuuuguuuguaauuuaauuuuuuuuuagcaguauaaauaucaaaaaucugcagaccgaguaaacauaucacuucagggacauugcauucuagcuaacauguuuaaaaaccugcuuuuagggugugagcccccuccccacccccauuguuugaaucagccucaguuucuguugcagccauucacuugaaaagcuguuguagagcaagcgcgugagaagacauuugccugcugcguguucuuguggaugcuuucuguacacgauggcaaccaucagacuacacgucaucgugccuguccuguucuccacugcagccuuuccagacagcaaacagcuucuuaguuuuuguugugcagcccaggcuggccuccugucuguccuguucuggaucuccuaggaugucaccacagcuggcucguccugucccuugacagucccuuuguuccuuaguuacccuuucauauuuaggccuuuucuacuacaaauggaauucuguaaagagugacuuugcaccugcccuuuccuaagugcauuugcauuugugugaguuaaaugcccaguggaguccccccccccccccuaguuccuuguguagcccuggcucuccuggaacucacucaguugaccucaccucacagaaauccaccugccucugccucccgacugcugggauuaaaggcgugcgccaccaccaccacccagccugagaguuguaguuuacuuagacacaaugcaugagaaucuguuuucuuacugcuguguuuuugcacgacuggaccugagcgauucagaaucgcugcacagagcgauucugacucacaugcucuuugcuaaaguucucuuuauauguguauuuuauuuguacgcugccaggauuuuuuuguugguguuggacuuuuauacaugauaugaaaaguaguaaauauuucucccuguuugacaguuggcuguuguaaguuuguuuaugguggguccuguguuuagcucaugcagagguuaugucuuuuuuuuuuauauaguaaaauuuuucaaaguucuccuccauaauuggagcucagagucaagacuuacucaaggauaaaagaaaauuauccuuuuuuuuuuuuuuuuuuggcccacuugggggccaaauugucugucaguuucugucucucuuuuccugugucucugucugacucugugucuguuuacuuuucuggcucccaguuguucuaacagccuuuagugaauaauuuauacuuuuccuucgauggucagaucauguucagagugcuaaccauggaacugcccgucaggucaacagaaugcauuguagccagaaugucccucaagagcccgacuguaagaaccguagaccuagugagucacgcucuuccuucaugaguuacacuggcuuuccuaccacacugcugggagcugcuucuugguaccugcaggagccgucuagcagccugaucucucacaaaggccuuuucuagcaaacugccaagcagaggcucggguagaagaggugggacggcuuuccacgggcugcuucauggcccugguugacucguggggacuggaauugagucuccgguaauaguuucugucaggcacuguuucuagugguuuacacaaguucaggaucaaaaggagaaugacuaaggaagcaagcguggcuuaugagauggacaagcgacaaggccuaugagacagccucucuuccaguuaguauguuccuaaugauuaccucuagguuuugacccgugaagaccucuuucacgcaucacaacaguugcaggucucuguguuccauauagcgacuaaaagguauauggcaaacauuuuuagcagugagauuuuaguugacagacacaaaaucaugugaguacauuugaaaauaggaauaaaaaggcuugugguugagguuugugguugagguuugcagagagaggccuaucaaagugccagucacacauuagaucccauccagugagccaggcuaguggggguaaaccccgugggcugaagcccacuucacagcagagaacaccaggucacuguaaggcugacggagauagagggauccugcuugauccaucacuuuuaaaccuagccuggucuggagacugggaaggccuuucugagaaauugaugccuguuuauugaaaauggcuccugaggagggcugcuaaggguuaggacugagagcaagcaaacuagcaggcagcuucagggucccuggaagagcuaauaccaacuuggacuaggagagguugacauuuacugugaauuccuaagacuuaucgauggaugcauaugauguaaaggggaauugguucugugucuagagggaacacuaagucccuuugagugcauugcucgguggggauucagaucugagccccaaguucgagggaagagucugaaaugaaggcauuggcuugggagcugccaucuuaauggugaucauuaaugcaguguaggaagcagugugacugcccaggaaguguguggagaagucugggguuagaacugcagcccgagggauggaggcugcucaggagagcuguggccaggaccacuccacuauccagauuuccuuccaggcuccaacccagucacaucucaucuguccucaguguuuaaauuagaacccaugucagcugugaaacuaucuuuuuuucuuucuuucuuuucaaaaggcuuuuuaaaaaggcacuuacaggagucagcauuugcucuuaauaauaaucaacuauacuccaacacaaaagauuuuugacuuggcaggcaguuucuugucuguuuaaaaaaagcauguguguguauuuuugcuuagcuggcucagugagugggugacuguuugcauauauagucauguuggacaacuaccaggcuggcuguguguuagaugcuagaaaucagauuuaacccuaaccuuaguguaccaacaacuuagugacaaaaauaaagggcggguggauauuguauaaaguuaacagcuucccuuucuccacucacauauaaguugaacuuuauuguuaaucccaccgccgccccacccccuuccccgugauagugacgugugcucagcuguaggaaggcagaacaccgggcagagauuuccuucauguuguuuggaaauguuugaaaguacacuugguauauacaacuuugcagguuacuacuacuacuuccuucuuccuuuuuucuccuucucuuccuccuccuccuccucccucuucuccuucuucuccuccuuccuccuuccucucuucuucuucuucuucuucuucuucuucuucuucuucuucuuccuucuucuucuucuuccuucuucuucuucuucuucuucuucuccuccuccuccuccuccuccuccucuuccuccuuccuccucccuccuuccuccuuccuucuuccuucuuccuucuucuucuucgccuuaaaaaaugucuccguuuuaucacaaauuuucuuuggaaacauuuuuaguuguuguauaaaaacaucuggacccuccagcguugccuucucuguuauguugccacguguugauuucuuucucccgcuccuugccugcgcuccccccgccucccugcaguaaugagcacuccagucugugcacuccucugcgcguuaccucaggauugcugccuugggugaauucauaggaguugaucugcuggcagaauacaaaugugucuuauggacuucaucauguuaugaagacuggcaacagcaggaacagguuccuuucagaccuuacuagguccugccaugaguuuucauuuccagggucauucuuuuuauugcuauuuuguuuccgauaacugugccagcugauggggagguagaaguaccauugacuuaauuuauauugggucuggaguugccgcaaaaauuuagagcccccuuguucaguagaccgcucuuacugauuuuuauuuuaaugcauucuuuaacaugucuuggcaagauuguuaacuugucacaccaugccuaggacgugggguguccugugugaugucaguuuuuaaggagauacucccuagaagucucucagaggaugggggcugcaugucugacucugcaucuacacuggcagagagcccaggagagacaaaggcuuuguaguaggaagugagcuugcucagggcucagaagagaguccugggugucuggagcaaagggccagcgauuuagccaacauugagaccagaggcuaaaggggcauacacagaggggaggguccagugccuugcaggagccaugcuaaggacuuuugaggggagcuaggagaggaggcaacuggcucucauguuccuuuguuuguuuuguuucuuaagauccuucuggcugcuggguuggagaugacagacaagugauccuagacgcagggagauauguuagaaagcuacuucuguugcccuggugacaagguuauacggauucauucaccucuccugcacuuuuagcuaaacgcacauugugacuaucaauagucaagauaacuaacugccagguuugccccauggaaaacuaaagcuugccaaauggaaacacuguacccagaggauugcccaagucuaaccagcuaaaccugggcaaaaaccguuugcacgucaaucucagaggcuuauugucagcugucguugaacaucccugugagauuaagcuauaaaugguauggugaauuuagaaggaugccuguauucccguuuuauauccgaagagccgaaaguugggacauuugcaguacugaaauagaaaggaaagcacuugucagcuucucccaaccucaagcaucauaugaaucacgucagagguugaaucuuuccuaguccugucguaacuucagcgcacaguagaugagcucaggguuuaaugugugcuuugcuuuguauuaucuugacaaccucauguauguaucugacuccccaggcacagggacaggccucuguacuccccguugucacaggacccauguggucccugugcuaagcauccauuaugcugaguuacauggugcucugcagacagagaugaaguuugggagaacuugugcacacagggagacuggggaggugcggcacacuuggggggggguacgagggccaggguaagacuccucccacaucguguaauccacuuauuucauuccguguugcgguucgauaggaagcaccucaccuagugaaauggaaugaaauugacauugcagggcgcugucuuuuguuucuaucaugggaccaucuugggaaacguagggcccuccuucgucucucaaaaugaagaguuuuagaguucugugacauuugcuugcuuuuaaguuggcauccaauucuugcgcuuuguaaauuugaaaaaaaaaauguaauuuucaguaagguauuuaaggucaauguaaaauaauucgguucuugauucuuucgucaugaugaugauguuuugauucgggacaguucugccugggcuuggccuuuccucccucaucugggcauugccgccguuuucucucaccggacacacucuuguguaggaugugagggucguucccuuaggucucugccuuuucuucaucuuccucugcucugcacagaugucccuaacucuucuuggccgucucucgaaggagcgugcgcucugccuccugguggccugagcccccuccaccccccacccccggucccccggugggauugcccuggucuuuuagucacccauguucaacagccuggucagcucgucagcucagacugucuucacuggccuccagccugcugguucuugagccgcagcacugggacacagcaggcagugagugcacaguccccgcaguucuauaacugccuugguggucuucuuuucguuuucucggggccuucuccauuguccucguuuagcauccacaguugagacacuugauuauuagcgagagaaacuggugaugagcuaggcucuaagaccacuuaucuccuucacagccgcagcuuccuuuacuaaaacccucucucgcagcacucagcuuagacagcauuaguggccgcuagggggcccucuugcuccuaacagagcgccuccacacagugccuucucuuguuuaucuuuucucaggaucccugcuuccucuuccccauuaagggaccacaucuugcaggcucuacccaaugagaugcccucuuccuuugaaagcacugcaugcauuuuuuuuguugugcuuuuaacaaguuccugccuaccuucgcuucuuaccacccucuuugcuuucuucaucucuaaguugggagcaguuaauacccaccucugggcuauugugaggacuaaguauguuaauauauguuuaaaagacuuuggcuugcugauaguccagcuuucggccucugcuucccaucguuggggucacagauacccaccaccaacuucagcuuuuucccugggugcuggaggucaaacagucugucccugugcugguuuuuuuuuuuuuuuuuuugguuuuguuuuguuuuguuuuuguuuuuguuuuuuuuuaagugggugcaggagauaugaacuccaguccucuccugcuugugcagcaagcauuauauugauugaaauaucuuccuagcuccauuaauacauguuaagauuaaaaauccgccccuaaguaccuccaggacggggcauguuuuaaucguucugugacuagccccauagaaucuagcauggugucuuaaacguaguuggcacuuccugaaguaccuuuugaaucaaauugaaguuuauaaaaaagccgaguuauccaauaacagccaaagucuuuuaaccauauauuaacuuacuuagucuucacaauagcccagagaugaguacugaaaugugcgaaggguguuuugaaaugcgguccuuuaagccagcacaaggcaguuucaucagucaaagugaggucacugaaaaaacuuucugggaucguuuaacaaagagcaugugguuuccuuguuuaauuauaugguuuggauaaaacaagccuaaugucguuuuaacaaaaauacacauuuuaaccgaaaccauacaaagaugacgacuauggagccccuggaugccagaacagcacauaguuuuaauacuuggagaacauagucaaucguucggcggccucuguuggagacagccuucugcaugccuauaugcagagcacagcugcccaggagcaguguggaacugucucccgguacaaggguucucagcucccucgcaugcucaugcauuucgcuagcaaauucaacuaggguguuuaagaagggguguugaagauuaagguuugcugcuggccuccauguuaaaucucggacgguuuaaacauaugaugucaguuuggguaucaguuuuauuuuccaugaucuugauugaaggaaugauagccauuaucacuggggcaaaugauacccucauuucacuuuagauuauuuuucauccguucacugaagacuuuaaauggaaaguuucuggaagcuuuaaaaguaccuaacggguuaaaauaaugcuaauaauucuucucuuggagaagacuuuuauccuaguaagcaaagccggauugaauggccugagcugguuuuauuccccuggacaauaucagguuacaauguauacccucuuccaggcuggaggucuuccauguguuuggaaguacugguaggaagcaccagcaggggcucuguuuuaccuuggcugggauuccugcaugaaguccaggcauauuaacuggcaugcuugacaggguugucucucuauaggaaugcaagcucuguuuuguccggacaguauuagcguauuuuuaguggugaagugucucaaguguuucuaauugaaauaaaaagcagaaacagccaggaauucugagguuggguuugaguagcucaaguggagggagggagaggaucgagugaccgugaugggauacuuacgacccacauuaucaguggccagcuuugcuuccgugucaccugucuauaccgccuuugucucagaguaaagaugucucuacagcaaaugcuccgguuugcucugcauuagaguuggaaauaccgaaaaaaaaauuuauguuguagauuauaucuucaccccuucuuuucucaaacugacgacaucuugggccucgggaugauuuacaaaccuauuagcaacgacagcucugugaaaauucaaagguauuugcguauggcuucuuguacuuuggguagagaccauuuauuuucucccuuuuucuaccaaguuuacuuagguuuauagauuccaagaauggagccccagcagacuucuaggggcuccaucuuuauguccucugcuuuaaucuguaucuuggggguaccugcccgggagcagagcuagcagccuucauccuaggcuuagauaacuugagaaguaccgguuauggacguuugcauuguaaggcuguccagagugcucccugugcuaauaggguccuguggcugacuuucccaaggcguguuugugcugugcgagcugugcccgcccgcccgccugccuagucucacuuuccucuguuuaucacugucuuacaacugcaguuagucacaaugaucaaucaggcaaaugcugaacaccuuugguaagcccacuacugcagggguccaggggaaguugucuguggucuuuaguuuacaugccugguguugcacugugaaucacugaaauuaauuuauaaauauuugaaaagggcagguuuuuaagguauaggccagagaaaaucgccauguggaggaaggguucauaguagcagaguggccugacuauaguagcaagggucguggagccaggcucaaucugcauauugguuccaugaugugcuagcaaggugagcuuggucggguaacucgauuccagucuccguuuacuuggcugucaagugggaacagagcagucugccugcuggauuucuuuacugaaguuucuugagaaguuugauggcgucugugugaauggguugaccuuuguuucaugguccuagaauggcacuacuuaaggacuguccucggguggugggaaaaccaccucucagucuucugcaugcaguaguuuggugaaaagccuuaguuaagagguaaauaaguuaacauauuauaaaccauguagguguagugcuuaucaucuuaacuguuacuggacucgguuuugucucugcaaagcauauaaucuuuccagguuaauaugcucaauacucccauucccuacuuuccagauuucccaauuccaugcccgugagacucaguuugucuccuaggcacucggugcgggcaguggcagcuuaagucccuucccuggcgaguuaggaccacugugugacuuccaucuacccccugccuccaauucuugguuuagauucaggauucuguuguuuugggguuuuuuuguuuguuuguuuguuuuguuuuguuuuuugcuuuucuaccuauuguguuuuacucccuuccuagcuuggguguucuggguuacacugcuggucuucucauucaucccauuuguguuaucaacuuuaaaagucugaaauuauccuaagaccaacuuucaaaggaaaacaaaaccgaaucccuuagauuucaaccccaguuacuacccauuccacuccucacgauguacaugaacuaucguccuguaauuuuagauuuguauuuagucauucuacaaguuugauguuacccacgcaacaguugcauuuuccuuuauuccaaugauuugucaacuguaccuucugauucauaccuuucuaauuggguuggcuuacuuuucuuaaugagauguuuuagauguuucacagcaacaaauggcaggaagauuucauuuugcauccucucuguuucacucucuugaaguauucaguccccgggucccccacucuggcuuugaaagugacccucauuagcuagucuuucugaaccagugguauguuuuugaaaugucuccuaggaaaacuaauaagaaaucuaguauuuacuacauacggcuuugaggguuuuuguuuuguuuuguuuuguuuuuuaauugagaagaccacuccuauuggcagaauuguuggacggugaaaggccgaaauaacucaaucggcuguaaaugucaggacggccgccccugcuguauuuggaacauuacuuaaaaccuucuuacaaguauguguaugucuaggucgugccaacaucucuggaucauguccaccgucacugccucccgccacgacuccccaggaucccucccucauaucuccgaguccauuccuuccuuucauaauuuuuuaaugaacguacguuuuugaaaaccaucgaguccagcuagcgccauccaugugugcacaagugugggcucauccacuggagaaugcggcuccucaccagugaccauccuagagaaagcggcucucccaaggcaguagcugcuucacuaggggcggggccucgggagccccucccaccucucgccggccuucugaucuggcucgaccuugugcagauugaguguucaagcgugcagcagccacaucgugaccggagacucugcccugcgaucuguccuuacauccuuuccuccuugugucccguucauggcugagggcucgugguagcuucuuagcggcacugugaacagucaggcauagaugcuucucugacuaagguugggagccacgccaggcuauggauagaaauguuuagaaggcaguuugguaaagugaucauguagaaaaacaacaguaacaacagauaccaguagauucuuccuggccuguuacaucccuagauaaggauuuugccuaggucuauaguaucaaguaugaacucccuccuguggagcaugccagcaucagucaggauugcuguugcuuacccugauagacagucuuguggcuacacccccacuugauagucuuuccugacaagcgcuacuguagcaagugaggguccagcacugaagucagggcacugaugucuuucucuggcugcaguccgccuugccccuucagcacugugacagcagggacuuuccgggcaguuucagauugaucugcguccuguggaguuucugcagcacgcuaucgcugcagagcuauuguagguagguaggagcggugacgggagccugugcugccuugggugucucugagaccugucugacaguaacacucggggaggagauuccugccuaccacugaaauuuucguuuaguaauucauguccuucugggaacagcaauuacaaauguaggguacuucuguucaaacucucccuuggaaaaagauuauauuuucagugugguuaccaacuagugggguuucagaugggcuucuacgaaaaugagaaugcugagaacuaaacguuuaagcaggaauggggaggggaugggagagggcuuagcuuuuguuuaguauucuguuuauauuacuucccccccccccagcaaacuuguacuuggaauguuacuuaaaaccuuacaaguauguguaugucuaggucgugccaacgucucuggaucacguccaccaucacugccucccacuacgacuccuuaaugacaaacaggcagagcucccauucucuuaaguuuuauuuucuguccgucguccugugaugucauguaaguggagcaccaugugucuucugugguuucaagacacauaccccauggugagcagccucuguugacuuacagugccgugggaggcaccccucagccagugucaguguggugcaguagcagucaacaacuggacuaacuucuagaaugguguguaguugccucaugcuaucaacauuccguuguguuugcugugauuauuacaggcuuagccauuucugucauuagcugccuuuccauccuagacuaacaagaaagaaaugcucaggcacauuucuugccacagaccaacuaaaguucugugcacgucuacaucaguuggaagcucuugggauggguuaguggggcaggggacgaggacugugugguauacucugcagcuugcaaaugaucauguucugcauagucccauguagaaaugaaauucuuauagaaggaacugguuucaaagaagauguuagcauuucuggaauugacgggagcuaucuuccgccugugaggcugaguugagggcgcuucagugcauucaugcacuuucggcuuuaccugcucauacucucuccguucuuacuccauuuuacucuacauguacuuuaaauuuaaaguuuagguuaacagaguaaggucucaucacggccuuuucacacacagauggcuuucuacucuaggcauugcuuuuuuaaacguggagcuuuguggcagcauauuucuuauauuuaacauuuccuaauuuuuuuuauuaaagcaaugcaucuuaaaaauagcuguaauggguguauaaagugccuguguauucagaguaaugaaagcaauguccuaaaaauuacaaaguauuacauaaauaaaaucauuagguagcagggguucuacauauagaaauaaguuguaggauauggaaggcauucuaauaggacaugguguguuggcgccaccugcugucuuguaggcauaauuucuucuugguguacaucuggaucuguuuuuuuuuuuguuuuuguuuuuuguuuuccccugaagccuugucccauagcuggggcauugcuguggggacuuucauuuagucucugcuguguggaaucuggguguuuggcuguucuaacgacagugucuguuccagguuagccaguguuuggaagucugacuucagaguaguccgaggaauguucuugauagcuuuaaaacuuacugaucaugcuaccguucacacuucuugguuuaaaacacucaaauugaucauggugacaaagacuacuggauuaaaacgggcugagcgagguuauuucgaguuucuugaguucauuugcugccuuuuucacuucucauauucagcauuucuggguccuuccauauacuuugguuuagagaaauaaucucaaauucucaggcuaaccaaacuucgguauguuaacauacaauuuauguaagauuuuguuagcuuguucuagccuuuuuaaaccucaagguuagcuacauuuuguuucuuguguuucuuaacacauuuuguaguuuuauucuacaugaaaacuuauuguugcuaccuugguguacaggucugcccaguauugagugcacaguaauuaugggggagcugugucuaaaguuauaguuguuauuuuauuguuuuagaauuuaacuucuuaaaaaaaaaaagauuuguuuauuuaugaguacacuguugcuguucucagauacaccagaagagggcaucagaucccauuacgguugggguugguugcaagcuaccaagugguuucugggaauugaacucaggaccuauggaagagcaguuagugcuccuaacugcugagcuauuucuccagcccccagaacuuaauuucuuuuuucuuucucucucucucucucucucucucucucucucuccucucucucucucucuuuuuucugagacaggguuucucuguguagccuuggcuauccuggaacccacuuuguagaccaggcuggccucgaacuaagaaauccaccugccucugccucccaagugcugggauuaaaggugugcgccaccacugccuggcuagugauguuauuuuuauucuccaucuuagaaaauacauuagaaugauuuuaacuuuaacuuugauuggucaaugaugauuaauuucuuaguaagauguguuuaggauaauuuuuuuuaauuauuuauuuauuauaucuaaguacacuguaguacacuucagacacaccagaaguggguaucagaucucauuacagaugguugugagccaccauguaguugcugggauuugaacucaggaccuucagaagagcagucagugcucuuaacugcugagccaucucuccagccugaaaagucuauuuuuaugcuagcuuuaauuauuaaguauuaagcgauuauacuuuaacauuggcuauguuuuuaaacuuaaggauuaucucugaguagaaggccucuauuauuuguuuuuacauguguuuauuuuuaucuuuuuuuaaaauuuauuuuauguauaugaguacaccauugcucucuucagauaccagaagagggcaucagaccccauuacagaugguugugagccaccaugugggaguuuggaguugaacucaguaccucuggaagagcagucagugcucuuaacugcugagccaucucuccagcccccaugcggcuucuuuagugggucucacuauagccuaggcugaucuagaacuuuauggucuguccgccucaaucuuccaaguguuuggggcuauaggugugcaguacucaccaacagcauuuauucacaauggucgaugugucgagucauguaguuacgaauacucuuuuguaauaaauauguagcgaggagauggcaccaaguuugcuacauagacacaagaaccugaguuguguuucccagcacccacauaaaagcuuagaggguggagauggccagauccaaaacagugagcuccaggcucagugacccugucucaaagaauaagguggagagugguggggaaacagguaguguugaugucuguccuccccacgacaugcgcagggagaacauaccugugcauacugcacacauacauacauaccucccccacacgcauacuguauucacacauacauaccacaaauacacacauaucaaacacacaauuaaaauauaaaaguaaaauacuagcgcacacgaucauugcuuuugcauauugacgauuuuuagauaaucaacaaaaaaaggagagucaacuuuaauaguuaccuacauauauuauguuacaaauuuauacuuuguccacggacguagagcuaacacuuguguuuucugaggcgauuuugaugguuugguccuuggguucuuggaaagaagcugcacccguggcuuuacgguucgcguacgguuugcuucugugguugcugaaguaggagcuggguggacaucagugccucguuuccuguuacaccagugaucacaucgugguugaguuugaaaacccuaaaucuguuuugcccucaagcucuguuagaauauuaauuuucagugacuguaugaucuauguuuugguggcaauugucaucaucggcuuauuugggacacuggguccuuuucccuccucccuccucccucuucucuccucccuccuccauucuuuccucuuccuccuuucuucccucucuccuucccucaacuucucccuucccucuuccugucagcucuuuucucuuuucuuucucccuccuccccuccucuuucccuccucccuucuuuacuucccuccucccuccucucucuccuccuuccucccuccucuguccucccuccuauucucccucuucaugucuuccuucccacccuccuuuccuccuaaucuuuucuccucccuccuucccuguuagauuuucuccuccccaagucuuccuucauuccuaaauccuuuugcuguuuaccacuaguuuuccucucgccauacaaacacauuucaaggccugcggaaacucucacugaaucucucugaggucuaggguuggguagauauggucaacagaggucauaacgguuaacucggaaagccccaugacaaucuccugugccccuuaacccuuugaaaugggguaaauaccucuaccauguaucauggcauuuuuuuacucuuucugucauagugugucaccauaaauaaauuaggcugcuuccccuuuaaguagaaacugccucgagggucagauggaacuugagaacuuucaucugaagcacuuguuggucccccaggagugucaguuggaccugguguggggagcgggggcaaaggcaggcuuggaggacggccaccauuguauacaugaagccuguacugugaucuagagauaagagcguugugaguacuaacuguggcucuaguaagggaugaacuggcuccccacccccacucccccacacacugguuuuuaccuggggaggcaguuggcugcuguccucuuggagguuggcauuaaguccaguucagccauuuuguuuucuuuuucuuaguuaggaaaucuuuuuuuuuuuuaauuaucuauuuauuuuguuguagcuuaucaaaagacccucacucacaaagaccacagaaauugccaucguugcaaaacgcaugaggaauuuacuuauccaacagguuggggaacccccucucagcacgcaggcuggaggagagacccagaacaaagaaaggacacacuuuuuauaacucuguaagggccagauauaggcaccaguuuagucuggcuuauuuuaauugguguagccaauaaccuuuuuagauacugguugguuuguggagggugacucucauuuugucuguccuugagguuuuuaguaugaggcgggacaaaggaauuguuaaucuuguuuuggaagcuuaguaauuuugaccguuaaaacuauguuucuauauuuguuuagucagccagcuuuuuuaucugacucuguacuuggccugcuaguacaguuuggaaaguccuuuugaagggggaagguacuggguagucuugaauuuauuuuggauauuacaauuucauauauaugaguacacuguagcuguauaaaugguugugauccuucauauggcuguugggaauugaaauuuuaggucaaccccacuugcucugguugcuauggcccaaagacuuauuauuuauuauuauacauaaguacacuguagcugucuucagacacaccagaagagggugucagaucuuauugugggugguugugagccaccauguaguugcugagauuugaacucaggaucuucagaagagcagucagugcucuuacccacugagccaucucgccagcccuaguuaggaaaucuuaagagcuacuuuaaaaauacuuggaggacuggauggcgauggugacaagaggagucuuuugcuucaguuggcagauaaauuacaugagauucuuucuaaagccuagcgugacgguacaaggucaugagcaaguccagcagcuuggaagcaggggcagggggauagggagaugugaacaguuuguucuccauagaguucccaaccagcaagugccauccagugagaccuucccucccucuuuccuccuccucucccucccucccuuucuccccucccccccuuuuuuuguuaaaggcaggcucucucacugucuagcucuccuugcuauguagaccaggcuggccucaaauuacagagcuccaccugccucuaaaccccuagcacuuugacuaaaggugugugcuaccacacccagaguaagacuuuagaaagaaagaaaggaaggaaggaagggagggagggagggagggagggagggagggagggagggagagagagagagagagagagagagagagagagagagagagagagagaaagagaaagagaaagagaaagagaaagagagaaaagaaauugaguugaauagcacaguuagcucuuaacuuugauaccagagcuuaaaccauuuugaauuauuaauaccauacucggaggguaacuguggcuccucauguuuucguucuuaagacccggugcuuagauguuugcuguguguguguggguaagagggaaagagacacagauauaccauuguaugccauuggugcugaggggcugaggggcugaagggccggacaggaagguggggggagacucugacucagcaugaggaaugcugacucauccugaggaaugcuggcucacaacgggagagagaagccuuucucuggagauuuggagauagucaguuuuccaguuuccuucagauggaauuguagagcagaaaaaaaaaguaaugaucucccugcuucucgccuacaaguuuuguuuuguuguuugugaagaacaaaacagaacaaaggaaaacacuucgccaaaagauggaauccuuaucugaaaaaaaagacguuuggaacagauucuccauuuuugucucuguagcuuuuguccauccuguccagguuuaauaacuaaauccuuggaagcaggaaguacauuagcacuguucuaagaguuugucagucccuuaggccguaggauuauuuccuccccaagguggacacgcagacuguuauaggaacccggaaaggaccagacccagggccaucggaagcucuguggaucgcacugagccacauucacaaggaguuucuguaaccuggcagcccauguucucacaagagccacggcuaacccucagcgucaaaggaggcuguguuuccccaaaggcuacugcuuucugaaaaauccaugacugcagcagguacucggaaaaagucaaugguuuuuucugucuuuuauucgcuauuuuagaccaggcucuuuuguggcaguuuguuaucaagaaguaaugaguagauucuucugagaguuuggacucauugcagucuaauuaugaaauaguaaagauuguauaggaauucuccuucauaggguaaaauugguccaguggugcuguuggugggcaguggaguugccguguuguguucauuaagcauaggugguggcuauuguaacuaagaggggaugagaccccaaguuuauuccacuaucuacgggagcaauucugcucaugucuaaagagaaacuuuaguuuugauuccaaaugauuucacuaaauaaaacauuaauaacaaccaguugaaugaaugcuaguggaccucuccacuaauauuuaauguuuuagaauggauauguuaucuugauuacuguuuuuuaauaucuaguauauuuuaguacauuuagcucggagguuguaauucugcauguguuccacaagguggcaggcuuguauguuuguagguucccuuugguuccgugcagagcaagcucgugguuaugcagaaaucaaaguuuuucuguuaaauguuaacuguuuuauauagcagagcuuuacaguuuaacuuuuaugauggaaugcucucugagccucaucccaggcuuuccuggugucuuaaacgguacaauguagugugguuguuaucaggaaacccucuagauagcagugacugcguagacuaaggacuaagauggagcagugagggguggaagggaagggauagaggcccuggcaagggcaugcaccugggcaguuaaacgcugccugauuccaucuugcuuuuuuuuuuuuuuuccuuuauuugcguuaguuuuccuauuaauaaugccaagugcuggucucuagucuagugugauagaacauggcugcuuucugcaaaauuaaauagcacacaguggcaggccagcccugccuucucucagggguuuugucauaucgguugaggggaggaaggcacugugacgucuugaguuuuauuuaucacaggccacuguggcaaggugacacaccguggugcugggagaggcguccuguagauguaaggucucaucuaaaguaugcuaaggggucuuuccugcaguccuugagccucucguguguagacaguuuguuuggaggagaugacacggaguacggggguggcucacacugaguuuggcuguucaaagcaguuugugguucuggugacacagcauuggguaagucgucugucuccuggaccagaacauuaguguucaucaaagcuucgcucuucccugcuuccgggucuguggugguuuugugagucuguacgguagccaaguugucuacugacguuguuccugccauuaguuauuugcauguuuuuccagucuuaauguaauuuauaggugcuggagagauggcucagcgguuaagagcccugacugcucuuccagagguccugaguucaauucccagcaaccacauuguggcucacaaccaucuguaaugggaucugaugcccucuucugcugugucugaagacagugacaguguacucauacauaaaauaaguaauucuuuaaaaaaauaaagguaauacauagaauucacuggcccaagauuaagauccuaucugugguuucaugagcgcugagagagcaguggcuaagguacugaugauucaaggcagcccucugcuuuucugggucucuguaaugucccaacacuggcucugcuguggauuuuacacauggcugcaguaguuaucaagucaugggaguguuucccccaguguugcacuggcugcacugucucuuacacgcacacuauagagaagccaccagccguuaugcaggagcuacguuuugccugaccauggaccauggacacuugagccucucuucccagcuuucccuaguagcaggacucuuaaccuuguggugggcagguguguagauacggaggcuaggugcuuaaaauauauggauagcuuuaucucauaacuauaaaauguaaacauuuuccuuuuagcuagguauuauaugcuuuugaguaauugguccacugccuuaguagacuguaauccuguaacuuauccuuacacuaacuuuagacuuggcugaaaaucuuggggccucuagggcagaauuuuguaaagcuaacuuuacacugugaaacgaaucagguucaggauauagcuguguuuagaacacguuauccaacgauguagcucaucugagauaguagggaaucugacauuuacuucuaacauugcgaguaucuuauuauaaggacucaauguguuagccuacacaccuaaguaauuuuuguuaucuuuaauauagcuuaaaauccacuuguuuuuaaugaaggaauuuugucagaaugaauugcuguugaaugucuaauaaagaaguugagcugggugcagacugagucccaggcuucagacuggaaggcugcccuguagguguccacagucgcucgagggcuugcagcaaagcaggcugcagggauacauaggccugcguuccccugcaucccccuagagcacgggguaacgcugaucuagaagccuugcuguauaaggcuguggcagggugguggcagggcuugccaggcgagguuaaggaaaagaauguuaaguagaauuuauuauuauuuggggugagucaggaacagaacacuuaagcagaagccaguuuugugauuguauccuucgauguauagaaaucuuuuaauuaauuucauacauguacugaggaaacuggauugcuuucaguacuaaccaaauucucuccagaaaguccuugccuauucucguaucuagagcuguguucccugugguuuuguguaacagagucaguuucgagucauacguuacagucauuuaucaguuuugaauugauguguguguguguguguguguguguguguguguguaugaguaugaggaaugggggcggggggagggaaaggggcuggaguuagggauugguuuaauucuuuuucauguggauauccuauuucuuccuauuucuuccagaaucuucuauuaaaagcucuguguuuccccacuagaugcuucugacagcuuugccaacacugguugguuguagcugcuguccccuaaaugaguggcauuguaacugugucuucagcaguucaucccaucugucugucaggccagcuacuucagggggguggggagcaugggaaggcgggugggccacuguggcacugcucuggucagaagcaauaccguguagcgugcugugaugguggagaaggaaggcauucugucaguccuccgguggugguuuuggcaaaagcgucacauucaggaauggcaaauggcauaagcagaguagaucucuacuccagcaaggacaagguguuuuccuucccguggaggaagccauccagugugguccuucacugauuugccuuuguugaucucuguauucccuagaaggaagccacuguggucaugguagcugugaucuuacuguuuccugaaaauugguuugcaaguacuuauugaaauuuugugugugcuauuguucaucuggauucuugaugugugucugugugguguguguauggugugugugugugugucugucugugguguguguguggggggguugcuugagcgcauaaucgagcaucuauguguguccccauccuuaucugguuuugauagcacaauaguaguggcuuccuagaagcggcuuugguagaguucccuguaauguagugaaguccucaggcccccuucaggucaagggacuuugcccuaauggaauuguuugcagacccucaguuagcucucaguuuauuaaaagugguaaaagcagugagagccuccaagccuggacugucuuucuguugcucuuucaguaucauugcuuguugcggaucugcucagcuugcuggugcccacugacuugaguuuuuggucggcgcucuguacuucagcaucuccauuucuuccauaaauuuguuuguuuguuuguuauaauuuucaaaacacuagugcucauuugcauuccauuugaauuuacuggaauuugaucucagcuauucauuuaggucuuucuuucccuugguuagucaggauaaaagguuguuaauuuuauguuucucaaagaaccaacguguucgcauuucuucaggcuucuggcuccaucguucuuucuuucuguccacagcuuugggguuggacuucuucuuguuuucuaagaccuggaaguccaucauuaauuuauugacuugggaccucuccaguuauuuuuuuaauuuuauuuauuuauuuauuuauuuauuuaugugugucugucuaugugcgcaugccacagaacacacagaggucaaaggguaacuugcugcagugcccucugccuucuccuuagaccaugccagcucuaggggacaaauucaggucaccugccuggccagcaaguaccuucaccugccugccagcucccugccuccaccccuccccaccccaccccaccccucccuccaccugauuuuuuuuuuuuuuaauguaaguacuuagaacuaugaccuuucaucuuggagcugccucagcuacaagccagagcuaagucaugcuuucauuuucacuugauuauuagaaccucaaaaucuuccuuuugauuuaaugacuguucuagacaauauuguucaaucuccaaguauuuguguggcuauugugguuucucuuacugcuaaauccaagucuuguuccacugugaucugauucgagacaaggaaccauuucaggggagugugugugugugugugugugguguguguguguggguguguguguguguguguguguugugugucuguguguggugugugucuguguguguggugugugucuguggggggggugugugugugguguguguguguguguguggugugugugugguguguguguguggugugugugugugguguguguguguggugugugugguguguguguguguguguguggugugugugugugugugugguauguauguguguguggugugugguguguguguguguguguguggugugugugugugugguguggugugguguggugugugugugugugugugguguguguguguguguguguguguguagucucauugugaccuaaaaugugaugcauuuuggagaaagcuccggaacuacugagaagaaggucuucugcagccuugggcgcaguguucugguaaauacaucagugcuguagaucaacccaaguuucuucauuggcuuuuagucuggacgacuucuugaugagaauggguuguuccugucggaaucuaucugcccuuuauuucuguccacuggugaaucugccuucguuacuuuucugauuuugucuagacguuuccuuucuaagguauccagccuugauguguaucugugugguguguguauggugugugugugcgugcgcuggauugcuugcuaauuuaggcuuccauuugcuuaguaaacugacuucgugcuuucagucuuugucuaggagacccuuucccgugagacagcagcuaguuggauuuuguccuuucaacuaaguuucaucuuucaauuuacauuuaggaauguuauuagagauguuuguuaauuccuuuaauuuuuuuauuuaaacaauuuuuauuagauauuuucuucauuuacaauucaaaugcuaucccgaaaguccccuauacccuccccccgcccugcuccccaccccacccacucccacuuucuggcccuggcauuccccugaacuggggcauaugaucuuugcaagaccaagagccucuucucccaauaauggccgauuaggccaucuucugcuacauaugcaacuagagacaugagcucuggggguacuggauaguucauauugcuguuccuccuacaggguugcagaccccuucagcuccuugggugcuuucucuagcuccuccauugggggcucuguguuccauccaauagaugacugugagcauccacuucuguauuugccaggcacuggcauagccugacacgaaacagcuauaucagggucaugucagcaaauucuugcuggcguaugcaacugucugcguuugguggcugauuaugggauggcuccccggguggggcagucucugcaugguccuuccuuccgucucaguuccaaacuuugucucuguaacucccuccaugggucuuuuguuccccauucuaaggagggacgaaguauccacacuuuggucuuccuucuucuugaguuucauguguuuugcaaauuguuaucuuggguauucuaaguuucugggcuaauauccacuuaucagugaauuccuuuaauuuuguuaauuguuucucugcuugguuagagaauuaagucuuuuucucuucccuuauauucacauauaaguguguugcacaugauuuuuuuuuucuuuuuaguuuauaacauuuguuccuucuuguagucucuugguuaagacugucuuucagaauuccccagcacaaaaagccaauguggcugugauuacuuggagccccggcauuagguaaacagacagguggcuggagagcucacucgagagccagccucuuuagccuaagugggagaccguuacccaaaaguuauuuacuuuugggacuugaaguacagcgccacacuuugcugaguuguaauguuuugggugagaaaccugaugcucuuggugugcuuguuuucccaggugaguugagcugguuggcugauuuguuuguuuucuucgguguuuucaaugcuguuucuuaguuuggugcguuuggcaucuugacuggugugugauggagagguucgucuuuggccauaccuguuuaggauucucaauucuucugggcccuagaugucuguucuuuugcagacuucagaaaugccugggauuuucuuggguggauuucuguuccuuuagcuuuucucucagcuccuuguucuaucccgugggcucuuagauguguucucuagaucuuauugggguucuugggacucaugaucacauccuccuccuuacugauguaugcaugaaguauuuacugguaaccuuugucucuugguccauccguuggcuuuuauuugauucauggccuuuuuauuccccaaauuucuuauuuguccuucagaauuuuuguuucuggacugaauuuguguuacauguugccgucuuguuugcuggguuuugcccuauuccuaaguugcugguuuuccucacucacuuggccauguacucacuguguugcuggcuuucugcuccagguccugaacugauugcucuguuacucucauuuguuuguggggugggugucguuucacauuuuacaaauagaguugaagucuucauccucccguuuuccccaggccuguaucugcggucaggggcuggaucuguuggagaagucacgugcugugccuacuuguguuguguaggucccugcucugcggcuuguccaucuguugguuauuuggggcucuuuuuaccaucaguuuacucuugaggguaaauccccgguaccccgcagccaggggccaacacugugacugcugugccaccaccaagcugagcaggauacggaaugaacuuaggauugauuacaagccggaaaucauuaccaacggcugugaaacagaaccaugaagucaacauagaugggacuggggagguagcaauucauuccccagggugaguguagagaugauggcucugaguaagaaagacaugaaaggaaggaaggaaggaaggaaggaaggaaggaaggaaggaaggaagaaagaaagaaagaaagaaagaaagaaagaaagaaagaaagaaagaaagaaagaaagaaagaaagaaagaaagaaagaaagaaggaagaaaguaaguaccgcgaaggguuagggugcgguggagacugcggugcuggggauuggagacuucagugcaugcaguagggaagaggcgggcgcagagccuagccuguguggggugugugauauccuagagcugccuucccuuucgaagcuuuccuuccuugccugugaggggccucugcuaguccuccuuagcuguguucuauguggaccgggcggggaccccccaguucuagcccccuguuguggcaaguuguugcuuugaggugucuuuccaaaugugaagggagugggagagaguguagccgugagauucucaugcacaugacccgccuuuguaaaucuugaaagugaaagcguacuuuuaacccuaaucaccaggcugugcuggucugguguuccacgggagcccccgaguucccaggccucacagccgggagccucgaagcaggaggguggcuucagagguugaucuaccugacaaccucaggcccaggaccguccagcuccagagcugaugcccguugauaaaaaucugcucuuuggcaacaacgguaggcuaccuuuccccgacgcuucacugccugugccgagcuuccgccuuugguacggcagugucaggccuucccugccacgacugccuuuccugccugucucccccgauggggcuggggggcuugaacucggaaucccuggcucaggauuguucucauucuugggcaccagggaggggaucuguauguugccccucaagauggcuccugccggaguccucugaucacagaaggccaaaugggauuccuggccucugcugacuugccagacagagcagauacugucucaucaaugccggggcaggacgggagguuuuggagagcugugggccauacggccuuucugucuugcggagccuugggcucacccugugguuaggacugcugucucaucgcugugacuggcuuacuuaccuuuuggguaaggcuucucuacccauccccagccagugagcuccagcuggauccuguuuauuagcuuuuuagccuggcuucacaccagcaaaucaccugggaagccaacuccacaccgggaaauuggaaucugagggucagggucagggucagguucgagcaucuguguuuuauaaaagcugccugcuuguuuguagaguucagccacaguuaagagccaccacucagccguagcccuuccguuaggcagagacugugucacuguuaggugacuagagcuuccuacucugccaagaucuguguggguaaggagagagcucaugacaaaggcuuuaagguaaggcgaaaggucacuuaacccggcuugguucagggauucacucccucccucccugccuuccugcuggagucuguugggugagcuguucccacauugagugaaggccuuuaacguuuacuguucacacuguaaaaauaaggcagccgcucaaaagagcugccuuguaaccagagcaccugguagauacaaagcugguuccggcucccucuagcugcgaacucugaggguugauauaaaagcugcccaaaagagcagaguggcaugcugguggcguugugaugggcagggguggcagguggcccugaugcaguagagagagaagcuugaaguucggggcuccaggccugaugcagcacagagagaagcuugaaguucagggcuccaggccugaugcaguacagagagaagcuugaaguucggggcuccaggccugaugcagcacagagagaagcuugaaguucagggcuccaggccugaugcaguacagagagaagcuugaaguucagggcuccaggccugaugcagcacagagagaagggggcucagggccaguaggcugaggggagguugaguagauggcggugaaaccugguaaggacuccugguggcuuggcuugacuccaagcuugguuggauacaguggaagcacuguguucagugucugcugcucacucagugacugcugcacacugcucucucuugggcugccagggaaagaccgugccaggguuucuaaaacucuuggcacuuucagccccuacccuggagagagguuuauguggcccuagguauaauauauucauaucauucugaaauccucuaaucaaaagccacacaucaaaaugguugcucuaugccaucugcagaggaaccaaucuccccgucacgggauucagcaguugauugcuuuugcucugaccaagccuuaguggacagccucgccccuuccacuuguaaaacugaauccacuucuaacucagagucugguacgaucagccacagaccugcagcucaucugggccgcucuucugcagaccugcuuuggugacagaguaaauguuaaacuugaguuuuuacaguuaggguucagauuagcuuagaugagggaggacuaaaagguaacuaagagcgcucucucucucucucucucucucucucucucucucucucucacacacacacacacacacacacacacacacacacacgccucagucucacuacguagcucaggcuggcuucgaccuuugguggcaauccuguuagcagcccuccuguuucggccucccaaguacugaggacaggugcauaccaccaugucuggcuaagugaucucucuuacaaauuuuuaaauguucgaguucauaaguacaccuaaaauuuagauuaaaauuaugcauuaacuugcaacauuuuacuuuucucagguaaacagguguuuuuaauuucuaagaaucuuuaccaacugacauugucucuuugcccuguuuuccuuucuuuagguuugagggguuguguguaugguguguguaccuggggcaugcuuuucugugcucauuuugaugugcagauagagccuguaucaagcacugacaggcacuuggacggguguuccaggugcgccuuguagguccgaguggugagcucuggaguuguauaucuccguguaucuugggauugccuaagguucuccuuaaugccguguaaagcgguguucuucugcauuacacagguuaaaacguuuuugaguuccuacgaaugauuucuggugaaagcuuuuuaggguaagucuauuuuacccccaugguuuauucugggcagacggucuguuaucuuucuggagaacauacauucgcucuacuagaggagaaccucgaaggacaucucgcuucaggagagggcacggaguccauguagccuugacagaagccaagagaacugcagcauaguauaggaugucagcuaaguguuaggaaagugagaguguucugguugagcuguaaaauaaagaugcuaagacucggccuggagcuacuguggaagccagcaucaggcuuccgcuucacuaaacuccugagucagcuggacaguuagguaacgauccgguguuuagaaagggguaacacauuguaaaacgguggauguuauaguugagaaaaaguugguugguaauuuacaauaauuuugaguauugggcacucucaagaaacuuucuacuuucaaaacuauguaaagaaauguguaggucucuuaaauagcuccaauuaccgcagaagccagauaacuuagggcacaagaucauggcuggaauuccuauaggaaacuccagauuccuaugucauuucuuuuaauugucagagcaaaaguauaaaauaugauaucccuguuuuacacaggaagaaaugauuggggaaauuuaaaucagggucuaacuccagagccccaaaucugacuguauacaaggcuguauuuuuauuauuuuuauuuuauuuuuuugguuuuucaagacaggguuucucuguauagcucuggcuccuggaacucacuuuguagaccaggcuggccuuguauuuuuaaaagcaaucaguguuguccaacuagguagguaguacaucaggcagaggacugcuugccaaccuggcauuaugcacuugauggagaacaccccacccacaggguggaagacagaacccacacuuacagauugcucucugaccuccacgaaugugcuguaagguuugagauacacacaaguguaggugugcauucacacgugcacacacacacauacacacacacacacacacacacacagagagagagagagagagagacuugaagguccaaaguaacaaagucgcaguugagacacaguacguugagauuaaauggagagguuacuucggcuuaucucccaaggccauguaggacugugcuguuaggagaacaugaguaacuucuucugucauuuucccacugagaagugagaggaucagaagugauggguacagugacuucugucauccuccaugagaagcgagaggaucagaugugaugggcacagugacugaaguaaaaagacgucacugguguccuuggaaaauaaaagcaaacccuagaauuuuuuucuuauuuugccauaaauagacauuaaaaguuuuccaagucuauccaauaauauaaauaaucaucuagaagugccagugggccuguuucuugggucuguaagauagauaugacuaugauaggugguguuucaguaagauugaaagcuuggugggacguguggcugccuucuucagguaaccuugguuucacuggugaauucucuggcuguuuucuuaucugucucaccuguagcugaaggcucuggaagccagggggccugaaacuacucagccaccuuagccuggaagaaaucgugaucugccaaauucuggucuuuauggagaaaauuauuucucugauuauggaagagggcuauuucugauugauuucuuauucacugccaucuacaugucagucaccuuaacagucuuuccaguuguucuguuuuucagucauugucccaaaugacaaugcagcacuugcuuacaacagucuccaccccgcccccacccccacccccgugucugucugucugucucucucgggguggggggugggggguguauagaccacugacaaugcacauggcaaggguucccuucugccuccuccaggggagauggcugaucucucccuagcuucuucauacuuuuuuccuuugcauucgcuguuugauaguaaaacagggagacuagccaucuuugggacauugaaucauacuuuuuugauauagaagcgcuaagauuuggagaagcaugaaaugugaaaugcuggccuugugagacacagcuguggacugagguagcuccugguggcuugguacagcugcugcuggcacugucggguuucuugugaccgaaaucuacaccagaugagaaacauccaugguccaugcugucuugauagaccagagucagcaucuguagcuguagaaacucagauuauuuuaugauccuuaaccuuugccugguucucuucuuugacgaugucagcucaucugaguaacugcucucucguguccucccuccuucucucccucguucuguucuugucugagauacguccucaguuucucuuuaguucugucaauguucacagugccacuuugaaggccagcuccuccuccaugcagaccccucuuguccugccauguugaaucugugcagacguuugagacgugaagcgucccacacugcaucguuucccuggcagugaccgcugcuuacacuagaggcucaugggcugcugaaggcgugagugggugucugugcuccaggcuuggcucaucuggauguuggacuucucggagcauguguguucuaaacauugggcucacugauggcuuucaacugucuuccaguucaccuuacggcuuguuuagucuuugauuugauggcaccccccucaucuuugaaaauugacggaauugauaucuuuaccauguuucuucugucuuuauguggcuaaaacugcauucuuuuugucuuuaguaguauguagguggaaaccaauguauguguugagucuuccucacuuggucagaaguaauuuuuaacagcuacuuaaacaugugaacuccugauaagaaucacagggcuucauggaauuaucuaaaccaagaaucaaccaagaaguucccucaugugucuacugcauaaacugagacaaccaguucuaugguugggaaacauuaauuauuuguacuucugggcaggaaaauguuucucagaagguaagacguaucccaaugauuguugaagaagcuagccuaggcuguggggagggcuguaguacccauugcugucacauccacacuggaguucuuagggacacugugaugucagccgcacaucccucuccucuacgagaaggucguccugggaauaugcagcucaaggagcaagagaagcagugguuccaugcauugguugcugcggauuuucaugcugcugcuucauuugccauggcuuugucaugggcucccugagugucugagguguccguccuuagcucuucugugugaaagcucuucugugguggacucacuccauuccaggaccgccccaaacucgcuucucaaggaguucuuuccugaagauuaacuccauauuaacucugaccucacuccucggcuccaggcuuuguccccuccgugcuuacacugugugugucucucucucaugcacacgcacacacacccauacacauacacccauacacaccuauacacacacacacacauauauauacauacauauauauauauacacacacaugcacgcacacacauacacacacauaugcacauacacagacacgcaugcacacauguacacacaugcacacacauauauauguacacacacacuuguaucaggcuuacuuuucagugugaggccugucagcacaggauccugccuguuuuguuccuauugaguugugaggagucucgccccucuuccccacagaggagaaccaucaggagccuggaccccgagcugggcuugacucuagugcuuccuugucuucucagcagguugugccagcuagcccucaggaggcgagaacagaggccagaggcucacugugcucucuguagccacugguugugacagugugugucugaccaggcugaccggcuacucuuuagugggcucgcacaggacacauuugguggcuuccugaggaacauuugggccacuuggcauuguuauuugaguugucccuuucuuccuugucguccucugugaggucaucucugucacuuuggucauucaagagacuacuguuguaugcuaggaucuagaaaacauagcuuacaccacgccaccuucuguuguguccaccagacccauagaaagcucacgucucugccuaauggccgcccuugaugaccugugcccccgcuccacuucucuuucccaugcacagcccugaggugguuacagccaguccuauggauaguuuugccaucucucaacuauaaacauuucucuuaggcccacucucuccugaguuccagaccauauuucccccuggcugcuggguccaaccagucaccauccuuuuuccccaaaccaacuaucucucucaccagccagccguagaaucugauugguuaaugaccgucaccuuccgcacauuccuaccuggaaagcugagaaucaccuaccugcugaacuugccucuggucaucaccucucucucccucccgcguggucucccucugccauuccuacaggaaucuuguacauuggcagugaccuuccuaaauaaaacacacaccccauuugacccccagcuaccaggaaucccagucucccuggagccugcccggccccagccuguuuuaaccuguuccccauugcuacuucucugcaaccccuccacaagcuccaccuccgacugccgccagucaguuccagauugacaucaagcccugguguagcugccucgugacccaggcauuugucuggucauuuccuucucucagguguuccccacccccauccccccuuguaccauguaaaugccuuguuuuucaaggcccagagggcaucuugagcucucagacccacccccuccacuucuuucucugaacgucauccuguguguguauauccuguuacaucagauagcauacccuccuccucugucuuccccuucaccuguccccagucccucugacucauuugucuuuguaacuuuaguuccuggccuuucacaguuuuuguugaauaaggauggauaaaugaaugggagaggagugcccaaagagaauuucgaaaauuuuagcuuguauccuucuggccaaaauguauuauauuaguccuuuaaaaaauguuaucaguuuuuauuuuuaaaauguguguguguguguaagagagagagagagagagagagagagggagagagagagagagagagacagagacagagagaggaaagguacaugugugaaagucagaaagagacccacaucucccucuucauuggccugggcccacuccauuguuacuucucuuugcccucuugcccccuuucccuuacugaguuguaacuagugagaauauaacaagguuagcaucacacauagacguugugugaggagauuagagauuagaggguacugccugcugugagccaggauccacaggaguacuuggguaccacuugccaccagacacacugcuaaugccacacagccugccuuauuuacaaaguaucguucccuucccgccucuugaacuccccuggccuuucucacagcuccugggggcucucggaaggaggcccaggaggucaccauugaacaccuuucacggccaucucugcacuguaaugugccagccuggagcugcagugagccugacugaggagcuagcugccucggacaucccuggucagucugcucugcauccuagcagagggcugggaggguuggucuccacugcagaccagaccuacacacccugcugcaccagacuguaggcucugugccacuuuugggcaauauacugauaagcuguuucugugcccauccuccaguuguguagguaaauuccggacacguaucuuaaggcguaucaaaacaaaauuguccacaaagcuuguuuccucuuuaaaauucugacuaauucguagugaagaggaagcccccccacccccccgggcagagcuccaccaccaguguccagagaggccaucauagggagugagucagagcagaagagcucacacugcagugagcucucucaccugaguccgagcuguacuaggcgcucaguggcuguggaccacccuccagcuuaucuuuaccuuuguaaagagaacucuuucguuaguuaaguuugucuacuuuaaggucaccgagacugacugauucuguguacauagaagaaaugggccgaucugguccuccugccucgucucuacugcuaccucaggaauuucucgugaaauguuaggcugcagugacuauuuuuaagguguaaggagcucaaaucauguauuuccauggcugcagaaaagugaagagggaauacuggucacuuuugguaggaaaugugcgugacaguccuggaauagaagcaggagaacuuuucacuucagauguuucuuacagaagucauuuagcuucuaaaucuggggugccauuuucauaaucuaccaccauuuugcagaagugguauuuaugaagaaauuuggcuucagaauaauuauucucuuggagauguaaaaaaaaaauuaaccauuugaaugauauugaggagcugcuuugaggcgaguccccaaugcagggguccuuggguaggguccccuuggcaccuuccgaccuugccucacggcucagccucugucuucuucccuacuguuuggccuuuccuaggagagcuuccaagugggaccauguauuuuguagccuuuugcauucaauggcuucuuccacucacuguguuaaauuugagauuuauucaugcugucaguaguucgcuuuuuguuacugcugagugguaaaccccguuagauuggcugcugggacgugguugucuuucuuccaguugaaugacaucauggugcuuacgacaaagccgcugugaauguguacacacuugaauucauaaccugcgcugggguuacuggccuugaugcagagugugugucuaacgguugaaaagugaucguggcauuuacacucccacugccaacagauggauggucuguugugcccccacccccaccccaacgguuggugcugcugcuuucacaaaaagacuggaaggcuugauuuuaaccaugcuggauauauacaggugugucggaugggagcaucucacagccucgguuugcauuuuuuguaaugguugauucugcuuaguauuuuuuucacaucuauuuauauauaaaauauauuuauauuugcuauauaaauauauuguguuauaauuauauaauguguaauguauuauauaaauuauauaaauauauauuauagauauauaaauacagucuuagcucauuucuuuuauuggcuguuggguuuuguucccagccccuuuugccauuaacuugcuuccaauauucuuguggcguuaacgucagagaauaauuucaguaauggcucuguugccacuuuuucuccuucaugaauugugguuuuaggguccuaucuaagaaguguuuuuaaucuacugacugaaagauuucuccuggguuuucuuacagaggcacuguaguucaggauuuuacauuuauucugugaccuguuugugcuuaauguuucauaugugugagggaaaguuugagguguuuuuuuuuuucuuuuucuuuuuucuguuauuuaauuuuuuacuuuauccaguuggcccaggaccaaggagcaauuacugaaaaguuaccaguucuucgcagaacucuuacaaaaucaacucgaugucauguauugagcuaacuuuuucuuugauaaccauaaauguauuucugaaacugcuuccugccugcaaucgugucccaguacaaggccagcuguagacugcugucccccugugugacagaguugcugucuguggccguuucucuuugugacuggauuuaggcacuuuacccuggcugucaucagggccgucuuagcuuccguggcuaguguuguaauaaugcuuggggaagcugcuguccucuccuaacauaguuccccuccucgaccuguuuucugggcucccuuacugaagcugccccugugggccugucuccugcuguggccagugcucucccccgguccuuucccuacccuguuuuuuccucugugguucacuuggaaucaucugcuguucaagucguguaacacugcugcccuuggaucugccgucuucauccuguucaucccgucuaguagaguuuuccucucaaauacuguaauuuucauuuuaucuuaaucgauaauuuucauuguuuuuuuacaccugucuuuaauauccuaauuucuuugcuaccuuugaccguauaaagcauagguaagucucuaauguaauauccuugacuuuggguucuauugccuuugucacaugcaggucguuuucauugacuuuucuuguuuuaugaguccugucuuccugguuuuuuuuuuuuuuuuuuuuuuuuuuuuuuugguuuuucgagacaggguuucucuguguagcccuggcuguccuggcacucacuuuguagaccaggcuggacucgaacucagaaauccgccugccucugccucccaagugcugggauuaaaggcgugcgccaccacgcccggcugccugucuuccuguuguaugucugcuacuuuuuaacauaugaccuugcagugaguaacuuguuaguuuuucaaggcuugcuuuuagacagcuuuccauaggaacaaaacacacauacaugugugcacacaggaugccuacuuuauacacacgugcacgcagacacauacacagagacucaugcaugagcgugcaaccccccacauacacacauacacacacacacacauacacacacauauacacacacacacauacacacacacauacacacacacauacacacacacacauacacacacacacauacacacacacacauacacacacacacauacacacacauauacacacacacauacacacacacacacauacacacacacacauacacacacucacacacacacacacacacucacacacacacacacacucacacacacacucacacacacacucacacacacaccccuguaguugggcggugauguccugagcauucgccgcuccagacuuagacuuucuucucuccgcuuccguagcccucaccagccaagacccucucugacuucugacugcuggucugcucuuuggcugugacugucucaaagcuugggugguuuuuauagaagcuuguugguggguggucuuuuguaagccuguguuugcauucuucccuuuuacuuaaagacuuuauuuuaaauccaggcauuucauauacauacucaaaacacuuagcauuucccccuuucugccccuuaucuauuucucaagggcagcuacuucuuaauguuuauuuuuuuuuaucuccguauuucuccaugacauuccuuuuuucucuucuuuuacuuuucaaucuugagaauaaugauuaagcugugaucacuguagaugcgguuuagcuccucggagcuaucgcacacuacaaaauucuuccuaccaccuucucaguaaauucaugguuuugauuuuguuuuuuuuuuuaaucucuaaaaugauggccauguagacugggggaggugugugcucucuuugcguuuguugacugauuccucuccgggaggacugaguaccuccauagcagcagcugcccaggcccugcaggccuuguuauucucucugcucugcugcuccugcagucucccuccaccaucaggccgcccaggcaccagcugcugcgugagccuaccaggcagccucuccugaggucacagccuucuggccuuucagcccccuuucugaucucuggcucuggcuguggucuccccugaccacugcuuuucuugauuucggucuccaguauauuguacaaaauaucuaaacauguuauucuucuaguuuugcaccagagagagaauuuggccaagugacaacucuggucagugcagcccuuuccucucagaaccuuaagaccuuugucucuacggucuucuggcagcgguaggaaaaccguuuucucugcuguuacuguuguguugguaacuugccuuuucuaucugugagauuccucucuaucccuguguucuuguguuguguggcgaccgcgagcuuugaugguuuguuuggguuuggguuugguuuagguguuuggucaucgcauucaccuggagacuccugcuuuaggugauugucugguaacuuccuucuccccgaguggugucuuuggaucacauccuguuugcacauuacucucuagauagucguuucuccugucugucuccuuugcacucucccuuccuuuuguucucccuuggagaagacuuuucaguguuaucuucuaacccaaaggaaggcugcauguagcaguuguucaucuuuugauggcauucauuucuccccgaugguaugcagaggaacuauuauaucacuaaagcauuauucaugguucaucugugaauuuuuaauguauuucuauauauugaaauacugcuuuaaauugacagguaaaauuguccacagugauuuuuaacugcuuuuauuuauuucuguguucauagaaauguacgugggcuaguuuaauauggcuugcuaacaaaugcacgacuugccaugcccugaguugucaggagaagagcggaugcucucagugaucacucacugaggcugcugugcuagucagcgggucucuuggcuuaugcuuccuaucugagauuguguagccuuugaguagcgucccuucagccaccccuucuucauccaucguccucggucaccuugguaaccacuguucugcccucuaccucaaugagaucuacuucuuuagagugagaucauguggaauuuguuuuugacugacuggacucugguuccauccguguuguagccaugauaagauuuuuuuguuuuuguuuuuuguuuuucgaggcaggguuucucuguauagcucuggcuguccuggaacucacuuuguagaccaggcuggccucgaacucagaaauccaccugccucugccucccgagugcugggauuaaaggcgugcgccaccacaccuggcuaagauuuuuauguuuaauggcuaaguaggauuuuuguuucuguucccaucuccaguucugacucugugcucaccacauuuucuuuggccauaaaaucugugguuuuguuaaacuugguauucuacuucugcuuccuagguaccugggaaagugaggugauugggggcaaggguggggugggguggggugggaccuagacgagcaauuuuacaagaugcaucccuugccugcuuccuuggcaguuccuauagcuucacaaggugucuccaugggaaaagagguuguuguaggugugcgggucucugcgucaggcagacccucacagacccuuccugugcuccagucaccuuagccccucacagaccuuuucgguucuccuccucauuccccacauuugauaccaagagucagaggugauugaaguagaauccauucaaacacucaugcggaccacaacagcaaauuucaaaugucuauaccuuucccuguauguauagacuuggugaggcugacuuguauggcccacaccuucgggagucucucgggaagggcuguugcauuucuuuaaaaccucagccaaccucuuggggucucagacauggauacuuagacuagauuuagacuccuggauacuuaucugguaaacaggagaaccuucaaggggcauccucggacgugcugaccccgugguuagagcccgcgaagauuuccucuguuuccauugccuuugguuuagauuauuuauucuuccguucauauaaaaaguuuuuaagggaauucagcacauuuguguaagagaugaaaagccuccauuguuuccagccaguucuccaguaggggaguggauuagacagauuggugguuguucauauuugcuucuguugcuaauacuguggguagucaugcaguuaaaaaugguaggaaacagaaccgacuuagcucuuuuauuuauguucaagaacaacaugaagaauaaaaucauguaauccuucuacauugcagcugggacucuuaaccccauuucuccauauguccugagcggccuuuauuucuguguuuagcucuuuuacauuuacaguguaccuuucugugauagucuuugcucuggaauugguguucagcuaaaauauuuaaaaagauacagauugauaguuagaauguuaacucuaagauuauagaaacuaauaaucccacuuagcacucguggacauaggagcuccauccuauuucacgagucacuaggauugcccaguccgccuuuguuucccauuacugagagcggugccuucaaacagcacacaucauaaacuacaaauacacuaacacuuuuguucagaagcaaagccuaacacgaaacacaauaaaaagaauauuguuuuguaacgacgcccauuuuucaacacagaagagaauuacucuccucuucuugugcuguauucaauauauuuggcguuuaacugaauuaaugcaguuucugaaaccauaugcccccuccagccuuggguaaacuucagagauugucuaagagacucugaccgcaguuuaggaaaguuuauuccuugagggggaagccucaucuugauagaggagggguucacucuucacgugaguguaagaguguguauuuauguaucauagucagauuuuauuuuggaauuauuugaguaccacuugccuauggagaggucccaaacuguugguacuuauuuuguuauuguagucuuuugccacuagaggguaguauugcagagguuaaauuuuccucgaccauacugccgacuguauauaaccuguaaucagacgucugcccuuaguuuuauaguauguuaauccucauugaugcaucuucacagauauuuaaauuauuagaguugauuuugcuccggguuaacucuuaucuaaggaccaugauuugauggcauuaaucugcucgcugugacuguuaggugaagagcgccuucagcaucucuugacuggugaacuauuuuuaaccaccauuagauucucuccacauuuuuacugguucaggccacacugcaaaugagcaaaggcuacauauuaaggaauugcaugcuuuuuggaaaacguccuugacguaucaaucucuccgauuuaagaagacggagcauugcgucuuggcggaauugcgaucucacuucaagaacccuuggcccuagggacuagcagaaaauagaucuguuugggauuggaccuguagauugauuuuuuuuucuagcaauaaauggaagaagacauaauuacugaugcaguuaggguaaugagauuuuaaggcuuacaacuccggggccguuuggggaagguucccugcauuucaucuuguagauuccuuugacucguuuauuugccuaccaaagaaaaauacaauauugguuuuuuuguacauaacugauaagcuuuauguggagcuaucucccaccaaaaaggcaaauguaauauuccuaugaauuucauuagcaugaaaaaggaauuccugcagcaggauuauuauccuugcacagaacacagccucuguagccucccguuagugcuucuuguaagaacccaauaauugaaaucgagacgccggcguuccugagucuuaguggugggacugggcaugcccaguagcucggcugggucugguugcaaagagcaagcuugcgggcaggguugagcgccgccgcagggacugcuuuggagacggggucuuacucccuuagacguaagcgugcgggcaccgggagcuuucgggaacccugacgcgagcgagccuuggaggagguggcgcccaacccccucccucuccuccccuccccgcuccgccggcgccgcgggcaccgggagggacugcagcccgggagcgcggggcgggccuauggcgcggccaaucggcgcggcgccuccccgccuauauguggcgcuggggccgggcggccuccucuagaggaguggagccggcagccgaguaggaccgagcugcugcagacgcgccgggucacucgagccagcaccaccguucucacgcccugagcugcagacagcuaggcgguuuuaucuaguuugaaccaggcugcuggagcuugcucccucccgcccucucucuuuuuuuuccacggggcuguuuuuuuaauuuggcugcaauugcaugaaaucccaaugguguagaccaguggcgauggaucuaggaguuuaccaacugagacauuuuuccauuucuuucuugucgucuuugcugggaaccgaaaacgcuuccgugagacuugacaauagguaaaugucagcugggauaguugguuuaaauugacucggaguaaaauugacuugcgguauuacagguacaggauagccaugcgaauuccuuuguccaugccuaggguuacugugacauagauguugcuuuuugaaauggccagaagauccuuauuuucguagaucuggcucgagaacaggcuuucuuccauuauguaauuuaguccuuuguggcuccuuaaaauagggaaaugccuggauagaguauggcugguauuuucuggagucugaugcauuuuggagcguuuaagaauacucaaaauaggaugcuaguaacgucauucgaauucagagaucuguccuuauccuggauguuaaagaucaauuccauuuaucgaugaucucucuuuuuuuauucucucuuccagcucuggugcaagugugguagcuaucgacaacaaaauagagcaagcuaugguauguacugauuuaaaauuacuuguacucaaugugggcgcugcacaaaaaccgacaugucuuggaaacgacuagugcaucccuuagcuaaauccagacggugcugauugcucuucauacagucagaaaugccagcgcuagcucguucucucuccccugccagcguggagagaagccacauccccacacgacugccagggaaggagaagggccccagguugugagcggcccugcucuggacccauucacuccgugucgggauaaggcaguggcccagccuccucguugcuggucuugggagcaccuucagcaguguggcuuuacugggaacccugagauuuuacuggggagcuggaagggagggugucccccuccacugagggcagcuggagaaggggucccuagaccccaccagacccucuccaguggugcugcggccgcacaaaggaggggaaugggagaaaaguuuugucuuucucggccugcgccuggauuucuccgauuuuuuauuuccgccuuggucguucuuuguuauuggagcagcgccuguggcucuucucacgggauucucugcccacuguugcuaggcaaacucugaaccuuuaauucagagcuauaaauaacucgggcucccauuggcuacgacgucugcccagguuucugugaugucagcuuaaucaagggggggcuggggggaguagagguggagggaagaaaaugcggcaacacgcucuguaggaacuggcugcagccggugccaagggagggaggagaugggaggggacgcucccugcgccgggagggccugggggcggggaagcggccacugggccucgggccuggaggagagcgaacacagggccugagccccuguguggugcgguuugccaucuugaauuggaaacuggacuguagacgucauuaaugucugcagagaaagucuggagacuuuuggaaagcuugaucacguauacauuaaacuugaguauugcgcgguugugauuaugcgcagauuuccacaagugugcuuuaaaugcucuuuggagauagaauaaauaauugguuagggagaguccaggaccuaguaagcuaaagccuuucuuugccuccuguuuucaggaucuggugaaaagccauuugauguaugcggugagggaggaaguggaaguucugaaggagcagaucaaagaacuaauagagaaaaacucccagcuggagcaggagaacaaucugcugaagacgcuggccaguccggagcagcucgcccaguuucaggcccagcugcagacuggcuccccuccggccaccacgcagccacaggggaccacacagcccccugcacagccagcaucccagggcucaggaucaaccgcauagccuccuaggccccaacagaacuggcugcugcugcugcugucugaacugaacagaccgaagagaugugcuagagagaagccgccuccacagucacccauuucauugcugucuacgaaagagacgugagacucacacgcuguucucgcuuucuccccaguauuaagcacucauaagcuuuuggcuugaagaaauguacuaguugagugaauuaaagguuaaucagagagugagcagggaugugcccugugcaacguggcagaugucugaggaaugguuuaauugaccccgaggagcucugugccuuuucaacccuccccagccgcccacccugcuucugagagcucgggcggcucgccuucguggggcucgccugcgugggguucggaaagugggcugcuccuggauucugcgcucucuucuccuucccuucaaagaacucggagaggccagaaacaagacugcaauggggggcggggggagggaugaugcaguccuuauacaaaaccgacaacugucaccaaagcuuauaaaacacgauaguacugucccucuuuucugaaccaucagaagacacaaaacuguuagugacacaacggugacagguagcugggaccuaggcuaucuuauuaugaagguuguuuugcuuguuguauauuuguguauguaguguaacgaauuuguaccauagaggacuguccguaacuacuguuuagcuucuacacauugaaauguagauguuucauuggcugucugaaaagguguggcuuguccuuccuagagagaucuacuuaaaaacugcuuugugacaaaaaccacaccugaagaaauuuuaagaauuuggcccaguuagucacucuguguaaucccggaaucuagcugcugaagucuugcgaaguaaacuccccgugaccgaugucaguuaagcuggugauaccuggagaaguggucaguugcuaaggaaguggauuucccaguagggguuucugcaccucaccuguauagucguucugcgcaugucccccacacaguccccacuguauuuaccuguucuacuugucaccuuucaauaaagcauaucaaauguuga

SEQ ID NO: 12523 - RNA, 91942 nt, Mus musculus
ucaacauuugauaugcuuuauugaaaggugacaaguagaacagguaaauacaguggggacugugugggggacaugcgcagaacgacuauacaggugaggugcagaaaccccuacugggaaauccacuuccuuagcaacugaccacuucuccagguaucaccagcuuaacugacaucggucacggggaguuuacuucgcaagacuucagcagcuagauuccgggauuacacagagugacuaacugggccaaauucuuaaaauuucuucaggugugguuuuugucacaaagcaguuuuuaaguagaucucucuaggaaggacaagccacaccuuuucagacagccaaugaaacaucuacauuucaauguguagaagcuaaacaguaguuacggacaguccucuaugguacaaauucguuacacuacauacacaaauauacaacaagcaaaacaaccuucauaauaagauagccuaggucccagcuaccugucaccguugugucacuaacaguuuugugucuucugaugguucagaaaagagggacaguacuaucguguuuuauaagcuuuggugacaguugucgguuuuguauaaggacugcaucaucccuccccccgccccccauugcagucuuguuucuggccucuccgaguucuuugaagggaaggagaagagagcgcagaauccaggagcagcccacuuuccgaaccccacgcaggcgagccccacgaaggcgagccgcccgagcucucagaagcagggugggcggcuggggaggguugaaaaggcacagagcuccucggggucaauuaaaccauuccucagacaucugccacguugcacagggcacaucccugcucacucucugauuaaccuuuaauucacucaacuaguacauuucuucaagccaaaagcuuaugagugcuuaauacuggggagaaagcgagaacagcgugugagucucacgucucuuucguagacagcaaugaaaugggugacuguggaggcggcuucucucuagcacaucucuucggucuguucaguucagacagcagcagcagcagccaguucuguuggggccuaggaggcuaugcgguugauccugagcccugggaugcuggcugugcagggggcugugugguccccuguggcugcgugguggccggaggggagccagucugcagcugggccugaaacugggcgagcugcuccggacuggccagcgucuucagcagauuguucuccugcuccagcugggaguuuuucucuauuaguucuuugaucugcuccuucagaacuuccacuuccucccucaccgcauacaucaaauggcuuuucaccagauccugaaaacaggaggcaaagaaaggcuuuagcuuacuagguccuggacucucccuaaccaauuauuuauucuaucuccaaagagcauuuaaagcacacuuguggaaaucugcgcauaaucacaaccgcgcaauacucaaguuuaauguauacgugaucaagcuuuccaaaagucuccagacuuucucugcagacauuaaugacgucuacaguccaguuuccaauucaagauggcaaaccgcaccacacaggggcucaggcccuguguucgcucuccuccaggcccgaggcccaguggccgcuuccccgcccccaggcccucccggcgcagggagcguccccucccaucuccucccucccuuggcaccggcugcagccaguuccuacagagcguguugccgcauuuucuucccuccaccucuacuccccccagcccccccuugauuaagcugacaucacagaaaccugggcagacgucguagccaaugggagcccgaguuauuuauagcucugaauuaaagguucagaguuugccuagcaacagugggcagagaaucccgugagaagagccacaggcgcugcuccaauaacaaagaacgaccaaggcggaaauaaaaaaucggagaaauccaggcgcaggccgagaaagacaaaacuuuucucccauuccccuccuuugugcggccgcagcaccacuggagagggucugguggggucuagggaccccuucuccagcugcccucaguggagggggacacccucccuuccagcuccccaguaaaaucucaggguucccaguaaagccacacugcugaaggugcucccaagaccagcaacgaggaggcugggccacugccuuaucccgacacggagugaauggguccagagcagggccgcucacaaccuggggcccuucuccuucccuggcagucguguggggauguggcuucucuccacgcuggcaggggagagagaacgagcuagcgcuggcauuucugacuguaugaagagcaaucagcaccgucuggauuuagcuaagggaugcacuagucguuuccaagacaugucgguuuuugugcagcgcccacauugaguacaaguaauuuuaaaucaguacauaccauagcuugcucuauuuuguugucgauagcuaccacacuugcaccagagcuggaagagagaauaaaaaaagagagaucaucgauaaauggaauugaucuuuaacauccaggauaaggacagaucucugaauucgaaugacguuacuagcauccuauuuugaguauucuuaaacgcuccaaaaugcaucagacuccagaaaauaccagccauacucuauccaggcauuucccuauuuuaaggagccacaaaggacuaaauuacauaauggaagaaagccuguucucgagccagaucuacgaaaauaaggaucuucuggccauuucaaaaagcaacaucuaugucacaguaacccuaggcauggacaaaggaauucgcauggcuauccuguaccuguaauaccgcaagucaauuuuacuccgagucaauuuaaaccaacuaucccagcugacauuuaccuauugucaagucucacggaagcguuuucgguucccagcaaagacgacaagaaagaaauggaaaaaugucucaguugguaaacuccuagauccaucgccacuggucuacaccauugggauuucaugcaauugcagccaaauuaaaaaaacagccccguggaaaaaaaagagagagggcgggagggagcaagcuccagcagccugguucaaacuagauaaaaccgccuagcugucugcagcucagggcgugagaacgguggugcuggcucgagugacccggcgcgucugcagcagcucgguccuacucggcugccggcuccacuccucuagaggaggccgcccggccccagcgccacauauaggcggggaggcgccgcgccgauuggccgcgccauaggcccgccccgcgcucccgggcugcagucccucccggugcccgcggcgccggcggagcggggaggggaggagagggaggggguugggcgccaccuccuccaaggcucgcucgcgucaggguucccgaaagcucccggugcccgcacgcuuacgucuaagggaguaagaccccgucuccaaagcagucccugcggcggcgcucaacccugcccgcaagcuugcucuuugcaaccagacccagccgagcuacugggcaugcccagucccaccacuaagacucaggaacgccggcgucucgauuucaauuauuggguucuuacaagaagcacuaacgggaggcuacagaggcuguguucugugcaaggauaauaauccugcugcaggaauuccuuuuucaugcuaaugaaauucauaggaauauuacauuugccuuuuuggugggagauagcuccacauaaagcuuaucaguuauguacaaaaaaaccaauauuguauuuuucuuugguaggcaaauaaacgagucaaaggaaucuacaagaugaaaugcagggaaccuuccccaaacggccccggaguuguaagccuuaaaaucucauuacccuaacugcaucaguaauuaugucuucuuccauuuauugcuagaaaaaaaaaucaaucuacagguccaaucccaaacagaucuauuuucugcuagucccuagggccaaggguucuugaagugagaucgcaauuccgccaagacgcaaugcuccgucuucuuaaaucggagagauugauacgucaaggacguuuuccaaaaagcaugcaauuccuuaauauguagccuuugcucauuugcaguguggccugaaccaguaaaaauguggagagaaucuaauggugguuaaaaauaguucaccagucaagagaugcugaaggcgcucuucaccuaacagucacagcgagcagauuaaugccaucaaaucaugguccuuagauaagaguuaacccggagcaaaaucaacucuaauaauuuaaauaucugugaagaugcaucaaugaggauuaacauacuauaaaacuaagggcagacgucugauuacagguuauauacagucggcaguauggucgaggaaaauuuaaccucugcaauacuacccucuaguggcaaaagacuacaauaacaaaauaaguaccaacaguuugggaccucuccauaggcaagugguacucaaauaauuccaaaauaaaaucugacuaugauacauaaauacacacucuuacacucacgugaagagugaaccccuccucuaucaagaugaggcuucccccucaaggaauaaacuuuccuaaacugcggucagagucucuuagacaaucucugaaguuuacccaaggcuggagggggcauaugguuucagaaacugcauuaauucaguuaaacgccaaauauauugaauacagcacaagaagaggagaguaauucucuucuguguugaaaaaugggcgucguuacaaaacaauauucuuuuuauuguguuucguguuaggcuuugcuucugaacaaaaguguuaguguauuuguaguuuaugaugugugcuguuugaaggcaccgcucucaguaaugggaaacaaaggcggacugggcaauccuagugacucgugaaauaggauggagcuccuauguccacgagugcuaagugggauuauuaguuucuauaaucuuagaguuaacauucuaacuaucaaucuguaucuuuuuaaauauuuuagcugaacaccaauuccagagcaaagacuaucacagaaagguacacuguaaauguaaaagagcuaaacacagaaauaaaggccgcucaggacauauggagaaaugggguuaagagucccagcugcaauguagaaggauuacaugauuuuauucuucauguuguucuugaacauaaauaaaagagcuaagucgguucuguuuccuaccauuuuuaacugcaugacuacccacaguauuagcaacagaagcaaauaugaacaaccaccaaucugucuaauccacuccccuacuggagaacuggcuggaaacaauggaggcuuuucaucucuuacacaaaugugcugaauucccuuaaaaacuuuuuauaugaacggaagaauaaauaaucuaaaccaaaggcaauggaaacagaggaaaucuucgcgggcucuaaccacggggucagcacguccgaggaugccccuugaagguucuccuguuuaccagauaaguauccaggagucuaaaucuagucuaaguauccaugucugagaccccaagagguuggcugagguuuuaaagaaaugcaacagcccuucccgagagacucccgaaggugugggccauacaagucagccucaccaagucuauacauacagggaaagguauagacauuugaaauuugcuguugugguccgcaugaguguuugaauggauucuacuucaaucaccucugacucuugguaucaaauguggggaaugaggaggagaaccgaaaaggucugugaggggcuaaggugacuggagcacaggaagggucugugagggucugccugacgcagagacccgcacaccuacaacaaccucuuuucccauggagacaccuugugaagcuauaggaacugccaaggaagcaggcaagggaugcaucuuguaaaauugcucgucuaggucccaccccaccccaccccacccuugcccccaaucaccucacuuucccagguaccuaggaagcagaaguagaauaccaaguuuaacaaaaccacagauuuuauggccaaagaaaauguggugagcacagagucagaacuggagaugggaacagaaacaaaaauccuacuuagccauuaaacauaaaaaucuuagccaggugugguggcgcacgccuuuaaucccagcacucgggaggcagaggcagguggauuucugaguucgaggccagccuggucuacaaagugaguuccaggacagccagagcuauacagagaaacccugccucgaaaaacaaaaaacaaaaacaaaaaaaucuuaucauggcuacaacacggauggaaccagaguccagucagucaaaaacaaauuccacaugaucucacucuaaagaaguagaucucauugagguagagggcagaacagugguuaccaaggugaccgaggacgauggaugaagaagggguggcugaagggacgcuacucaaaggcuacacaaucucagauaggaagcauaagccaagagacccgcugacuagcacagcagccucagugagugaucacugagagcauccgcucuucuccugacaacucagggcauggcaagucgugcauuuguuagcaagccauauuaaacuagcccacguacauuucuaugaacacagaaauaaauaaaagcaguuaaaaaucacuguggacaauuuuaccugucaauuuaaagcaguauuucaauauauagaaauacauuaaaaauucacagaugaaccaugaauaaugcuuuagugauauaauaguuccucugcauaccaucggggagaaaugaaugccaucaaaagaugaacaacugcuacaugcagccuuccuuuggguuagaagauaacacugaaaagucuucuccaagggagaacaaaaggaagggagagugcaaaggagacagacaggagaaacgacuaucuagagaguaaugugcaaacaggaugugauccaaagacaccacucggggagaaggaaguuaccagacaaucaccuaaagcaggagucuccaggugaaugcgaugaccaaacaccuaaaccaaacccaaacccaaacaaaccaucaaagcucgcggucgccacacaacacaagaacacagggauagagaggaaucucacagauagaaaaggcaaguuaccaacacaacaguaacagcagagaaaacgguuuuccuaccgcugccagaagaccguagagacaaaggucuuaagguucugagaggaaagggcugcacugaccagaguugucacuuggccaaauucucucucuggugcaaaacuagaagaauaacauguuuagauauuuuguacaauauacuggagaccgaaaucaagaaaagcaguggucaggggagaccacagccagagccagagaucagaaagggggcugaaaggccagaaggcugugaccucaggagaggcugccugguaggcucacgcagcagcuggugccugggcggccugaugguggagggagacugcaggagcagcagagcagagagaauaacaaggccugcagggccugggcagcugcugcuauggagguacucaguccucccggagaggaaucagucaacaaacgcaaagagagcacacaccucccccagucuacauggccaucauuuuagagauuaaaaaaaaaaacaaaaucaaaaccaugaauuuacugagaaggugguaggaagaauuuuguagugugcgauagcuccgaggagcuaaaccgcaucuacagugaucacagcuuaaucauuauucucaagauugaaaaguaaaagaagagaaaaaaggaaugucauggagaaauacggagauaaaaaaaaauaaacauuaagaaguagcugcccuugagaaauagauaaggggcagaaagggggaaaugcuaaguguuuugaguauguauaugaaaugccuggauuuaaaauaaagucuuuaaguaaaagggaagaaugcaaacacaggcuuacaaaagaccacccaccaacaagcuucuauaaaaaccacccaagcuuugagacagucacagccaaagagcagaccagcagucagaagucagagagggucuuggcuggugagggcuacggaagcggagagaagaaagucuaagucuggagcggcgaaugcucaggacaucaccgcccaacuacaggggugugugugugagugugugugugagugugugugugagugugugugugugugugagugugugugugugugugugaguguguguauguguguguguguauguguguguguguguauguguguguguauauguguguguauguguguguguguauguguguguguguauguguguguguguauguguguguguguauguguguguguauguguguguguauguguguguguguauauguguguguauguguguguguguguauguguguaugugggggguugcacgcucaugcaugagucucuguguaugugucugcgugcacguguguauaaaguaggcauccugugugcacacauguauguguguuuuguuccuauggaaagcugucuaaaagcaagccuugaaaaacuaacaaguuacucacugcaaggucauauguuaaaaaguagcagacauacaacaggaagacaggcagccgggcgugguggcgcacgccuuuaaucccagcacuugggaggcagaggcaggcggauuucugaguucgaguccagccuggucuacaaagugagugccaggacagccagggcuacacagagaaacccugucucgaaaaaccaaaaaaaaaaaaaaaaaaaaaaaaaaaaaaaccaggaagacaggacucauaaaacaagaaaagucaaugaaaacgaccugcaugugacaaaggcaauagaacccaaagucaaggauauuacauuagagacuuaccuaugcuuuauacggucaaagguagcaaagaaauuaggauauuaaagacagguguaaaaaaacaaugaaaauuaucgauuaagauaaaaugaaaauuacaguauuugagaggaaaacucuacuagacgggaugaacaggaugaagacggcagauccaagggcagcaguguuacacgacuugaacagcagaugauuccaagugaaccacagaggaaaaaacaggguagggaaaggaccgggggagagcacuggccacagcaggagacaggcccacaggggcagcuucaguaagggagcccagaaaacaggucgaggaggggaacuauguuaggagaggacagcagcuuccccaagcauuauuacaacacuagccacggaagcuaagacggcccugaugacagccaggguaaagugccuaaauccagucacaaagagaaacggccacagacagcaacucugucacacagggggacagcagucuacagcuggccuuguacugggacacgauugcaggcaggaagcaguuucagaaauacauuuaugguuaucaaagaaaaaguuagcucaauacaugacaucgaguugauuuuguaagaguucugcgaagaacugguaacuuuucaguaauugcuccuugguccugggccaacuggauaaaguaaaaaauuaaauaacagaaaaaagaaaaagaaaaaaaaaaacaccucaaacuuucccucacacauaugaaacauuaagcacaaacaggucacagaauaaauguaaaauccugaacuacagugccucuguaagaaaacccaggagaaaucuuucagucaguagauuaaaaacacuucuuagauaggacccuaaaaccacaauucaugaaggagaaaaaguggcaacagagccauuacugaaauuauucucugacguuaacgccacaagaauauuggaagcaaguuaauggcaaaaggggcugggaacaaaacccaacagccaauaaaagaaaugagcuaagacuguauuuauauaucuauaauauauauuuauauaauuuauauaauacauuacacauuauauaauuauaacacaauauauuuauauagcaaauauaaauauauuuuauauauaaauagaugugaaaaaaauacuaagcagaaucaaccauuacaaaaaaugcaaaccgaggcugugagaugcucccauccgacacaccuguauauauccagcaugguuaaaaucaagccuuccagucuuuuugugaaagcagcagcaccaaccguuggggugggggugggggcacaacagaccauccaucuguuggcagugggaguguaaaugccacgaucacuuuucaaccguuagacacacacucugcaucaaggccaguaaccccagcgcagguuaugaauucaaguguguacacauucacagcggcuuugucguaagcaccaugaugucauucaacuggaagaaagacaaccacgucccagcagccaaucuaacgggguuuaccacucagcaguaacaaaaagcgaacuacugacagcaugaauaaaucucaaauuuaacacagugaguggaagaagccauugaaugcaaaaggcuacaaaauacauggucccacuuggaagcucuccuaggaaaggccaaacaguagggaagaagacagaggcugagccgugaggcaaggucggaaggugccaaggggacccuacccaaggaccccugcauuggggacucgccucaaagcagcuccucaauaucauucaaaugguuaauuuuuuuuuuacaucuccaagagaauaauuauucugaagccaaauuucuucauaaauaccacuucugcaaaauggugguagauuaugaaaauggcaccccagauuuagaagcuaaaugacuucuguaagaaacaucugaagugaaaaguucuccugcuucuauuccaggacugucacgcacauuuccuaccaaaagugaccaguauucccucuucacuuuucugcagccauggaaauacaugauuugagcuccuuacaccuuaaaaauagucacugcagccuaacauuucacgagaaauuccugagguagcaguagagacgaggcaggaggaccagaucggcccauuucuucuauguacacagaaucagucagucucggugaccuuaaaguagacaaacuuaacuaacgaaagaguucucuuuacaaagguaaagauaagcuggagggugguccacagccacugagcgccuaguacagcucggacucaggugagagagcucacugcagugugagcucuucugcucugacucacucccuaugauggccucucuggacacuggugguggagcucugcccgggggggugggggggcuuccucuucacuacgaauuagucagaauuuuaaagaggaaacaagcuuuguggacaauuuuguuuugauacgccuuaagauacguguccggaauuuaccuacacaacuggaggaugggcacagaaacagcuuaucaguauauugcccaaaaguggcacagagccuacagucuggugcagcaggguguguaggucuggucugcaguggagaccaacccucccagcccucugcuaggaugcagagcagacugaccagggauguccgaggcagcuagcuccucagucaggcucacugcagcuccaggcuggcacauuacagugcagagauggccgugaaagguguucaauggugaccuccugggccuccuuccgagagcccccaggagcugugagaaaggccaggggaguucaagaggcgggaagggaacgauacuuuguaaauaaggcaggcuguguggcauuagcagugugucugguggcaagugguacccaaguacuccuguggauccuggcucacagcaggcaguacccucuaaucucuaaucuccucacacaacgucuaugugugaugcuaaccuuguuauauucucacuaguuacaacucaguaagggaaagggggcaagagggcaaagagaaguaacaauggagugggcccaggccaaugaagagggagaugugggucucuuucugacuuucacacauguaccuuuccucucucugucucugucucucucucucucucucucccucucucucucucucucucucucucuuacacacacacacacauuuuaaaaauaaaaacugauaacauuuuuuaaaggacuaauauaauacauuuuggccagaaggauacaagcuaaaauuuucgaaauucucuuugggcacuccucucccauucauuuauccauccuuauucaacaaaaacugugaaaggccaggaacuaaaguuacaaagacaaaugagucagagggacuggggacaggugaaggggaagacagaggaggaggguaugcuaucugauguaacaggauauacacacacaggaugacguucagagaaagaaguggagggggugggucugagagcucaagaugcccucugggccuugaaaaacaaggcauuuacaugguacaaggggggauggggguggggaacaccugagagaaggaaaugaccagacaaaugccugggucacgaggcagcuacaccagggcuugaugucaaucuggaacugacuggcggcagucggagguggagcuuguggagggguugcagagaaguagcaauggggaacagguuaaaacaggcuggggccgggcaggcuccagggagacugggauuccugguagcugggggucaaaugggguguguguuuuauuuaggaaggucacugccaauguacaagauuccuguaggaauggcagagggagaccacgcgggagggagagagaggugaugaccagaggcaaguucagcagguaggugauucucagcuuuccagguaggaaugugcggaaggugacggucauuaaccaaucagauucuacggcuggcuggugagagagauaguugguuuggggaaaaaggauggugacugguuggacccagcagccagggggaaauauggucuggaacucaggagagagugggccuaagagaaauguuuauaguugagagauggcaaaacuauccauaggacuggcuguaaccaccucagggcugugcaugggaaagagaaguggagcgggggcacaggucaucaagggcggccauuaggcagagacgugagcuuucuaugggucugguggacacaacagaagguggcgugguguaagcuauguuuucuagauccuagcauacaacaguagucucuugaaugaccaaagugacagagaugaccucacagaggacgacaaggaagaaagggacaacucaaauaacaaugccaaguggcccaaauguuccucaggaagccaccaaauguguccugugcgagcccacuaaagaguagccggucagccuggucagacacacacugucacaaccaguggcuacagagagcacagugagccucuggccucuguucucgccuccugagggcuagcuggcacaaccugcugagaagacaaggaagcacuagagucaagcccagcucgggguccaggcuccugaugguucuccucuguggggaagaggggcgagacuccucacaacucaauaggaacaaaacaggcaggauccugugcugacaggccucacacugaaaaguaagccugauacaaguguguguguacauauauaugugugugcauguguguacaugugugcaugcgugucuguguaugugcauauguguguguaugugugugcgugcauguguguguauauauauauauguauguauauauauguguguguguguguauagguguguauggguguauguguaugggugugugugcgugugcaugagagagagacacacacaguguaagcacggaggggacaaagccuggagccgaggagugaggucagaguuaauauggaguuaaucuucaggaaagaacuccuugagaagcgaguuuggggcgguccuggaauggagugaguccaccacagaagagcuuucacacagaagagcuaaggacggacaccucagacacucagggagcccaugacaaagccauggcaaaugaagcagcagcaugaaaauccgcagcaaccaaugcauggaaccacugcuucucuugcuccuugagcugcauauucccaggacgaccuucucguagaggagagggaugugcggcugacaucacagugucccuaagaacuccaguguggaugugacagcaauggguacuacagcccuccccacagccuaggcuagcuucuucaacaaucauugggauacgucuuaccuucugagaaacauuuuccugcccagaaguacaaauaauuaauguuucccaaccauagaacugguugucucaguuuaugcaguagacacaugagggaacuucuugguugauucuugguuuagauaauuccaugaagcccugugauucuuaucaggaguucacauguuuaaguagcuguuaaaaauuacuucugaccaagugaggaagacucaacacauacauugguuuccaccuacauacuacuaaagacaaaaagaaugcaguuuuagccacauaaagacagaagaaacaugguaaagauaucaauuccgucaauuuucaaagaugaggggggugccaucaaaucaaagacuaaacaagccguaaggugaacuggaagacaguugaaagccaucagugagcccaauguuuagaacacacaugcuccgagaaguccaacauccagaugagccaagccuggagcacagacacccacucacgccuucagcagcccaugagccucuaguguaagcagcggucacugccagggaaacgaugcagugugggacgcuucacgucucaaacgucugcacagauucaacauggcaggacaagaggggucugcauggaggaggagcuggccuucaaaguggcacugugaacauugacagaacuaaagagaaacugaggacguaucucagacaagaacagaacgagggagagaaggagggaggacacgagagagcaguuacucagaugagcugacaucgucaaagaagagaaccaggcaaagguuaaggaucauaaaauaaucugaguuucuacagcuacagaugcugacucuggucuaucaagacagcauggaccauggauguuucucaucugguguagauuucggucacaagaaacccgacagugccagcagcagcuguaccaagccaccaggagcuaccucaguccacagcugugucucacaaggccagcauuucacauuucaugcuucuccaaaucuuagcgcuucuauaucaaaaaaguaugauucaaugucccaaagauggcuagucucccuguuuuacuaucaaacagcgaaugcaaaggaaaaaaguaugaagaagcuagggagagaucagccaucuccccuggaggaggcagaagggaacccuugccaugugcauugucaguggucuauacaccccccaccccccaccccgagagagacagacagacagacacgggggugggggugggggcgggguggagacuguuguaagcaagugcugcauugucauuugggacaaugacugaaaaacagaacaacuggaaagacuguuaaggugacugacauguagauggcagugaauaagaaaucaaucagaaauagcccucuuccauaaucagagaaauaauuuucuccauaaagaccagaauuuggcagaucacgauuucuuccaggcuaagguggcugaguaguuucaggcccccuggcuuccagagccuucagcuacaggugagacagauaagaaaacagccagagaauucaccagugaaaccaagguuaccugaagaaggcagccacacgucccaccaagcuuucaaucuuacugaaacaccaccuaucauagucauaucuaucuuacagacccaagaaacaggcccacuggcacuucuagaugauuauuuauauuauuggauagacuuggaaaacuuuuaaugucuauuuauggcaaaauaagaaaaaaauucuaggguuugcuuuuauuuuccaaggacaccagugacgucuuuuuacuucagucacugugcccaucacaucugauccucucgcuucucauggaggaugacagaagucacuguacccaucacuucugauccucucacuucucagugggaaaaugacagaagaaguuacucauguucuccuaacagcacaguccuacauggccuugggagauaagccgaaguaaccucuccauuuaaucucaacguacugugucucaacugcgacuuuguuacuuuggaccuucaagucucucucucucucucucucuguguguguguguguguguguguguaugugugugugugcacgugugaaugcacaccuacacuuguguguaucucaaaccuuacagcacauucguggaggucagagagcaaucuguaaguguggguucugucuuccacccugugggugggguguucuccaucaagugcauaaugccagguuggcaagcaguccucugccugauguacuaccuaccuaguuggacaacacugauugcuuuuaaaaauacaaggccagccuggucuacaaagugaguuccaggagccagagcuauacagagaaacccugucuugaaaaaccaaaaaaauaaaauaaaaauaauaaaaauacagccuuguauacagucagauuuggggcucuggaguuagacccugauuuaaauuuccccaaucauuucuuccuguguaaaacagggauaucauauuuuauacuuuugcucugacaauuaaaagaaaugacauaggaaucuggaguuuccuauaggaauuccagccaugaucuugugcccuaaguuaucuggcuucugcgguaauuggagcuauuuaagagaccuacacauuucuuuacauaguuuugaaaguagaaaguuucuugagagugcccaauacucaaaauuauuguaaauuaccaaccaacuuuuucucaacuauaacauccaccguuuuacaauguguuaccccuuucuaaacaccggaucguuaccuaacuguccagcugacucaggaguuuagugaagcggaagccugaugcuggcuuccacaguagcuccaggccgagucuuagcaucuuuauuuuacagcucaaccagaacacucucacuuuccuaacacuuagcugacauccuauacuaugcugcaguucucuuggcuucugucaaggcuacauggacuccgugcccucuccugaagcgagauguccuucgagguucuccucuaguagagcgaauguauguucuccagaaagauaacagaccgucugcccagaauaaaccauggggguaaaauagacuuacccuaaaaagcuuucaccagaaaucauucguaggaacucaaaaacguuuuaaccuguguaaugcagaagaacaccgcuuuacacggcauuaaggagaaccuuaggcaaucccaagauacacggagauauacaacuccagagcucaccacucggaccuacaaggcgcaccuggaacacccguccaagugccugucagugcuugauacaggcucuaucugcacaucaaaaugagcacagaaaagcaugccccagguacacacaccauacacacaaccccucaaaccuaaagaaaggaaaacagggcaaagagacaaugucaguugguaaagauucuuagaaauuaaaaacaccuguuuaccugagaaaaguaaaauguugcaaguuaaugcauaauuuuaaucuaaauuuuagguguacuuaugaacucgaacauuuaaaaauuuguaagagagaucacuuagccagacauggugguaugcaccuguccucaguacuugggaggccgaaacaggagggcugcuaacaggauugccaccaaaggucgaagccagccugagcuacguagugagacugaggcgugugugugugugugugugugugugugugugugugugagagagagagagagagagagagagagagagagagagagagcgcucuuaguuaccuuuuaguccucccucaucuaagcuaaucugaacccuaacuguaaaaacucaaguuuaacauuuacucugucaccaaagcaggucugcagaagagcggcccagaugagcugcaggucuguggcugaucguaccagacucugaguuagaaguggauucaguuuuacaaguggaaggggcgaggcuguccacuaaggcuuggucagagcaaaagcaaucaacugcugaaucccgugacggggagauugguuccucugcagauggcauagagcaaccauuuugauguguggcuuuugauuagaggauuucagaaugauaugaauauauuauaccuagggccacauaaaccucucuccaggguaggggcugaaagugccaagaguuuuagaaacccuggcacggucuuucccuggcagcccaagagagagcagugugcagcagucacugagugagcagcagacacugaacacagugcuuccacuguauccaaccaagcuuggagucaagccaagccaccaggaguccuuaccagguuucaccgccaucuacucaaccuccccucagccuacuggcccugagcccccuucucucugugcugcaucaggccuggagcccugaacuucaagcuucucucuguacugcaucaggccuggagcccugaacuucaagcuucucucugugcugcaucaggccuggagccccgaacuucaagcuucucucuguacugcaucaggccuggagcccugaacuucaagcuucucucugugcugcaucaggccuggagccccgaacuucaagcuucucucucuacugcaucagggccaccugccaccccugcccaucacaacgccaccagcaugccacucugcucuuuugggcagcuuuuauaucaacccucagaguucgcagcuagagggagccggaaccagcuuuguaucuaccaggugcucugguuacaaggcagcucuuuugagcggcugccuuauuuuuacagugugaacaguaaacguuaaaggccuucacucaaugugggaacagcucacccaacagacuccagcaggaaggcagggagggagggagugaaucccugaaccaagccggguuaagugaccuuucgccuuaccuuaaagccuuugucaugagcucucuccuuacccacacagaucuuggcagaguaggaagcucuagucaccuaacagugacacagucucugccuaacggaagggcuacggcugagugguggcucuuaacuguggcugaacucuacaaacaagcaggcagcuuuuauaaaacacagaugcucgaaccugacccugacccugacccucagauuccaauuucccgguguggaguuggcuucccaggugauuugcuggugugaagccaggcuaaaaagcuaauaaacaggauccagcuggagcucacuggcuggggauggguagagaagccuuacccaaaagguaaguaagccagucacagcgaugagacagcaguccuaaccacagggugagcccaaggcuccgcaagacagaaaggccguauggcccacagcucuccaaaaccucccguccugccccggcauugaugagacaguaucugcucugucuggcaagucagcagaggccaggaaucccauuuggccuucugugaucagaggacuccggcaggagccaucuugaggggcaacauacagauccccucccuggugcccaagaaugagaacaauccugagccagggauuccgaguucaagccccccagccccaucgggggagacaggcaggaaaggcagucguggcagggaaggccugacacugccguaccaaaggcggaagcucggcacaggcagugaagcgucggggaaagguagccuaccguuguugccaaagagcagauuuuuaucaacgggcaucagcucuggagcuggacgguccugggccugagguugucagguagaucaaccucugaagccacccuccugcuucgaggcucccggcugugaggccugggaacucgggggcucccguggaacaccagaccagcacagccuggugauuaggguuaaaaguacgcuuucacuuucaagauuuacaaaggcgggucaugugcaugagaaucucacggcuacacucucucccacucccuucacauuuggaaagacaccucaaagcaacaacuugccacaacagggggcuagaacugggggguccccgcccgguccacauagaacacagcuaaggaggacuagcagaggccccucacaggcaaggaaggaaagcuucgaaagggaaggcagcucuaggauaucacacaccccacacaggcuaggcucugcgcccgccucuucccuacugcaugcacugaagucuccaauccccagcaccgcagucuccaccgcacccuaacccuucgcgguacuuacuuucuuccuucuuucuuucuuucuuucuuucuuucuuucuuucuuucuuucuuucuuucuuucuuucuuucuuucuuucuuucuuucuuucuuccuuccuuccuuccuuccuuccuuccuuccuuccuuccuuccuuucaugucuuucuuacucagagccaucaucucuacacucacccuggggaaugaauugcuaccuccccagucccaucuauguugacuucaugguucuguuucacagccguugguaaugauuuccggcuuguaaucaauccuaaguucauuccguauccugcucagcuuggugguggcacagcagucacaguguuggccccuggcugcgggguaccggggauuuacccucaagaguaaacugaugguaaaaagagccccaaauaaccaacagauggacaagccgcagagcagggaccuacacaacacaaguaggcacagcacgugacuucuccaacagauccagccccugaccgcagauacaggccuggggaaaacgggaggaugaagacuucaacucuauuuguaaaaugugaaacgacacccaccccacaaacaaaugagaguaacagagcaaucaguucaggaccuggagcagaaagccagcaacacagugaguacauggccaagugagugaggaaaaccagcaacuuaggaauagggcaaaacccagcaaacaagacggcaacauguaacacaaauucaguccagaaacaaaaauucugaaggacaaauaagaaauuuggggaauaaaaaggccaugaaucaaauaaaagccaacggauggaccaagagacaaagguuaccaguaaauacuucaugcauacaucaguaaggaggaggaugugaucaugagucccaagaaccccaauaagaucuagagaacacaucuaagagcccacgggauagaacaaggagcugagagaaaagcuaaaggaacagaaauccacccaagaaaaucccaggcauuucugaagucugcaaaagaacagacaucuagggcccagaagaauugagaauccuaaacagguauggccaaagacgaaccucuccaucacacaccagucaagaugccaaacgcaccaaacuaagaaacagcauugaaaacaccgaagaaaacaaacaaaucagccaaccagcucaacucaccugggaaaacaagcacaccaagagcaucagguuucucacccaaaacauuacaacucagcaaaguguggcgcuguacuucaagucccaaaaguaaauaacuuuuggguaacggucucccacuuaggcuaaagaggcuggcucucgagugagcucuccagccaccugucuguuuaccuaaugccggggcuccaaguaaucacagccacauuggcuuuuugugcuggggaauucugaaagacagucuuaaccaagagacuacaagaaggaacaaauguuauaaacuaaaaagaaaaaaaaaaucaugugcaacacacuuauaugugaauauaagggaagagaaaaagacuuaauucucuaaccaagcagagaaacaauuaacaaaauuaaaggaauucacugauaaguggauauuagcccagaaacuuagaauacccaagauaacaauuugcaaaacacaugaaacucaagaagaaggaagaccaaaguguggauacuucgucccuccuuagaauggggaacaaaagacccauggagggaguuacagagacaaaguuuggaacugagacggaaggaaggaccaugcagagacugccccacccggggagccaucccauaaucagccaccaaacgcagacaguugcauacgccagcaagaauuugcugacaugacccugauauagcuguuucgugucaggcuaugccagugccuggcaaauacagaaguggaugcucacagucaucuauuggauggaacacagagcccccaauggaggagcuagagaaagcacccaaggagcugaaggggucugcaacccuguaggaggaacagcaauaugaacuauccaguacccccagagcucaugucucuaguugcauauguagcagaagauggccuaaucggccauuauugggagaagaggcucuuggucuugcaaagaucauaugccccaguucaggggaaugccagggccagaaagugggagugggugggguggggagcagggcggggggaggguauaggggacuuucgggauagcauuugaauuguaaaugaagaaaauaucuaauaaaaauuguuuaaauaaaaaaauuaaaggaauuaacaaacaucucuaauaacauuccuaaauguaaauugaaagaugaaacuuaguugaaaggacaaaauccaacuagcugcugucucacgggaaagggucuccuagacaaagacugaaagcacgaagucaguuuacuaagcaaauggaagccuaaauuagcaagcaauccagcgcacgcacacacacaccauacacacaccacacagauacacaucaaggcuggauaccuuagaaaggaaacgucuagacaaaaucagaaaaguaacgaaggcagauucaccaguggacagaaauaaagggcagauagauuccgacaggaacaacccauucucaucaagaagucguccagacuaaaagccaaugaagaaacuuggguugaucuacagcacugauguauuuaccagaacacugcgcccaaggcugcagaagaccuucuucucaguaguuccggagcuuucuccaaaaugcaucacauuuuaggucacaaugagacuacacacacacacacacacacacacaccacacacacacacacacaccacaccacaccacaccacacacacacacaccacacacacacacacacacaccacacaccacacacacauacauaccacacacacacacacacaccacacacacacacacacacaccacacacaccacacacacacaccacacacacacaccacacacacacaccacacacacaccacacacacacacacacaccacacacacaccccccccacagacacacaccacacacacagacacacaccacacacagacacacaacacacacacacacacacacacccacacacacacaccacacacacacacacacacacuccccugaaaugguuccuugucucgaaucagaucacaguggaacaagacuuggauuuagcaguaagagaaaccacaauagccacacaaauacuuggagauugaacaauauugucuagaacagucauuaaaucaaaaggaagauuuugagguucuaauaaucaagugaaaaugaaagcaugacuuagcucuggcuuguagcugaggcagcuccaagaugaaaggucauaguucuaaguacuuacauuaaaaaaaaaaaaaaucagguggagggagggguggggugggguggggagggguggaggcagggagcuggcaggcaggugaagguacuugcuggccaggcaggugaccugaauuuguccccuagagcuggcauggucuaaggagaaggcagagggcacugcagcaaguuacccuuugaccucuguguguucuguggcaugcgcacauagacagacacacauaaauaaauaaauaaauaaauaaauaaaauuaaaaaaauaacuggagaggucccaagucaauaaauuaaugauggacuuccaggucuuagaaaacaagaagaaguccaaccccaaagcuguggacagaaagaaagaacgauggagccagaagccugaagaaaugcgaacacguugguucuuugagaaacauaaaauuaacaaccuuuuauccugacuaaccaagggaaagaaagaccuaaaugaauagcugagaucaaauuccaguaaauucaaauggaaugcaaaugagcacuaguguuuugaaaauuauaacaaacaaacaaacaaauuuauggaagaaauggagaugcugaaguacagagcgccgaccaaaaacucaagucagugggcaccagcaagcugagcagauccgcaacaagcaaugauacugaaagagcaacagaaagacaguccaggcuuggaggcucucacugcuuuuaccacuuuuaauaaacugagagcuaacugagggucugcaaacaauuccauuagggcaaagucccuugaccugaagggggccugaggacuucacuacauuacagggaacucuaccaaagccgcuucuaggaagccacuacuauugugcuaucaaaaccagauaaggauggggacacacauagaugcucgauuaugcgcucaagcaacccccccacacacacaccacagacagacacacacacacacaccauacacacaccacacagacacacaucaagaauccagaugaacaauagcacacacaaaauuucaauaaguacuugcaaaccaauuuucaggaaacaguaagaucacagcuaccaugaccacaguggcuuccuucuagggaauacagagaucaacaaaggcaaaucagugaaggaccacacuggauggcuuccuccacgggaaggaaaacaccuuguccuugcuggaguagagaucuacucugcuuaugccauuugccauuccugaaugugacgcuuuugccaaaaccaccaccggaggacugacagaaugccuuccuucuccaccaucacagcacgcuacacgguauugcuucugaccagagcagugccacaguggcccacccgccuucccaugcuccccaccccccugaaguagcuggccugacagacagaugggaugaacugcugaagacacaguuacaaugccacucauuuaggggacagcagcuacaaccaaccaguguuggcaaagcugucagaagcaucuaguggggaaacacagagcuuuuaauagaagauucuggaagaaauaggaagaaauaggauauccacaugaaaaagaauuaaaccaaucccuaacuccagccccuuucccuccccccgcccccauuccucauacucauacacacacacacacacacacacacacacacacacaucaauucaaaacugauaaaugacuguaacguaugacucgaaacugacucuguuacacaaaaccacagggaacacagcucuagauacgagaauaggcaaggacuuucuggagagaauuugguuaguacugaaagcaauccaguuuccucaguacauguaugaaauuaauuaaaagauuucuauacaucgaaggauacaaucacaaaacuggcuucugcuuaaguguucuguuccugacucaccccaaauaauaauaaauucuacuuaacauucuuuuccuuaaccucgccuggcaagcccugccaccacccugccacagccuuauacagcaaggcuucuagaucagcguuaccccgugcucuagggggaugcaggggaacgcaggccuauguaucccugcagccugcuuugcugcaagcccucgagcgacuguggacaccuacagggcagccuuccagucugaagccugggacucagucugcacccagcucaacuucuuuauuagacauucaacagcaauucauucugacaaaauuccuucauuaaaaacaaguggauuuuaagcuauauuaaagauaacaaaaauuacuuagguguguaggcuaacacauugaguccuuauaauaagauacucgcaauguuagaaguaaaugucagauucccuacuaucucagaugagcuacaucguuggauaacguguucuaaacacagcuauauccugaaccugauucguuucacaguguaaaguuagcuuuacaaaauucugcccuagaggccccaagauuuucagccaagucuaaaguuaguguaaggauaaguuacaggauuacagucuacuaaggcaguggaccaauuacucaaaagcauauaauaccuagcuaaaaggaaaauguuuacauuuuauaguuaugagauaaagcuauccauauauuuuaagcaccuagccuccguaucuacacaccugcccaccacaagguuaagaguccugcuacuagggaaagcugggaagagaggcucaaguguccaugguccauggucaggcaaaacguagcuccugcauaacggcugguggcuucucuauagugugcguguaagagacagugcagccagugcaacacugggggaaacacucccaugacuugauaacuacugcagccauguguaaaauccacagcagagccaguguugggacauuacagagacccagaaaagcagagggcugccuugaaucaucaguaccuuagccacugcucucucagcgcucaugaaaccacagauaggaucuuaaucuugggccagugaauucuauguauuaccuuuauuuuuuuaaagaauuacuuauuuuauguaugaguacacugucacugucuucagacacagcagaagagggcaucagaucccauuacagaugguugugagccacaaugugguugcugggaauugaacucaggaccucuggaagagcagucagggcucuuaaccgcugagccaucucuccagcaccuauaaauuacauuaagacuggaaaaacaugcaaauaacuaauggcaggaacaacgucaguagacaacuuggcuaccguacagacucacaaaaccaccacagacccggaagcagggaagagcgaagcuuugaugaacacuaauguucugguccaggagacagacgacuuacccaaugcugugucaccagaaccacaaacugcuuugaacagccaaacucagugugagccacccccguacuccgugucaucuccuccaaacaaacugucuacacacgagaggcucaaggacugcaggaaagaccccuuagcauacuuuagaugagaccuuacaucuacaggacgccucucccagcaccacggugugucaccuugccacaguggccugugauaaauaaaacucaagacgucacagugccuuccuccccucaaccgauaugacaaaaccccugagagaaggcagggcuggccugccacugugugcuauuuaauuuugcagaaagcagccauguucuaucacacuagacuagagaccagcacuuggcauuauuaauaggaaaacuaacgcaaauaaaggaaaaaaaaaaaaaaagcaagauggaaucaggcagcguuuaacugcccaggugcaugcccuugccagggccucuaucccuucccuuccaccccucacugcuccaucuuaguccuuagucuacgcagucacugcuaucuagaggguuuccugauaacaaccacacuacauuguaccguuuaagacaccaggaaagccugggaugaggcucagagagcauuccaucauaaaaguuaaacuguaaagcucugcuauauaaaacaguuaacauuuaacagaaaaacuuugauuucugcauaaccacgagcuugcucugcacggaaccaaagggaaccuacaaacauacaagccugccaccuuguggaacacaugcagaauuacaaccuccgagcuaaauguacuaaaauauacuagauauuaaaaaacaguaaucaagauaacauauccauucuaaaacauuaaauauuaguggagagguccacuagcauucauucaacugguuguuauuaauguuuuauuuagugaaaucauuuggaaucaaaacuaaaguuucucuuuagacaugagcagaauugcucccguagauaguggaauaaacuuggggucucauccccucuuaguuacaauagccaccaccuaugcuuaaugaacacaacacggcaacuccacugcccaccaacagcaccacuggaccaauuuuacccuaugaaggagaauuccuauacaaucuuuacuauuucauaauuagacugcaaugaguccaaacucucagaagaaucuacucauuacuucuugauaacaaacugccacaaaagagccuggucuaaaauagcgaauaaaagacagaaaaaaccauugacuuuuuccgaguaccugcugcagucauggauuuuucagaaagcaguagccuuuggggaaacacagccuccuuugacgcugaggguuagccguggcucuugugagaacaugggcugccagguuacagaaacuccuugugaauguggcucagugcgauccacagagcuuccgauggcccugggucugguccuuuccggguuccuauaacagucugcguguccaccuuggggaggaaauaauccuacggccuaagggacugacaaacucuuagaacagugcuaauguacuuccugcuuccaaggauuuaguuauuaaaccuggacaggauggacaaaagcuacagagacaaaaauggagaaucuguuccaaacgucuuuuuuuucagauaaggauuccaucuuuuggcgaaguguuuuccuuuguucuguuuuguucuucacaaacaacaaaacaaaacuuguaggcgagaagcagggagaucauuacuuuuuuuuucugcucuacaauuccaucugaaggaaacuggaaaacugacuaucuccaaaucuccagagaaaggcuucucucucccguugugagccagcauuccucaggaugagucagcauuccucaugcugagucagagucuccccccaccuuccuguccggcccuucagccccucagccccucagcaccaauggcauacaaugguauaucugugucucuuucccucuuacccacacacacacagcaaacaucuaagcaccgggucuuaagaacgaaaacaugaggagccacaguuacccuccgaguaugguauuaauaauucaaaaugguuuaagcucugguaucaaaguuaagagcuaacugugcuauucaacucaauuucuuuucucucuuucucuuucucuuucucuuucucuuucucucucucucucucucucucucucucucucucucucucucucucucccucccucccucccucccucccucccucccucccucccuuccuuccuuccuuucuuucuuucuaaagucuuacucugggugugguagcacacaccuuuagucaaagugcuagggguuuagaggcagguggagcucuguaauuugaggccagccuggucuacauagcaaggagagcuagacagugagagagccugccuuuaacaaaaaaagggggggaggggagaaagggagggagggagaggaggaggaaagagggagggaaggucucacuggauggcacuugcugguugggaacucuauggagaacaaacuguucacaucucccuaucccccugccccugcuuccaagcugcuggacuugcucaugaccuuguaccgucacgcuaggcuuuagaaagaaucucauguaauuuaucugccaacugaagcaaaagacuccucuugucaccaucgccauccaguccuccaaguauuuuuaaaguagcucuuaagauuuccuaacuagggcuggcgagauggcucaguggguaagagcacugacugcucuucugaagauccugaguucaaaucucagcaacuacaugguggcucacaaccacccacaauaagaucugacacccucuucuggugugucugaagacagcuacaguguacuuauguauaauaauaaauaauaagucuuugggccauagcaaccagagcaagugggguugaccuaaaauuucaauucccaacagccauaugaaggaucacaaccauuuauacagcuacaguguacucauauauaugaaauuguaauauccaaaauaaauucaagacuacccaguaccuucccccuucaaaaggacuuuccaaacuguacuagcaggccaaguacagagucagauaaaaaagcuggcugacuaaacaaauauagaaacauaguuuuaacggucaaaauuacuaagcuuccaaaacaagauuaacaauuccuuugucccgccucauacuaaaaaccucaaggacagacaaaaugagagucacccuccacaaaccaaccaguaucuaaaaagguuauuggcuacaccaauuaaaauaagccagacuaaacuggugccuauaucuggcccuuacagaguuauaaaaaguguguccuuucuuuguucugggucucuccuccagccugcgugcugagaggggguuccccaaccuguuggauaaguaaauuccucaugcguuuugcaacgauggcaauuucuguggucuuugugagugagggucuuuugauaagcuacaacaaaauaaauagauaauuaaaaaaaaaaaagauuuccuaacuaagaaaaagaaaacaaaauggcugaacuggacuuaaugccaaccuccaagaggacagcagccaacugccuccccagguaaaaaccagugugugggggaguggggguggggagccaguucaucccuuacuagagccacaguuaguacucacaacgcucuuaucucuagaucacaguacaggcuucauguauacaaugguggccguccuccaagccugccuuugcccccgcuccccacaccagguccaacugacacuccugggggaccaacaagugcuucagaugaaaguucucaaguuccaucugacccucgaggcaguuucuacuuaaaggggaagcagccuaauuuauuuauggugacacacuaugacagaaagaguaaaaaaaugccaugauacaugguagagguauuuaccccauuucaaaggguuaaggggcacaggagauugucauggggcuuuccgaguuaaccguuaugaccucuguugaccauaucuacccaacccuagaccucagagagauucagugagaguuuccgcaggccuugaaauguguuuguauggcgagaggaaaacuagugguaaacagcaaaaggauuuaggaaugaaggaagacuuggggaggagaaaaucuaacagggaaggagggaggagaaaagauuaggaggaaaggagggugggaaggaagacaugaagagggagaauaggagggaggacagaggagggaggaaggaggagagagaggagggaggagggaaguaaagaagggaggagggaaagaggaggggaggagggagaaagaaaagagaaaagagcugacaggaagagggaagggagaaguugagggaaggagagagggaagaaaggaggaagaggaaagaauggaggagggaggagagaagagggaggagggaggagggaaaaggacccagugucccaaauaagccgaugaugacaauugccaccaaaacauagaucauacagucacugaaaauuaauauucuaacagagcuugagggcaaaacagauuuaggguuuucaaacucaaccacgaugugaucacugguguaacaggaaacgaggcacugauguccacccagcuccuacuucagcaaccacagaagcaaaccguacgcgaaccguaaagccacgggugcagcuucuuuccaagaacccaaggaccaaaccaucaaaaucgccucagaaaacacaaguguuagcucuacguccguggacaaaguauaaauuuguaacauaauauauguagguaacuauuaaaguugacucuccuuuuuuuguugauuaucuaaaaaucgucaauaugcaaaagcaaugaucgugugcgcuaguauuuuacuuuuauauuuuaauuguguguuugauauguguguauuugugguauguaugugugaauacaguaugcgugugggggagguauguauguaugugugcaguaugcacagguauguucucccugcgcaugucguggggaggacagacaucaacacuaccuguuuccccaccacucuccaccuuauucuuugagacagggucacugagccuggagcucacuguuuuggaucuggccaucuccacccucuaagcuuuuaugugggugcugggaaacacaacucagguucuugugucuauguagcaaacuuggugccaucuccucgcuacauauuuauuacaaaagaguauucguaacuacaugacucgacacaucgaccauugugaauaaaugcuguuggugaguacugcacaccuauagccccaaacacuuggaagauugaggcggacagaccauaaaguucuagaucagccuaggcuauagugagacccacuaaagaagccgcaugggggcuggagagauggcucagcaguuaagagcacugacugcucuuccagagguacugaguucaacuccaaacucccacaugguggcucacaaccaucuguaauggggucugaugcccucuucugguaucugaagagagcaaugguguacucauauacauaaaauaaauuuuaaaaaaagauaaaaauaaacacauguaaaaacaaauaauagaggccuucuacucagagauaauccuuaaguuuaaaaacauagccaauguuaaaguauaaucgcuuaauacuuaauaauuaaagcuagcauaaaaauagacuuuucaggcuggagagauggcucagcaguuaagagcacugacugcucuucugaagguccugaguucaaaucccagcaacuacaugguggcucacaaccaucuguaaugagaucugauacccacuucuggugugucugaaguguacuacaguguacuuagauauaauaaauaaauaauuaaaaaaaauuauccuaaacacaucuuacuaagaaauuaaucaucauugaccaaucaaaguuaaaguuaaaaucauucuaauguauuuucuaagauggagaauaaaaauaacaucacuagccaggcagugguggcgcacaccuuuaaucccagcacuugggaggcagaggcagguggauuucuuaguucgaggccagccuggucuacaaaguggguuccaggauagccaaggcuacacagagaaacccugucucagaaaaaagagagagagagagaggagagagagagagagagagagagagagagagagaaagaaaaaagaaauuaaguucugggggcuggagaaauagcucagcaguuaggagcacuaacugcucuuccauagguccugaguucaauucccagaaaccacuugguagcuugcaaccaaccccaaccguaaugggaucugaugcccucuucugguguaucugagaacagcaacaguguacucauaaauaaacaaaucuuuuuuuuuuuaagaaguuaaauucuaaaacaauaaaauaacaacuauaacuuuagacacagcucccccauaauuacugugcacucaauacugggcagaccuguacaccaagguagcaacaauaaguuuucauguagaauaaaacuacaaaauguguuaagaaacacaagaaacaaaauguagcuaaccuugagguuuaaaaaggcuagaacaagcuaacaaaaucuuacauaaauuguauguuaacauaccgaaguuugguuagccugagaauuugagauuauuucucuaaaccaaaguauauggaaggacccagaaaugcugaauaugagaagugaaaaaggcagcaaaugaacucaagaaacucgaaauaaccucgcucagcccguuuuaauccaguagucuuugucaccaugaucaauuugaguguuuuaaaccaagaagugugaacgguagcaugaucaguaaguuuuaaagcuaucaagaacauuccucggacuacucugaagucagacuuccaaacacuggcuaaccuggaacagacacugucguuagaacagccaaacacccagauuccacacagcagagacuaaaugaaaguccccacagcaaugccccagcuaugggacaaggcuucaggggaaaacaaaaaacaaaaacaaaaaaaaaaacagauccagauguacaccaagaagaaauuaugccuacaagacagcagguggcgccaacacaccauguccuauuagaaugccuuccauauccuacaacuuauuucuauauguagaaccccugcuaccuaaugauuuuauuuauguaauacuuuguaauuuuuaggacauugcuuucauuacucugaauacacaggcacuuuauacacccauuacagcuauuuuuaagaugcauugcuuuaauaaaaaaaauuaggaaauguuaaauauaagaaauaugcugccacaaagcuccacguuuaaaaaagcaaugccuagaguagaaagccaucugugugugaaaaggccgugaugagaccuuacucuguuaaccuaaacuuuaaauuuaaaguacauguagaguaaaauggaguaagaacggagagaguaugagcagguaaagccgaaagugcaugaaugcacugaagcgcccucaacucagccucacaggcggaagauagcucccgucaauuccagaaaugcuaacaucuucuuugaaaccaguuccuucuauaagaauuucauuucuacaugggacuaugcagaacaugaucauuugcaagcugcagaguauaccacacaguccucguccccugccccacuaacccaucccaagagcuuccaacugauguagacgugcacagaacuuuaguuggucuguggcaagaaaugugccugagcauuucuuucuuguuagucuaggauggaaaggcagcuaaugacagaaauggcuaagccuguaauaaucacagcaaacacaacggaauguugauagcaugaggcaacuacacaccauucuagaaguuaguccaguuguugacugcuacugcaccacacugacacuggcugaggggugccucccacggcacuguaagucaacagaggcugcucaccaugggguaugugucuugaaaccacagaagacacauggugcuccacuuacaugacaucacaggacgacggacagaaaauaaaacuuaagagaaugggagcucugccuguuugucauuaaggagucguagugggaggcagugaugguggacgugauccagagacguuggcacgaccuagacauacacauacuuguaagguuuuaaguaacauuccaaguacaaguuugcugggggggggggaaguaauauaaacagaauacuaaacaaaagcuaagcccucucccauccccuccccauuccugcuuaaacguuuaguucucagcauucucauuuucguagaagcccaucugaaaccccacuaguugguaaccacacugaaaauauaaucuuuuuccaagggagaguuugaacagaaguacccuacauuuguaauugcuguucccagaaggacaugaauuacuaaacgaaaauuucagugguaggcaggaaucuccuccccgaguguuacugucagacaggucucagagacacccaaggcagcacaggcucccgucaccgcuccuaccuaccuacaauagcucugcagcgauagcgugcugcagaaacuccacaggacgcagaucaaucugaaacugcccggaaagucccugcugucacagugcugaaggggcaaggcggacugcagccagagaaagacaucagugcccugacuucagugcuggacccucacuugcuacaguagcgcuugucaggaaagacuaucaaguggggguguagccacaagacugucuaucaggguaagcaacagcaauccugacugaugcuggcaugcuccacaggagggaguucauacuugauacuauagaccuaggcaaaauccuuaucuagggauguaacaggccaggaagaaucuacugguaucuguuguuacuguuguuuuucuacaugaucacuuuaccaaacugccuucuaaacauuucuauccauagccuggcguggcucccaaccuuagucagagaagcaucuaugccugacuguucacagugccgcuaagaagcuaccacgagcccucagccaugaacgggacacaaggaggaaaggauguaaggacagaucgcagggcagagucuccggucacgauguggcugcugcacgcuugaacacucaaucugcacaaggucgagccagaucagaaggccggcgagaggugggaggggcucccgaggccccgccccuagugaagcagcuacugccuugggagagccgcuuucucuaggauggucacuggugaggagccgcauucuccaguggaugagcccacacuugugcacacauggauggcgcuagcuggacucgaugguuuucaaaaacguacguucauuaaaaaauuaugaaaggaaggaauggacucggagauaugagggagggauccuggggagucguggcgggaggcagugacgguggacaugauccagagauguuggcacgaccuagacauacacauacuuguaagaagguuuuaaguaauguuccaaauacagcaggggcggccguccugacauuuacagccgauugaguuauuucggccuuucaccguccaacaauucugccaauaggaguggucuucucaauuaaaaaacaaaacaaaacaaaacaaaaacccucaaagccguauguaguaaauacuagauuucuuauuaguuuuccuaggagacauuucaaaaacauaccacugguucagaaagacuagcuaaugagggucacuuucaaagccagagugggggacccggggacugaauacuucaagagagugaaacagagaggaugcaaaaugaaaucuuccugccauuuguugcugugaaacaucuaaaacaucucauuaagaaaaguaagccaacccaauuagaaagguaugaaucagaagguacaguugacaaaucauuggaauaaaggaaaaugcaacuguugcguggguaacaucaaacuuguagaaugacuaaauacaaaucuaaaauuacaggacgauaguucauguacaucgugaggaguggaauggguaguaacugggguugaaaucuaagggauucgguuuuguuuuccuuugaaaguuggucuuaggauaauuucagacuuuuaaaguugauaacacaaaugggaugaaugagaagaccagcaguguaacccagaacacccaagcuaggaagggaguaaaacacaauagguagaaaagcaaaaaacaaaacaaaacaaacaaacaaacaaaaaaaccccaaaacaacagaauccugaaucuaaaccaagaauuggaggcaggggguagauggaagucacacagugguccuaacucgccagggaagggacuuaagcugccacugcccgcaccgagugccuaggagacaaacugagucucacgggcauggaauugggaaaucuggaaaguagggaaugggaguauugagcauauuaaccuggaaagauuauaugcuuugcagagacaaaaccgaguccaguaacaguuaagaugauaagcacuacaccuacaugguuuauaauauguuaacuuauuuaccucuuaacuaaggcuuuucaccaaacuacugcaugcagaagacugagaggugguuuucccaccacccgaggacaguccuuaaguagugccauucuaggaccaugaaacaaaggucaacccauucacacagacgccaucaaacuucucaagaaacuucaguaaagaaauccagcaggcagacugcucuguucccacuugacagccaaguaaacggagacuggaaucgaguuacccgaccaagcucaccuugcuagcacaucauggaaccaauaugcagauugagccuggcuccacgacccuugcuacuauagucaggccacucugcuacuaugaacccuuccuccacauggcgauuuucucuggccuauaccuuaaaaaccugcccuuuucaaauauuuauaaauuaauuucagugauucacagugcaacaccaggcauguaaacuaaagaccacagacaacuuccccuggaccccugcaguagugggcuuaccaaagguguucagcauuugccugauugaucauugugacuaacugcaguuguaagacagugauaaacagaggaaagugagacuaggcaggcgggcgggcgggcacagcucgcacagcacaaacacgccuugggaaagucagccacaggacccuauuagcacagggagcacucuggacagccuuacaaugcaaacguccauaaccgguacuucucaaguuaucuaagccuaggaugaaggcugcuagcucugcucccgggcagguacccccaagauacagauuaaagcagaggacauaaagauggagccccuagaagucugcuggggcuccauucuuggaaucuauaaaccuaaguaaacuugguagaaaaagggagaaaauaaauggucucuacccaaaguacaagaagccauacgcaaauaccuuugaauuuucacagagcugucguugcuaauagguuuguaaaucaucccgaggcccaagaugucgucaguuugagaaaagaaggggugaagauauaaucuacaacauaaauuuuuuuuucgguauuuccaacucuaaugcagagcaaaccggagcauuugcuguagagacaucuuuacucugagacaaaggcgguauagacaggugacacggaagcaaagcuggccacugauaaugugggucguaaguaucccaucacggucacucgauccucucccucccuccacuugagcuacucaaacccaaccucagaauuccuggcuguuucugcuuuuuauuucaauuagaaacacuugagacacuucaccacuaaaaauacgcuaauacuguccggacaaaacagagcuugcauuccuauagagagacaacccugucaagcaugccaguuaauaugccuggacuucaugcaggaaucccagccaagguaaaacagagccccugcuggugcuuccuaccaguacuuccaaacacauggaagaccuccagccuggaagaggguauacauuguaaccugauauuguccaggggaauaaaaccagcucaggccauucaauccggcuuugcuuacuaggauaaaagucuucuccaagagaagaauuauuagcauuauuuuaacccguuagguacuuuuaaagcuuccagaaacuuuccauuuaaagucuucagugaacggaugaaaaauaaucuaaagugaaaugaggguaucauuugccccagugauaauggcuaucauuccuucaaucaagaucauggaaaauaaaacugauacccaaacugacaucauauguuuaaaccguccgagauuuaacauggaggccagcagcaaaccuuaaucuucaacaccccuucuuaaacacccuaguugaauuugcuagcgaaaugcaugagcaugcgagggagcugagaacccuuguaccgggagacaguuccacacugcuccugggcagcugugcucugcauauaggcaugcagaaggcugucuccaacagaggccgccgaacgauugacuauguucuccaaguauuaaaacuaugugcuguucuggcauccaggggcuccauagucgucaucuuuguaugguuucgguuaaaauguguauuuuuguuaaaacgacauuaggcuuguuuuauccaaaccauauaauuaaacaaggaaaccacaugcucuuuguuaaacgaucccagaaaguuuuuucagugaccucacuuugacugaugaaacugccuugugcuggcuuaaaggaccgcauuucaaaacacccuucgcacauuucaguacucaucucugggcuauugugaagacuaaguaaguuaauauaugguuaaaagacuuuggcuguuauuggauaacucggcuuuuuuauaaacuucaauuugauucaaaagguacuucaggaagugccaacuacguuuaagacaccaugcuagauucuauggggcuagucacagaacgauuaaaacaugccccguccuggagguacuuaggggcggauuuuuaaucuuaacauguauuaauggagcuaggaagauauuucaaucaauauaaugcuugcugcacaagcaggagaggacuggaguucauaucuccugcacccacuuaaaaaaaaacaaaaacaaaaacaaaacaaaacaaaaccaaaaaaaaaaaaaaaaaaaccagcacagggacagacuguuugaccuccagcacccagggaaaaagcugaaguuggugguggguaucugugaccccaacgaugggaagcagaggccgaaagcuggacuaucagcaagccaaagucuuuuaaacauauauuaacauacuuaguccucacaauagcccagagguggguauuaacugcucccaacuuagagaugaagaaagcaaagagggugguaagaagcgaagguaggcaggaacuuguuaaaagcacaacaaaaaaaaugcaugcagugcuuucaaaggaagagggcaucucauuggguagagccugcaagauguggucccuuaauggggaagaggaagcagggauccugagaaaagauaaacaagagaaggcacuguguggaggcgcucuguuaggagcaagagggcccccuagcggccacuaaugcugucuaagcugagugcugcgagagaggguuuuaguaaaggaagcugcggcugugaaggagauaaguggucuuagagccuagcucaucaccaguuucucucgcuaauaaucaagugucucaacuguggaugcuaaacgaggacaauggagaaggccccgagaaaacgaaaagaagaccaccaaggcaguuauagaacugcggggacugugcacucacugccugcugugucccagugcugcggcucaagaaccagcaggcuggaggccagugaagacagucugagcugacgagcugaccaggcuguugaacaugggugacuaaaagaccagggcaaucccaccgggggaccgggggugggggguggagggggcucaggccaccaggaggcagagcgcacgcuccuucgagagacggccaagaagaguuagggacaucugugcagagcagaggaagaugaagaaaaggcagagaccuaagggaacgacccucacauccuacacaagaguguguccggugagagaaaacggcggcaaugcccagaugagggaggaaaggccaagcccaggcagaacugucccgaaucaaaacaucaucaucaugacgaaagaaucaagaaccgaauuauuuuacauugaccuuaaauaccuuacugaaaauuacauuuuuuuuuucaaauuuacaaagcgcaagaauuggaugccaacuuaaaagcaagcaaaugucacagaacucuaaaacucuucauuuugagagacgaaggagggcccuacguuucccaagauggucccaugauagaaacaaaagacagcgcccugcaaugucaauuucauuccauuucacuaggugaggugcuuccuaucgaaccgcaacacggaaugaaauaaguggauuacacgaugugggaggagucuuacccuggcccucguacccccccccaagugugccgcaccuccccagucucccugugugcacaaguucucccaaacuucaucucugucugcagagcaccauguaacucagcauaauggaugcuuagcacagggaccacauggguccugugacaacggggaguacagaggccugucccugugccuggggagucagauacauacaugagguugucaagauaauacaaagcaaagcacacauuaaacccugagcucaucuacugugcgcugaaguuacgacaggacuaggaaagauucaaccucugacgugauucauaugaugcuugagguugggagaagcugacaagugcuuuccuuucuauuucaguacugcaaaugucccaacuuucggcucuucggauauaaaacgggaauacaggcauccuucuaaauucaccauaccauuuauagcuuaaucucacagggauguucaacgacagcugacaauaagccucugagauugacgugcaaacgguuuuugcccagguuuagcugguuagacuugggcaauccucuggguacaguguuuccauuuggcaagcuuuaguuuuccauggggcaaaccuggcaguuaguuaucuugacuauugauagucacaaugugcguuuagcuaaaagugcaggagaggugaaugaauccguauaaccuugucaccagggcaacagaaguagcuuucuaacauaucucccugcgucuaggaucacuugucugucaucuccaacccagcagccagaaggaucuuaagaaacaaaacaaacaaaggaacaugagagccaguugccuccucuccuagcuccccucaaaaguccuuagcauggcuccugcaaggcacuggacccuccccucuguguaugccccuuuagccucuggucucaauguuggcuaaaucgcuggcccuuugcuccagacacccaggacucucuucugagcccugagcaagcucacuuccuacuacaaagccuuugucucuccugggcucucugccaguguagaugcagagucagacaugcagcccccauccucugagagacuucuagggaguaucuccuuaaaaacugacaucacacaggacaccccacguccuaggcauggugugacaaguuaacaaucuugccaagacauguuaaagaaugcauuaaaauaaaaaucaguaagagcggucuacugaacaagggggcucuaaauuuuugcggcaacuccagacccaauauaaauuaagucaaugguacuucuaccuccccaucagcuggcacaguuaucggaaacaaaauagcaauaaaaagaaugacccuggaaaugaaaacucauggcaggaccuaguaaggucugaaaggaaccuguuccugcuguugccagucuucauaacaugaugaaguccauaagacacauuuguauucugccagcagaucaacuccuaugaauucacccaaggcagcaauccugagguaacgcgcagaggagugcacagacuggagugcucauuacugcagggaggcggggggagcgcaggcaaggagcgggagaaagaaaucaacacguggcaacauaacagagaaggcaacgcuggaggguccagauguuuuuauacaacaacuaaaaauguuuccaaagaaaauuugugauaaaacggagacauuuuuuaaggcgaagaagaagaaggaagaaggaagaaggaaggaggaaggagggaggaggaaggaggaagaggaggaggaggaggaggaggaggagaagaagaagaagaagaagaagaaggaagaagaagaagaaggaagaagaagaagaagaagaagaagaagaagaagaagaagaagagaggaaggaggaaggaggagaagaaggagaagagggaggaggaggaggaggaagagaaggagaaaaaaggaagaaggaaguaguaguaguaaccugcaaaguuguauauaccaaguguacuuucaaacauuuccaaacaacaugaaggaaaucucugcccgguguucugccuuccuacagcugagcacacgucacuaucacggggaaggggguggggcggcggugggauuaacaauaaaguucaacuuauaugugaguggagaaagggaagcuguuaacuuuauacaauauccacccgcccuuuauuuuugucacuaaguuguugguacacuaagguuaggguuaaaucugauuucuagcaucuaacacacagccagccugguaguuguccaacaugacuauauaugcaaacagucacccacucacugagccagcuaagcaaaaauacacacacaugcuuuuuuuaaacagacaagaaacugccugccaagucaaaaaucuuuuguguuggaguauaguugauuauuauuaagagcaaaugcugacuccuguaagugccuuuuuaaaaagccuuuugaaaagaaagaaagaaaaaaagauaguuucacagcugacauggguucuaauuuaaacacugaggacagaugagaugugacuggguuggagccuggaaggaaaucuggauaguggagugguccuggccacagcucuccugagcagccuccaucccucgggcugcaguucuaaccccagacuucuccacacacuuccugggcagucacacugcuuccuacacugcauuaaugaucaccauuaagauggcagcucccaagccaaugccuucauuucagacucuucccucgaacuuggggcucagaucugaauccccaccgagcaaugcacucaaagggacuuaguguucccucuagacacagaaccaauuccccuuuacaucauaugcauccaucgauaagucuuaggaauucacaguaaaugucaaccucuccuaguccaaguugguauuagcucuuccagggacccugaagcugccugcuaguuugcuugcucucaguccuaacccuuagcagcccuccucaggagccauuuucaauaaacaggcaucaauuucucagaaaggccuucccagucuccagaccaggcuagguuuaaaagugauggaucaagcaggaucccucuaucuccgucagccuuacagugaccugguguucucugcugugaagugggcuucagcccacgggguuuacccccacuagccuggcucacuggaugggaucuaaugugugacuggcacuuugauaggccucucucugcaaaccucaaccacaaaccucaaccacaagccuuuuuauuccuauuuucaaauguacucacaugauuuugugucugucaacuaaaaucucacugcuaaaaauguuugccauauaccuuuuagucgcuauauggaacacagagaccugcaacuguugugaugcgugaaagaggucuucacgggucaaaaccuagagguaaucauuaggaacauacuaacuggaagagaggcugucucauaggccuugucgcuuguccaucucauaagccacgcuugcuuccuuagucauucuccuuuugauccugaacuuguguaaaccacuagaaacagugccugacagaaacuauuaccggagacucaauuccaguccccacgagucaaccagggccaugaagcagcccguggaaagccgucccaccucuucuacccgagccucugcuuggcaguuugcuagaaaaggccuuugugagagaucaggcugcuagacggcuccugcagguaccaagaagcagcucccagcagugugguaggaaagccaguguaacucaugaaggaagagcgugacucacuaggucuacgguucuuacagucgggcucuugagggacauucuggcuacaaugcauucuguugaccugacgggcaguuccaugguuagcacucugaacaugaucugaccaucgaaggaaaaguauaaauuauucacuaaaggcuguuagaacaacugggagccagaaaaguaaacagacacagagucagacagagacacaggaaaagagagacagaaacugacagacaauuuggcccccaagugggccaaaaaaaaaaaaaaaaaaggauaauuuucuuuuauccuugaguaagucuugacucugagcuccaauuauggaggagaacuuugaaaaauuuuacuauauaaaaaaaaaagacauaaccucugcaugagcuaaacacaggacccaccauaaacaaacuuacaacagccaacugucaaacagggagaaauauuuacuacuuuucauaucauguauaaaaguccaacaccaacaaaaaaauccuggcagcguacaaauaaaauacacauauaaagagaacuuuagcaaagagcaugugagucagaaucgcucugugcagcgauucugaaucgcucagguccagucgugcaaaaacacagcaguaagaaaacagauucucaugcauugugucuaaguaaacuacaacucucaggcugggugguggugguggcgcacgccuuuaaucccagcagucgggaggcagaggcagguggauuucugugaggugaggucaacugagugaguuccaggagagccagggcuacacaaggaacuaggggggggggggggacuccacugggcauuuaacucacacaaaugcaaaugcacuuaggaaagggcaggugcaaagucacucuuuacagaauuccauuuguaguagaaaaggccuaaauaugaaaggguaacuaaggaacaaagggacugucaagggacaggacgagccagcuguggugacauccuaggagauccagaacaggacagacaggaggccagccugggcugcacaacaaaaacuaagaagcuguuugcugucuggaaaggcugcaguggagaacaggacaggcacgaugacguguagucugaugguugccaucguguacagaaagcauccacaagaacacgcagcaggcaaaugucuucucacgcgcuugcucuacaacagcuuuucaagugaauggcugcaacagaaacugaggcugauucaaacaauggggguggggagggggcucacacccuaaaagcagguuuuuaaacauguuagcuagaaugcaaugucccugaagugauauguuuacucggucugcagauuuuugauauuuauacugcuaaaaaaaaauuaaauuacaaacaaagccaguuucaugcugaacaucauuacuacgccugagaaucuuggagggcacuagaauaggucaacacuaccagcucucugcuacaguuuuucuucauucuccuugucugacuuuaaaaggucucuuaauguccaaaguguuccugaggaccugaggcucacacaggcauguaccaggagggugacaggcacuauuuacacggcagccagacgagcauccaaucgcaaacacagcuaggcuacuuucgaaguacacucaguggcugcauuauaucaaauaaacgauauucuuccuugucacaagaagcaaacgucccaagugaaauacuauuugacuucuauuuguggaaaaacucagugugccaccuuagaaaagccccgguccaaaauccaauaggaaagaauuuggcagaggagcgggcagcuuccucccucaaagccaggcucgcccaggauccgcuccucguuucucuuuuuaugucuuagauucagcaacacuacuaucaacgggagcaucucaaagcagaaaacgaaacacuccaucucacacugcaccauggaggaugaagggagaaaggggcuggagccucuccccaagucuucacuguugggugccacgccccucuucuuccggccacccccucauuucucagcucucccaugccaaucaagcuauaaaaagcaacugaccauggcagcugucagauccaucacacccucucugacuuaggauuugcacacacguguuuguuuguguguguguguguguguguguguguguguguguguguguguacagcacgugauaagauugucugccuauguauuaagucugauuuauggaucguuuucacuauuaaccugugcuccaaaaaaccucaaguucaggaacaugaugaaaaccauaguuacuuuaagaaaauacucccuucucauuaaacauuacuaaaaacacuuugaaaacuggaaucguaggcagcaccauccuugauccaugaaacccaagcuccuuucuuccagcccaauggcacaaauggaguaucagugacaaguuuaaagaaaaaaaaaaguuugaaguccccgaaaaccuaaugugguggcacacaccugucauuccagcacaaaagggguuaaggcaggagacucuuaaguucaagaccagccuaggcugugaagugagguuaugucuccuaagacaaacacaaaauugccuguacacaauaacuggcucugucaaaauggaauaacugggcuuaauaugaauccacagacuguucuucucauuagauucuaggaaucuuucuuucuuuuuuucuauuuauuuuuuuauuuuuguuuuuucgggacagggauucucuguagaccaggcuguccuugaaauccaccugccucugccucccaagugcugggauuaaaggugugcaccaccacugcccagcaccuucuuucauuucuauuuagagacuuaacuagagaccacagccaaggaugggugaggggcuugcuuuaaccuaacacuguaaaauucagaaaaagcuaucugacccgauuucuauuucuucccugccuccccccccccccccccccccgagacaggguuucucuguguagcccuggcuguccuagaacucacucuguagaccaggcuggacucgaacucggaaauccgccugccucugccucccaggugcugggauuaaaggcaugcaccaccgccgcccgacugauuucuauuucuuaaucauggcauuaagaugguaguaaaaauuauggacugguaaggcuagaauuuauuuuuauaugcaaaucacuuugauuucaaagggcuguaugugaaaaaaaacucaauuuuuuaauuauaccguuacccaguuaucugcaauagacugauguauuuggugcaguaagaaaauacuagaauuugguacuugaaguuuagggaaacugacaauugcuuuccuuucuauuuacauacuguaaauacccaacuuucugcucuucagauaaaacaggaaaauaauuuuugguuaauauuuaaaguucagucaacuugacagggauguucaaagacaguugacaauacgccucugagauuaacacauaaacuguguuugccuagcuuuagcuugcuaggguggagaagguacucacaagcucacgguuucuaguggguaagcuuuauuuuuuccgaggaaacaaacaaagaaaaauaagccggacggugguggcacacaccuuuaaucccagcacuugggaggcagaggcaggcggauuucugaguucgaggccagccuggucuacggagugaguuccaggacagccagggcuauacagagaaacccugucucgaaaaaccaaaaauaaaacaaaacaaaacaccaaagaaaaauaaguuaacacugugcuauccacacauaaacuggcacugcacacuuggcguccacugucaggucuccucacauccauccauagugcacaaguucacacuacacaugcccaagcuguuucccagcggccucaccagggugugagauggaucucuaauggccguuaucugguaaccugugauacagagcuuucaccccucagcuggugggcaccgggcugaguuagacuguuaaugaaggaagcagcagcuucucaaagcucuugcaaggaacacagggucaggaccacuuaaugccgggccgaaaauggaagaauggcacgucagacccaagucccguguuaaucucaccagcucaccggagcaccaugaaagccaaaccuucaagaauucuauaggaaacacaucugaccgccaaugaaaugauaguucuaagcccauucuccaucuccagacacuaaaagcaugaccaucaaccagaucuaaaaauuaaaacauccaaggauacaaacuggucuaaagccacacaagucucaauguagcucauuuaacguuuuaaaauacuuacuaaauauuacuaacacuguggaaagacuugcuguuuaaauucuuuuuuuuuuuuuuaaagcacccuacugaaacuaaauugcaauaguguaucaguccaggggguacuggcaacugugagacacagaaguugggauauaaaaauuagacacagauucuggaucuggcugggccgccugucaucaccacacucaggacguuaaggcaggccgaugagacaggagacuuaagaccucuuucuuacacagcuuggccucuggcauuugcaacacuguuuccaacacaaacacacaaaggacuuggugauggguugaaggcaaguuuuacugaagauauaaacucaguaacaaauuccuccuuuuaaauauacacuguauguguaggacuucuacuuuaaccaaaaggcaauucucugauaaccuuagaaagcgaaucuagagaauuacccugauucacugagagaugcaaguuacugagaagccgaagugugaccugugcccaggagcccaucagugggcuacguacacagauuugugcaugugcauauggaagaccuuuaaacaaaggaauccuugggacauuuuagucagaggguggaguugaaaauuccccuuucucucuccuacaguucaccaccagucacuuacuaucaauaacuugaaaaacaaugugugaauuaaaagacaggcuaagggggugggaaagauggcucagcaguagugagcacugguugcuuuuucagaggacuucgguuuaauucccagcauccacacggcagcucacaucugccuauaacuacaauuccaggggggcaggacccacacaaacauacacgggggcaaggccaaaaugcacauaaaauaaauaaauaaauuaguuaauaaagauaggcuacaggccuuucucucacguggcacaaaucuuaacagcacccugaaucuacccucucuguaaagaaaagguuucgagaguucauggggguaguugcuccucgaacaucuuguggaaaagcuuuauggauagaggcuugaacauaucuguaucacgcagugauuugcauugaacacguggaaggaguaacuuaaaaacccacuugcaugcucaaaaagcugaaaggagaaauuuaauuucucuuuauaaacucauuuauauuaggcuuuuauuucuuuuaaacaaacaaaaaaauguuuuuaaccuuuauuuguguuuguauuugaaggucagagggcaacuuccaggcacugucucuccuaccaugugugugcuccagggaucgaacucgggucuucaggcuugcuggcaggcgccguaagccacugugcucucaccaggcuaggaguuucuuaaaaugacagacacuuauaauuuucaaauugggagcaagggaaaacugaagucagagcagagaaaauucacgcgguaagaucccugggaagcagaggcacaagccaggcgauguuaaagccucagaucccugaggcaaugugccaccuccuaggacugcucaacugugugaacugagcuaccaaagccaugagugcuaaaucaaacucaccuuagauucauucagaaaaacuuuucauuaaagccuguuaaacagggauggguguuuagaaaaaucacccaucguuauuuggugcguuguacugagacgucagaaugacgugggaaagaccucacaucugcacaggaugaguggugagcauuuaaaaaaaaggaguggggggcaaaacucuugacucacagagaaaaguaauaauaauaauaauaauaaaaaucaauccaggauacaaaucugguucucugaaaaccugaaggugauacccaaaguggagccaauaauagcaccuagcuuuccacuggaaauuucaguuuaaauguauaugaacccauucauuuuuaguagaguucccaagcuacacaauucaggggacacaaucuuugcagugaccugaccuuuucagcugaguggggagaggacaaucuaaaccggaagcugauguaccacccaccuaauccaccuacuagggcagggcgcugacccgauuggaaagggaugcuaauuagaaaaugugcauacauuagaaaaugugcauacauuguaucggcuagauccccaacauccaggaagggauugcuaguuguuauuagcacauacgggauacgggaagugggaaccaagcaguguuuuaaaacuacauuaucuccacaggacuguuauuaugaucguuuaaaguacugaugaaaaaauaagucugauaguauuacaaucacauuuuccaugggggaaaauaagccaagcuuauuugccacugacagaacgcucagauggugaacuucauauuuggggaaguauccacuuaugauguuuccguuacaaguacuuagggaaaaguuacugcuuuuaggauuagaaauuuuaggaaacauguaauaagcuauuuugcacggaaguuuucuucagcgcaaaaauaaacacaucucuaacuuuaucaagaagaaaaaaaaaauacuucaaaguugucaagcaagcuggagaggcccaggguccuguuaaccaauucuagagaucaucuuuucccaaaauaaacuugccagugccugagcgcggcagaguacuagacuccagccugcucugugcucugcagggggcaccccgcaggcgcuguuauuacuuggaauaguuugugcucuagauauguauuuuggcauucgucaguugugagggguggcccacacauuaaacucacaacugucacaaaacauccccacuggguaagacaauucaagcaagaagaacaacaaagaccuacaauguagaugauuucaaaaccaugacucacuccuaaugacugccaagaggcuggaaugauacauuuaucccaaaggcuacauaaaugugagacuaccaacgguuuaucgcacaguuuccuagcaagaaggcccuccuauaauauaaaggcgccaaagaguuaaguuuaggaacacuacaaagguaagagcugaugacgcugcccaguacuccccacuucugcaggaacaaucaaaaggccucucucaccccgggggggggggugggggggguggggggggcaggaguggcgcccugcaaacagaaaugaggcagugagaggcauggacagaaucuaggcagguuuguggcauucccaagcucccccugaaugcacaaggcuuuucaggaacagccaucccaguuuccuguucccacacugccgccaagcccgccaagccuacucugggcacuuccccacaaguccacuuucuucagcuuucgaacacaugaaaaauggaaaagugccaaucccuuucuugaggugccaccaagccugaaagggaaaacauucagaucacacacacacacacacacacacacacacacacacacacacacaaagcaugcacacacuuaaaaaacaacaacaacaaaaacccacugauacugcuuuuaucacuaacuagagaaaugaaggagcuuaggggagucacggcucugguuacuuccauuuuaaaagagaauucuuucaagcuggagagauggcccaauggugaagagcacuugcuguccuuggagacaacccaguucccagcacccacaggggcaguucacaaccaccugucacuccaggcccuagggaucugaagcccucuucuggacuccacaaguuaacuacauauucaugguguacauauagacaagcgcucucucucucucucucucucucucucucucucucucacacacacacacacacacacacuuuuaaacuaccuucaagcuaaguguauuagauauauuagauacaaugagaagcaaugauaagaccgacaacaucaugggccucaggaagucgggcaguacacagaauauguacuuuuaaauagagaaaaaucccaacggaggagcccauccacaaaggauggggguuaaggagaacuggaugguacauaugaugacaaaccaaagguacuucuaacaugaggaaauguagcugagcucuaaaaggggaguaggggaccucccagucacagaaauccccuaugacaagagggaguaagacaucgugucuuaagcaagccagcuggaaggccaaaucauggggcuugucauuguacaaaaauaaacacuuuuuuaaaauuggguuuaagcaggaggcaggcaugaagagcaaaggccaugggagcggcugaggcagggugaugcccauccgggguagaggcugaugagaaaagacacugagagaagaggugugaagaucagcuaagcuuagagaccucggacagagggggaaacagucucucaacacccggugcugggaacaacugggugggauacagcaggaagagaagaaccgcaagaaaagaagaaaacccugcucacucgccucacuuuuccguuccaaauagaucacagacgucaauguaaacucaaccguuaaaacuuuauugaaagcaauacagggggcuguggagauuaguuuuuucuuguuguuauugauuuuuguuuuguauaauaacuaccaaacucauggcauauuagagaggcacagcucauuaaaaugaaaccuuucucuucucccaggcaccacugggugaaugaaaggucaagccaugaaaggaaggccaucugguaaggacccggcguuggacugggacuucagugccacugagaaaaugacuuuuagauggguagcaguuauggauagcucgccaaagagacaagagaacaagacucugacagagugcgacguggacuggggaccugcagauuaaaacaaugaagagccaccgugagccaccgugagccaccgugagccacugugagcagacagacgcagacacuggcgcugccagaugcuggggaugacgccaagugacagaaccgguagccacagcuggcaaagaaugcaaaaugaaaacggccacuuuacaggacagucgcagccugugcuacagagggaggcugagaacgggcacuuugccagaagaauucaaacuuggguccacauaaagaaagcaaugucugaacaaucauggaugguauuccuccuaucagccccaaagccgcugugagaagccauucaaugcauaaacaguagcaaauauguacgccugacaggagcugaucugccaccaaaaagaaaagaaagaaagaaaaaaccauucagcuacauagugccaaugaaagcaagccagucugccccgucacacugaaggcaggcaaacuggcugggaaacgauuggugggugccagaggucacagugagaaaaauuaauacccaaagaccacacauuuccaaauuugcuacaaaauuaacuuacgcaucauguguauaaaacugcuucuccaacugugacaaauaugccacucacuaggauaguaauggagugacaucaagggagaggucaggagcuacugaggugaggcagagaaagagcaaggucuacacgucugucaccuuccuuuuccucaaagaagggucugagaagggcaaaaggguaaaaacugguggacagccaguggccaaagaaagccacugguuugcguaaaaccauuuaagcacagagagaagcgaggacaacacgccgagcccugaagcucauccauggcugggguggagagcaauggcaacuugagagacaggaagagagagaagagagaaaacaugaagucacagaagccaacagagugcacuucaggaaguacaagaguucaaaccaaggcugugcuugcacaaggucagacagagaaagucaugagcugcuguguuuggcaacagagggggccuugaugacuguccacagucaucacgguggugcaggugcaggaagcaaaagccaggcugggacagacugaagagagacagaaucugagaagcugugacaguacaaauagaccagucuggguguccaaggugcggugacuggagacaauguguaaggaaaagucgaguggacuuccuucugcucuaagcccacagggaggugagcugacccgcaucaccauuuggucugaaacucgauggagccagucaacuccagccucaacaacgcacuguaggaagccuuucugugagaagcugcuugucuccaaggagcgcuucucggagcuggcacugggcaguuuucaaucauuucuaaaccuguuaagacuccaaaagccuucuuuacuaaaaacugguguaugaaagucuaacagauacuuacagugggccuggggccagggcucagggagaaagaaugcaugcugcucucagaagacccaaguucaguacucagcacccacagugaacggcugauaaaugccuacacacacaccuacacacacacacacacacacacacacacacuuauauaaacaaauacacaguuaaaagugaaaaaauaaguggggcagugguggcacacaccuuuaaucccagcacuugggagguagaggcaaauggauuucuaaguucaaggucagccuggucuacagagugaguuccaggacaaucagggcuacaaagagaaacccuguugugaaaaaacaaaagaaaaaagaaaaagaaaaaauauuuuuagaagauacccagagcaaugauuuaucaggacuaccugauaguagaggaaagagaacauuaaaaaaaaaaucccuuaaccagauucaagagucaggaaagacuaaauaaauaaauccgagugacaaugauggcuugcaaagugcacagagcaacucuuccuccacgugggacuccaauauagucaaggcaagcgcaagcagggccagcucaaacuaggagaagcaggcaaaugcagaaacagcgacugcugccuagcuucccagcuggugcaaaggccagggaaugagcgagcagcuacugggaacuaggagggaaaaccuccuggcaaagcaccaugggggccucacuccuacaugauccaccuccagguucuugugguaaagaacauacaaaaauaccaggcuccugugucuagcaaaacuaucccgggaaagugaaaaaagacuuuggcagacaagaagagaugggggugggagaagggucacagaaaggcgccugggaacauuaaaaguuccuguaagaggaaaacaaggcaggucuacacaaagguaagcuuggagacagugggaaagcagaaaggauacuucugcgauucucagcugaucuaagccuuuucugaauggcgaccgcaccaacacgggaaagcuagcacaggauggagagaggucuaggaugcucugggacgaggcagcggcugggcucaggaacugaaauaguaauccgaagguagacuugccugacacggauacuuuaaucuccaggacuaaaauaaaccuuuaguuagaaggcuaagagaaaagaaacauggaauuucauaaaaugcuugcuugcuaccagagaagagugggggaggggagagacggaguaaugucgaaaacacaugaaagaaaugaaaaguuacauacaagguaacuaauacaccgaccgucucagccaucacuucagcugcuaacaguguaaacaaaccccucaaagcgcgaauaccaucaggaaaacaagcgugaagauccagaugugugcugucuaugagauacucugcuuaaguucaaaggcccaucuggauuaggcagagugcuaagggacaggcauggggguauauacuuguagugccagcaccgaggcagaggcgggaggaucuggaguucaaggcuagccugggacaacagggugagaugcuagaccaaacggaggaaggacaggcaagacaccucaagcaaacuggaugagaugaucugcaucuagaacucuggcagcacucccgcggcgagauggcuggugcaaacagaauugcccaggacaccaagggccagcuagcuagccugaagccugcagcuuggcagaaauaauaggagacucaccucaaaaauaugagagagcugauaccugaacacuguucugucuuccaaacaugucccaugacacgugccuacacgcaagaacacacaucacacgcacagcgauaauuuuuuuuuuuaaguagagaaaaggcaguauguauuauacuuucacuaaucaaaagaaaucggaaggcuggggauggugguagaguucuugcugaucauacaugaagcccuugaguuugugucccaauaccacauauaucaggcaugacggcacaugcuuauaauucccaacacuuggagaggcaggagaaucccaaguucaaggccauccauggcugcaugcugaguuugaggccagccaucauaacauaaaagaaacauuagacgccagaaaguuggcucaguggucaagaaaucacuguucuugcagaagacccucagcuccagcuccaggguaucccauacccaccaucagcaccugcacuugcaagcucacaggcccauucccccacccccagacucucacauacacauacauuuuuauaaaucuuuuuuugaaagagaaaaaucuaaaaauguggaaguacuuguacucauuucaaaguuaaguuugagaacacgaaaaacauucaagauagguaaguauuaaugauuaaaaagaucaauauuguaagcugugaacaucuguaguauguaugugcucacccccgaacuccccgccccacccccacaaaugagacuacgaggcaaaaacugacagauuagaaaaacaagcaaauccuccauuccagugaaagacuuuaugagaguaacugccaagaccuaucagagagaagaaggcacagccuaacacaucaucaaucagcagggccuaaaugacagcuugggguuacuacauccaacagcaucaaaauccaucuuccucugaagcucccacagcacagucaccaagacaguucauguuuagagcaaucggggauauccaaauauuuucagacaacaaugaaauuaaaccaaaacuuaguaacacuucaagccagcugccgccccucaaauuuuggcgaggcuuuuaaagucaaguaguagucugaagagaaacugaaaguauuucaaacuagaggcugccagggugacuccccaugucaagacuccuacuggacaaaccuggacaaaucccaaauuuaauccccagaacgcauacaaagaaagggggcggggggggggggagcaacucaacaaagcuguucuccaagcacacgccaacauaaacaaaacuuuacaaaaguauuucagacuaaaggaaaaggaaauucaucaagaucugggaaucagagcagcaagaauacuaccuggagggaaaugcccagugcugaacacacaugcaaaaaaagacuuauggggagguggggggaaucaacaaaacccaacucuaguucuuugaucaaugcacugacuacuggccacagugacagcacacacuaaugacacacuugaaagagagaccaugagauccagcaaacacuaaaaggacaguaagcauugagagagcuguccccaaaccuggcaacuuaaauaaaauacaacaauaucuucuaggaccaaucuacuuaaacaagggggggggcgcgucccggaauguuguuaaaugcacagaccuguacuuauuaaauaaaugaagacacuaauuaguagccuucccaaacagaagcgcuagauacugaugacaacacuccugaacacuauucucuaccaacacucauugcauucaaacacacacagccuauuuggaaagaugaaacacuagcuaguaucucaaacaaugguaacacaagaaagggagauuauagauuauaauuauagauuauagauucacuucucucaucaacaaugaugcaaguccuugacaaaugaaaacccaccacaccuaagugccacucacuaugauuuauccaaugcaugcaaggcuggcucaacucagaaaccaauuaauagaacuaauggaaucaaguugcagucgaaaaacucauacgaucaugaaaauaaaugcucuuuaaagauuugguuuuuaagggguuuauaucucuguaugugacagguguggguaugaugagugugugggugccuuugaagaucguaugagggcaucugguacccgagagcuggagccagggcaagugcugucaaucagagucaucugcagccuucaguaaauagaugcuuaugcauuugucaagauucaacagcaauuccggauuaaaagcacuaagagcgacuggaauggaacuucagucucguaagagugccgacaagacugugcagcuaagcucacaacaccuuccccuaauacuggcugcacaaaaacauguccucucacguguccaauagcagaugcuaguggcauaagcaaaggaaauggaggauagacuggagaagaagaaaucacgaguaucucuguccccagacaccacucccuaccaaccucgcggggaacacggguggggaggggggaaucucaacucuguaggucacuacagcagggcugaaggauaugaagcgaauaacacgacaagaaagccagcugcuuugagcaguaagucacuggaaaggaaauaaagacacugcuucgcuuuuacaggaaaacaaaauacaaaaggcugguaugcaacuaucaaugguauacaacuaucaaggcacuugagaggcugaagcagaggacugaauuuaaggcuagccugagcuacaagugcuugccacgaguuuuuaaaauggggguuaaaucuuacauuaucucauaauuuauauauauauauauauauauaugacugaagugcugaugaaugugagaacagacaggucccgucuucaagaaugggaagaccgaaacuuuuuaggcugcaaauucaucccaaacugacauuaacuucaauguagccaaucaaaaugcucagcugcuuuuguggauggagacaaagaucugagacacuaagaggcacaggaaagccgaagacggagaagagcacaagacaaagcaugugaaggauagcauggcuucaggucuuccccaaagcuccaggcugagaggaaaugguagcaucgcagcaucaggacaggacaucgugccaagagacagaaaccaagaacagaguagauaucucugaaaaagcaacgagcaaagucuucaaauuucugccaucaaagggaagcaagccuguauccuacaacuuuugcaaaauguuaacucaaagucaaagaaauacuuguaaaaugccagaccuugaggguggggcagggggcuuaagaggggacaggacagggcuagacaacgaagaguggaggggaaaucuaugugaauggguuuggaauaaauuuuuacaaacagcaccaaaucaugacucauuaacaggagagugucaggauggacuucacuuaaaaugaguaaaauaaacacacuccuccgaaaaagaacauugucaaaggucuaaagacaagccagaauuguggauaaauuuugccaaacauauaucugacaaaggacugguauucaaaacacaacauaaauuguccaaaaucaaugaacugauuuccaagcaggcaaaaaacccuuaggauaccuaaugucaaagaagcuaacagagacaaaaacccaccauauacaauggaccuuucaacaaggauggccagggaccugugaauucaaacaauaagcgaccacugcaacuccuacuggaaaagcccaaaccagacaccaccaaaugcugaggagaggauacagucacuuuggcagggaugcaaaacgggccaaagaaucugcauuucuaagaugcuugcucgcccucccacacccucucuggugcccaggggcagcuagacccaaaccacacuuugaaaauuaucacuucagagaaaaaccaaacccuuucugggguugagugguggugguggugguggugguggugauagcuccggcaguaaagcccuugccuuuagaaguuugacaguuuuguguauaaaggagcugagcuuagcuuaccauaggacccagccacagcacgagcaggagccccuagggguucuaggucagugaccucuucugaugucaucagugaaucugugacacugugugagcugguacaggacucagcaacaacaguaagugccacacuaauugagaagggaauuauaggaaagauguccaccuuauugucuaauguauuuuccuagaauucccaaacuuuuuaaagccugugaguauauacuaaguggauccuuuugcagacccaacacggcauucuaugaaaauaaccugcccuucuuuuggcaaagauuuuuuaaaaauaagacaauagauuaauucuuuagacuaacacuuucauaugccaucuccuuugcccacugacaguauacucucaggcagauuuuauaagcugaguugcuuggcauagaaaacagaaauauccccagcuuucucacagguuagcugaaccguuggauaagcacaggcaaagcacccaagaaguguguccauuauagcuauguaaacaaaauccuaauucugccagaguaggauagucagccuuccuccguagccauagauccaacauuucagacuaaaaggacuagggguuaaaaacugucuucacgacacaugaggacaggucuuauuguugcuccuaaguaccagugugucagcugaucuagagaagaucucagacacacugcaaguuguaggugggaacacacacacacugcaucauuuuauaaaaggcacuugaguaucugcgauuugagcccauccauccacgcugcagagacccguaagcuccucaugucuuccuggaggucaguucuguaucccgguggaaaucuuaaauauuccaacuggcaacuaaaaaucaugcuaagcucuacggaugcugugcuguagagcaucuggccucuauuucaauacacaccacaaguucugcaucugcacuagaacuugggcuucgacaucuacuucuucaacgucuucaguugguuugguucauuucccaaaugguuccaaugaagcauugcuccacauuucuaauucuguuacuaaacacaaguucauuuccucaaugccagucauguaacaauacuuuggcuccaaaaggccugauuacccuuaaaucugcaaggacauccuggaaaaauaacauuuuauauuauaccggucauuuaacacacaauucaguuauuugugucagaacuaagcaagcaaaccaaaaauaccuuaaguggagauuauacuuuugugucucauuuuccaaggucuucccuauuaccucaacucuauucuuuuacuaaacuaugugccuuguacaauuuuugacuaccgaucugauucuuacaaauaauuucuuugugcauuauacuacauaaauuaucugcuuaggacaaccucaacauaauagacuuaagugcuuacuggauacagacguagggacuuguauagguuauauaucagugauauaagaucccauggacaagcaaggucaguucuuaauagccagacacaucuguaccguucugggucaauguuacaaugaaaauccaaaacauguucagagaccuauaaggcucucaaagacaugcuucagaaauagggggcauggccgugcuugaucuaguaggaaggaggcucaaagccaacaggagaccauauagagacaucaucaagacugccauauaugaaaaggaaaaaaaaacuuguuuugccaaccuaguaacaugauauccugucccagcuguggcugagaauuccacacauuuauuauuuaugaguaguguggaauuagaaaugguacacuguuucuauauagcaaucaauuguauguauaggggugauaaacugguucacaaagcagagaggagcaaauccugggucaaguucuucucagaacuacucucucaccaaaggcugagcugacaguggauuuguaucagcaacugugccguuuuacccuaagaacuagaacaacaauuuuaaaaucccucuaaggaaaagcaguauguugacaagcugaaguccuucuccaaacaguucaaaugugauguaauucacaguguuuucuguuaccucucagaagucaaugacacuugugaccuuaagaaaacaauucuaagccagacgugggggcgcaugccucuaauccuagcacuuggggagguagaggcaggugaauuucugaguucaaggcuagccagagugaguucuaggacagccagggcuacacagugaaacccugucuugaaaaaaaccaaaaaagaaaagaaagaaagaaagaaaaagauaacaauuuuaaccuguuuucuaccagucaagacugauuucucucagauacaccgaguauuauauuaacacucaaguuuuuuaaccuacugaacuguccuuaaggaauauaacaguauagcuuucucuuuccaauuacuuuuacauaguagguaauauuucuuacuuagaaauauggguuucccaacuuacuuaaaguguauaaaaguccuuaauuuaauaaaccaaaauaaagauuuuauauuuucuaaaucauagguguaaagccauagaaaugagaagccagaggcaaagugaaggcaggugguaacugggaaacgcccucauuuccaugccaaguacagcgcuuccacgguccuucacaggauacaaggcaccacacuaaaggccagaagggauacacaccugggacguacucaggaggcugaggcaggaagauuacaaguugaagacagccugugcuacacaggaagacugucucaaauaaaacccacuaaauuaaguaugggucauagacacuaagaaaggaaagguagacguugccuuggaacuuuauaauauuagagguuacuuguacauaaagaauacagugucuauggauauauuucuagauaaaccgcaagcauguaaaaacagaucuauuucuguggucuggaaaaguuuccgggaaaaccacgacccuggcuccucucucucugcagagaaggcagcccugguaggcuugugucgucaggagacaccgugcuggccacagcugaagcuccucugccugcaccacgccuuaccucuucuggggagagucucuuugaccagaauuucugaaaacuccgaugcacuuccaaguccuguaggauguuuccuauaguaaucuaauuuugccucagauguauauacuaguggaaaaagacuccagggcaccuccugugugguuacuuuguuuuuuuuuuuucacauuuagaacccaauuaauauggaaucauuuuuuacagguaacaaaaauaaccaaauggaaaaaaauuuaaaaaaagaccuuguuuccaaagcccaagcauugacauucugcucaccagggcagaggagaauguguugugugcacacgugcagcaaguuuaaaggucaggacuucuuuucguagaaaagaaguuauccaaagaucuaucccucuccaaaaaaaaaaaaaaaaaaaaaaaaaaaaaacccaaaacccaacccucguuuuaucacguacaaaaaucacaaucuguuuauacuacagcuaaacuauucagugguggugaagcaagccagaggccacgcccgacucuugagcauguggguaaaacccacauuuccacucugcaguguuugauuaugauuugauuauuauuaacgacaguauggggaagacugcaaaggcggcguguacaccucucacuucaucauuaucuuugcaaucauuuugaaauuucggaugccuaccacagccguccucugaagcaggacugcggaccuuucaacaacucaacucuaacauuaggaacucugcccucuaacgggagcuuuaacucaucuuuccaaacuuacccgaugaauaagaccaaagaauccuggcuccauccccugccggccccaguguagcaggcauuucaaguuaaacuuccacuuacaaugcucauuuugcucagaauggcauuuccuugggaagccaaaucgcuaggcugucaagccucaagcucuauuucucgugugggacuccauagugugugauuuagugucagaguccaccguccgagccucacguuugggaaagugccaugguggcugcugggggaggugaauguauggcugugaugaucagagucacccgugucuggagacguuaaaggcaagggacucucaagucaaggucuacuauauguucaagccgaacauuaaacagaaaacacuucucuuggugacaccucaugaauugggcaguucucuaaccagccauuauuuucaauaguuucuguuuuaaguagaggaauaauuucuguaugcuauuuuguaagggguuauauuuugaucaauguaaucucaaaaauuugaucaaauuacucuuaauauuuacuauacugacucuagaauuuuaacaggauuuuuuuucuaaaauuuaaaaaaaaaucaaaaaacaauauauucagaaacacuuagcaaaagacacauaaauacacuuaaaaauacgguugcaauuuucacuuucuacuccugaaacaaaaauaagccauuuaucaguaagugcauuuuuuccauggagaaaauauuuauuaguuuucaaaugaucacauaauacaaauauuacacaauaaaucauucuaggaaaaaaucacuuauauuaauauucauagaguaaacacggaaaagauauaggauugcauauugugacacgaaauuguucuuuaaaaaucuagaaagaaaaugcaucagaauuaaaguucaaacaaaacaguucacagugauacacaaaguuugacuuugcaguagcuuguagcguaugagguaauaggaaugcacuaacaucucguuugcauacuuuaaggaacagagcugaaauucauuaaagcuugagauuccaaggguaaaucacuuucugucuucagugcugagacaaaaggcuagugggcucaggcauaaaauggcuccuacugugguuuaaagaauacaacaggaugucuaguaaaucccaguuucaguuccaaauccaacuuuuguuuagauccacuuguaagcuaucuuacuaaggcaggacaacaaagcugucaucauucuacaggaauucagaguucuguggggaauuuuucaguucaaaauuaucuuuaauauuuacuuuuaaaagcauuaaaacuuuugaaaaaugaguuauaauuaagaaauaguuuuuauagccaagaaagacuaaaagcagguuaucucuuagcugauagucuuccauguugagaggcuaacauuuuaguucuccuauuauuaauucuaugauuucucuucuuaagacuuauuccaacuuaaaagguguuggaauaacggugacugucaccguuuuccuuaguagcuuugacuggucaguuaccugauaaccaaagaaagaaucaccauuuugacagcugcggccaauugguaaauuggacaauuccuugaaaccuauucccaccuacgguucacucugacuguucacuaccucugcucugcaucucucaagaggcgcaaugcccacagugcagagucagcccuucaacccuaacaggcguuuacugcuuaggaacacagacugggcuccacugggccuccaagacagcuccauggcuuucaucauuucauaaacuacaguaagaauaaggcucaggaccagccagagaugagccaagaguaccugcuaacacuucaagacuuggguucacccuuuauucgcuuuagcaaugggugacaagagagaugguggacggguuccucaagcucucugugguguuuuuuuuuuuuuuuaaaggcugcuuuuuaaaguggggguugccuaugugauuaaaugauuuucagucccacaaaucuuuuaauucaagcagauacagagagcugcuuugaaagacaagacucucaagcuuccucuauuucagucuucagaauaagaaauauuuucauggccauguaaaacuccaauaugaaaagauuacuucauuauuugagccuuuccauuuucagaccaaaaauaaacccgaguauaucuuggaaguuuguaaguaacaagaucaggugggcuggcucauccuugugucuucuagacauagugcauggguccguucaccacugccuuccacacugcaggugcugccacggggacagauagcguccaugagggcucugcuagaggacuuccuuugcugaagagguaggauguuuaccaguugaaagaaaucugggcaauuagagaacaaauaaaccggucucccauuaucaagauaccuggagucacagaagaagccaccaaggaaacaaugaaaacuugccaaagcaccaaccucacauucuacccacugcggaucuaagacacgccugcacucacacccuacccuuggcaucaaagaaacuaagaaagagucaucuuaaugcccuaggaaaaaucuaggguuggcauaaauuacauuccuagggacuagaaaacuacuuuugaguauguguauagcuuucaggaacauuaaauccugaaacauauuuguuuuauuaaaggaugacaccuccauuugacaguaaagccacaacagugcuaccauuccaucuccuaagagaccgagugugaaggccuaacauuuacgguaggaaaaaagaccaaaaaguccucucuaauagggcagggugacaccugaauagucaacuguauaaauuuagagauuucagguguccaguucaaagagaaagaacagaaacuucaauuucuggacucugcaagaacucuaucaagucuacuguuacaauaaaggccaaagcaagaaaugacugccuuucuuucauuccugugaacuacacaggcauggagcaaauugugugugugcuccagauuagccacugaaucaguuaucuggagagaaaauuaaauuuucgguuuguuuugugaaugggcacuagacaguauucuccgcaaacacacagacugcagucccacuuggcuccuccaagaagccaaggggguucccaacagaauaacggggaauggaaggacacuccacucuacagauaaacccaaguaaauaauggaaagcacccacuuguuuauuauccuuucccacucucuccagaagcuggguauucugucuccaaggguucaguggagaaaguggagcccugacgucaaaagcucuccguggucuuggcuguaucugugcuguggcucuaggaucacuccuuguaccucugggaggagagaagcacugaaauagagcugaauauagauuuaagaaaaaauucugauuaaaaaaauuacauacucuggucauuugaguuuguaauggcuuauccucaggacaaaaaggagcgaucuuggugcaaacuuucuuaaguaccaucuuaauuucaauuguagucgucuguuaccacaaaugauugauuuccucgguagcuaacuaagaaggggccuguacuggucuaagccauaacauacucugugacaaagcgcucaacuucaaacagagaucggagcaaaaaaaaaagaaaaucauaaauuauuaugggaaacaagaucgcaguuguuauaaagggccagggagaaggcacucagccugauacaccaaagauccccaguuaauucuucuaugaaagagaagaggauggacugggaaguagaaacagaauaaucacaguaaagaauauuacuaaucaggagcaucuacagagcucaauuuaaugguuuaaauuccaguaauucagacagaccgaucaacacuauaggccaauauuauagcuuaaaaaaaaaaaagguuaaacuggaguuuuaucaaaacucugacuaaugucaaugaaaaagguuuccuuucuccagcggucagucaucuuugaaacuggagggccgcauaauauucauagguaauaaauacuuaaauuuuuuuuuuacaugcaugauccuuuuauuuggagucaagagggaccaggaauaaucauuaguggccagaauguagagauuagaacacggaaguauuccaaacaauagaugauggugaagaugcugggaaacaguuuuacugugggacagagguucaaaagcucacagugucugaucccuggaaagcucaaaggagaugcagaggcaggugcggauuuaaaggauaggaacgaacagcacugccuuggggaagggaccagcugccugugcgcagggugguaagcuccgcugaagccugaagccccuccucuauuccuaaaggugccgcgugucccugcggcgcgugucagucagccaugguguccuauuucugggaccuguuauauucugggugagcgaaggaggggaaaugcagccaaguuguuuuccccucacaccaacugguuaucacaaguuuccuuaccuguuaguggaccgaggguugugcuguccuguucucuaccaaacaaccaacaaagguuacaucucagcauuaaggaggcagugaccacgacagugucgccugccuucacuuccuccuggcucuggcagccaggguggaaacaaaccaaagcugaaaaggaaugguuacuccauuaucuaacaacauuuacacucaaccuuuucaaagccugaggaggaagagcaagcugaacccuucuacuuaggaacauacccagcucugcacagaugaggaauaaaaacaacguggcccaagaaaaggaaacccgugaggacuauaauuuccaaaaaauuaaaagaaaaaaaaaaguagcagaggagguggaauuggcaccuaggaaagacaggaaaucaacagccugaguacuucacgagccaaaguggcaacacguggcccucccuagcucacagugcccaauagacugcaggacacugugguuuuuaaagaaagggcugcccagggccuucucauugggaagggagagcaggaaugacaaaaagcacacacuagaaccaagaccugaguacagacuacccagagaaacacugucuaguccuuuacuaaaaagaaggacugacguucccauggcuggaauggucgagucugugacaacagcauggacccagggcauuggagacgccuuagacgcacggcccuugcacuucugcaauaauuagcccacaagaacccuccaauucuuucuaaucaauucuguuggcaaacccuuccuuccuuuuaugauacuucaauauaaaccacugaagacuacuuaagaauucuacauuaaugaaaucuaagcaaaauuuaacuguaagagucaagguaguguuuuaaaauucuauucagaaauuacaaacaaagguuggguauuuuuuuccaauuuucccaguccuaccccccccccccccccaauuaucaaauaaugaccaaucauaacccagagcuggauggaaacuggaaaaggugaagagccauuuugaacauuagguuaaguucacaacuucagcaggagcucuaaaguaaucacuucaaaaccuuuauuuuucacaccuucaagaaugcauguuaaaaacacagccaucuuagcuugaaaacagcaaaagccaaagaaagagaaccuuaaaaucuuugcauucaguuacagagcaaguucaauucaagcuccucaaagucccccuucucucagcuaguccuguauucuguccucagcaccaggccugcugcaugcucugacucaacaaccaauaaacacguagauuucgccagauaaaaauuacuuugguaucauucaagggaggcgguguuccuuuuacuguaaguuaaaauucugguuagauuugaugauuuuauacagaaaaaauguacaauuucaagaugggguggugaagugaagggcaucaacggcguuaucucaccaguacacagcagaccaccucgccccacuguccucugugugacauaacuaaguuuucugcaagacuaagaccugguuacuagagaauaaauuucaaaccaaagguaacaaacucugucgcgcugugaugucacaaggaugggagugauguaacacaaggacgggagugaugucacacaaggacgggaguggccucaguagccacgggcuagcaaaugcacccgugcucccgggaacugucuacauuucugaagauucucacagaaaauccagcuacguucaaauaaaaaaaaaggggggggguggggccgcuaagauagauagagauagcauuguauacauuuacacauccuacugagaaagacgcauuccuuggaaaggucuaucaaaugaagcuauuuguaaaauuugcccucaguacuauauuaucaaaugaggauauacggcuuacugguuuuaugcaucaucaaagaaaaagagaaagcuaaaccuacuuauuuuuagacaacgcacuugaaucacauuuucguugcugcuuuugagggcagccuuggucucccucucugccucucuagcgcuagugccacacaacagucugaguuagcccacacaugggauucucccuuaaagucucugcagccacugauccaguuaaaccugcugcuugcuuaccugugugcagacuauaaagcagacagcagacuuggucaccugccauagcaucuuuuucuuaucuaccuucuagcaccgauacuuccugguuuaaaagaacucccauuuaaaaaaugaacuucccauagacuccucuguccauaacugccccagcuggucaucagaagaaaacugauuuuccuaaauaaaugcagaaucuuugcucuccaggcccuaggaguguguguggcacgcugaauaaauaauucaguaaauguuuuccaaaugaagugcacuagucaagaaaaccgugagagaggacugcguuuccuggcuuucauacagguagacacuacacaguucaacuugaauucuuaaggaaacaacuuuauccacaguaucagaguucagacaggagaugagaccaaaccagacuaccugccacgccagugugucugcagagucagaccccaucucaaacaaaccacccaacagacaacaaaacccccucaccaucuaacaaaauuccauuaugguuuuuuucauccuuuugaaaaaguaauguucaaaauguuauugauacugaagucccaucacuagauuuaaaugucaaguuuuguuaaaagguaacuaaccaaaugugucuucacaagaacuaagguacaggaucaaguaagagauggaaacugagacgauccuuaacacaugauguauuuaaaguggucagcuuacucagacugaagggcaaagggcaaucagaaaacagaccugguaaguucugccagcuagcugugacaacagcgaaggcagccucagaggaaaggaaagacacaaucaucccugaaccugacucucacagaauaaaaaaagaacugucuguuugaccugcccacaucacggagugaucguaagucucaaguuacucagcugcgauuuuuagagcuauccuaccuuuucccucucccaaagcuccuuuugcuggccuugcucuuagaacaucaaagagacucugaaauauauguuacuuucagacaaaauaccccuuccauuguuuuuuuuuuccuuuuaauccuaggaccccaaguuguacacuguaugaauacacagaauaagaaaagacaacagguaauauucauguuucauugauuacaucaauuccuuuaguaucuuuauccauuuauggcaaaacccagcaacaacaacaagaagaugaagaauacaacugaaaaggcccugaugcggcaaggaugucagacgcuaaaucaagacaggaaguacaagaaacagaauacaugaugcugucccaggucaucaccuucacugagacaacuccaguaauggggcaaguagagcaggcaauucccguucuaggcacggggcagacagaccgcagcagcacuccucagcuacuaaacuccuaucccgucccaucaggagaaaacaaaaacagggcgaacagaagaaagccuuggcuauaugaaaauccugucugaaaaacaaaagcaaaaccaaagacagacagacugcuuauguucacagugcauuugacagugccacuuucuuuguauuuaucaagccagcgacccaaaucuccacagagaaauaaagcaaggugcuaggacgauggcucagcaguuaggagcacugucugcucuucccgaggacuggggcuuaguucccaacaccgcauggugauucacaacugccuaacucuaguucggaagauccaauacugucuuccagcaucccacagaacuaggcacaaacacugugcaggcaaaacaacugcaaacauaaauaaaauuaaaaaggaaggaaggaaggaaggaagcgggggugggaggggcuggagggauggcgccgugcaacuuucuuagagaggauccgaauccagcucccagcgcccuaugccagaggucuguaacccccuggaacuccagcuccagggagcuugaagucucuucuggccucuucagguacuugcacccaaauacauguguguauauacauauacauacacacaauuaaaauaauuuuuuaaugaaaugaaacuccucuaguauccuucacacauuuuggaagucacugacuacuuacuacucagaaguaaugccagauugugguauuucuaaaaacuaaaaaaaaaaaaaaaucauucuguccucaaauuuagaguucagcaaauacuuuaaagccuaaguugacuucacaguuuuauggcagcucagaagagucaagagcucucuccauauuaaguagcauuaucuucacaaacaucuucuauggcaaauuuuucaccuuaaaaacaaacaaaaaaaaaaugucuugggcuacaaagaauuucaaauuuuaccuugaaauuugagauuuuuuaaaccucgaaugguggcucaaucuauaaucccugcccucagaggcggccucaggaggaucauugcaggaggauagccugggcuacacaacaaguacuauuuauauauagucugagcuauauaaguacuauggccggguuacagagcaagaaccugucucaaaaaaaaaaaaaaaaaaaaaucaaacaacaaaauugcaacauuuguauuagcuagauucuggcaaccuaauuuggguuuccugaagaauagagugccuaccacauacagacuccaucccuaauaacugagcuguuuacgaaggcaggggcagcuggaugagcgagggcgugugugucaacgcagcacuguuccgagcaucuggcaaacaccucuguggugcucucauguggcgauauucaaacuuucauuucuaauaugaaugcauacuuagaaaaaauaagauaggaaacaucuccaauuguuauggcaggauaauaaauguaagagaaacgggcucaagaacacacaaaaaccaucuggcaaagccacugggcucuagaacuuuccuuuucccaugugacaaacuaguauuauuuaaaaaacaaaaacaaaaacaaaaacaaaccucauuuugaaaguuuauagagaacuuccaaauccagcucaauggaucuccgaauugaagaaucccgauuccgagucauccaucgccuuauugaucagccucauucacugagaugguugccaucccauauggggcugagaacggaacagauggucuucagggcacugugccauccaaaacaaucuuuacagaguuucagaucccgucaucuggaaacugauucuacuuuggaguguuaaauugccacaugacacuguauaauaucccuaaguccccuucacuuccauuagaaacaaaacaaaaaaaaaaaaaggaaggcacguuuuguaacaacuuuugcaucugugaacuuagcuagcccaagcacucaucaaauacucagauaaaggacaguccucacagaauggcauucagaaaaacaaccagccccugauguccccacugaauggaauacauuuuuugguuuuguuuuuaacaaaaugacaaucuguaucaugcuugguagaagugagaaagaagccacucugaagccaaguucuuccguacacucccuggcgauacaaacuacaccaaacaucacaaagacccagaaugacuugcugagaaggcuggaguauguacaagucuuagccugguaggcaagcuuucuuuuaauuuacaaugcuauaaaggaaccuucuuacucggcacacuagggacaccagccauguacagagucuccucugauuuucccaaacaguaccaggguuauauucuagcccccacagaacagcuaagaaaacuggacuaacaaaguuuaacucguuuauaaaagucaauuaagaaguagaaaaacgggcuggagagauggcucagugguuaagagcaccgacugcucuuccgaagguccugaguucaaaucccagcaaccacaugauggcucacaaccacccaugaugagaucugacgcccucuucuggugcaucugaagacagcuacaguguacuuagauauaauaaacaaaucuuuaaaaaaaaaaaaaaaaaaaagagguagaaaaaacaaggcuagcgaccaggucugaugcuaaaacugauguuccaauaaaaucauugaaugcugacagcacgaacagcuuuguugaucaauuacuugaaugcaaaagcugucaugugugcuauauaugggacaacaauugagcaaauacuuaacuuggaagacaccaagaucuaagaugcuuaggacuuguggagaucuuaugggcuuucccuuccuuguaucauuagcacuucugcuaaacacuagguauguaugaagcaagcacuugguauuucugagacaauacauuucuauggagaguccuguagagagcuuucuagacugacagacaacuccuuaagcuagcugcugucauuuucacuccccauggguagaccuccagguguaggcaacgaggggagggcaucccuggagagugggcuguaccaaguuacuccacaaaaacugucacaacugcaucuuuccuucccacccucucuacugguuuaccacccacccugguguuuguucaucuccuagugauguguuuaaccucuaacucagaccucaguuauucacuacucaugguauguagacucagugcuaaugggauuuaaguuucauauucaaaagcucaaauauaguacagcuuggcucugugagaguagacucuauucuuaaaagcuuuugguuuuacauauuagaucuauuuauaauaagccacuguaaagccucaugggcuuagacucugaguacaacuugaaaaauaacugaaacuaagaaaaauuccaaaaggagccuuaccuuccacacacuuaacucguggccuggcccgcggagacagaaggucugggaaggucacgcguagagguaaacugacgagcuuucacagcagcuacucccucccacuagugacagugagaauuagggagcagacaggguccaaucaguacccagugaugaccuaagccagcaccucauuucugggcuucacugcaccccaaaaaccccagcugucacuuucaacagcuccaaugcucauucacgaaaacaaaagaaaacgugacuaacuucugcaacaacucuuaaguacaacaacuccuaaugcaaccuuuccaacaacaaaugaaauuugcauuccaacagaaaggaggaaaaugaugaauuccauuuuuaaacugcauuauuaaucacucauauaaauuagcacuuuuguaguucauuaacaaacauaagcugcaacaacuaaaaauuaaagaccugagucauaaauacgcuauuacaacucaauuaguuagaguaagguuucugcuuuuagccuauuuaacuguuaagcuaugcugagcauaaggcagacacccucaguaagcuuagcacugagaacagacagucccaucuacucaucuuccguggcauaaaacugucucccuggacaugggaggcaagaggcagauagagcucugugauauuuaggacagccugggcuacauaguaaguuccaagacaagugaggguuacacagugagagccugucuaaaaaaaaaaaaaaaaaaagaaagaaagaaagaaaagaaaaagaaaagagaagagaagacaagaagagaagagugucuccaguuacucuucugaauugugacuagacucccacaauuccaaguuaacgcccaggcaguacacuuggaacuguuagcuacagcaaugggagccaccacuguccacugucuuccucucagguguccaugggcccuuaugaauuuaucaucaagcugccaaaaguucagaagcuaaaaggucugggauguggaguagucuuaauccaacagggcacgaggauaggagaggccuggaucuagauccacuguucucucgugaacuguaagaaguacucgcuaggaaccaaauguuagcgauuuuagcagguaaacaaugugaacacucaacuucagacaguaacugaggaguguguggugggucuccaugaaggacaagaacaguaaagagcagcuggggcgagugcaggagagaaaggggagagaggggcagaucugauggaagcuccugaccaucacgccacuaaauacagcauaaagacauggcccgugauggauucuaagagaugcagguaggcugugagaggaacacccacugauggugcccgggagaguugcagaucgcugggcuccucacaccaggcugggcacgucagcucacaccacagcugcuguguccacucaccagcuucauuaucucugcccccaaaggauacuuaagaaacgcccaacgacauaaacacucagggcaaaguguucacuuagcagcguauuuuuaaaacuguauuugcuaggcaaagucauccaacaucaucuuuauaaaguacauuucaaaagcggacuguguucaacaaaaagaaacuguguacaacugucaccaauacaaccagguuaucuagagagagcaagcaaggaaaugagccucaaguuaaacacaaaacuugcuuauaacgacaauaccugaaauagccaccccuuucaacccagcaaaucaaaaacuaaggggcccucuauuauaucaaaauaucuuuauuagucaguaauucuacugugguaacagaaaaugcccuuugccccagugccgcccaacacucuuugagaaagcagaagucuccugaccacaugccaccacagcaggauggcucaacuugagaaggagagggaccacaaagugaaaucuuugggcaugaagcagucucuaggaugaacuaaaugugggggaucccauuccauagguggggguccuggugacuagaaauuggaaagugggcugaguaguggcauuuguauccacacccacacccacuguuuccugucaguuacauuguugcaaccaugagaagaaagucaaaauucaaaccccuaaaacaagaauuccaugcacaaaucccagaucccaccauacugaauaaaaggcuucucucucucuccucaguuuccucaccuguaaaauggggauaaauaugaagccaaaauagauguucagaagauuaaguagcuagcacccaugugcucagacaacucagaacaguggugcugguucuccacuacucuacaccaacgccaccacugaugugauuggagucugaacagcacacaacauauggcagaaacuaccaacucccaggcaggacagagccucaagagggcauaaucuaacucaaagugcuuaauuaaaaacaaauuaaaaacuacaugaaaguacccuuaucacugcugcuacugagauacaccauaaucauguggcgauuuuaaggguaaguaccauuucaacucugaguauccuuucaaagcacuccuagccagucaauauacuauuuguuaguauguauaggcacacuaagaaagccuaaagacaaaaaaaagguaguaacuaaauaaccugaauaagcuauugagagaauuaagucuuuacuaacaaacaauucugaauuuguaagucauucaaagaauacucagaaauguacaugggauaucaagaauuccccaaaccggacagucagguguuacugcaaaacuucgagggcccuggaagaguaagccauuauuuucuucugucucaaccacagagagcucugagcuacucugcuccguggauccauggaugagcaaagccacggcaugcaucacggccuaacacugaucugucaggaaaccaagucacaguaagucuccccagucagcacgaagugguucugugacaggcaaccaggccaaacacugacagguucacagacaugaagggacacucuuggacuagccucuggugaucccuggauuacaucauuuccccuccugguggugggggugcugcuucugguaucaucaccaucaucaguagcccacccuuaaaaucggaggccucaucugucucccaaugcuucucagacacacacacagauagucacuaaugcuacugugaguucugaccacugccagcccuuucaugguucuuucccccucugaagagccccuacuuuccucuucugaauaacaggcaacuaauaauggccacaagcaaaacagaucacagaaacuguaagcaaauguuuaccaaacugguuagaggaaacaaacaaacagacccccucaacagaagcaaguagcauucuacaagcucaaagauuguuuuuacauagcugacuacaaaggauuuccaagauaauaccuagguauuuuagaaacauuuuauggaaaauaacuaugccagucaaaagugggaaaaauacugauuauuccgauuacaaaauaaauggagggcucuuuguuguuguuucauucaaguuaaaagaauuuuuaacagcuuuagagaauacaaaauaaacaaaacacagugcuuguuuagggaaaaaagaaaaaagaaaaaaaccccagccaacucacaagcagcgaaaagcaagucucaaucacaucuaccaaaggaaaaaacugacgucacaugacagccucuaaggaauuuaauucuaucuucuaaaaagcugcaucugauuucccuguucuuacaccaugauuaagaguagauuuucuucauuaaacagacuuucaccaucucuguaaacugaaauaguuuuuggguacgaguagauuccaaacaucccucuucacagagguuaaaauuuuaucagauaaucacaucaaguaauaaauuauaacaaguauuauaaacaaaaauaacaaggugcuuuuaauuaguuuuaauaaacaaccuaaauucauauugguaugucagaggcccucccaaaaguuaacaguuuagcgggguguagugguacauaccuguaaucccagggcucuggaggcugaagcaggaagaucacaaauucaaggccagcuggggcuacacagcuaaguucaagguuggccuaggcuacauagcaauaucuuggaucaaaacaagaaaaauaaaauacaauaaaaugaaaggacaauuaaacuuuaaggaagaguuggggaggugaccuuggacacauuuauguucaagaacugcauguccaaaugcccagagaggaauggguggcaggugagaaaguuccugaaaggucaucaagugucauuaggaaugaagcagugggaguggaagcccugggcagagcgcagcguggggcacuugccuggcacgcacgggacccuaggcgccaugcccagcacggagagaagcgaacguuuuacuuuucccuuuuaucugcuucuugucugccaagaacagugagcccuugccacaugcucgcucccaccaccaggcgcauggggccaagcaaccaggacagaaccuucuaaaaccaggagccaaaauaaaccucuccuagggaaauggagccugacgggaggccaggagcggccaagacaaaaggaucaccuuacacaagaggggaagggcucaggggaccugggcacgugcguuacagacaggcaacacugccacaguaacagcuucauucgcgcugcagcaccguaccagagaaaggcagggugugugugcgcgggcgcgcaucgcucggucagagagcugccacaggcgguacuucccugagugaaggcuguuuucucucagacuggaacugugccagcagagacgagaugggagacaaaagaaagaugggguuuuacagucagcauggagccggagaggaaaaggagaugaagaaugccaucuuagugucuaaaguaaaauagugagucuccaaaaugaggacagcaagcguuaguuagguugaccacuggggaagacaggcgcucccuccguaggcagagcagcucgugccugugagcccagcaccagggaggcugaagcaggguggcugccucaacucaaguuugggcccagccaguacuaaaacaccgagcagccugugagaaucagaaaggccgaggaaagcugacauugauagucuggcagagaauaaucucaaaaagaccaacacagaauagcaagaaaagugggaaacaaaagaacaaaaaaauaaaaacuagaaauaaaaaacaaagaagggugucgcagucagccagagugaugcaggugggaggucggucggccagcagaaggcagcagagacgacuuugcggucaggaggacugggaaggaagaaauggcggaaggaaaaagguaucugucugugagaucacacccacuguuuacaauauagggaagaagggcuuguuuuuuuucuucuccuguaccuuccuuugaaugagcugugugugguaggccugaccaggaauuccugcaucuggaaggcugaggcaggagaacugcugugaaagacuugucucugcuaagcaaggagaaugugaccucacaagcaaggaugagaaacaagcacacguucugccaugacauccagccuugaugguaacgaucgaacccaaggaacaaggcucccacugugacuccagaccggggcuuuucaguuucaagucucaaauuuaaauuucuagacaagaaacaauaucuauucuuuugcuguuaaagugaauuuuugaggcccuaucucaaauaaauaaaaggaaagauauaaaaaugaagccuauuuaaaaaaaaaaaaacaggccaugaaaagacaauaguaauacaacucuggaugcuggaaaguggacggcugacuucgcaaacaguaauaaaaacaaucagauuagguaaacaguggagaaagccaaaaacaucccaacuuaaacuucacaaagccccaaaggcccaggaacuggcagccagagccacuguaggcauggaggcucugaggaaggcagguguaagcagcucucaggccugcuccuuccccaagggccaagucugcaggcugagaggggccuugugaagccaagacgagugggcgaagcucagcagaaggcaagcggggagaguggaacauggcugaaugaaggccugcuggggacccaaggcucccaagacuuuucacuccucugcucccugcagccccuguggacacgccuuucugccuaggcacuccuucuuaccauagcuaaucaaguacgaagauaucccgaccccuagucaaacagcccagucaggguaccagcuauuggggccaucaauggccgacaaaagcucuguugagaaccuguacccaacacuuccaucuccuaccuugcacacaacugccaacuguuuaaaggaagggaauagaacaugaaagauacagacccagguacagaagaaaaugaaaccuggaaaaagcagacugaacacaaaggaaacuuuuaaagagcuaagcgugaugacacacgacaacaucuacacagaggcagggcuggauaauggcaaguucaaggccagccuggacuacacagagaaacccugucauaaaacaaaucuaacauguucacggagcuaagaaaaagcucugcuaaauuaaaauggagcgguacacagcuuuaaaaaaaaaagggcaaagaucaaaaacaacaaagcucuuggaaauuaaacauaagaaaaacggagcagaaauagaaaccaaggaaaucagaccagccagaaaggcccauuaugcaaauaaguuugaggagaaaauucugggauguaguucaccuggcagauccuuugccaagucuaugagaggcccuggguucaaacucaguaccccaaacuuuacaggaugaaauagcacacagcaaaacuucaugaagagaagcagaaccacccucccaccacgaacacaagucaccacuggaagcaaacuuuaaaagcuuucauagauuuuuaaaaaugaggagagagaggaagggaggagaaugaaagagaggaaagacacuaaggccacauaaggccuaagaaaccaaaacggcucuagaauucucaaaagcaguauggaagcuugagucaguggagucaguggugucagugaagcuguaagacaagguuugcgaccugucacccucaacccaagcucagaagucaaccgaguguaaaggugagcugacaccauuuaaaaacagcaagcaaaucacgaaugaugucaacacuggcuguggaaacgaagauggaccacuggaggagugagagaauccaagagcaaugaguagcgagccuaggugacaggccaccacgguggccagagugacacucgacuuccuagagaaaggccgagucaauaccccgauguuaaggcugaggggcagguaauacggaccauucgugaaaagcggugacuaaaugcaauauaaauggggaccauacacuccagccacugacgcugaccccaagccaaguuccacgcuaagaacaaccacaacaaauguucuaaguagcucuccgguccucuggcacugacaugcaagcacacaaucaccagagagcugaggaaggccucuauccaggcggagaccaaagcacacacaacuuggagaccaggagaaacaggaugaagaaauucuuaagagggggacccaccccuuccaauacaccaaguaucuggggacggaggggguagcaggccagccacuggacacuguacuguggacagaaaaaggaaugaucuuuuacaaggcuuaugaauauucaagagugacauagcaguugggagaaacucccggaacaaggacaaccaacaggcagguccauuuuuaucugagaaauuuaagaacacaaaguaaggauaguucuuauuugauaaacucuuagggacacaaugaguuaaguucagagagucuucuaaauucaauuuaauuuaccugauucugugagaacugcuaucgccuucauuguuuucaaaugagggaacugaggcacaagcaaaccaaacaaccccccugaaguccuaggaaaggagcagaggacagaggagacaaggcugggcggucugccuucugagcugcuccugaccggcacacuguuggccaaccgggaguaagacaggcuugucaaagacgaaccaucuacacaaaauuaaagggauucuaggaaggagaucugaaaaggaaggaggugggagguagacuuuuauucuuuaaauuguacaucuaaaaaauaaauacuuccugucaggcgugauggugaacacacaccucugaccccggaagcacuggggaggcagaagcaggcugaucucugugaguucaaggccagccagggcuacuggucaauacaaaaaccauuaaaagguauuugguguuuuacauuauuuuaauugauccguccuaccacucccaguagauaagcaaaacaagugugguuccuuuuucuguaagaaaccccugauuuccaggcuggggagaaggcucacucucccaucuuacaagaugggaggugcuugcuacagagccugugaaccugaguuuggaccccagaacccacauaaaagccugacagaggcagaugcuucuaaucucagccccgaggaacuacagacagguguaaguauuccugaagcucacuggcaagccagcccagccgacacagugagcuccaaucuaaugagaaggaaucucaaaaaauaaaguggacacaguugaggaagacaacugaaguugacuccugacuucauaaucacauacaugcaugaaacacaaaaguaaacauuuuuuaaaaagcccacucauuccuguauaauuuaaggacuuacuauaaaacagacacuauuuagaaugcuggcaucauuucaccuuaaggagcaagaagcuagcgaagucauauugcucauuucauucuauuacauaaauuauaacaccugcauuucuaaugaugugguuaagaugacagacaauaggaacugugccuugauaggaaaaacagaaaaagaucugcuaaguuuguuuaaaaaaaaaauuuuuuuuuuguuccugcccuugugggaaagacugguaaacauaauuaucaccaaauauacaguacuuaaauagagacaguaaaaugugcuaaggaaauacccccuggggaagaacaaucuuucagagggaacaucugagcuuugcuuauaaacaagaauuucacauaacacugugcuaacaaguacagaacauuauaguaaaauaacuaucuuccuguuccugcaaacgugaaguucacauuaaaggcuaagacaucaagaucguuauaauaaaauggccuuuuaaaaaaauaagucacauaaucuuccauccccguaucuguaauguuuauagucuccucugaguauuacaguugguaagugcacaacugaaagcacuuuccacgugucugacugagcauuuacaucuaaagugcuagaguauaucgcaauauauagaguauaucacaauauauagaguauaucgcaauauuuacucaaggauaaucucucucuucugccaccaaacauuuccaugcuaacauuacuuccugggucauaaaaugaaaugagggcacaacccuuucuuccaaaggauaucaauggugacaaagccugaaggaugcaggugacacaggcuggcacggaggacaggcaguagcucuaagguugguucacuuuugccucuccuagguauuucccaauuaucucccaagggcaaauuuaaguuuuuuuuuuuaaaucaaacuacaaugagauaaaaacaaucuguaauaaaucacaauuaaaacuagaccuggaugguugguccagcaugcuccuugagggggaggggggaggacgacacuccgaccuuagagaacuuggacaccuggcaaacaguguguccacucuugaugacucaacucugaugucaacugacacaaacuuguaauaaaguucaaagaccgucugaggacugcuuccguugguuacugcagacaauugcuucccagugcuucccuggaacacagcucuaccccagugacuccugacccgccuugaccucagucacuacgcaucuguuuaggaaacugcucugcacucucacacugggauucacucuacggauaaaaaccagugugcaguauccucugacuuaacuguggacagcaggucuucccaggccugccaucucccuaccaacaggaggaaaaacaaaggaggaagcccucccaggagcucacagacaguaauuaagaaaaccuucccagguuuguuaccagugugugguaaugucaugucucuaugucaucugucuuucacaucuuagguugacaucuguauuauauaguuauuuuaacaaggaacuucacucaguucacacccuuuugguuuaggaaacaaaaaaauuagaguaaauaguuccuuaaacuaaaauuacaggugaggaucagaaugauaaagauaaaauuaaagguugaacaauaguuauaauugcacgaaacaguccaucuugugagguacuuuuguaggaggguaaggacuacauuuaguuaguaacaaaauuuaaguauaugacuauuagaaaaacaaaaaaacuaaaaaaguauuuucaccuguuucaauguuaaaugacuugggaaaaaaauagugaaaacuucaccagaacacauggccuuguuuucucuuuauaaaacucuuuugcaacauuuucaguuuuucaaaguaaacccacaaauauacaaauagaauauaaauguuucaacuagaauaguugaaaguuuaaugucaaauaucucaaaaaaaaaauccuaaaauaauuaacuaucuuaaauguuuuuucaaaacuucagugaaaaagaagucuuuuuacaacuacuauacuucucuguuuauauauacuggcaaacuugcaaaaagaacuuuccuuuuuuuaaaaaaaaaaaaaagaaagaaucuuaaaguaauauaaaaucaaaguucacagucugacucacaagugugauuuagcauauuauuuccagcauaauuggaaaaaaaaaaaaugcuggccuaauacugccuuuuagccugucugucuuuuggcgagaagagaaaacaggugggacagauaaccaguauaaaaucagcccuuguaagacugaccucacucuuuaaaauggcuaccacuuuuaucuacuaucagaagacaagacuguacagcauuacugacuaccaaggauaaauguagguauucugcccuuggaaaauacgcuuuaaggcgcacauuccucuucuguuccgacagaguuuacagaagcuaacaacagucugagggcagccuauaucacccagauuaggucaucuuucccacagugccuuaggagggcaagcagguaacuguaucuuucacagcgugagaucaaacauacuaggaaagaaaagggcuguaccgcaagaacagacguggcaaccacacccccaacaagaaaucaccauaaagauucuaguagcuccaaagaauagcuuuaacuauuucgugggguaacaaaagguaagccgcuuuucauaaucuucucaaaagcacuuuauaacuaauaaaagcuaccugguagccccaagucuauuuggcauauacacuuacacuuuauaacuaccgugaacauuacugucauaaccuagucugccucccaaccacucugaaaccauuccgugacauucuuccucugggaaacuuaccaugaauaugcacuucucacaugcaaacgaaaagguguagguauauauacauauguauauauguauauguguguauauauguacauauauauguguguauauauauaucuucagacuaacugcacccacacguauuguauugcuacuugagagauuaacuuggaacugcccgauggcugcagaagcacgugaucuuaccucucguccucgccauccaccagggguguugucagcgguagcaccuucaacgggaagagagaagcaggggcugcuaggcugcugcuacucccaucugaaacugcugacauucccccacugucaccacucauagucugagguaagccgccuaaggagggcuccgcugggcgccuggcaucuuccauuuggcuuccaauggccugagcuaaugauuguguagagaacugaguagaacuuagugguaucuguugugccaaaggcaaauuuauguuaguggcuaucaagggagauugacuaacacuuugaaccaaacugccauuuuggguggcuggggguugugcuauauucugugguggaacuaaguuuguugggacagaaggcauuccagaaggagcggcugaacuaaccugauuuguaacagaaauagugcuagcagagggcagaggacugccugugggcaacugcugggaaacaaccccuugggccacgguuucuacucccuguggcuggggaggcacaguuaccaagguacucuggggugcaaugaccaauuguuguggaaggcuugaagcacggguuugaacucccugaugaaugaucccgguuggagcagguaggacuacuugugaagauggaggagcaccuugcugaauaacugaagguguaacuuggguagagggcugcuguacugcaguggguauguuugccuguugaccgauacuugcaaucugaccgccaguugguacaguggacacugcuguuugagccuggccaaugggcugcccagccgccccugcagguuguguuuguacugcugugggcugcccuggcagcuggauccccugugccugagccacaggaaucacugauauuccugcccccgugcccguggaacuggacugcccagaggacaaugcugcuugaaauauuggcugcugcugcugcugcacauacucugaaguuggauuuugagucacuggcuggccauggccuggggcuaucugcgcaggaaccauugguugcugcugcccauauuguaacugcugggguggugccccuggaagaggaguuugcacgggaggagcugucugagaauauggcagcugcgguugagccaggcuggaaacagaaggcugcugaccuacagccgccgugaugccgaccacgcugacaggggaaggcuggauaccaguugcggcacucaugguggcuugcagagggacaggcugaagagucugcuucugcugaaagcucaacucuugaggcuguaacuguacuugugacaucugugacugagaaauacucuguggcauacuaaccgccgcaauacucuguggagcagggcuacugaacucuagcuguuggagagccacaccuugaagaccuggaggcgcuggugguagcggcggcugcugcggcgccaccacagccggggcucccaucaucucuccacuucccacacucuccguguagugacucagugugcucacacuacugcucacagaacucccacuagugcucucccucuccgaggacgaugcuuccguggggguuugcuucaccgucuccaccacuuuauugacggccacgccuucuguagcuggcacagcguuuuccuucucauagaauucugugcaaguccaucgaccuuuuuuaaaggguucagaaguagagucuaacuucacaacccugaaccucgauguguuaacuguugguugcugcugcugcugcugcugcugcugacuggaaaccacucccacagugauaccugcagcugcauuaaggacacuguuagcaacaggagaggaagaaacgguaccauugcccaugccacucaagauacucgaauuaacaacacugguaacuccaggcccaccacuuaugcuagcagcauuagggauauugcuuguauuuauauuagcauuaccaugcacgcuguucgucacacugggacugaaacuacccacagcagcaauguuaacauuauucguagcgcucgugccaguaaccgaauuuauaccuaggcuuccuguaguacuuggaguacggauguucgucaucacugaugcugguaagccacucgaugguacugcaggaggaggugcgacuggcacaccaccaucagaacuuccaguuguagagaguuuccuggacacugggcucgaggguggcccuccgggaauggauggaccggccacagcagcaugugaugaaugauggugcccauggugaagguggugcccaugaugagggugauggugaugauggaggugguggggaugggcauucccauugaucacaacguucuguuguggaaggugaggcaaaugaggcugaggaagguggggcugguuaggagagacugccccaggugucucagcuuccuggaaguuauucagagucuccucugaggagcuucguucaggcucaccuaagucaguggcccuggaaagggagacgucgaggaucucggaagaggagagaucuuccgugugcgacucauccagaucgucguagcucucgguguccuccgcgaugcuguuguuggagcugaugcuggcagagaucugagccggaguaacgcuaguuaucuggaagccacuuuucuuuuucaucugaguuccgccuggcgcaagaggcugucccugcagcugagccugcgagaggagguucaggcuuuguggaggcggaggcuggggucccugcguggaagaugcagcaggaggcggcggcuggagcagcgaaggaggaggaaaaucuucagaagauggagcagcaccacugacgcccguaccugcugcauugagagcagaggcgcugccaccaccgcugccccuucgagggaacauugccgggugcgccaucuuccuagcacuaaugucugcagcagcggccgccgcggcgguggacuccggcggcuggugcauugugcuggguaccggggggcggaggaggcaagugcaauuuccuucugcaccguaaucuuuguauggagaagccggagagacgaacaggaccugaagcuccgcccgacgcgaucccuccuccuccuccuccucugccgaaggcgccggcugcucgugccuucgagggcuaacuucgggaagggaggaugaaccgggugaaccagguggcuggggaaccgaagggggaccccuucaguccuucgccauucacuucccccuccagu

SEQ ID NO: 12524 - RNA, 14720 nt, Mus musculus
ucgcggggcagguacgcgcucucuuagguugcugguggagcuuggggguggcgggagcggguuccggcgagagggugagcgagcgcuggggcggggcgggagaaaguggcugcccgaggaccucggcggugacgcguggccgagcccaggagccccgaucuccgugcccgccuucgugagcgucuggcugccggcccaggggucccccgccgcggccccccgccgaguccgccgucccgugccagcccgagcgaggugggaucgcgaucgcuccgugucccgcucccguaauccccagaccguccaugcccacgcgggugcugaccaugagcgcccgccugggaccacugccccagccgccggccgcgcaggacgagcccguguucgcgcagcucaagccggugcugggcgcugcgaacccggcccgcgacgcggcgcucuucuccggagacgaucugaaacacgcgcaccaccacccgccugcgccgccgccagccgcuggcccgcgacugcccucggaggagcugguccagguaagcagagcggccggccucccuuccccggcucgggcgugucccgccgcuacgaggcgcgggcgacaggggccgcuccagacugggacgcgcgggaacgggugcccggguggacagccccgcccugcgcucccagacggggcgccggggaguggaugggggagcagggcgggggcccacccggaucuguccagaggagcuaaagagagccgcgcgcucgcgugcaccuucucuuugcuugcguggggaugaaagcuugugcccacgcucaacuuggcuuaaaaugcuucuugaccgcucucucccgauggcccuggccuuggaaguccaccugccugcguccucuggggugaaauagaaaugcaaauuggaguacugggguuucauauacccccguggaggcucacccuagaauguauuguagggccccguuuggaaaacuagaaucuuaagguuguauuggaacaccgcuuuucccuuaaaaagaaacacggacaaaaaaggccagggguguuguuuuucuuagugugcgcguaaauuuccucucggagucgcguugaaagcuggcaguuggcuuuuacacuugcccagcagccgaauuagagcaagcgccuguuucuuucgcccacgcacgggagucauauagccuagaaaaaacuucccgggacuuuuagcuagucccaaggaaaaaaaaaauuggaaacagacccacaugcaaacagcuggaagagcuaaaaucagaaaccacuaaccgccacgggagcgcagugcacgaaaggguuuaagaucgguuuauuucaagacgcuuaguuuaauagccucuugcuguauuguguauuugcacugagcgccuauuucuuggggucugccagugucguggugcuuugagaagacaguggcauuuugucagaugugacucacauggcuacagcaugaaucuuuauuuuuaaguccugcauauccgggaaaucccguccguccucguccacauccagaucuugaugaucugagguccgaggugacauuucuuuggaaaauuaaaagcaaaauauacgacuccuauucacugacugaggugaaugguucuaugaaccauuucauuuaccuggggcuugaucuuuuucugacuuccuuuuuuuucaaugucaaaaaaaaaaucaagagaaagcguucguuauauuagagaagagagcugggggaaagauaggcgucuggucaguagcuggauugauuauguauguucuuaaacaaucagggccuggaagauauuugguuauuuuauucugguaguuuucgcucaggagauagcaagaugacugcgcuuuuuacagaggaagggggaauguagcauuggcccacggagaggacaugauaaauguuuugcugaugacugugccugcgaugcagcagccucuccccacccacgggagucuuagcacccgucuaccaagggagugauuuuucuccuugauaauuaaagaucuguuuuagauagggauaugaauagguccauuucauuaugauagugacccauuaccgaaucuacugguucaagugaacauuuggaccaaacguugagggugcaauuguuuuguaucaguggauacaauacaggcuucugcuccacagguucaaguuucuauucaaaaaguauugaaauggccagagaacauuuuauauuaggccugauaaaauaaccuaguccacacacaaaagcccuuuggaauaauuauuuuuaagauuugcacagguuuuaguuuucaaguguaauggaugugaacagauuugaggcaguuuggcaaaacugugauaccauaguuuaacugaagauauacccuaauuugacugugugugcgcgugugcgcgcgcgugugugugacuugauugcaucagaaaauguuuugaccuccaccccccaccccauuugccuuucacuuuugucuggggaugauuugcgggagugacuuuagugaagacaugucguagagucuugguuaaccgauaauuacacaauugacaaaauaaacuuguguguucauaagcaacacuuaggaguuggccccuguacuccugucgaguuuuuaaguaaaccauauuauuuauuuauccuuccugacugagucggguagauuacguguauucgucuuuucuuuuuuagacaagaugugaaauggagaaguaucugaccccucagcucccuccaguuccgauaauuucagagcauaaaaaguauagacgagacagugccucagugguagaccaguucuucacugacacugaaggcauaccuuacagcaucaacaugaacgucuuccucccugacaucacucaccugagaacuggccucuacaaaucccagagaccaugcguaacacagaucaagacagaaccuguuaccauuuucagccaccagagcgagucgacggccccuccuccuccuccggcccccacccaggcucuccccgaguucacuaguaucuucagcucccaccagaccacagcgccaccacaggaggugaacaauaucuucaucaaacaagaacuuccuauaccagaucuucaucucucugucccuucccagcagggccaccuguaccagcuguugaauacaccggaucuagacaugcccaguucgacaaaccagacggcaguaauggacacccuuaauguuucuauggcaggccuuaacccacaccccucugcuguuccacagacgucaaugaaacaguuccagggcaugcccccuugcacguacaccaugccaagucaguuucuuccacagcaggccaccuacuuucccccgucaccaccaagcucagagccuggaagucccgauagacaagcugagaugcugcagaaucucaccccaccuccguccuaugccgcuacaauugcuuccaaacuggcgauucacaacccaaauuuaccugccacucugccaguuaauucgccaacucucccaccugucagauacaacagaaggaguaacccggaucuggagaagcgacguauccacuucugcgauuauaaugguauguggucugugugcucagggcaucaggaggguuucauguuccagagugccaauagguaggguauaccugacaguuaaagaaaucaccuauucguaauauuucuguguuuuaugcugauguauaauggcauaaaacaccagccauggcaauucaugccuuuaaucuuagcaaugaggccgagacaggaagauuacacguucaaacuaaccugggcuacauagugagauccuuuuauuauuuacuuauuauuucuguuuugguuuuucgagacaggguuucucuguauauaccccuggcuguccuggaacucacuuuguagcccaggcuggccucaaacucagaaauccgccugccucugcuucccaagugcuggaauuaaaggcaugugccaccacaccuuuaauuaaaaaaaauauuauuuuuauuuaacgguuagaccauucuaggaaauaaucuaauuuagauuucuuucuuuuuaguaguaaaugacaacuugggguucauuuaaucuaauagauuauagcaccaaauggauuuaagaaugguuguuuccgauaguguaugcucauucuugaaugagauacgugacccaaaauauaauuggaugguaauaaauauauuuccaaguugcaggcauaagcaaguuuaugauuaaugcagggcauaauuuauugacugcacgauguggcaugacaugcuaaaugagaaaaacaaaguaggauuauagaaaaugauagucaucuccgauaaugacuuaacacuguuaguucugcauccauuacauuaaauauacauacauauauacauacauaacacacacacacacacacacacacgcacacacacgucccacgauugcucuccauuuacugaaaaagcaccuacuggagcauaaacacagaauuuccauuuauugguuggcuggguuaaccuguguucuuugcucccaaaaaugauacauagagcagaucaccucugccuucuaauaaggucaggagggcaccuugaaacuucuuagccaaagcuucgagugugacccucuagcacaagcuaguucaucuuuagagccagguuuuaaacagugaaucaucgaauguaaagauuucaaaaggcccuggagaugacaagcuguucuuccucuguucccuuucuucuucuagguugcacaaaaguuuauacaaagucgucucacuuaaaagcucaccugaggacucauacggguaggugaucuucuugcuaauucugcgaguucuguaaacaguguaagcggcauucauccuuuuaaaaagccaauacguguuugaucucuucuuucuucugucaacuuuuauuuuuuaauggccuaccuuuucagcaagggcuugcuuggcucaaaauuccguuccccaagaaagucugguuccgggaaggcugagguuuccccagugagaccuugcccugucacccucacguagaauuaaugacccucaaaacguaaacggcaguguuuacuaauggauuuuaaaacuuuaauggcaaugcuauuccugucuugaaagaaggaagaaaacccuccuugguaaaucgucguugcuucaauaaggccccuuuuuaagcuaaaaacuuuucccgucaccauguuaggcaccggugcuuagcacauuaucuucaguuucaccaguggcuucaaauauuuguguuuucaccuuuuugccaugucugagaaguaggccuaagaucugcagagggugaaagagcucggccagggugagggcaggauuugaagcauuccucuccagccaaccccgggccuuggcuugucugagaggccuaguccauccuuaagucuuccauuucauuuucuucugcagcuugcuuuuaaguucagucucuaauuauauuuugauguguuuuguuaaauucacagcaacccccuuguaggagcuauucauuuugaagccgcccuuguaucagaaacacguuuacaaugacguucaguagccuacuuuauuagagggauccaccuacccauaauaucuucaagugucuggaugguuacuauuauaauuuucuuaaagaauagcccugaaggaaaagacagauauaaaagugacugcauucccccccucaauaaauacacccuccuuaccuaaaguucaaagaauaaguuugcuaauaaaagcagugaccuagcaaaauguauuauuccaucauugcuauggaaaccagaguauucaacagcuccuuugaauggguuguuggauuagugugaggacuugccucucccuaggcuggagguuacuauggaaauugaguuuugauaaaugaaguaguuaucucuaaccacugcauuaaaaaguaaaagcuuuuggacaaaggucaguggcgaagcagagcucugugagaguaugguuucagacauuguguaugcguguuaggagggagcagugcuugguuaucugaaugccuaacacuuccuaaaacccgggugguagcugugagcuuuccaagaauggcuuuugaaagaaaaggcaucucucaguuuaucugugauaggagugaaauuauuugggccugagguuggguuggguuuuuugugggcagguaagcaugaacagaauaaauccaaagaugauucaaacuccagucuaaaaccucccaaauagaguugacaggugccagaagaguccauauagaaacacuaaagcaaccuacuaaaauguccuuuuguagacuaguguuagggaaacacugaacaugggguuuugagcuuuggaucaagaggagaaacagaaguaguuuaggaacauuugagcuguuguuucuucucucucaucagaaguccuugaaacuggagauaggaaagaggaaagguauuuuuugagguuaaaguccccauaauaaaagaagugugcaauugcauauaccgacguaaucaagugcuuauugcaggcacaucgucaggcuauaucuaaauagccuuuccacccugucaggguuuacugcucugaaugcuuguaccugggauccuggaacuugaccugcuggcagagaaauuuaauagugggucgucugaacaaugcccacacuaauaaaaauaaaaaauaaaaaaaaagacuacgaugaaggauccaggccuagucagggucccauggagcaacuuugucacaugaucguaaauauuguggccuuaaaacaucuaaugaguaaggccguguaaugcaguuuaaugaaguuguuugauagucuuucagaugccuugaagggggggggguguaacagacucgcucaucuggcuaaacccguucuuagguaaucauggugcauggaggcuuucuccucauuucugguuucuagacaaugccuuuuaaaaucaccugugugcuggcuaccauugucuccgcccuccgcuccugcccccugaaugugcaggaagccaggagaggcuuguggcuuguuucuuucuuucuuuuuuuuuuuuccuuucuccuucgacugcccagguagaugaaacaguuuuuuguuuuuccuuucugaauaguaccucugacuuaauagcuuguccuguuuuucuuucugucccauuuccucgcacuuggaaaacuuguuaggggacucuuaaaaaaaaaaaaaaaacuacauggcaauauugacuguguauuugaugauauuaaaagaaauguuuuuguacugauugcagguagagcgugaaacaccccagccuuucuguaauuguaguaauuguagcugcuuuuuuaaaaaaauguauacuuaccauaugccacaguagauuuaagcauauaaaagaacccucauuuguguucuguuuaaugacuuauucuggggauuuuuagauaacuugaguuacagagggagucuaagcaagccgccagucuacugcacaacuaacgcauucuuccugagcugagacagaaguguaaaacaucagucugccuuucgaaucacaaguauagcauucgaguuuucuaaguuuguggacuucagauuucuuuauagagaacacauacaaaaaaaaaaaacccuuaagcucuuccaugucuggucagacguagcugugucuguauuuaucuguauguaacacagcacacuuggcuacauauaggcacccuuuaugugggugagaggguguuuguguauguuauuugagauacgugaacauuaauaugcuucuguuuagaaaugguuaggaccgcuuguaggcaaccgugucaguaaguggucucuucuucccaaaucaaaucauuuguacuuucuauggcauuugaaagaacaugucguuggagcucuuccagcuugugacgguacacuuuaccaucaaucugcaauuucuuaucagcaccuuucaaaaaacaacccaacucugguaucguaagucaccauaacugauaagcucucuucugcuguccguuaaagacagaacuuuaugcauucuaggcuaccucagacagacuccuucccuaaauuccauuaugaauauguaucagccuuggcuuucuggucaagguagcguuagcagcuguauauacaaguauuuagaagcaacacucaaaagagucugcaccacugugucucaaaugaacauaaauagcagacacuugaguucugugcucaagauucccugaugaagagggacuguagucugucugucagugugaagagucucuaccuucaccccuuccccugcugugggaaccacauuauucagugacauuuaucugugaguuguuagcaugugugccuguaaguacauaauuuuggauucugcuuuaguuucuaagcucgacuugggcacuaugcaagcauccugcauccuguguacaaaugucucgagccaggugcucacugagaacuccucuuuccaucggcucucugagacacaguuuugauaacguuggcugcugagauuaggacggacauuuccacugaaagaaccccuuuccaacuaaccuaugcagaggggggaaggagaaccaggagggauuucauuucaggccauaauggacgauggcgcucauaugauuugaaucuagaauagauagauaucaguuagcugcauaaccuguguaucagaauaagcaagcaucccaucuuagagauauucuguacguauaauaucuaguggaauauggcacugauaagcaucaccauucgggaacuggugaaacgcacucguguucuuuguauuggaucucacuuguagcuuugaguuaaagaguaguggcuuaagcaacuuguuagcuuagaccccaggaaaaagguacuuacgaacgggaaagcuuagacaacaguuucuuuuuaaugacucaccagugagacuaaccugcuucggggaguggaguccuuccaucagcaaaacauuuacauaggaaauuaaucaaacauuguugauaaagcuuacuaagguuaagaaggauaacugaacucagcugauugguuucaugaagaauccaaagaauugaucucgucuuacuuacccuucaguuuuuaagcucacgggaggagagggcuccuauguagauaaaguagaauugcuggaacugagcuggaagcagucgugcaugugagguggaaagcaguauuuaaaaauauacauuuuaauuacccgggaauuuucccuagcuagguauuuuuaguucuaucugauggccuacaucuuuucuggugaaagauaagaaacagaguccuguccuacaugaggggaagugacucuuugccugccugugacaauucauaguccgagacuuuuagcaggccuguuuaaagagaccaggcaaugcuuuagaggcucacaguggcuggcuuuugccuaaaaaccaucuguauagaaugaguugucccuuuggcuguuccuaaagaggcaugucagcugcugggcgggguggggggcggggcgcaggugaagguuagguagaggggagggggcuucaaauugaugauccauuuccacuguuacugcuuguugaggcugggaauuagccaaguguauaggaaggagcaagggaccacuccugucacccgucccuucagccuccacagcaagggcaugucucuccauucuacucuccagcagaugagcaagcucuggcuccccauaggagccccguggagcuuguguccagccuccaggccuuucagaacuacuccaguucuauagaaguucagguuacagagaaucuccauccugugcccuuuugggauaagggauucuagaauuuaauccugaagacacucaaagcaagguucucgucuaaauauauucacauuaauuaccccagucaucccaagccucagccaagccuucccucguuuucauuaugagaauaacugcucagauuuggccuauccaguuuucagaggcagaaaauggggaacucggaacagagggauagucaggaauacaaaauacagcccaccaagacccaauccuuuccccuccucgcccagggcuucauugaacaacugauuggcucaagugcauuugaucuggggauaaaacccaucacccugugcaugaaaacgacggcugcuagcacugagccacauccccagccccagucaaagucgcgcagguggugaggacacagugcaguggccacucguggucugucagguuuuuuuuucuagagggagggagaaagaggaauuggauuuaaaaggaugcaaugaguugagaaacaagaugaagagaaggggucccguaauccccuuuacauuaguucccuugaaugggccacuacuggcauccaggaagccuuagcuuacaaagugaaccuuccuguuccaaggaggcuacugcugcuacacacacacaaucucuucauggaaaaguacuagcaugguuguauaaagaaacaaagacagugagcccaaaucacuaucacucuucucagauauguaaauccuacuuuccuucccauaauuccuuaauuguauucuguuuuccccuuuugaguauuagcagaucugguauugaguguuccaggaacacccacgagacaaggugaugugagggagggagacagguaucggucagucaccaucuucccacacuaagcaccccagugcaggcugugcccucuucagcucugguuugagggcuuuuaauauauugauugagauaucuuuucgccauugaaggagacauaacuauucacuguaaaacagaccucagaguuaccucauuuccuuuguuagaacagucuauguggaacuuucuagaaaagggccuugcugucggacuauugaguauguucaacagagcagagaaaccuccauucuauuguauaguuggcucagaaaaagaaauuuuaaaucuguucagagaaaaauagauguuucuuauugaggauuuuuuuuuaaaaauacuuggcaaaacaagcauucuaacacagagaagggacccucuacaggguagcauuagagauggcaugaggcuuuguaacggaccgguccagccacagugugccucaagccucucacaacaggcuucuacaggccucccgaguccuucagagucccguucccuucacgagaggcuguagaguccaaguaaauuugaacaauauguaugcgcucguuccuagagucagagagugugguaauguuuaccaauggaagacuuaagugugacauugagaaagcagcagacuaggcagucaucuucaaaguucuggagcuggcuuuuuuugaggguugaaugaagagaacgaccuagcuuuagagcggacuucuggagaccugaugguggcuugccucuuucuucugguaguuucugcugugguuuuuauacagaguauacuaaugagcuuuaccagcaaggggagugaguguguuuaacuugggccuauucuucggagaccagggcuucuucagccaucucugucucuaacugugaggcagagacagcaaaggcacgcugugcgagcgagcgagcgauaaggcacaagccaggggugccacggcacacaagccugccacuguguucccuuugcccugccguacguagcuugacgcuagcagcaagacuuaaaaauaaauacaguggaugucgaaagagcuuaaccgaguauuucaaauuggugguauuggaaagagauucuuuaaaaauccaauuaaacuuuugaaagcucuauccuguugaaauauaacuuggaggaagucaguuugcuuucccagaaguacuggccguaguguuucuggcugaggaaaaaagguuugagccuucuccucagccagaaauggggucccggcuuccucugcgguguuuggcuugaacaguguugacacuugaacaaaucccauagaaacugccccaagugggggauagucgucccugcuuuuauaguaagccuuggccccgguuccugcccuuccagacacuggcgguauucuuggcugaauaagcuauagaugcacauaaauugagagcaaaaccccaaauguuuuaggaacguuaauggcuacuguaugucaaccaaucaguaaagucaacuugacaaaauauuggugcaguuuauggcuuugcagccaauaaaaacagugaacaaaaaaguucaguguccccugcuucuaacauagacccugaaaacuucauucugagccauguaauuauuaaauucaaaagggcuugaaugauccuucuuaaauugggacucugaggaaguguuuuuuuuuuucuuuuuuucuuuuuugauuuaaacaccagaauuagaccucucuccuccauggaaugacaggaaagccaugcuuguuacuguaauuuuuuuuucacuagacuuuucugugugaggcuuucuucugugugauugacaccccugauccagaaaguaaccguuaccacuaccauuaaagucuuucugugaauccagcauugugugugaauggaagagaaaugacuuucugauuacuuaaaagccuggaguguuaguguaacuuucuagaucgaguuuucugcgagagagugaaagcacaaaccuuuaaauucaccagacaggacuacauggugaaauacacacaugaugauucagcacacacacacaacacacacacacacaccccacagaacacacaccugugauggacgagaaauuuagaaucgagguguuguucauuugacuuuuuuuuuuuuguugagguagcauguuauauguaguguagggugguuucaaaaucaucccccugccuuagcccugccaguacugggauuacaggaauuuaccuucaugucucucggagaugugcauuuugagaaaugggaugaugauaggagcuuugcaucagaggcagaagcagggccacagagggacggucagggugaaucgcuacaagggaaggaccaggcaugggacuacccccgagugauucauucuggcuguugcuucuuugcccuguuagacuguagggucacacuaguuaucaggauaaugaaaguacagccuuuguggacacucacauucacccagguagucaccagcauccagaagaugacacugcuaaacugaguuaaaacaagaaagguugugcaguugcucugcuuagagcuccccuuucaccccuaagcuggcuuuuagcagcaaucuuccugccucaggccagccagaagaaaaccuuuuuuuuuuuugaaaggaaguugggagaaaugucucuugaaaaaccccagcaaaacaaauaacaaaugaagucaugacaaguugggagugcucagagacaugaaauuuggagaauuuggcguagaaaaaaaaauuuacaugauccuaaauagcaaauugcaauuguauuauaaauauuaagugauuuuuggaaguggcuggcacauuugggagaacauuagugaucauaaacauuguacagugggauuggcucggguauccgcucacuguuaaaagcagaugacuggggauaaaaaccagaaagauuaggcagaaauccgccugccucugccuccugagugcugggauuaaaggugugcgccaccacgcccggcuucaaauuuucuuuuucuuuuucuuuuuuuuuuuguuuuaggccaggcuuuuaggggucaccaguguaagugcccccaggccuggucuucuuguuuuguuuauuguauuccucgccuggacaauugccaaauuguuuguugacugucuuggaacucaauauguagaccaggcuagccaagaauucacaguuuaagccgagcagugguggcucacacauuuaaucccagcauuugggaagcagaggcaggcagauuucuugaguuuaaggacagccagggcuacacagagaaaccuugucucaacacccccccacccccacccaaaaaaaaaagagcucagaucaaccaacuucucccaaaugcuaggauuaaaggugugcaccaccauguccaccaaguccaacaucauagaaauuugauagcgucuggaguggcccucaucauagaaaauguucgauacacuugugcaaccagcugaugcuaagauucuggguuggagacaagggcucagaguagcccuugccuaacaagcugaaggacacagguuuaauauccuuagcacuuaaaagaagagagagccucuugccuuccuuauuagugugaaucagaguaaccagacucuagauuacuuagggaauuuuaaaaaaaauaucaaaugcaaaauguuuacauaaagcaauuaaauuuucugguuuguaugguuggccuugaguagugguguggaaggccggguggacugauucccaacauaccauguacauuauccucgccgcuacuuguauaucauccucgccgcuacuuggggggggagggauggggggcgcacugcacgguucaccauggggauggggugugggcugugccgcuggucuugcagcagaccaccucacccugucucuuccuugucacaggcgagaagcccuacaagugcaccugggagggcugcgacuggagguuugcccggucggaugagcugacccgccacuacaggaagcacacgggcgccaagccguuccagugcauggugugccaacgcagcuucucccgcuccgaccaccucgcgcugcacaugaagcgccaccagaacugagcgagcgagcgcugcgcccacccgccugacgccuugcaguccgcucugccauccuuuaaaccgcagaccuaacuucauaa

SEQ ID NO: 12525 - RNA, 114000 nt, Mus musculus
ggugagaucgagggggaggacccaggaggaggcggcgcguagaaggaggggcgcugcagccaagccaccagucuagcuguagagugcuguacuccagauacuccuggagcuccagccccucagaccgcgcguccccgccgccguucgccuuucggcauccuaaacuugagcggcagcucgguuucaacccaucgacugcuugcuucaaaucagacagcauugcgacccagacaccggaguccgccgagugaaagcacaacgcugcccuguaggaccagaccaagaaaacagccucgcgaagcagcaacucuggguugggaguacagaagccaacaagugagaaggcgccgcguuuccggggcgcagggagaacgcuagagcaggcgccagagaagacagcuagagcucggaaucggagcccaaaccucucuccuggaggcggcucagcuucuuuuuuuucuaggcccucuuaggcuugcucugggcuuccuuuuauccggguaggagccacaucccuggggaauaugcagcgcgcguggauccugcucaccuugggcuugauggccuguguguccgcagagacggugagugggcccagccggggaagugcacuguuaagagugcccgggcaaauagaagagccagaggguaauugggggaugcuaccugggggaucugccaacccugaacguggggcugccuagguucuacugaaacaaaugagcuugcuuuucaaccacuugccccugggcucuuccuuuucccucuugcacaauugagcugcuacagggaguuacccaagccaugucuucagggggugggagcacaagacuuggagguuagggaccccacagguccuuaaagucauuuccagcuuucugccuugggggauuuuaugguguagucuaggaaggacagagggcuaaaaguugcagguuacuagagcaccacugcgggccaggaaaggauccaguaagcucuguguacuggacaaaccccaggggugaguuggaaacuuuggggaggaucuguuccucugcacacaucccccuacuccaggcuuugagcuugacugaaggcaaguuuagggagauaggguccauauuaaggaaaccgagaguaucaggagugaaaguuucuaaaagugcauuuguuuaaugcucccuguggcuguggcaaggggcccacacuaaguggagaugcagucgguggucuauuuggaggcuccuggcuucauggagcuuuugggaacaggccugggcucucugguuucugggaucuuccaggaacgguccuuguggagcaaagcuguuggagagagauggaauuuuucaaaauggaaagaugagggugcuugugacauugcuuuggcccucagauccucuggcugcuggagggaauguagauuucuguccugccaaccucauacuccuuuggauccauauucccaugaacugucuucuuccacuacuagcauccuuucaccucuguggcccuggaaauuugauuucuggucaggauuguguuucugggguuggaguuuguuucucugcguugcccaguguaugcacucuuaggcucaugacuagugugccagccccuaucugggucacuacaggucuguuuuggcagguggaaguccaagcagcuucuauugacaugcagucccagggcugcaggcucaauuaaggagugcuccucuuuucuuuacucuuguuuccuaugccauuccuuuggcauccaguaaguugcccaauuugaauuaauaaaaaagccuuuagcuggguuggauaaucuccccuuuuugacccuuggacgauugguaaaccuuuuggcauucaggagaauaaggacauuugugaucagcuauagggugggggcacugcugugugggcuagaaggucauuguccagaguucgagggugggguacuuagaauuggaaacugcauaggauagguggguauuugagugauugugauguaaaaacacaacucugagucuuaccagaauucucacagcaaaagauguuuaauccuuugaaauuagcaaucucucuuggcuaguucugaacuuuggugugcuguaaacuaaauuggagcuauucuguguguauuucaaagaaaacagaacaacucaaaacaacaggaaccauugcauuacauagcugugcaaaacuggguaaagggacagcucaacugaauuauuguccagagaggaucuuguaaacugagcagaguuggggaccuuuucuuugcagaaccugguucagagauuugcuaggagaaaagcccuugggagcuucuguauggcuuugauagcuucuuaagaccuggugggguuugcuguuguuuguuuucccucaaaugugcuugucuccucucccugccuuauuuucccugaaaucucuuauguuuggggcucuaccauuuucucaguucaaaacagaauugaauguuuuucaaaagagcagcuuuauuggaaagauucuguuuugaggccuugcacuaucauucaaagggugauuaaauauuuuugaaaugucaacuugagaauccuacauacagccuuuguugggcagugagucagucuuucucagucaaagcuguuucaaaacccaaaccagcuaauuguccauuuacauugcuuuccugucucuauuugcuucaccuaaaguggcauaaauauacccagacuugaaaggcaugauuuuuuuuuuuaaguuagcuauuacagaacauuauuuccagcacuuuguauuuuaauuuggaaacugcuguagcguccugggauuuaaaaguagugauuguuugagcugugacuccuuuuggcaagaauggagaaauaucagcagcuaguaaauuuuuuaguuuuauacuuagcucagagugagaaaaacuucucagacacuaagauucaaaacugauugggcaaaagaacuaggggucuucuugaggacacggaggcagcaggaaagccuguuccuagggacccauucaugcuuuccacuggcagcugaagacuuucacuucuggaaggauggugaagggaaagggacagcagugauguguuucuagguuccugucaauuuuuuacaugacuguuuauguuagaaauaauacaguacagacugcuguaaacauauaauuugaacuggaaauauguuuaaggaaaggaagucuuuuaaacugguggaauuuuauaaacaugcuuagaugucuguaaauuaaaagaaacuguuaagucacuuggagccaugcauuaccucaaaaggcacuaugaaagccaggcucuggaaagugugcacuagaaaggaaauuaaagcugaaauacuguagcccuuagcagucuuucuuuaaauguauuuuugucaguucuaauggggcaaacuaguugugcuuugacagaaacaaaggcucuuuaucuuucaguucaauauuagcaguggagaauugucauuuaagaaggaaagcucagaauauguguguucaagaaggaauuugaauaugccuuucaacucuuucuugugggaacuggaaugccuuuuuuguuucauuaaaaauguuaacaagcaggguggugguggugcaugccuuuaaucccugcacuggggaggcagaggcgggcagauuucugaguuagaggccagccuggucuacaaagugaguuccaggacagccagggcuauauagagaaacccugucucaaaaacccaaaaaacaaaacaaaacaaacaaacaaauaaauaaauaaaugaaaauaaauaaauaaaauaaaaagguuaauaaauuaauacuuuuacauauuuaugauauuuugauucauguaugcauuauaugauauucaaaucaaaguaguauacuuuauucuguugucagccuaacaguggacuguguaauguggucaacugaagggcaacuaggauaaucauaaguugggaaagaauuuuaaaaggucagcuaguuuuuuucuaaaagcaaaacuaauuuucaaaccuucagaacacccccaaaccugaucauagguaguuuggaaucuuccugggacuaucuauucugaggcugaccuggcuaaucagagcccagucaacucugucaucaagguuuacaaggagucuagucaagcuauugugcuauuggugugccugcugguugugauccaacaggcccagugagcagaagcuguccuucuuccuuugccagaaaaccaaauuacaagaucuugcucaucauucccuccuucccaaggcagaaagaaggcuugccaucuuucauacccaggccaaaaauacaucccaguaucucaaagucaucuccuucuuucauggaguaggagccaaugaaaagucucagaagaaagcccacaucaugaagaagagcuuugacugaaaacaaggccaucauguuuuaacuuuuuagguugccauagaguuuuauuucuagccuggaauaaaauugacuggaauuuugaagaaauccuugauuccuucauuuaucaugguucccaucuauacccugccuuuaaacucaccaggguguugaccccuccuuuuacucagcagguggguuuccugcuaggugcugggauuaagcagugagcaagccugcaaaucuucugcaucuucuuagugacuguauaguuaccauccuuggccuggugcuggucugcucuaugguuugcccuuuguuuaucacuuugagauguuggcugugguccauccagaaacuaccuuguauacuaauugugguuuggaaucugcauucauugaccagauuuguaagcuguuccaugcuaacacugcuucuugguuacuccuucuuggucacuguucuguuccuuccuuagacauagcugaauuuaagcauccccccuuuaauaagcuguucauuagaccuccuuuaauauucuguuuaguugcuuuucucuauuguuccagccaaaccuauuuuuaugcuccuguaaguagccagacagacugacaaggucaugggaaguacauauaaauacaaaucuuacaaguuuaucuccaauuuuugcaagcagagccucaguguguguggcuggauaauuuguaucuuuuacaaagcaucucugaugguuauaaugagucagcuuccccugggaaucacagguuacuccuuaauuauggacuguccugaaucccauccagaccucucagcuguggcuggguuagagcaaagcuaguuucccuugggaagccaacaggccuggguuucugugacagugcuugcuccuuguccauuauggcagaacucacacaaaauacaaagcuccaagccacuuaaaaaugcauucucuaagugaauugggcccccaaaauuauuuuaugccaugaauuuugaccaucuugagggugcaguuaaggcaucuaugaauggcagaagacaugacauaguguuccuccuuugacuaugaaauacagauuaguguucuuuaggaucucuuacccuccugugucucuuccauaaagacugagcccaugugagggaagggguggugucuauaacucuggucuacaaagcacagaacucaguaggagccaagaccugguaaagcauuauuaauucugagacuuuuagccagggugcuggagggcuuggcagacaugaauuaaugggcacuuuuccucaaaucaguuuuuucugggcucacugaugauagguauuaugcuugggguucucugaauccaccaccucuaagcggccugggccagguuuuaggaugguguccuuuaugccucagccuuauuauuaugacaggaguagcaggaagcguggacaauacacagaugcaaagaccuagcaugcuagcacugcucauucacucuugcuccuguguucugcagcugggucuagagaccaaacagucagagguguuaggccucugucacaugguggugugcugcuaggaagaaagguaucaugaaauauggggaccugggagucagaaagagaacauuuuucuuuuuucagggguagaaauagaagcucuccagcuaucugagcuccuauuuaaaugcauacacacacacacaccaccaccaccaccaccaccaccaccaccaucacuaccaccaccaccuuuaaugcuagcacuuuggaggcaaagacaggcuauuuuuuaugaguuggugaguagccugguuuacacagugaauucuaagccaagcagucaggcagggaugcauagaggggguugguaaggaaggagggaggggaggagagaaauauaaacuacauugaugaucgguuuuuaccagauugaguuuggacaacaagaugggguggacuacucugaacugggacaggauugaaauugaauugugaauguuucuccuuucuuggaguaucuuaaagaacugguaugacuggaagaaggagagaaccuuaaagucaacagagauuucccauuuacauuccuuagaaugagagugaagaaugcccauuuaugacuuguccuccuaacugagaaaacugcuaugcuugcgauuuucuuuccucuacuguugaaucuauuuuaugaaaaauguuacaaagaugcagaaacagugugaccuuuacacaguacuuuguuguuguuuucuccagugcgcagauauaagaaauacuaauaguacugacaccuaaccugcagugcauacagugggucucaugggaaaaugacacauggagcaaaacuacaauuauuaagaguuaugaaaagugaaagcuuauguuuuguauaauuuccucuuagaacugaaagacuccuaaaguaaaugcaugccaucuuuagaccaggcccacagggggaauuuuuauacauuauuaaggacugcauccugugggucaucuacagagugacagagcugaauuggagaaacuuucugccauuaauauuuaggauuuuuggguuuuuucuucuuuuaggguauuauugaggaaauuuuagauuaauccaauuaauacauaaucaaguccuugccaagugauuuuugaguuuaaaauuuuauuuuuaaauuaaaucacagugauauaugcuuauuuugcaaauauguuuuaaguaggaaaguucugaguuuauuauugaagcaagggaugcucucccauuucagaaugguaaaucacuugugguagucggcaaugauguguuagcuugagcacagcauucaucauguacucugaauaguuucauugccuggaauaccuccugagccagcaaguaguaguuucugauacgcucacaagcuaauguagcaucaugacugguugauggggugggauuaacuuugacuauagauagaagucagcauaacuucuugaugacauuugggaaggcuaagaccucauacaggugccuucuacugcuucccucuuuaguaauacugugggugcuguggagaauaggagcaagagugggaagcagcaggcucuuugguaggcagcucagagcugggguucuagaauuggccugguuuagaauacauuuacccuguaacacugguguauuuauuaaucucugagcccaacauugucaccaugguaagugaaccaugcuaaaauaauuucuuaggauuuuguuagguaaaauaaauaggaucuuuuaguaacugguauauuuaugcccuaugccauguguuuguuacagcucuaaguuuucugcuuccuaaggaagacgaacuuggcacccacaacucaugagcucaugugauaaacacuagcugagaagggcucagaauguccauaacagagccagcuacuucuugcuuccaucuugguaaaaacaagcucuguacugagauaugaagcauauaccgauacucagcugauaggagaaaauacaucauuuauuaucucuauuuguccucacggagacagggcaaacccauaacaguccauuucuaguagugauuuuaccacuacagaccuauccagagggaauaaucauaacuggauaaacaguguuuucaagugagcucauuuugaagcucugcuuauaauaguuuuaaacaaauuaaaaccugaguauauaauaaugacuaaauuaaagggucuaaugcacacuaaauuucauguagccaucaaaaauguauuuguaaaauguaaauaaguuuggagacuuuauaacagauuaaaaaguaagauuugaaaauaagcauaguaagucacuguuuguguguuuaagacuauauauagaugugugaauuuauauaucuacauauuauccagauacauauacuauaugcaauccugcauaugugauagaauuguguagagaaugagaaacacacacacacacacacacacacacacacaaacccaaacacauacuuaugcuauaaauuaggaguaucagaaaaaaguuguuacauuauauuaauaugcugauuguggauauuauuacuaagguucuguaaaauguuaucagcaggaaaaacaguuaauggguguaaaagaucuugcugauuauuucuguacuugccuccagaaagcaaaggccccagacugggaggguuuuccuagugagcauugcaggcccuucaaggagcaagugauuguuguucuagagcacagggaaugaagugaucaaaguuucuucuuuuccaaucaauggaugagguuaguacuauccuaugucagaaucagaggcauacaggaaaacagauuauuagucagguucacaccacuggugccauaauuguaaauagguauugccauauucaaugcagccacaguuuuauuaaaagaacaauaugagaucacagaagaucuauccaagggauguuuuaacaucaggaaagcaaugcugauauuaacacuucaaggggaguauggccaucucaacagaugcagaaaaccaucuuauacaacacuaggaaagguuuuauacacugucacugaaauucuuguuaagugggagguuuucuauauauuaggguugauacaucugugccaaugacuuaauucgcgugacauguuuaggaacccaaaggccaauguuuaugaagauuuuaggcaacagucuugugugggugacagguaugugacaguccaguaaaggcagggcuguagcacagagguuuuaacucauguggaguuguaguuucagcauuuccaguccccacugugcacuccccaaauucagaugacuacaggagaucauauucaggcuuuggaguucuguaaaucacaauuugguucuggugucgcuauuuaaaagccaugugaucugaggauguuucuuaccacuuccaaacuuguuucucuaauuuaaaacugagacuuauaauauuuguucuuuugagacuuugaagauuacuuuaauauucagcuuuaauauuuuguugcuuugaagauuaacuuuaauaucaaacauaaaacuugaccuacaguuggcauuuuaaggaugcuuguuuuauuuuucuuuaagcuuugugguucugaaauagucucugauaaaaguuuuuaaaaauguguacauacaaauauguauggguaggucuugcauuucucacuugugucuuguggcauacaccaaguggcuuacauugucacaaauauagggccaguuauuuauuugacuagagugggugugcugcugaguuguauuuuugauuuuucucaucaucauuguuucuuggguuauacuuaaagcacacaggaaauguacaaagcagauuucacuaagacaggaaagccagguguaauuauugaggauaucacuguaaaauguucaaagaagccaauaccagcccguucaauuguaaacaccaacuacacuaaguucacuaauguauuaauaauuuaugucccacuuuugacaucauuuauuuaagagagauauuuugauuugcuuauauuagauuugguucgauuucguaauuaucuuaguuaguuauugaauuaaaucauguuuaguuggucuguuaacacuuaauguacaucacuauacaucuaccaaaggaaagucuuggcugccuuuucaaacuaaaaacaaauugugacuuggagcuuacuuucaaucugcucuuaauccacauuugguuacucaggggaggggaagaugaacuggaucuaugcauaauagacacagcauguaaaguaugcaucuuuuugccuugguccaguuggauauguuugguaaucugaacugccagaaagcuauaacccagaaagaagcaggaccacugacaggaguuaagucacuacuuuucuaggaaagcagggucuucauaaaacaccagcaugauggagggagacaucagaacuguguuguugacuuuuguuuuuuguuuuguuuuuuuguuuuuuuguuuuuuguuuuuuguuuuuuguuguuguuuuugguucucuuuuuuuuuuuuuuuuuuuuuuucuauuugaccaccaaugaaagccuucagaaaaauaaaauauaaagaagaugcaaaaugaaagaaacuuguuuaguguuucuuggaguuguuugcuguuuauaucagagaagaaugagacuuuauauuuuagcuagucacauucaccauauaauguauacuguaggcuccuagagucaagaugucccuuguauggggccagcuuagauugagaacuuaguguuggauaauucucuuguauucuuuuggacucuuuccuuucaauccuuguaacaauuggaugguggaugguggagcuggaauaguuacuuuuaaaaaauaaggauuuggcuaaccuuuguuuuuuugagacagagucuuauuacauagccuauguuggccuuaauuuugugaucuuccuaccucacucagccuccuuagcaauaauauuauuagcaugugucaucacauccagcuauguuuuguuuuaacaucgauuuuuaauuuauuuguguguguguguguguguguguguguguguguguguaccgauguuugugguggucagaaggucacuuucaguacuuauuucucuccuuucaccauauagguucugaggaucaaacucagguccccagacuugacugcaaucauguuuuuuaaacugagcuaucacacaggguccuggaucugacauuuagaaagugacacaaugaacacugagagagguuuaggagcuugaccaaggugcuguaguauauaguuuaaucuaaguggucugaccuacuaguauauuuuuucuuuuuuccuuuuuuugcugucaagcauuucuuuucuggcuucucccugauuccuggugguacuguucugacauacauaugaagaacugaaacaccaacagaacauguguuauacgcaauacacaccagugugccucaugugcuaugggaaacacgaauaaggugauuuuuagcuaacuuacccauuccuagcaaaaccucuagcuaauuccuuugcugguuuauggaccuucuagcuaguugugggaggaggauuccagcgauuuggaagaaccagauggagcagggacugaaaucaagucaauuugcaaauuuuaggacuacuguggagauaaaagcuuccuggaaauaaaaaccaauaugcaaaacacuugugaguuaaagcugcguuuuucuaauaaggaaaaggcuguuauuguagguagaggaauaaagaacauuccucagauuuuuacauuaaaaaauacuucaucagugugcaggaggugagucaagcaugccuuuggcccagcugaaaaugauccuuugcuguguucuucuugccagcauagaaaguagauugaucucucaacaguuuacucuugaagacugcuuuccuaaauuacuucaucauacaagugcguguguuucagccauuuucagaaaagaaguuugugggaugauuuuuaaagagaauuuauuggagacgacugucucugaucuacuacuacaaauaaugaaugugaucccuacuuuccauucauuauuugugacugucaccugacugcccugcagggugauuuacagagguggcagccuacacuccaaguuagagcuugaguuuuucuggcugucagcaagccccuguuaugauaccauaaucgaucaggaacguagugaaacuuucaguguuucuaauuuuaauucaccuaauagguaugcaugcuggauugucaaagcaccagguccuuuauuuuccuuaacuagcuuaauucuuuuggccauugaaauucagaguucuuuaccuacaugucacauuuugcuuugauggguucugucuacauguuucccuuuagugguguggaagcuaagaaauaaacuuguuugggguauuggagauuucaucuugggccauaugaaucaaggcuaaguucuuaccacugagcugcacucccaagucuuaguggaaauuuaacuaaacucuaugucaguugauuucuguugugcuguggaaaggucauaucuggaccuuaguguucacaucuauaagaagguuauuaaucacauaggcuaccucccugagauaauggcaugauuaggaguuaauacugguaagccaaacauuuagaagacuauccugcauggaguuugcaaucuuagugcugcugcugauucaaauggaugacucauaaaauauauucaucagacaagacagaacuaugaacaagagagagggaugagggauggagaugguggcgccacuaacuagguaagaucgucagaggaaaauuauggauuuuccccuuuucuucucccucuucuuuuuauggcuguucuguuguuuguuuguuuguuuguuuuuuuguuuuuguuuuguuuuauuuugguggaaggagagaguguuuugaccucaauaugcuugucaucugagucuuggaggucuuauuauagaguagugucaugaacucaugauguacaguaucacaucuggaguuuuguugcuaaugcguaucauucuagcguucaggagacugagggaagagaagacucaugaguucucgucagugacacucugucucuuacauugcccugugcaucuaggccucacaugcauaaaacuaggauggggcccagcucuugguguuuuagaaacuccucagguaagucuuaucuucuagaagauuugagaaccuuugcgugagaugccuuuuugaccucuguccuaggaagucucuggcaggcaagacuucaagccccaggaccacaauggcagugccuuguucucuuccacccuccuguuucccacacugaaaugacaucuguuaucuguacuuuuugguaauuguuuccuuaucuuaugguggaucugggaguucuucagauaaaaaagugauauauuuggaaauuaauuugucuuuaaaaaaaagaugucauuugaaaauagacacaggggagguguccacaugaagauucacccauauauacaaaugcaccagcauauacauaaugugcauguuuugugaacacacagaaacuggaaacauuuacauuuauuaaggaaaacuuuuuguagaggaacaguggaugauuguccuggugcagacaacauguuuagucagcuuauuagacuugucccaggaauacucugaauggagaacuugugugauuggcuggaauggaauucagaauuugucuaaaugcacugaucuuguguuaagucuuauacauaugguuucaagauugucuuuuuaugguaccaggacuuaaguacuguuccauggaccuggaucaaguugcugccuuccacacagugccauuuuuuuucuuuuucuuuuuuccuuuuuuuuuuuuuuuuuuuuggccauucaguggaaagagagggcuucagacugugguggacacaagacaucugaacuucagcaagaagcaguagcccauuauugaaucuauucauaguuuacuuuuuucauauauauaauuugggagaauguuugcucucauuuaacccuaaaaccacaauuucucaucuguuaaauaaaagagggauaucuugaauugacacaggaggaaagaaagaccuuucaaaaacauucuggauuucucaaauauuuuaaaaguugcccuguaggauagcauuagaacacugugggguggugggcugugcacagacagccugguccccaguugagcaaaggucuggaaccccagauccccgguguuggugauuuccaccugcaugggacaauaggaguucgcaccuggcucucugcaggggcgcuguggaaggcuguggguagguacagccucccacaguccccugcagagagguauucagcugcaccaagcccucacacaugcaaauaagguuuccccaaacccucaguccaagccaaugagaaguaccugcugccaaacccugacucaucccccccaaacuguauauaaguccuaucgaacgaauaaaaggugugggagaacgacuucaugauccgagccuuugcccuaagagcuguaacacuugaggaaaggucggcucuccaaagcgccgccugaggcucugccgcacuccucaauggcuaaucagcuucuggucagcccagcccgaccugacccagugcggggcagcacagaauuauggcagaggagguggagcugacuggagcagcagaagcagggaagcgacuuccccucccuccccucauuugcuucccuucgccggaacccucgcaccaagccuggcuagaaucuccguggaaaaucucugguacccagacccacaaaacaccacccuuuuagaagcugugacuccacaugaaucugccucgaguugagagaagaguagcauucugagaaagcugcuaguggaggcuuagaaauccaguaagucuaguaucuagaaugauauucaauauuauggccuaguuuuuggugaggauaggauuaacugugccuucaaaaaguauugagcacgguguggcuuaaucuuagaagucaagugaguagaaaugggauuuucuucucucucucucucucccuccacuguaucccugauaagcagguuagcaucccagagcauugauguaauuauuauguagcaauguuuuacucaguggacauugaggccucugagucgguauauccagcuuuggaccaguggcugucagugucugugggccaucaacaucugccucagugaggaccaugugugaagugcagauuuugugucccauuccacacccacacaucguuuuccuuacuucucauuagucuauauggccagagaggugcugugugcugggaacuacagacauuccucacaaggauucuuuugccagcuagcuuuggagagcagcugacccuuggaucucaaugcugagagcaaugcgggcaguuaagugagaacuccugacccuagaugcuuauuucaaucuuugcagcugccugagagauugcaguacucagaguuggagaccagugguuugguacccuacggaguaggagcaucaucugaaagcuaguuagaaauccagacucuggaaccccguugagaguuacuaaauuacaguuuucauuuuaacaagauuucugugacucauaaacacauuagaguuuguagaaaaguugcuuuauagaaauaaugaauuuccuuuauagaagucaaccucuagaauggcucuaauuuacaaguuuugugaggaggcagaacaguugguuuggcuucugccugacaguuacuugcaaggcaaccaacagagagcaaaggauagcuucauagcaguugcuuaggaccaggaauauuguaauggugacagucugucggccacugggaggugagugguggcaguuaagaccuuugcagaggcauauaaugaaaaccccauuuuuaaagcagaugaaugcaaaggaacaucuuagcucccacaauggaagggugaaauaaaagcucugguauggcugcaccaagaauauauacugugauugucucaaggaauccggucugauaugcuucucaucucagugccccuuuguuagcaucacuuccuggcuggaaaagaauuaagcuaacaguuacguuauuaugaaaauguccuuaaucauaacagcuuaaauagauuuauuccucuuugcauaauaaugcaaagacagccaagaaagcucugccuugcucucauacagcucucacugguuaaguccagguggcuaugucccacuuaauugccuagccaggaaagaaucaaaaggaccagagcccagaaguguaacauagcauucuucucauaaccuauugguuggaauuaagucacauguccagaaugguccaugcaugguggagaaugcagucucuauacacaaggaaaugugccuacuuacaucugaagagaaagggcaacuuugagauauugaugggccagaagagacuaauccccugggugcaucaagauguagcaugacaucucuggauuaacagccuacccucagcauuugcaguggaaaaaggucccuuucucuaugagcucucuaucaaccacucuaggaagaaccccagauuggcuucuucuugacccuuccuuggccuggaauacaugcaccaagccaggaaccaaauauggagaacucaucaccugaaccccauggacuguuguagagaaggaaagauuuccaaagauggauggacagauucuuaccugagaagaaagagggaauauugugguaugggucccaucucccaucaucuccuuccauugccuguauucugacuuccuauuguaacuucccuuugauguaaagccugauccugacuuuaaugaaggaaauggguggcacauacagccaucagccuuggccucaaaauuaugaggcaccagcaugaauaugguucagguguuaucacccuucauaucuaugucuguucauugacacauuaaauaacaggcuuagugcagacuaaguuguaccuaaugcuuaaacagcuggcaagaaacagaaguagagaacuugguguggggccuaaauagauaaaggcuguugcugucucucagcauuuuugaguuuggagcauuuggaaauuaaguuucugucagaacaaguucacuuguuggcuguauugguauguguuugagcacugcaccauuugcuuuagugguuggcaaauuugaaucaagguggagauagacuuggaaaaugcuuuucucaaauacgcuaaauuaaaugaguuaaaugucuaauucugacaaauguguggaagcuuguagccaaacaaugaguuuuauaaaaauaaugauuugaacucacuucccaucgcuuucucaagcucuuuauguacuuuccuauguuuuuuagaccuuauucagagcacaaaagauuagaagugauuucuaaagcuaaaggcauuauucugcaggaaugcuguaaagaguaaaguuagacuuauaagcagccgaagucuuuaacauauucuguguaaugcuuuaaaaaagacuuuugaugucucgggugauaaaaaaguaauacauaauagucaaauaacacaccaauuccaagccuuucaacugaaugcuuauugucuauuuaauaaaaauagggguuguaggcacaucugaugcaaaugaacugaaauuuuauuugccagaacucugcguauccuguuaauaagauuuacuccaaacacugcuguugguuuaauaaauacugaggggacauuugcaauacgccucuuggcaucugcuguuucucuccucugagcauugacuacucuugugagucuuuaccaggcugcuuuugcuguuuuguacuuugagguacaaauagagacagagaacccagaggguucuaacaaauuucauaccauaaacuuuuuacagaugugcuuacuauucauuaagaacuuuuuguuuacugaaugaaaacaauauuuucuuuuuggcacuuuugugcaagagguuuggauuuuauuuuacuagaaaccuaagaaacaguaaugaaaguuucuagacaguugugaugaguuuuccggacauuuuaacuuccuggaucucccauucuuuuggacacuggugugaugcaguggcagggagcucugaggagacugauuuggguuggauaaaaggaagaacuuucuaaauagcaggcagauuaagaauaggccaaccagacagugauggcuaauagggcuugugcuuggguuguguggcuagcuacugguuuuggauauucaagaaauacuguacauccucuggcuguggaaauuagcuugccuuucucaguuccuuguaaccuuagagggugcugcaguucuuacaguuugauguugugaacugaguagcuuagcaugcauuuugcuuccuuuacugaugacuuggucugacaaaggcuaggaaucuuuuguugucuuuaguaguacugugaaauuuuaggaucaacacacacuaaugccaacugucuaguugggggaaucauaaccauugcaauuugacauugucuuagcuuucaaggauucugauaggcaucuaccauguacaguagucacucaccaacucaggucauugucaaguugcacagccucuuuucuucucuccuguuguucucugcagcccaaaggccaugaaaugucccugcauuuccuuauggaagucauuccuccaacacauuuaccaaguauuuuaaaguaaaauucuuuaaaauuccaguacaguuuugccuuaugccccaucuucuccuuggcagucaagaagaucaguuguaguugucaguuagaauacacuaaucauucaugacuaaccauuuacucuuggcugugauucuucauauaguuccucucaaauaggauuggcaaugcucuugauaugggaaguagaaguuggaauaggagguaaaguucuuaauguagguagaaaauguccauguguuagagaacagagguaauugaguugugaaggccaacugucccuguucuauagcugagaacccgagcucagcuccuuccacauuuuaagcucuggaguuuagccacugaguauacagucugacuuguuuggaacugaauaguuuucucaaacgugaacacauguccaugcuguuaugcccugauuccgagggaaaccccggagagcuuaggaacuacagaguccauugcaauuugcauaagaguccuuuuuaugagucucaaccuggauuggaaaccuuccuacaguguuggucagaagugcgaccaugggcuuggauggcuuggcacuuauauacagcauaguuagagauucuuugaaugcuuaagguggagaggagggaaggugggugagguaagucaucauucagacacgauaccauuugguagggcggaauccagaggcugagaggggguuucuuccgaccuaaggauuaucuuuauggggcuaucgggaacuaguuuuauggccagcuauaacugucuaugaucuuugauuaccucucaucuaugauuuaaauguaauucuccuuuuuccaaggacaggcaccggcugcagcugggaagagcccagcagguuaucagggagagugcuaguuucuggaguuggggaguuuuaucauuugucucauucaagcugguaccuguggcuccuugaguucucucugaguggcaggguaggggggucccuguguuugcuguaggguguggggagcaggaguuggggaaaagcagaacuucugagggaaaacacagaggcaagcugccuuagugucucacugcucuugcugugagagaaagccuaggggggagggggacuucugugggagagugcagaagcaagcugcuuguacacuucaaugccccccccccccaaagccaaacaaaccaaaacaacaacaaaaaaacaaguguauuucaggggcuuggugaaacacgauguaucugaaccuuugcauuagaaagauuccaaagcugggcauggugaugcauggcuaaacucagcacuugggaggcagaggcaggcggauuucugaguucgaggccagccuggucuacaaaaagagucccaguacagccagggcuauacagagaaacccugucuugaaaaaccaaaaaucaaaaacaaaaacaaaaacagucccaaauaccuaucaacuugaugguaagaauucuugccaaagaaaagaaaacacugaagguggcuugcucaccccggauucuccucacccuguggaaaucgacauccaugguucccauccucuagucuacauuguguaaacacacugauauuuuagacucauugcuguaggcugacaaauagaaaguucaggaugacuuccuacagacuucccuccuaugccaacauuucaguuccacuaaaaagauuaucuacaaaaugcaaaauuuugauccagagcuaaaaaugaaauaauuccucguguuaucuguaaauuguuuaugccuuaaaauuuuuaugcucaugguugauauuuguccacaauguauaacagauuugcuaagaugauuuaccuaccauaaauauucacccuuuaaggauguuaugcucaguagguuuugauauauuuauaguuguguaugaaaugucaccacagucaaauucuagaacauuuuaucaccucuccucauauccccauuaucaaucauuccuucuuccacccgugccaaguucuaggaaaccacaguguuaccuccuguauauagaugugccuauucuugucacugcaaccaacagaaacaauaacagaaagccacaacuaauuaaaaugaugaguucuggacccuagucccagugaacagauacaucuacaaaauaacuccaggaacugacauucagaguucaucacagaagagggggugacaagaacauaagagccagagcgucaggucagccacagccacagccacacacacacacacacacagacacacagacacacacagacacacagacacacacacacacacacacacacacacacaccauuaugcagauagagcagguuacaguaagggagggauauauguauauauacauauauaaauguaacaacacuuaauguaaaaaaaggucaugaauuugaaagacagcaaggagagguuuauaguaagcuuggagggagaaaagaaaagggaaaaauaauguaauuauauuagaaucucaaaaauaaaagacaaaguaaaaacaaagaagaaagaaaagagugaaguagaagauugugguuacaggccagccugggcaacacaauggauucuauaccagccugaccagccugggcuacagagugggccuguuuaaaaaacaaacaagcaagaacaacaaacaccuaaaccaaucaagaacaacaaauugaaaaguaaguaggagacugauugguuugcugguaguuuuauuccuuuucuuuucucucuggcaaagaagacauuauggagucuucuggaguaguucauaugaugggucuuguccuugaccugcaccuacuuuacuaguaggacuuagcaaauaaggacuuaacaaaaugaccagcugaaaauguucucaccuauauaaggugccaguuuacuagguuauuuuauuuuaugauguacaaaagcuugcauuugugaucuuugaaguauguccuggcuucuuucuucucaaaguauaaaacauguaguagcaacccagcacucugcucugacucuugacugauuccucucauggacauuguugaagagucugucugacuuagaguuguggaaaaauagcuguauguucuuacaacauguuugaauuuuauucugggccuguaaggauuuaacacuaugggcuuuuaauuguuggcaucugguacauuaauauaaugauaauaauaauuggaaauaaugugguucaucucuugaguuguuagcuuuaauucccugaauguuuuugaacagaagucucccaaagucuuaaaguagaaccauuuggaggagacccauucuaguuuuuagucagaguguguucagacucugucuuguucugauuuguugcaaugauuuucauuguuugauuuuaauguuuuccacaugaaaacacaaaaccaggcaauacccaacaaaauccaccuaaaugcccucucugaggagaccgaacagaagcaacaaugugucugucuucuuugagagcugccaggcucuguggggccaagcacaguggcagaacucuguugggaaccaggcugcagaagcggaagaggaagcggaagcggaagcggaagcggaagcagaagcagaaacagaagcagcuuggugcuuaugauuucugugugauaagagcaacuuuucccauucuccagauaacugucuaguagauuugcaaaucuauuuuucccuccucacugucuuuaaugaagucuucaaauucuaaaauauaauuuaugacuggaauuuauuuaauauggauucuuaagucucaaggcgcuucucaaaagauuucaaaauucuauguauucauuagugugaacgucuaacaaagaaugugcaauugaaaagggcugaagcuucagaugaagagguggcucagccauuaagagugugcaugucuucucugagcuuggcucuccacacucacaacagcucucacagcuaccuguaauucccacucuagaaccuaugcacggguagcacacauucacacaggugcaugcauauaaagaaaacguaauaaaaauaaauacuuaaaauguaauuuguauagagaucugggaacucuucaaauauuuacaacuaaauaagaaucuaauuccauugaaucauuaaagauaacacuuuugcuucaggagucucggucaccaaauugucuaaauuuaugcuuaacauggaaaaauauuuuaaaaucauaauggaguuugaauuguuuguaugcuagaagcaguaauauaauauuaacuauacgaacaaacacguagucucucaugaguuaugcuggccccuaauuugacaaauuuaguacauaguuguuaccuagaacugacugguucucaagcaaacuuuuauuuucucgagagacuuccuggcacacggugaguugugcuaauuauaguugaucuaagaauccagccaagaaaacuuuguaaugaugaccuuauuuuuaaaaugcauccugcaaauccuucucccaaaccuacaagaagaaaacauuuucgcuaaagcuaaguuguuaguuauauuuccaagagaacaaaaccaaaucauuuuuauucuugcguaccaugggauuggauuggagaggcauuacagugucagggggacauuccauugggguuaggaaguagugucugagcuauauauuuaguggugacuuuggaugcuucacucaccuuuaauguuguguagaauacugccuguccaugugaacacaggcacaguaagaggucuguuaacagacguucacauccacggcucucuagguaccuuucccacccccacaucauuuauauaugauauuuaguguauggaccccaaccagacuucuguuugaaguccuugaaucuggagaggcagcuugauaaagcaaaacagaaaucuguuggcauuuugagaguggaguucacagaggauguuguuugcaguguccugaaaacauacaggccagcagcuggagcaggccuggugacaggcaaucucacuuccagagaacaaggagggcugagcaguccucuaaggauuagcuccagcucagcagcugcugucugagucugauuaugcacauccggcucuaagagaccugcauuaacccucagccccugggaacuucagggcuguuuuuuuuuuuguuuuuuuuuuuuuguuuuuuuuuuuuuuuuuaaaacaaaagacucuuccagggacaaccaaggacuaaagcccagaaaauguagaggauaaaagaagguggcucuuugggagacugaauuugaaguagccuugagccaaagcugaagaagaccuggcaaauaguauuugucuuugcagaccugguggcggacauugggggaaaggacuggaccaggagggcuugagcagcugaggaggacagaggcucagagaaguuaaguuaccagcuuagucauuuuuccacugcuaugaagagagacaguauaguaugaccauggcaacuuagagaagaacgcauuuaaugggcacuuaaaguuucagaggaugagucugugaccaucauaguggggagcauaggaacaggcaggaacacauggcacaggauaguagcugagaacuuaacauuuuuuuucccacaugcuugaggcaaagagagugugcaaauugggaauaacacaagcuauugaaaucucaaagcccagcccccauggcacuccuccuucaacaaggacacauucccaguccuucccaaauaguuucacucacuggggaccaagcauucaaauauaugagccuauggaguccauuuuaauucaacuaccacagagaaaaaucauguuuucccauuccccaguuagagcugaaguaccacaugucugaaguuguuaucuuuaccuugagauaaucauucaugcuuuugaaaacugaccuuagagaagaaacacuggagaaagcauuauggaagcuggagacaugguuaagaauacauacugcucuugcagaagaccugaguucaguucccagcagcuacauuucuggacucacaaucuccuguaacucuagcacccagagauuuaaugucuccugccuccaagggcaucugcacacaugugcgcauucccauauauaguuaaaauaacaaaaacauauuuuuggaacauaagaaaagcacagggccuggaaacauggcucaauaguaacaucagcuauucuuccaaaggauucagguucccagcauccacauagcuacucacaacuggccacucaaucucuaguuucagaagauccagugcccucugcuguccuccguggacacuaggcaugccuguaguacguagauauauaugcagacaaaauacacacauauauaaaacacuuuuuuaaaaagugcaucggggaauuauauggcaaucacuguguccagcuuguugggauauauuucuuucaagcagcauuuugccaguguguaaaugacuaguggauagaccacugcagucaauucuguguaugauauuuaaaggcagagcagauacugggaaggaaaguagaagcuaagaaagcuucauggagaaugagccuucuuuaaugaaauggauuccuuuguucaacuccagcgguaugaggcccagcgcugcacucugggagaauuagguguuugagaaugacaguguguugcugagccuacagcuguccagguaaacaaaaggcuuuguuagaaaaggcuuugucagagaagauggcugucuugaguuguguugcuguguagcaucuacacugaguguugaaugauucccuucuuuaugguuuuagcaggaacuauagaguuauuccuuugggugguuggaguugaugcuuucauguaggaacuaacacauuaaaugcaaaccaaucaguaaauacuuccuuauuuuuguccaauuaaaagauugagcuauuagguuaggguuuucgacauuguugcuuuaaagaguuuuaacuaaaaacagaacaaaccaacaaacaauaacaacaaaacaaaaccagcaugguuuuauucacugaaauuucuugugguuuuggaacauauuuuuauaauuccugucuuguguuuguguguuugcuuguuuguauauaugcuugguguagaggccagaguuugacauuaggugucuuccugacuuguuucucucccuuauuuuuugagacagagucucuuacugagaccuaggguucacuagcuauuggauuagacuagcuggccauugaacccuggggaucuugcuaucucugucucuucagcaacaggauuauauguaccuggcagucacacccaguuuuuauccaugcauucguaugcucagauucuuaugcauguauggaaagcacuauacugacugaucugccucuauagccuuguauuuuauacuucuuaaggaugggaucucuaguuacucugucuacuuuuguagguugagugugaucccaguguguaguuguucugugguucuauucuguguaaaaauaaaaauuagaugcuguauuuaggacgcuuuacugagacgcuacagauuaucuuucuuugcauuuauucuuuucccaagauuuugauaccacauauaggaaaagcaucuuccagacagcugugguuugagaagugguuuuauucagccaucucaucacaauguauuugguugacugauuaugugaauacaaccugagggagaauuucagugguaaucucuguaggcaguuguucuaacucaugugauauauacuauguaaccuuuggagaaucuauuuggacugccgaagcugaggaaguagccuauggaucugugguggauaauugaaguuguuauuaugcugugcuauucaacuuuuagagagcaaaaugagcagacugaaggcauaaguccugugugaauugcuucuaaacugucagcuagguuguaauucccaucagauggugacuuaucuaggaauuggcaugucucucccuggaguagcuguaaaccaaggaaguguguuucccaccagcuguccuugccugggguuggcauuuuucccucucauugucacucuaugucugucuagaaguguguuguucuuuuccaagauagugcauuauguggcucuucaaggaagauuucucuaaggguuaugagcucagcucuuccauccuuagugguuccuguuacaguaacaaaccuuaggguuuaagauagcuauauacaucaucuuaguccuuauuccuuuuuuccaaaaaacguaugugguggauuauuaaggaucuaaaaucuuacgcuuuuugggaucuccuuuuuagaugauuugguaguauuucuguuuaaacucaaccacauuaauagaaaguugaggguuuugacuuacaggaggccuuuaugaauaguucacacuaggauaucuagcacauguucauauaacguuuuuggaagcauuacuuaguaacuuuccugggaguugauuuuguacucaugcuggcuucucuaggagauuccuggguaccaucugagaggagccuucauuauugccaguccaggagggauuuacaucuguaaacuggacaaaaauaugugaaaaggugauuaguuuaauuggucuacaauuauaauuauucaguaggaggugacuguggaauuacuauuauagcuccaaauuccugcugggaaggggaggaaaauaaaaucaccgaaaacagcaauguucuaaaauguuggcuuaacauacaguuaguaacaacaaauuguccaagcacuuaaaggauagagaaauucuuaacaauuugugcaccuaucuaucuaaaaaugagguggacuuuuuguucaggauaacugugggaaaacuuucaaauguuuucuuuuccuuggcauauuagauuuuagggagaggugaacucucaguauguuuauuacuugaauauugucucccaugguagugaagacuaucaggguggccucaggagcacuguuguuuugucuuccuucaaaaaaauuccagucccuguaauauuguaaaguggaguguuuuucuuucacaucaaagggcagggaaaguucuacagugaacuaagaaggagggagcugacauuacagcccuagcuuugggaaacuaugugaggaaugccauaguucauggaccagagacccugaagugaaucuaggugccuguguugucccauaaugaaaugacugcaggcagaaauugaauccagaugaaccccaaauaaaauugauggcuuuauucagcauucuuuucaugagauuuaacuuucuaaugugcacauauaucacucuggugaugucauuguaaauagccgaccuuuguuucaggaagccacugugcagggcugcgugcagcacugcuuggauuucugcuuacaucuguuaagcaugugagauaugcaugcaagucuacacacacacacacacacacacacacacacacacacacauacacacacacccuacaccuugauauuuggggaaaaaaacucaaugaaaaccacucaaaucuaauuuuagaugcuccaguuuagaauaacaacuuuuuugguuucagauacugaaguuguggaauucuuaaauggccuuguugaaaguugcauuaggaagucuccaaugcagagcacugggguuuguugucuugccccauccucucuuaccugugguuaaugauugcaaggugucugggaauaaugggcauacccugcaaaguuuguuagcggcaagcuuuggugacuuuuaaaagucaucccgccauccucuucuucacuaauaggagucagagugcugccauggauacaccuaauaaauaccugcaggaaucacugggcuguuuaaugaaaccuaauguagugccauuggugcagcucagugggcaguucuuauuuuccugugaucaaaaugugaugucugaaggauuuucaaugacaguccucuuuccuccucccuccucucaauuuuguuuuguuuuuaauacaucacaauuaaccuaggaaggcccugaacucaggguguagucaauauuguauuguccuugaacuccugaucucccaccucuaccucucaaugaagggacuucaggcaugugccaccaugccaggcugcuccaaugacauccucugauuaccauagaauacuagugaaauaagauauuuaaaagguaaauucaauuuccauuugagcuuagaggauaccagagaacuugaaucacaguaauaagggaaugaauucugcacuuaaggucacuguagagagaugaauggaacuccugcugacccuucuuccugcauauccucaugaugacuucaaccucccaguauuugaagaugcccauucucuucucuguuguucuuuugcuacuuuagauucaaagguggcagaacuuuuggccaaugcaugaugauauuaggccagagagaacacuguuuuuguccugaccacuauauggaaguacugcuccauuauuacaaaugcaccauguguguugcagcucuaaggaccucucuucaccagauucaguuagaguuguggaccuccucuccuuaguaguggagugguauacuuaauuuucuggauguuucuuauaagagccuacucuuuguggguaaagccaauccuaaccuguuucccuaucuuuuacaucucuucuaucacuugauggcucuguuuaauagcuguuuaggacuccagaagaggguucuuguucugggggacagcauuuagucauauuuucucugcucucuagcuauuuggugacaaaaccuucuucaagcucuucacaauccagacaaguuaacuaaucucugaccaagaagagagcugguguuuggaaguaguacagaacuuagugccucuuuucacuagcaaagugaaaccaauuuuguuccuaagaacuuucaaauccuugauuggugggauccuucauacauugcuuaggccucaguuuuuccacauaugaaaucagaggaagacccuucccuuauacaaaggguaugguguugagaagaaauaagauccuuuaggagaaagguaugaauauuuugcacacacacuuccagaguuggaucucacagcuuguggauuagaugugagugaccucauuucauggauguggauaguaagucccagaaagguucaaauggagcuuaucaagcugaacaucugggcuguauuugcacaucauguggcauagauaguccuggcuuguggauauggcuuaggcauguuuugcuuuauagcacuuuccugauacuuugguucuguaggcuccucuuauggcuguguuuguuaugaaaguaggaauucugugaguauguaaccgauuauuugugacuggguuuauacauggauauacaauuuuguaauuuuuguagacaauaaagcauuucaaaaucaucauuuauguguguguuggggaaacuggcuccaugguucccacagauaaccggacggacauucaaauucuuacccaagaaauaguauuuguauauaacaauaguaauuauaugcacauaucuucacauauuccagauaauauuuugauuacuuauaaugccguauaagcaauaauuuauaauaguuuaaaugcugcaugaauaguuauuauucaguguuguuuaggguguggcaagagcaaaguauacuuguuuaguuuauauaaaauuguuuuagaauauuuuuuuaucuaaaguuuguucagaaggaugaaacaaacuagaagcuuacagcuucucaacauagaacugaucuccuuaaagcaguuacacagacuucuucguuaauauagaacuguguguuucuuguugugaaguauauugucagaaaaugcacagccaacgucuuauaguuacauaaaugucuucucuguuuccugugagguuuaagauaauauagcagauuucuuauuuuuggcaagauggcaaaauagcagagaaguuaucuuuuuuguguucuaugaaugccagcauggagcuucagagaaugcugcacauaauggggggaggguuaugugugaaaaggccauuuuuuuuuccugagaauuuuuuuugggguggaucuucauaaguacuugguauacuuuaucaagaccagagguguaaaagacuucguauauuaacaugggaagaacaucacacccagggacagguuuuuaaguuucuggauuauuugaaagcccuaccagccccaacagucgaauaauauugaauuaaguaagucacuuaauucuauacagggaauguguucuccaucgccauagucuuuagcuucugcccuggaacagugauugcaagaaucuccuguuucugacacuggggcacugaacucucuucugacaguuucccaccuggggugcauuggugugguagguucaugaucccacccccucagccaauggggugauucuggguaggucaccugcagccauagccaaagcugcuguugguuucuaauauguugugaaaaugcugccacaaauuaaaugugcuuuagucaaugguuucagucuaaaauucaagaagugccaccuguacgggacaggagauaauguuaaauacaauaggccacgaaucauuccugcaauaucaggagcaugugaaaaauaaaggaauggaagaaaauacauuaaaacuugaucuauaauuguuccugaugacuggacaaucacuagauauccuauagauaacuuuucuuuccauguauuuaaucuguaucuuuaaauuuucauaugcuacgaacauauucaauuuaaaauacaauaaauuuauuaaaguaaccaaguuccagcuguauuggcucacacuugcaaacccagaacuucaaagaaugaagcaagaagauuguuaugagcuggaaccuaggcuggaucgcagaguaccaaucugccucaaaacaaucacaacaacaaaaccaaccagauuuauacuugaaaccauccucauauccuuauuuuuugaauaagggaucauuguuuuuguucugguuaagaaucuuaagugggagaggacccaucacacccauaaccauuacugagggcauuagcaucucaggguacuuuaucugugcuuauuuugaaggcuguugaaggcuuaguaggcagccugugagugggcuuuagaagcuucucauuugggguuggugauaucaggugcuuucuuucuauuuuccuucauaaauauuuuuucucuuuuucuugggauugcugaauugguuuuucuuccuuuguuauucucaauuccuuguauguuuauaguuagaugucccuuguggccacuuagcuaugugauggagaaucuguuuuuaacuugucuugacucauuaugguuugccuucucccccucccucucucaugcuuauuuacaucuugcuuccuuguagugagaugauuaguuuaaaacagacuuuuuuuuuuuaaaggugccuuuuccccccuugaucuuuaaugcuuucaauccacuuuuuaguaaaacgccucacucucuugaucuucugaaaagaguuuucauugacuuuuggccuuuuaaucauuugaagugugauuuuggaguucuguaaucacaguaaguuaguucacaguacuuccaugacauaugaucaugugucauacaauuauuuggguagaaaacaugagagggaaauuugcugagcuacugugcuucuuaagcacaagcuuggagugguuaauagcuagguuaacauaucacacucauaaauaccaauuuacuacaauucuguuacuauuaaaacuguguuaaauagaguauuuucuuuuauauauauaccauguuaagauuuuuauuuggagaauaggcaaaagaaaauauuaauagaaauuucuaacuaauagaguauuaguaaauacuauugcaauuaaauauauaaauuuaaaagugcauccuuccagucugagccaaugccaugagcaggucuugagugcuagcucugcacucaauccaaccauacccagaggaagcagaacccccaggagcucuaacaaaccuaggaucauaggaucauaggaucacagggucucaggaacuuggccacaccaggauuucuggauuccauaggcagcuugacucccagaagcucuuacacucaggaugucaggaucacaggaucauagagacagcuggacucugaggaguucugacacaaccgagauaacaggaaggacaggcuccagucaaacugugaguucaggcagcacuagcgauaacuagauggugagaggcaagaguaacaaaacauaagacacagaaaccaaggucacuuggcaucauuagaacccaguucucccaccauagcaaguucuggauaugcuaucacauaggaaaagcaagauucagauuuaaaaucacaucucaagaugcugaaaaaaagauuuugagaaggacuuaaaugacucccuaaaaaaauacaggagaauacagucaaacagguagaagcccuaaaagaggaaauacaaaaaucucuuaaaguauuacaagaacacaaccaaacaguagaaggaauugaacaaaaccauucaguaacuaaaaaugggaguaaaaacaaugaagaaaucacaaaaggagacuacccuggagauagaaaaccuaggaaagaagucaggagccauagaugaaggcaucaccaacagaauacaagagauagaagagagaaucucgguuauagaagauaccauagaaaaugcaaaaugcaaaaagcuccuaaccccaagacaccuaggaaauccagaacacaaugagaugaccaaaccaaaggaugguagguauagaagagagugaaaauuaccaacuuaaaggaccaguaaauaucuuccacaaaauuauagaaguaagcuuccuuaaagaaagagaugcccaugaacauacaagaagccuacagaacuccaaauagacuagaccagaaaagaaauucuuuccaucacauaauaaugaaaacaccaaaugcacaaaacagugaaagaauauuaaaagcagcaagggaaaaaggucaaauuacauauaaagggagaccuauuagaauuaaaccagauauuucaccagagacuaaaaauaaccagaagauccucgacagaugucauacagacucuaaaugucuuagucaggauuucuauuccuggacaaaacaucauuaccaagaagcaaguuggggaggaaaggguugacucagcuuauacuuuuauacugcuguucaucacuaaggaagucaugacuggaacucaagcaggucaggaaucaggagcugaugcagaggccaugaggggauguuucuuauuggcuugcuuccccuggcuugcucagcuuacuuucuuauagaaccaaagacucccagcccagggaugguaccaugaaaaaugggcccucuccccuugaucacuaauugagaaaaugccuuacagcuggaucucauggaggcauuuuuuucaccggaaguuccuuucucagugguauguccagccuuugucaaguugacaaacaaaaccagucaguacacuaagagaacacaaaugccagcccaggcuacuacccagcaaaacucucaauuaccauagguggagaaacuaagauauuccaugacaaaaacaaauuuacacaauaucuuuccauaauuucagcccuacaaaggauaauagaugaaaaaacuccaacacaaggagggaaaacuacacccaagaaaaccaagaaaguacucuuccaacaaacucaaaagaagauagccacacaaacauaauuccaccucuaacaacaaacauaaaaggaaguaacaaucacuuuuccuuaauaucucuuaacaucaauguacucaauuccccaauaaaaagacauagacuaaugaacuggauauguaaacaggacacaguauauaggaaacauacuucagugacaaauacagauacuaccucagaguaaaaggcuggaaaacaauuuuccaagagaaugguuccaagaaacaagcuauaguacccauuauaauaccaaauaaaauuuacuuuuaaccaaaaguuaucaaaaaagaugaggaaugacacuucuuacuugucaaagaaaauaucuaccaaggucaacucucaauucuaugguccaaaugcaagagcacccacauucauaaaagauacuuuacuaaagcccaaagcacauauugcacuacacacaacaauagugagagacuuuaacaacccacucucagcaauggacagaucauggaaacagaaacuaaacagagacacauugaaacuaacagaaguuaugaaccaaguggauuuaacagauaucuacagaacacuucauccuaaaacaaaagaauauaccuucuucucaccaccucauggaccuucuccgaaauuggccauauaaucuaucacaaaacaggucucaacggauacaagaagauuggaauaaucccacacaugcuaucugaucaucauggaauauggcuggucgucaagaaugacagaaacaauggaaagcccucauacacguggcaacugaacauucuacuuacugauaacuuggucaaggaagaaauaaagaaagaaauuaaagacuuuuuaaaauuuaaugaaaacauaagcacaucauaccaaaaaguaugggacaaaaugaaagcagugcuaaguggaaaacguauagcucuaaaugccuacaaaauguaacuagaaagagcauacacuagcagcuugacagcacaccugaaaacucuagaacaaaaagaagcaaauuaacccaagaggaguagaaggcaggaaauaaccaaaaucaggacugaaauaaaccaaguagaaacaaaaagaacuauacaaagaaucaaccaaaccaggagcugguucuuugagaaaaucaagauaggaaacccuuugccagacuaaucagaaggcagagagacaguauccaaauuaauaaauucagaacugaaaaggcaggcauaacaacagaaauggaggaaauuaaaaaaaucaucugauacuacuacaaaugccuguucucaauaaaacuggaaaaucuggaugaaauggacaauuuucuagacagacaccaugugcuaaaguuaaaucuggaucagauaacccaucugaacaaucucauaaccccuaaagaaguagcagcagucauuaaaauuuucccaacccaaauaaaacccaggaucagauggauuuaguacagaauucuaucugaccuguaaauaacaccuaauaccugagcuggcauuuggguucucuuagggucuguaugacaucuguccaggaucuucuggcuuucauagucucuggugagaagucaguaguaauucuuacaggucugccuuuauauguuacuugaccuuuuucccuuacugccuuuaauauucugucuuuauucaguucauuucuuguucugauuauuaugugucgggaggaauuuauuuucuggcccaauguguuuggaguucuguaggcuucuuguaugcucacgggcaucucuuucucuuaaguaugggaauuuuucuucuauaauuuuguugaagauauuugcuggcccuuuaaguugaaaaucauucucaucuauaccuauuuuccauagguuuggucuucucguuguguccuggauuuccuggaugguuugaguuaggaucuuuuugaauuuugcauuuucuuuuauuguuguguccauguucccuauggaaucuucugcaccugagauucugucuuccauuucuuguauucuguugcuaaugguuccugauuucuuuccuaggguuucuaucuccagaguugucucccuuuggguuuucuuuauuguuucuacuuccauuuuuaguucuuagaugguuuuguucaauuccaccaccuguuugguuguauuuuccucuaauuuuuuaagagauuuuuguguuuucucguuaaggacuucuaccuguuuagcaguguuuuccugaaauucuuugagggauuuuugugcuuccucuuuaaggucuucuaccuguucaguaguguucuccuguauuucuuuaagugaauuauuaaugcccuucuuuaaaucaucuaccagcaucaugagauaugauuuuuaaaucagaaucuugcuuuuuggguguguugggguauccagaacucgcuguggugggaguacuggguuaugaugaugccgaguggucuuuguuucuguuaguaaguauccuacauuugccuuuugauaucugguaaucucugguguuauauguucuagcuaccucaggcuggagcuuguuacuccccugauucuguuugccuuugucagcucuccuggaaguccaacucucucuugagucccaguggucagagcacucuuggcaggcaagcucuccucuugcagggaagguguacagaggucuggagcucagcucuaccuccuggcugaagaugaaugucagaagggaaccuguucaagaagcucucuugcuucugcagcccacauuguuucugcucacaaucuucccaaaccaucuuuugcaguacuagcuuaaaugauaugcuacuagacuuggcaaaagugugcauuuuggcaguuucauacuauggcucauuugaggcuaucccaugcuaaugcuuuauucaauuucaguuuauaguucucagguuccuuuaaguauauacccuucuccccuacaaacauuuuaguuccucucaaauuauuuugccuccuuuaguccuacauguguuuuuauguacaugugguaugaggacuuguuuguguccugugcauguguguaugaagcccagaagucaacuucuuuuuuuaaaacuuuuuaaauauuauggucuucauugaacguaaaucuccccauuucagcuagaguacuugcugggaucucucucacuaguucuccccaguauuggggcuuaccaugccuaguuuuacuggguccaggugucuuuuacugucuauuguaaugcuaagugugcccccagcaaccuuagccccugugacccugccccguuauuuuugauuggugaauaaagaugccaacaaccaauagcucagcagaaaagacaggugggguuggaggaagauaaaggagaaagaggaggggagaggaagaggaagaagggggaggaggaggagaagaggaagaguagaagcgggaggacaagaaggaagaagggagaagaaggaggagaagaagaagaaggcaaaggcaguggcaagaagagaaagaacacgccaacauggguuaggaauaaagaaaagauagcccugugugcuggaugauugagguuaagagcagcccagaugacacaguaaauaauaaguaacaauucagguuuauugauaugaaaguaaauucuaauaacauagaggauagguauuugccuacauagugagcuggggucacuaugggcucauagugaguuagggcucaucauaacuauuaagccuguuugugcuuuucacucuggaacuuaaauagacuaaggugagguugaaaccucgaaaccucgaaaccucgaaaccucgaaaccucgagcugggaauuaaagaauuucaacaauaucuaggagaccugaacucaagcccucaugcugugacaacacuugaaccuuuuuccauccucaguuuuaucucccaagucuguccuuccccuagccccaucaugaccucugcccuuucucuaauggcuuggccauuuguuguuuccuaccauaaauagugguucuugguaaaucagaaugcucaauuaaaauggaucuacuuuuuauuuuauuuaguuaauuaguuuaguuuaaauauaucccauguacuguuugggauauacgcuaagaaauguuuguuguuuucagaaauucauauuuauccagacaugcuuuauuuguauauaugagucuauuaauccuaugaauaccagcuuauuuauuaaaaauguucuuuucaaagcagcauauuuugaccuucaggaccaguaggugaguaaaagaagauguuaauuccuaccugaggccuugcuuugacuaacuugaaaaugccugcuagucaguacaagagccuugacaacacagagggguuucugagauuuuaaggcaugaaaugggggcaucagccucaauuuaggagaucacaugacaaauguaaggaaucugugugucauccccagauguaggggauaccuauguacuggcuaguuuucugucaacuugacacagcugggguuaucacagagaaaggagcuucaguuggggaaaugccuccaugagauccaacucuaaggcauuuucucaauuagugaucaagggggaaaggccccuugugggugggaccaucucugggcugguagucuuggguucuauaagagagcaggcugagcaagccaggggaggcaagccaguaaagaacaucccucuauggccucugcaucagcuccugcucccugaccugcuugaguuccaguccugacuuccuguggugaugaacagcaguauggaaguguaagccaaauaaacccuuuccuccccaagugcuucuuggucaugauguuugugcaggaauagaaacccugacuaagacaaccuaugagaucguuauucacaugcuuuacaucuuaccccaaacauagaaaagucuuaccuuccuugcauaagucccaaucauguggcuuucucugaacacagcaggaagucugccuugaagaauguaugccuaagagacuaugagaacacagcuaugagaguuaaggauuauaucaggccauuuuaugaaucacaaaaauugguauuuuugugaagcucaaaccaugaugcugaagaaauaagccaaaagagggaugauuuuaucugucagcuaaggucuccuaaccuauauaugcagauacacuacucagaucuccuuucucugagauggauuuaauuuauauauaaggaguuugaaaagggacuuaucuuaguuuuuccuuuuuacuuucuuuuugugucuucucuacuccgaaacagaaauaaaacaaacaaacaagaaaaccagguucgccauggcucugcauagcaacagugaagugaaggcuggucaugguauggucacugcuccauucagucauguuucuuaagaaacuuacagauguggucaucaugauaucugaaugucuucuguaagcuuagaggacuuuggauuguagguccuagggauauagcugugaaugggccagacacgaucuaugcucuguggaguuaaugcucugcuauacuuuuuagagaagucagggagaaggaaguuccagccucugggaccuccuuaggguuccuuacuaugcucuuuacuucuguaucuaucagagaaagucugcucuuggccagaguucgguucuggguacccggcaggaaucuacacaguuugaaaaguucaucagacuuuagguauuucagucuaauucaacagcagccaaauuuaguaaaaccauuuaucuaccaauuuaucucuuuaugaaauaaugaaggcaugaucuagcacgugcuauaaugucuucuuauaaaauuggugacacaugcccaugagccuaauaauuaguaguaaaggcccggacuagguuacuagcaagaauuugcagaaagacgaagggagagagggagucagcuggucuccuuauuggugcuuuaccagaccuuugugggauccuauugugaaaaguaguagggcuugauuuaucuuaaugacuaaaaucaauuuuuagaagaauagggagauuauacuguauuagcaagauuuauagcuuuucucugcaccaaaagaauuuauaaauauuaugggagggaauagaaggcaaagaagaaagaaagcuauugauuuugcaaguccacuuucauguuuuuaagacaaugguugggggagcuuccuucuucugaagccacuugagaucugaaaucuuacauuuguagaccaugacacuucuugaguugcuugaggucccuagucugaaguucagagaauucuaugucuucauauccagagcuauuucuaauucucagaaauaguuugaaaauagcauacuuaagaaacaacuggaaaaaaaaagagaaacgacugaacaugguacaaacauucuguggguguggaggcuccaucagagaacauggcaguccagggauaauaagaguagaaagacugcaugcaagucagagcaaaguuaguaaccuucucuuugacagguucuuacuuuggacgauuguuauuauuuuauuggguuuaaacacuaguguaaugagcccuguauauuauguuggugucacuggauaaugagugaaauauagauaauuuuuuccauuccuuaggagacuaugcacuuagagccgucagcuuccuuucuuuuacaaaagaacccugacuucgggccuaauugguuucugaacauuuagaaguacuguguaucauacaaaaacucuuacuucuuguaggauguguuauauggaaaguuaaauuauauguuauauauuaugcucaggcuguaggcauuguuguuacucaaucagcgauagacuuguggggcaagguuuacacaguaaaaccugguuuaccuaagggucuccucaccaggggaaccauaucuugggagacagacuaaccccuacauuucauucccaaaagucuauuucagaccauauaacaaaacagguacagaaauguaccaaaacugcaggugcaguuguuuuaaaacaaguauuuaguaaauauuucaaaccaaagauacuacagguaaaaagauauuugcuauaaauuuuacuguuuaauuuuuuuuucuuauuagcauaaauugacugaagcuuaugauuucaauguaaaaaucucccuaaaacacaugaaggguuuuucuuuuucguuauuuaaaaauucuucaaaauguguuaauuuuuuaauauaggguuauuugccucgaagucuacaguauaaaaauugauagacaugaguucagaaauugcuaaaaguugaaggggcaguuuccauggcaacuucuucagucacccauaccuuuauguuuuagaagaaucugcauugcugagcuaugaauacaauauuaaggauucaaucaaaucuuugccaugcaaagagcaauugcuagagagauacauuugccuuaaucaucauuuaaacaaacaaacaaacaaacaaacacccaaaccaaauccaucccccaccccccacccccacacacacauauacaaguccacaugucuucucaucugggucagcccugcuagggugcugaccaagacauuauuuguaaacaguaaccuuaaagggauaauggcgaauucuauaggaggcaguuacaauauaagcuauguuuauuucauccugguuugaaauguuaaaauaaacauuuuaaacuguuuauuugaaaauacuccaugugcuccccaaaguaaacaaaugauuaauuuuggucaaaagauaguucauacuguagucauuuucugauuuucccuuuugaguguaagaagacaaaucaauaccuguuaccaucuugccaauaccuaguggcaaacauggaauuuugucuaauguaacaugaaucauuggagucuuggcagaaaugacauuaaagaaggucuuuuaucucccauguuuucaaagaugaaacacaucucagcaugggagagaugacauuaaaguacuuucuucaaacacauuugagugcuuuucuucuaaacuagauuugugcuugugagauugcacacaugguaaaguccuuauauguuuguggauucacagucuagugacuuauuacccuguugaauuugaaacuuuaaaaauuuauauuagaauuggaaaagcaacauugauucugggcuuuuugcuaauacuuaaauaaaugaccauauauuaaggauagcugaugcuuguccagcacuguacugcaggaagcaaaagaaauguaagaaaggauccugauccauuaaagaugucugguuucuuuccugaugcuucauugaaguuuuuaaagaaagauaaaaugcaauuuuauguuuuaucuuaaauccugucuccuuucauuuucccuuaaaauaccccccccaaaaaaaaccaagcaagcaaacaaacaaacaaacuucgguuaaauauccuugucaccauuuauacuauaaauguuaucaacuuuauaaccuuuacuggucauuccuuaaaucuaagcaucaguuuuuaaaggugucauuucuggaacaagguauaguuuacccuuauucuacucucagagcaucauaugauauaacuaagugaaaguaguucugaccaaugaguuuggaugggaaaaauagaccauauugcuacaagauauacuuuuaaaauugguccauuacacuuaagaccacugagauaauuauaucaagugcccaagaaguuccaauaacuacuaagaaaaggaaacaaaauguaauucugcuauggaaguuggauauuguuuauaauuaugcuuuuagauccuguuauguucuaaugagaaucucucccauagguugcugucacuguuuggagaggcuuaggagugguauggcuagaggaagcauaccaccagaguuuggcuuugagguuucaaagccucuugccaucccaguuugggauucaagaugugucccucagcuucuguuccagucaccuugccugccuacggccaugcuucucugaucgugauggacauuuucugucuggaacuaggagcccaaauaaguucuuucaucuauaaguugccuuagaaggggauucuuaucacauuaauagaaagguaacugauaacagacccauauucagaaucuuaugaugguccaaaaggauaaaagaaccucuuagaccccagucuuucagucaagcauaaguguucagacacuuucaaucagggguuagcuaaauucaccugccucauugggggggucauuucuguggagaccaugcuacucugccaccuccaaacagaccucuguggguuaucaaaaccaggacuucaaaaagggcuaguacucuuuaucuuuccagcagggauuuuucucuuucuagaugaagaguugugcccacaagcugucagugaaggaagucuuaacagcaguacuggaguggaugcauucaaacagaagcugggaaaagcaaagcacuuuuccagaaaagucucaguucacgccucaggccaaggggauuaaguucuccauuuugcuugauagaggaauuugaggacagccuuggggaaacauuuucuuaccugcuuuuuguuuuuugauuucuaacacaucucuguuucuacagcaaauaucaaaucuuuuauucaguacaaaaaaagaaacuagaagugccugucacauugaaugugaguguguuccauuucuguauuugaaguauaguuccuucauugauuccaaacacauuuaccauaguaaacaacaugugcugaacacagaguggacaagcuaugcaccacuaauccaaaaguggaaaggcuauguguaauggugugugccucuaaucuuagaauagaagagcuaguugugguggugccacuaaccccagaccucaggaguuugaagcaugaauauuuugaguuaauggauauucagugaggccuugacucaaaaaauguuuuuauuuuuuuuuaaagaaaagaaaaauugacuuucacuacuacugagguaaaauucaagaacauuaugauaauugaaagaaacuggaaagagaaagccccaaacuuacucugaaugacuagaacaguuaccuuuauagaaauagaaacaacaaugggugcugcaaugcuuaggagauagaaacagaagguuaauguuugguuuaugaaugucaaugucgcaagaugaggaaaguugguagagucuauuugcacuguuacacaguuauuuguauaaugaucugcauuggacguuuguguuuuguuugauguucuccaguaguuggcauaaaaguuuccuagaauugacagggcucacaaaugaaugacagguaaguuuauagugcugugggaaccaggacacaggauaggucauacucaaggaaacacugauucucagacauaaccuggcugcgaaaagaacugugaagcucucuuugugacucauuuuuuuauugacuccugcuuauagcaugcagagcugcuaagaaggaugcagcauccugucaacaagcuucuccauucacuggcaugccuucuguucuuuuccaaauccagcacucccguuccaucuuggugcgcucuuuuacuucucuuauuucuucugcauguaucuuucauuuuacaauccacaucauuuuccaucacagaaucuaaauucaaagagaauaugggcucugaaauuugacuuuagcagcauccagcacagcagaccguauguaaugaguguuuuggguuggggaaagcucugaaguuggaagcugaaauggcuaaugccuauacaauagaagguuauuaaugucucuucagugguggccugguuuuuauagcagagaaugaauaaacacccaagauuuuuguuuuuguuuuguuuuguuuuguuuuguuuuguuuuguuuuguuuuguuuuguacugguccuaaacaauccugucacauuauuucucugcauaucugucuuaguauucuagagagaucagaagugggacaggugaccuccacugagaacucaaggguguacagguccugcuugggauuucaaggugaauccauggcuuaacuaaaucuauuuauuaaauaauuucuucucuucuucagugcagaacauuuuuuuucuacacagaauaauagugagaacggugaccauauuccucauuugucuuucuuauauuucuccuacauggcugugugaacuucccaagggccagagcuuccucauucaucgugauaugccugcuguacuuugcucagagcagcagcagcccuaggaaauucuguagcuuuuuaaaaaauuuacuuaguauaugaaugggcuuagagauaauuauacccacuuacaauagaugaagcaauuguagauuuuuaaagcacaugaauguuauagacaaccucauuuaguauaauuaucaucugguuuauagauaauuaaggaacauaauuguauauuuuuuacaguuuguuauuaugcauuauuugaaggcugcccugcauuuuaugggccuaucacuucaugaugucacauaagugaucuggggaggggcagaggugcaugccuucuuuaaguucacugagcugucgacuguuaccaguauauccugaugggcuaaguuggcuagcuuggcugcuuugacuccugcauuagcuaagagauagguuuuacuauuucaacucuucucugccuaggaaacaguucugggaauauuuuaguuuuuuuguuguuguuguuguuuguuuuguuuuguuuuguuuuguuuuuuguuauuguuuuaaauaaauguuugauagucaagucauuggugucuugugagaguucuguuuacguauauuguuucuugaauucugauuuuucacacacacaaaaucacugccaguucucugaauuuuacagcucuuagccuauuccaugacugauaauuuugacaauuucucccuuuuccccucccuacugaagucauucugaugucagaauucagacaaaacuuaaaugagagagaaacaagacuagaaacuguauccaggaauaaaggaguuugauguaggucauuugaaaaguguaagauauagacaaagagaggggagaugauucucuuacagcagugggagucaggaccaaguccaaggcaaggaugaauccauggcacuugaaaagacugugguaacagaagcauaaccauguuucaguggaauauugaucucuguagagcugcagaugcccuagaauccagugaacuauguaaucauccauaguccugcuuuuuucuacccugaaacucuguucaguguggacaaacucuguucuguucugggauuaguguaucuccugcgaucugcauugccaccaggcaccuaagugagcuuggaauguuggaaccacgcuuuaugaaaccaugccucagauggcagugccuacagcuugcaguguaguauucagauaagugcaguuuagugcuguacccuggagaccccaucagggaugcuaaggaacccucagaggcuguucauguaagagaguaacagcaagcagaaauucaagguagaacuuuucuagggcugaugguaugggcagaugagaacuguugagaaauuccaaaguguuuuuuguuuguuuguuuguuugguguugguguuuuguuuuguuuuguuuuucauuugucauucauugagauguuuucaaaaggcaagcuuuuaaauccguuccucugcaggucugguaauagagccucauagauacuccauauaauccaggacuagagauugaacuuggagggauauuuuaguugggaccaugaacccuaaauguacugaaggccacugaaccaauucccugaaauaguagaaugguacagauguuugcuuuguggagaagaugggccauagccuugacuacauccacaaacaugcccuuacuaagauuugucaaagcagacaaaggagucaugagaugugucuggggaaggcaaggcuggcugucuugcagaagacauuccauuugcuucucuguauggguugccgcaaucauuaacugggauagaaggaacaaaaagggcgguguuguguaguguguauaauaaauuuuucuguuccguaaggagcugugccauugguuuaggcugaaguacaaagggauagcaauuuuaacagugaggagcugaauuauaucagcuuugcagcugaaagauaaaagcugguauaugaaacaggaucuugugugaaugaguucuucaaguguuucaauaaagauucaucagagcaguuagcucucuaaccagguuacagucucuggcuucugauuccuuuguggaauuaaaaaugcuuuuaguaagaggagcuaaacaagccuuugguuuggauuucuauauauugauuuauggaccuggugagcauccugcugugaacuuccucugccaaugguaaccaucacaauaagcaaagcuuuucugaacuggcacuuccacagacccuggagccugcuauauuaggugugacaguuuuuaaaaagcaacuguguuagaaugaaaacaggccacuucuaaauggucuauugauuugcaaaaccuuugugucagagugaauagucucauaucugaguugagaggagaugcugaccaguuucaauuuguuacuauagcuugaagcuuugagcugacaauguuucagugauggugcuugccaccuguggaaagucugcuugugucucaggcuucagucauacaugugaaaauccgauucauuauuucacacaagaaaagacuuuaacaguuccacuacagugugaaucucugugaauguggaucuagaaggccuuguuaugacucaagcucucccauaaacuuguagauccccguccccaccaaugcucugcauugggcuauugguggaaauuguuauguggcuugugucuuaggccaacauggauaguguucaaugaguucuccauaagaauuacaaaugggagaggauugauagacaguucaguggaacacuugcugcucuuccagaggaccugaguucaguucuugguaccuauguugggaacuucacaacuaccuguaacucuauuucuaggggaaccaauucugucuuguggccuccuguuuuaauauuguuccuggugagaucuaaauucuauuuuuuuagacccuuaauguccuuuuucuguuguggauuauacuuuccaauuauaaaauuagucaugauguuguaaugucugcugcaugacagauauccucccaaacaaggacugucaaggaaaaagacaguucucagaauuacaaauacuuucugcuguagauuauggugugauucauauugucagaggaguuguuuuucugugcucagccuugaguauguauuugacccauuuuucaaaacucauuuuaaccuauauuucaugucaucacugugguuuugccuuuuaguacaagguguagagguccauuagguggcugcagcugagccuaagucugagacugagacuacaaagucugagucuagcuguacuggcuaguuuugugucaacuugacacagcuggaguuaucacagagaaaggagcuucaguugaggaaaugccuccaugagauccaacuguaaggcauuuucucaauuagugaucaagggggaaaggccccuugugggugggaccaucucagggcugguagucuugguucuauaagaaagcaggcugagcaagccaggugaggcaagccaguaaagaacaucccuccauggccucugcaucagcuccugcuuccugaccugcuugaguuccaguccuggcuuccuuggugaugaacagcaguauggaaguguaagccgaauaaacccuuuccuccccaacuuguuucuuggucaugauguuugugcaggaauagaaacccugacuaagacacauugguaccaguggagugggguauuccugugacaaccugaccauguuuuggggaggacuguggaaggacuuuggaacuuugggcuugaagauccauccauuguuaagaccucugucggauguuguguaggagcuuggaagauaauguugagaacacugcagaaguuggagcucuggugugugaaauuucagagggaaaauuaaagacucuuuucagggccauuucuguuuugauugugaagauucuguaguucugguuagcuggggcugaagaaucagcugugauuaacaagauaccagaacuacuaaagcaaaaacuuugcauuacugggacuauugaugcugguuagcuggagcuaagaaauuagcggugauuaagaagagaccagcaucauugaggugacaucuucugggaaguauuuucugaaagcacaguggcuguguuccagauauagccaaaguuguaccuugugcuguggcuggacuugguaauguguaagggucacccaggugguacugguuuugaaggcaugaaggaguugagcagagcagcugaggcuuggcacugugagaggccauggaaggccauuggugaaagugcagccucaguugcaauugauggcccaggacugaaggggucaugcaguguuuuggagaugccaguaccaugagaugaccaccaagagcagcagcagcaguggaguacaggcaucuggagccuagaggaugacucgugugcuacaaagggccuggcuggagaagugacccaagcccuuggaggagcccagaagaucgugaguuggaucccagacauuggacaguuggagauugacuuuugcuuuugauugugacugugcccugauauuuucccucuugaaggaagaaacuguuuuaguggagcccacaguuaagagacuuuuaauuguaaaaagacuuuggauuuuaaaagagauggauauuuuaaagagauugaaauuuuaagcauauguaaagacugugggacuuuuaaaguuauuuagaauggggaugaauaagauuguaaggguugaggcuuacuagugauguuuuugugugucaaguugacaaggggucaauuguacuggcuaguuuugugucaacuugacacagcuggaguuaucacagagaaaggagcuucaguugaggaaaugccuccaugagauccaacuguaaggcauuuucucaauuagugaucaagggggaaaggccccuugugggugggaccaucucagggcugguagucuugguucuauaagaaagcaggcugagcaagccaggugaggcaagccaguaaagaacaucccuccauggccucugcaucagcuccugcuuccugaccugcuugaguuccaguccuggcuuccuuggugaugaacagcaguauggaaguguaagccgaauaaacccuuuccuccccaacuuguuucuuggucaugauguuugugcaggaauagaaaccccgacuaagacacuagcuuaaaacauaagagagaaaacuuacuugguaguacacucaaaagaaguguuuuuugcaguguugaaaguuguugacuuuacaggcuugaugucaaguaguacacagauauaugucuuugaaaguuuugagcccacauauuugucuauaugaaagcuuuggccccaacucuguauguggaacagggaagcugagcauaucugagcaagcauuuaauggaaaucacagcauauuauugcauuguacaaaauucccucacuaacaugcuaagcaaauugaacugaaaugugcccgagaaccucaucugucuuguauugcuauacaaauuguaucugucagaaauauuucuugagaagucuuaagugcaggaaucuaaauacaguauucaacagaacuccuuuguauuaaaaucgaggagucuucuucuuaggaaaacauuaaaaaagccauguuguuuaaaaaucgauuuugacuauuuacaaauuuucccuaucauuuuuccuccuccacauuuucugccuaccacgggccuuggcuuagagaaaacaagauaaaugguuuuuauuuuuuucuaacaugucugacuguugaaucagacacaaaggaaacaaacaaacaaaauagacucagaauggaauaccaaaauucuuaucauauagguagcccuggaaaaugaagucguaucuuugagaacucucuauagacuguuguaaaugcuacagcuugagaaaaaauugguggcugcacagcucugggagaaagggcucuaaagcagcugacagaugcauagaagcagcauccuccaccugauaggccaauaauuugaggaauucuugcuaauugcccauuuguuuccuuuauuuauuuaggguagcuucaccagacuuuuaccaugggaucucccaucaaagaaaauucaguuuuaacugacuuuguaccaguuucuggaacaauggcacaguauaguugcaucucuucaaaaaauuuuuuuauuuaucaagucaguauuaaguauuaagguauugagguuuuuuuaaauuucuuaugagcauauuuaaaauaugcuauuucugcugaaauguguuagugugugugccuuuuucacugacagauuggaaugcugcaaccuuucuagcucuucaguuuuaaguguugaaucagcaagcugggcuuggaaauuuacacuuggaauuucaguuucucucugguuuauauaguagucccaaauacacagguuccccaggcuaggaguggcucugcuuuucagaaaauaaaaacucaaaaagcuugucagagaucucauauuuauaaauaacuaugcuguuaaauauaaaaauuaaaaucaggauggaaacuagguaauugccccuagcucuuugaggcuuugagaguaauuauaauccaaaagcaugugcaggguguuuaguuauucucagagagagacaaaucacacucccaaauugaauggcuagugcuguuuuuuauuauccagguuuucaaagaugcugaagaaauaguggcuucaauauuccccaacagguacacgucacaugcucacugacaugaacugauuccuauauaaacaaggauacccagaguccuuaggaaauaacguaguaaguguuuccaauaacaaaccucugcuaucuaggcauguugagucagaaaaauuuuauaaguuuuaguugaaguauacuugcaguggcucuuagacaagugaagcagguuaaugguuccaaggccuucugugaguguucccccucagccuccuacacagggcucacccaugaauaacaaaggucaaguggcuucuacugauggcuguuccaagcuguuuucuagguuucagauuguuggcccuuguuuguuguuuguuuguuuguuuuguuuuguuuuuuauuuuguuuuuccugcagugucuauggucaugccuggugagaucugcagguuuuuccaggucaggaguuacuucaggagcaauuugccuccagcuucucuagugaucaacagaaguucccauuggcaacggcaaugugcagaaauaguagguuauuuucuccagggaaccuugccugguucaaguacugugacucuggagaagguuucuuggucucacaccuuccguagacagguagcuuagaugcaaaguucaugucacggcugccagggguuacaucacuuucuuucuggaaaccccuaugaaauaugacuggaagagagucuggucaugcuuacuaguuuccuagucaaagcacacaaguuuuggucugcauauguguguaguugcguacgugcugcaaccuuagcuaugauuccucaggagcucucuaccuugcuguuuuauucaagcauuucuacgaaccuggagcuuaucuagucauguagccuggcuggccaguaagccucaaggauucucccaccuuuacccccuagucccaagaacuacaaagcuaaccuuuuucccaugccacaucaugaaaugggccucuuccucagaggguagugacuaggaauaaucauuucucugugguguuuacuuuaugaaaacccaugcugucagcauccugugccugaaguuacugaacuuuuguagccaucuccuaagucaggcauaugaccaaucagucauucacauggaagaaaagcagggacacaacaauucaguuauuugaccaaguuuuggaacuggugggcccaggaaaaaucuaggcagcuguagauuccugaucuuacccaaucacaccucugucaccaagugcaagaugguugcagggucguuuguucagauucugauggacuuuuccagagauugagcuugccugucucuaaguguaggcaggucauuuuguaaacacuaggacaugauccaccaaaaaggcuucgcugggcagaccccaucuguacccugggcagucuccaggcucgcucugcuucagcuccuuuggguucaggagucauguucuguuguguuuauuuccauuuucauggaguauguuuucucagauuuccucuguccaaucuuuucuuccuccuuccuauuuucugaaacaagaucagccaguuucuuauugggcacgggguauggggcugcagggacccgauugacagagauucacaauuuacgcuuccucucaagagugugugaauaccuccugguuugcgcaaaacaucaaaccccguugaucugcaguagaauuagggucacaggaaugauggugcuauguucucuaagggcuuagccagaagcccugauuuauccaaauuguauucaagccaaugccucaccuuaaauuaaaauagguaugaaauacugauguuaguaucuaauaucaaaauauaacuuguuuuuauucugaacuccaucuugguacuguuauguccagaggccuagaguuuuguuuauccccauguuuugauauauuaaaguucuugaaucauaucucauguuauugaucuuagguaaggugucaaaaucaagagagcagcaagugguaucaugcuaccaugcuuuuggcugcauucugcccaaccacugagggaauggacuuuaggcagcuaugauuuaucaccaugaagccaguuugcacuuuaccuuaagaacaaagcaaagcaaagcaaaacaaaacaaaacaaaacaaaacaaaacaaaacaaaacaaaacgugcccuuuaagacagguuaaaugugucaaguugcuuaaaccaacaauccaaaucuauagacaaaugauacauuugagucugaaaaaucuaacuuuggacucccaucugacuuuguuuuuuaaugugaacaguugcauucaaaaucuuggaaaagaucaccaauuaaagcacaaaauaaaacuaagagaggaagugagccucucacuuauuaguucugugccccuuguaaggguuuauucugauuauaauuguaaaguuaccugcuuuguuucaaacuuugaaacugaaggggacauggauuugugggauuuguuucugucuggaagauuguggcauuuuuuauauuuugaaguccugauuuuguuuuguuuuguuuuguuuuguuuuuuugaacuguuuuuguucuguuuccuauuucuucuguuucuuguugauugccacuuuccauauaaagugaaguaacauuccuccugccauacuucccucaugucaggacauuuugaauguugaaauucccugcugucuaaaagcaucguuuuuguuuguuuguuuuuuguuuguuuuguuuguuuguuuguuuuauuggauauuuuuuuaaauuuacaauucaaaugucauccucuuuccugauuucccucccuccuggaaauauccuaucaauccucccucccucugauucuaugaggguguuccucuacccacccaccuacucccaccuaccacuccucgauuccccuacacuggggcaucucuuaaaccuucagaggaccaaggaccucaccucccauugaccaugcucugcuuuauaugaggcuggaaccguuuguacucauugguugauggcuuagucccugggaguucugggggcggggggggagucuucuuguugauauuuuuguucuuccuaugggguugagaaccccuucaguacuuucucuaaguuuucuauuggggacuccaagcucaauuaaucugauccagauuuaacuuugguaccugguaucugucaagaaaauuguucauuuaaucccaguuuucuauuuuuguugaguauaggcuuuuguaguaggaucugaugauuuuuuggauuuccucagauucuagucuuaugucuccuguuuaauuucuuauuuuguuaguuuggaugcugucccugugccuucuaguuagccuggaucaggguuuaaguauuuuguugauuuucucaaaaacugguuccugauuuugauuauuugucauauauuuucuuuguuucuacuuguuugauuucagccuugaguuugauuauuuccugcugucuacuccuccugggugaauuugcuuccuuuuguucuagagcuuucagguguguugucaagcugcuaguguaugcucucucuaguuucuuuuuggaagcacucagagcuaugaguuuuccucuuaggacagcuuucauuguguccuauaauuuugaguauguugugguuucauuuucauuaaacacuaaauagucuuuaauuucuuucuuuacuauccuugaccauguuaucauugacuaaacuguuguuuagcuuccauguguaugugggauuucuauuauuuauguuguuauugaagaucacucuuagucugugguguucugauaggaugccugggauuauuuuaaaaauuuuguaucuguucauuacuauuuugugacagauuacauggacaguuuuggacaaggugccaugacgugaugagaagaagguauauccuuuuguuuuaggauaaaauguucuauagauaucuguuaaauccauuugguuaacaacuucaauuaguuuuaccgugucuuuguuuaguuuuuguuuccaugaucuguucauuguugagagugggauguugaagucucccacuauuauuaugugugguacaguguguccuuugagguuuaguaaaguuccuuuuaugaauaugagugcccucacauuuggaacauagauguucaguacugagaguucauuuugggagauuuuuuuccuaugaugaguaugaaguauccuuccucaccuuuuuugauaacuuuucauugaaauuugauuuuacuuaacauaagaauagcuauuccagcauguuucuucagaccauuugcuuggaaaauuguauuccaaccuuugacucugagguagugucugucuuugucacugaaguggguuucuuguaugcagcaacauguuggguccuguuaugcagccagguuauguguuuuuauuggggaauugaguccauugauauuaagagauauaaaggaaaauuaacuguugcuuccuguuauuuuuguuguaagaguagagauucuguuuuugugguuaucuucuuuuagguuuguugaaagguuacuuucuugcuuuuucuugagcauaguuuccuuccuuguauuggaguuuucccuuuauuaucuuuugaagggcuagauucaugaaaagauauugugugaauuugguuuugucaugcaauacuuugguuucuccaucuauaguaauugagaguuuugcuggguacaguagccugggcuggcauuuauauucucuuauggucuguccaggaucuucuggcuuucauagucucuggugagaagucugcuguaauccuaaaaggucugcccuuauauguuacuugaccuuuuucccuuacggguuuuuauauucuuucuuuguuuugugcauuugguguuuagauuauuauguguugagagaaauuucuuuucugguccaaacuauuuugaguucuguaggcuucuuguauguucauaggcaucucuuucuuuaggguagggaaguuuucuucuacaauuuuguugaacauacuuauuggcccuuuaaguuuaacaucuucauucucaucacuaccuauuauacuuaguuuuggucuucucauuauguucuggauuuccuggauguuuugagucaggaucuuuugcacuuugcauuuuuauggauuguugaaccaauguuuucuauggaaucuucugcaccugagauucucuuuucuaucucuuguauucuguuguugaugcuugcaucuaugacuccugauuucuuuccuagguuuccuaucucuagaguuauuuccauuugugauuucuuuauuguuucuauuuccauuuuuauauucuggauggauuuguucaauuccuucaccuguuugauuguguuuuccucuaauucuugaagggauuuuuguguuuccucuuuaagagcuucugccuguuuaccuguauucccuuguaauucuuuaagggguuuuguuuguuuguuuguuucaucuuuaagggcuucuaccuguuuauuuguguucucuuguauuuuuuguuuguuuguuuguuuuaagauuuuuuucucuccuguauuucuuuaagggaguaauuaauguccuuccuaaaauccuguaccagcaucaugagauaugauuuuaaaucugaaucuugcuuaucugguguguugggguauccaggacuuguuguggugggauuacuugauucugaugaugccacguaguuuugguuucuguugguaagauucuuguguuugccuuuugccaucuguuagucuccgguguuagauguccuugcugucuuuggcuggagcuuguuccuccuguaagucuguacgccugugucagcacucuugggagaucaacucucucauaguaagaccugugcacagagggcuugggaauagccccaccuccuggguguagauguaggcccuuaggagccuuggcagcuucugggaucugugcacuccugaguggacccgccuuagggagucaccagagagaaauaucuccugaguccugcuucuauuccuuucaggguuaugggucuguuuagauggguuuacaugauccuguuuuaacuuuggcaccuuguaugugucuaggaaauuguccauuucauccagauuuuucaauuuaguuuuguauaagcauuuguaguaggaucugaugaguuuuugaauuucugugauuucugucauuuaugucucccauuucauuucugauuuuauuaugugaauacugucucugugccuucugguuagucuggcuaaggguuuuucuaucuuguugauuuuucuuaaagaaccaacuccuaguuuuguucauuuuuuuguauaguucuuuuuguuucuauuugguuuauuucagcccugaguucgauuauuuccugcugucuacuccucuugggucuguuuacuucuuuuuguucuagagcuuuuaggugugcuguuaaacugcuaguguaagcucuuaccaguuucuuuucagaggcacuuggagcuaugaguuuucuucuuaccacugcuuucauuguguuccauaaguguugguaugauguguuuucauuuucauuaaauucuaaaaagucuuuaauuuuuuucuuuauuucuuccuugaccaaauuaucauugagcagagaguuguucagauuccaugcauauguaagcuuucuguuguuuuuguuguuauuguagaucagccuuagucugugaugaucugauaggguggaugggauuauuucaaucuucuuguaucuguugaggccuauuuuguggauuauuauauggucaauuucugaggagguaccaugagaugcugagaagaaaauuuauucuuuugcuuuagaaugaaguauucuauaaguaucuuuuagguccauuugguacauaacuucuguuaguuucaguguaccucuguucuguuuccaggaucugugcacugcugagauugggguguuaaagucucccacuauuauuaugugggaugugauuugugcuuugggcucuaguaaaguuucuuuaugaaugugguuucccuugcauuuggaacccagauguucagaauugagaauucaucuugguagauuuuuuccuuugaugaguaugaagugccccuccuugccuuuuuugauaacuuuugguuggaaauugaguuuauuucauauuagaauggcuacuccagcuuguuucuucagaccauuugcuuggaaaauuguuuugcagccuuuuacucugagguagugucugucuuugucccugaggugcguuuccuguauguagcaaaaugcugguuccuguuuaccuauccagucucuuagucuaugacuuuuuauugaagaacugaguccacugauguuaagagauauuaaugaaaagugauuauugcuuccuguuauuuuuguuauuagaguggaauuauguuuguauggcaaucuucuuuuagguuuuuugaaagauugcuuucuugcuuuuucugggguguaguuucucuccuuguguugguguuuucuaucuauuauccuuuguagggcuggauucauggagaaaacaaacaaacaaacaaaacccaccaccaccauaaccaacaaaagaaaccucuuuuuagggcugauuuaugccagucuuuguugaagugguacaaaucugaccauugguuacucagaauccugcacaaaacuguaccagaagugguaaauugaaauaugcauuaccuccuauucuucacuaccccacagacucuauguccauaaaugugcuguggacuugagagaugauuucugugucucucucuacauguuaggggaggacauuugcuuacuuagucaugggcuucuuguggcugcucucugucauuacagaucaacagauaauaguuaucaucuaguuuccaaucuguagucuuguguucuggagauaguuuugccaggcaguauaagcuccuugguaauucguucaguuuccaagagaauacagucuuguagcuccauggcuuggaaguuauacccaguaauagaggcagauguccucacaagcacugaugggaagauuuuaugcuuuaguuuuguugagaguaagguuuaaggauggaaccaagagugagagaaagagaguggcagugacucggaggaucagguuauacuaguguuuauucguaaacaacaauaaaacaaauagaaagugggaucacauuuauucacacacucacuucacucaccuccaaucuggcauaugucauagccaggcuccaaugacugugcaggcaaggacugcaacauuucauacugugcuuuggcucuaugauggagcuuuguuccagaguuggggugucuggaaucagugggcuggucccaaggaugagcuggucuuaacuugaagagucucugucgggacccaggaucuggaaaaguugcaguugccagaucaggauuuuuaagucucuuucagcucagaaauucagcauuauuuuaucugacacuggcccuuaucaccuucauucacacauuccaggcuuggguuccaugguaacauuuuagccauugagccuaaaauugaggcguucacuuagucauugcauuuaccuuaucacauuucacauacacacucacuaauuacaauaguuacacagauguaaacuuguuuugaaaugggaugucuguuuugauuucaugugguagagauaggauguauuuuccaguuaauaaaaaaaaagucuccauaguguuagagaugaaaauuuuauuagcaguggucaaguucaaugucuuguuuuaugagugaauacacuuaaaucuugauaaacacagccauugaugaagccauccugauaugauuucuuugauucagaagguacuucagaaccucagaggaucaucauacugaaaagaauuuucuuguuugucuacaucauagaagugaauuuagguugagucuuagcuuuauagaguaaggcuucugauaaauaguguuuggcaucuguaguccuaacaugguaugcauauauagucuuuuacaguacaaaccaagaaggaccuaugaggugagggagcagaaagccaaaacucugggaggccagcaacagguucaucaaugagugcugugaugaguguggugggguguuguuuugucaugccacccauuagacccagaaacacugaguaccuuccaaagcaggagaaacaccagguuagaaaggcugcaacagugacugccauggauaaauggaacauuuagaauucagcuccacuucucuuggggccagggaaaguuuaagacacagggagaggcaguagaguagcuugugaaacugagaacuguuugcuuuguuuuuuaauguucuuuuuuuuuauuagauauuuucuuuauuuacauuucaaauguuaucuccuuucuuguuuccccuccgaaaaaccacuauucccugccccccccccccccccgauucccagcccauccacucccauucccagcccauccacucccauucccaguucuggccuuccccuauacuggggcauagaaccuucagaggaccuagggccucuccucccauugaugaccaacuaggccauccucagcuacauauacagcuagagccacaugucccaccauguguuuucuuugauuggugguuuaguuccaaggagcugugggaguucugguuagaucauauugauguuccuccuauggggcuucagaccccuuaagcuacuuggauacuuucucuaguuccuucauuggggaccuaugcuccauccagaggaugauugugagcauccacuucuguauuugccaggcacuggcaaagacccucaggagacaguuauaucagguuccugucugcaggcucuuguuggcaucugccauaaugucuggguuuggugguuguuuaugggauggauccccaaguggggcagucucuguauggucauuccuucaaacucugcucugaacuuugucucuguaacuccuuccauggguauuuuguucacccuucuaagaaggauucugagcuucugggcuaauauucacuuaucagugaguguauaucauguguguucuuuugugauuggguuaucucacucaacuugauauccuccagauccaucgauuugccuaagaaguuuacaaacucauuguuuuuaauaucuuccauggguauuuuguucccuguucuaaggaggaaugaaguauccacauguuggucuucguuuuucuugauuuucuuguguuuuucaaauuguaucuuggguauucuaaguuucugggcuaauauacacuuaucagugagugcauaucaagugacuucuuuugugauuggguuaccucacucaggaugauaucuuccagauccaucuauuugccuaagaauuucauaaauucauugcuuuucauagcugaguaguacuccauuguguaaaugcaccacauuuucuguauccauuccucuguugagggacaucuggguucuuuccagcuucuggcuauucuaaauaaggcugcuaugaacacaguggagcauguguccuuauugaauucagugaucucucagcagagcauuagaaucacauuuggugcauaggacaguagauaugccucauggcuuacgggucuugaguagacuucuguccugccucuuacacaauuguuuuaggugcacaaacauggcuaggacgugaggcacuuagccucaucaguuguuguugauaaccagugccugcucuaccaccucugggcuuaaagagaauuagcugguaugaugggggagaguuacaggguuaaguugcagauggagacacaagcugaucaugauuguugcucuugauugcagaauuuacccuggcuucuuugacagucuccuaugaaaugggaacuggucauuuaaaugcacagguucaugaagaauuuugggguggacuuucauauaauauuggacucagcacauaaacccucuccuggcuuuuagguauuucuggacuauuuaagagcauuuaauuaaccccagugcuguaaaauuauaaaacucuguguguguguguguguguguguguguguguuucauucauuaggaugauaaggaguguggugcaaugguuuucacaugcucugcucacauauuugggaaaauaauaaaugugaaucauaggagaaauuaauuguauauaauacgcuuuacacacacacacacacacacacacacacaccauacauacacaugcacauaauagcucucaugccuacuaaauuuuuguaauguauuaauagcaaacaugcauacuacuuauuuuuuuugcugguauuuuugaaaacaccaggucuauuuuuuuuuacuuaacuuuuaauuaaaaaaaaaaacaaacuuuuuuucaucauuuucagcauuucuguuuagggaaaauaugauucucucucucucucucucucucucucuguguguguguguguguguguguguguucaaauauuauccauaguuuucaaagcucacaugugagaguuuaucaguaagcucucagggcuauaauauuuuuauccaaauguaaucaagaacugaaaugaagaauuuuguuagcaagaagacagugaugauuuaccaguuaucuauggugugaagagaaaauguuguuuucuuuuaggucuuacacauuaccaucuucugccuacuuuuagcugauaaaaaaauucacaggaguaauuuccucaccucaaguauguuuucacaaacucauuuuuauuacuaaagccuuauuccucacuuugugagaauuggagcucuuggacugaacguccaaaacucucccacacuauucaauguauugugugccugugauucuuguaacuacucuagaagguaguuagugguauagccuuauguuuuagaaaaacaaaaaccaaaaaacccuacauauugcugcucucaacuccuggucagguauggcucacagggaagcugaaugucuuccccuguguguucccuauucaggcagaauuccugguuucuaguguuccucaugcuuggagugaagugguaaaauguaauuuuagcgucagugaacuuccauguuugccucaaucuuguucgcugugucuuuaaaaaguuguaugaaaacugaggcucauuaacucaaggccuccaacagaaguucuuauagcaauuauccuuauaauauaucuucuagaggugaaaauguucuguaauaaauucagugucagguugacacuauuggucaaccugaagaucagguuuaaaugagaaaaauauuugaaugaaugccuuuuuuacuuuacugugggaacuaaaagggggauauagggaaagaugggggagggaggacagcccacauccgucuagaguuccuccuauggucugggcagguggacacgggagggcugccagacgcuuuccacuuagcccugggugggcauguaagccacugaccccacucgacagggggauggacaaggggcagcccccaacuggggacccuggagcaacacccuguagcuccaggguuaugggagaaagggcugaggaagagagguucacacgcaagcgagaguaagugcagugggccuugacuggagcacaagaaggccuuccaucagcagauuagaaacagcccauuaggagaaagccuauuucaucauccaagugcagcgggccuugaugaacagagacagucuaugguuuuagagcuuuauuauagaaaggcagggggaaagagagaagguggaaagacagagagagagaccagccauugccaagaggagagaaggggcaaaaagagagagagaagaaaggguagagauuaaaaaagagagugagaggagaacaugagaagagaggagaggagagugagaggagagaggagaguaaggggaguaagaggaguaagagcaagagagugagguggggccaagcagcccuucuuauguuaugcuguuaucuuuacuguugcuagguaacuggggaggagucuagccugaaggucagaagcuugggacaaugccuacaugacuacuagccaugccuuuccuguguggacugaaggggcgguaacuucgacaggauccaggguuccaggagacaugggggaacuccuuccaucccacguaggugaauuaucaccacaggguccuggggcuccacaccucaacuugacuggagaccagacuaucuccaguguauagcccaaugccccacaguuuaccugucagauguaaccugucauagagccuaagaaacugcccugguaaaggccagagaccaucugugauuguuauauagguccuggucuauaugggucaaucacuugcuuaucaaaaagaaugucagaucagaugcaagaaagcgugaugagcaaggaaagugauuggccaucagggaaugaaaaguuucacaggcugauacuuggauuguaguuguagaguguucuuucacauccauucacccuuccuucuugcuguguccucagucuagguauccuuuccuucaugagauuacuugccuguuuuucauucaccuaaguuaauucuucuuugauauucuuauguauaauauaauaucuuccuccugauccuacauagcucuugucugucugucuaugugacuauaagcugagagcaagggcuacauagacauggugauucacacuuaccaaggauuaaguaccuguuaaauaaauuaaaaugaggccauaaaaaucauaguauaauugugcccuaauuguaauaaaucucugcccuaauuguagauaauacuuauugaaugcuuucuauguguuaaaugcuacacaaaucuuccaguagguauuaauucacuuauuuuuucccaacaacucauacaguagguaugcacuuuuauuguucuauuuuuugaaaguagagaagugaaauugagugucaccucaauaguugucuuuuuugcuucuugccucuagcuuauccugaugggcuucuucaggugguuuuuagaggcaauagagcuaggcuaguagaagggcauaggagucaagaaaagauuaaacaugagugccuuccaaggagggaguucuggcauuagguggauaaaaggaaauaucaccugaacaagucaccccuggaauagcaauaguaaaacauauuacugggauuucuuaaucagcauaucuggggcacuuacaaacugccaggcauuguccaaagugccuuuacauuuuaauugauuuaauguuuuugaaagcccuaggugguaaccccuaaugacucucauuucuauucuaugaggacccugaguuucagggagguccuguagcucacagaagacaaacuuggguguuucacugauagguuuuuaaaaauccugcccuaaggucgcacuugauuuuucuguucuaaggagauggaugugggguuaugaaaaacaaugucucaaaugauauuucuguucagauauuauaagaucauuuuugcauuuggagucagauuuuuuucuauucguuuucuccccccacccccgacgccaauuaauuaauuaauuuauucauuuuuccucccagucacaguaucccccaucuccuccuaaguucuccccucauaugggccuuccacaccuccccuucaccugugagaagggagagauuacuccuaccuggcuacuaacccacccuggcaccucuagucagugcaaaacuagguacauccucucucacugaggacaaaaagacaauccauuuagaggaacaggauccacagacaggcaacagauucagagacaguccccacuccaauuguuggggaaccugugugaagaccacauugcacaucuacuauauaugugcagggguggggcacuaaauacaguccuucuauguucuuugguuggugaccuagccucugggagcccccaaggguccaaauuaguugacucuguugguuuucuucuggcauccuuauccccucuggguccaucaguucuucccccaacucuuccauaagacuccccuagcuucauccaauguuuggcuguggaucucugcaucuguuuugguuaguugcugggcagagacucucagaagacaguugugcuaggcuccugucugcaagcauaacagagaaucauuaaugguuuuagggauuauuaggcucucaaguugagccacucauugguuagucauucccccagucuuuguuccagcuuuguccccaguacagguuuuuacuggcuucacauuggguucucuucccccauaucucccguguugauuugcauuuggaaguggccagagggcuucaagaaccgaacuacuuaaggugaaaaaauaauucuuugccaaguauuauuuccaaguuuuauugcaguaacuccuguuggcuuguaccacugccacaauccucagcugcacauacuaggcucucaguaaauacaugaauuagcucuuggccuaaguccauaaugguagccagcaucuuuagcuuagggaguccuuaaagucuccaguuuggacaugguccuuugauuaauagcagagcccccagggcagcaguggaaaggaaauagcacugucaccacaaacugcuuucuuuauucaccauaggaaagcuuucugugguuuucuagauuugagguggcugcaacagccucuggcucuacaguaauuuuucuagaguucuaugaugugccuguuaggcauuuaaacuguaauugccuccuaagaauaccccacaaaaguaucucaguuugucccucagguggcaaucagcuaagauuguguuaucugugaaccacauuuucuguauccauucuucuguccuuggacaucuagguuguuuccagcuucuggcuaucacaaauaaggccguuaugaacauaguggaacacaugccccuguggcauuguagagcaucuuuugacuauauccccaagaguggaauagcugggucuucagguagaucuauuuccaauuuucugaggaaccuccagauugauuuccagagugguuguaccaguuugcaaucccaacagcaauggaagaaugucucucuuucuccacauccucuccaacauguguugucaccugagauuagacauucugacugguauaagguggaaucucagggucauuuugauuugcauuucucugaucacucaggacuuugaacauuucuuuaguuguuucucagccuuccaggaugucucaguugugaauucucgguuuaguucuauacuccauuuuuugguuggguuguuugguuuuuuggugauuaacuucuugaguuuuuaaaaauauauuuuggauauuagcccucuaucggauaugggguuggugaagauuuuuugucaauggaauacuauuuggcuauuaagaacaaggacaucuugacuuuugcaggcaaauggauggaacuagagaaagaaagaaagaaagaaagaaagaaagaaagagagagagagagggagggagggagggagggagggagggagggaggaaggaaggaaggaaggaaggaaggaaggaaggaaaggaagaaaggaagaaaggaagaaaggaagaaaggaagaaaggaaggaaauaucauccugagugagguaacucagaaccaaaaggacaugcaugguguguacucacuaauaaguggauauuagccauaaaaauaauacaggauacacaagauacaguccacagaauucaaagccucaacaagcugaagugcccaagugaagaugccuuagucccacuugagagagagaagaaagcaaucacaagugaggagggacagauggaccuaggaaggaaaauagauggggucauggggguguauugcgggggagagggaaaccugaucugguauucggugagggaaaaggacuagaacccugagggcaagcagaaaggauguaaacaggcaaccucagaaaauaggagguuggggggaucccccagaaugaaucagagaccugggaggugagcaacuuagaacucaaagggagggaccuuagaugaaaugucugacaguagagagaaugaacuuauagagcccaccucuagcaggaagacaggauaucaagugagggaugugguugccaucccacagucucaacucugacccauaauuauuccugucuguaagaaggauggaaauggaauggaaccugaggaaaagaagguccagugacaggcccaaagugggauccaucucaaggggaggucccaaggccugaugcuauuacugaggcuauggagugcucacaaaaagagauguaucaugacugcccuuugaaauacccaacaagcagcugaaagagucagaugcaguuauuugcaugcaaccaauggacagaagcagcugaccccuguuguugaauuagggaaagcugaaagaagcugaggagaagucuaauucuguagaaggaccagcaguccuaauuaaucuggacccuggaaaucucucaaacacuggaccaccaaacagacagcauacaccagcugauaugaggccccaaaacacauacaguagagaucuuccagguuuguguuaaaucagagaugaugcaccuaacccucaagagacuggaggccccagggcauuuagaggucaguuggauuggggggccugagcauucuaauagagaugggguggcgaggaggugugggauguggagcaauaggaggguggauggggaggggcaggaaauggauuauggaguguaaaaaaugaauuacaaauagaauuaaauuuaaaaaacacauccaacaacaacaacaaaaaaaaauuuuaugcuuaucuuuuuugacuuucagccuccaacacaagugacacacaugugcauguacagcuaaaauaagcuucacauacauagauagauacaugcacacauaaauuuauuacuuauuaauuuuaaauuugaauuaaaauauuacaauuauuugugucaacauuguacugaaguauaauagaaaaguauacaaaucugaacucugcaucuugaauugaaauuauaguuuaaauguaucaaugaaauguaauucgugaauaauuuugauauugaaacuaucaucuuuauauuauauuuuauauuuuuuauauuagcuaauuaaauugggguuugguggaguuggagacagaaguuuugaauuauguuuucuuguuucucuuuuucuugcuggugguugauccuggagucuuguguauacuaugcaugcauucugucacuugguugcaccugaauuauucucucuugaaaugaccauguaguaacuucuccacauuucagagacauugaagggucuccucccaccccaugauauuaucugaguuacaacuuguauuauuuuuuucuuuucuuuuuuaagccuucaauucuauuuuuuuuuagccuuugaauaaauacaugaauuccaucacggcugcauacauacagaaauugugucuguucuguagaucugacauguuugucuagugaaaaaguaccaaagaauugguugcacaugcaauucugauaaaguaagauuucuaucuugauugauucuauuuccucuccuuugaagacacuuccuguacuuuuaaccauuucuccucauugguucuucuucuguuucuauaaagaaauaacaaacacaggcuaccuuuauaaaagaagagaggcuuauuuagcucaguguuugggaaauuuaaaagcauggugcugucagcagcucagcucuagugaggacccucauaggagugucaggugucaggacaggucacaucaccaaacaggaagcugguagacucaaguugcuuuuuauaucaauuugguuuuaaagaaagagucaacggcuucaacaagagcuccuuuaaucccauugaagggaaucucuucccgugaccugaacauccuccuuggucuccuccuuuuaaaaaaaauuaauuaauuauuuuuauuuauauucuuuuuuauuagauauuuucuuuauuugcauuucaaauguuaaccccuuuccuaguuuccccuccgaaaauucccuauccucucccuccucucccugcuccccagcccauccacucccacuuccugacacuggcauuccccuauacuguggcauagaacuuucauaggaccaagagccucuccucccauugaugacugacuaggccaucuucugcuacauaugcagcuggagccaugggucccucgaucuguucucuuugguugguaguuuagucccuuggagcucugggagguacugauuggaucauauuguuguacuuccuaugggguugcaagguccguucagcuuuuucaguccuuucucuagcuccuccauugggaacuuuguguucagaccgaugauuggcugagggcauccaccucuguauuugucaggcacuggcaaagccucucaggagacagcuauaucaggaucccgucagcacacacuuguuggcauccacaauagugucuggguuuggugacuguauaugggauggauucccagguggggcagucucuggauggucuuuccuucagucucuguugcacauuuuguaucuguaucuccucccaugggucuuuuguuuccccuucuuugaaggacugaaguauccauacuuugguuuuccuucuucuugagcuucaugugaucugggaauuguaucuuggguaaucugagcuucugagcugauauccacucaucauugaguguauauccuguguguucuuuuguuacuggguuaccucacucaggauaagacagcauuuuuaacaaaugguucuaguucaccuggcgguuaguaugcaaagaaugcaaauugauccauucuuaucuccuuguacaaagcucgaguccaaguggaucaaggacccccacauaaaaccaaauacacugaaacuaaaagaaaaaaaaaagugggcaagagcauccagcacaugggcacaggggaaaauuucguaaacagaacacuaauagcuuaugcucuaagaucaagaauugacaaauggaccucauaaaauuacaaagcuucuguaagacaaaggacacugucaauaggacaaaacggcaaccaacaaagugggaaaagaucuuuaccaacccuacaucugagagaggacuaauauacaauauauacaaagaauucaagaagguagacuccagaaaaccaaauaaccuuauucucuuuuccauugcauggguccuagagauccaacucaaguccuaacggcaggggucaccuuuaugcacugaacuguaucacuggccuuuacuguuguauuuuuaaugaaauaauagcaagcuucuguacaugaaaguuguugaaacaauagucauuaaaugaucuaguuagauaaaugggauagacagagcaauuaaauuguuagucacugacuccugcaaauauacauuuaagcagcuuauccaagcaggaaaagcuuaccaaaguagguggcuuuugaagacccagacuuuuaaccaaaaucucaaaucuccuagaaaugaauuguuccauaucaguagccuccagacaccuguggcuacuggaacauaaauuuauuaagaguaaaaaaaaaaaaaaaaaaaaaaaaaacagaggauuucaauugcuuaggcagggcuaauggcuaucauuuugaauagcacagauguagaaauuuccuucaaugaagaaauugucacuggcuaacccuaauucacaaaaaagcauuccaauuggagggugggacuggaauuaguugaccaagcugauucugguuucucuaaugcuuuuagcuuuuuugugccaucaccacuuuacaauagaagagaugaagccuagagauguguuuucuaggggagaaacuuugcuuaaaaugacuuacuggggauaaaaaggcuuucuggaccaguaaagcugugaaaugcccccaggugacaaccccaggaagcuuggcuugaaaucagucugggcucuuaaucagcuaguauuaaagagucuuauagaauucucaacuuuugcuaauuuaguugggugaauuugagaggauaggauagauguggagagggaguucaauuuucucauggaaaagcagagguuguacccaucccuuccaaaaacugugaugacagcuacaugccaggaaugugaagcuugaauggauaguggacaugugccauagcaauuauagcuagcuucuuaaaauugaaauuacuguuauuugaacgcaaagcacauaguuaaguuuuucuuuucuuuuugccagcuauuuugauguggucagaucuaauuucauucccauggugggugucagacuggcacacaguauuguagguugugacuccaauuagauuucaauucuauguucauuuuauguauaguauuuuaauaaagucucauauuuuccuuugaaacaaaagcaccaguaacaaacauugcauuaaaucaugcuuuuccuuggugucuaaucuggaaauuggcuguugacauuagugauuuuuuaaaaauuugauuuuugaugcaaauuccaaauugcucugucuguacauuaaaacuuuaaauauugacuucuuggcuuuugaaaagcucaaguuucaaggagaccuaguacaaaaagugaacuugacagaauaauauaccuaccauaauuucuguaaaaagacuuaauauauucuaguauuuggaaguucaaucaggguauaauaacuugaaacguaacuggauauacaggccuagaauugauagcuuuuucaaaaauaggcacagggaaaauaauauauuaucuuaugccagauauugaaugaaaaugaauuuccauucaaucuuuaagcuagucuugacuaauaaacaacuauuauaagaguggcuguuuuaaucaguauuuaagaauuauaggguauauucaacugaccuuacaaagaaaagaaaacacucugucccccuuaaacaaaaggcaguguauuagaugacuuugucuuaugugauauggugugugugugugugugugugugugugugugucugugugugugugugcgugugugugucuguguguguguguguguguguauaauuuaaauaguguuucauguuaggcaagucuagaagaauugauuaugguuuccuuagccuuaaauuguuuucuuaaaagcugugaaaaaggggagaauuaauaucuuuuauuagcuauuuucuucauuuacauuucaaaugcuauccugaaaguccccuauagccuaccccugcucugcuccccaacccacccacucccaauuccuugccuuggcauuccccuguacuggagcauaugcucuucacaagaccaagggccucuccucccaaugauggccaacuaggccaucuucugcuacauaugcagcuagagacacaagcucuagggguacugguuagaucauauuguuguuccuccuauagaguugcagaacccuucagcuucuuggguacuuucucuagcuccuccaucccuguguuccacccaauaggugacugugagcauccacuucuguauuugccaggcacaggcauagccucacgagagacagcuauaucaggguucugucagcaaaaucuugcuggcauaugcaauagugucuggguuuggagacuguuuaugggauguauccccagaggggacagucucucgaugguucuucauucacuaucagcuccaaauuuugccucuguaacucccuccaugaguaguuccccauucuaaggaggaaugaaguauccacacucuggucuucuuucuucuugagcuucauguguuuugcaaauugcaucuugaguauucuaaguuucugggcuaauauccacuuauuagugaguacauaucaugugaguucuuuuguaauuggguuacuucacucaggacaauaucuguugaggccuguuuugugaccaauuauauggucaguuuuggaagguagcaugaguugcugagaagaagguauauccuuuguuuuaggauaaaauguacucuagauaucuguuaaauccauuuauuucauaucuucuguuaguuucaaugugucucuguuuaguuucuguuuccaggaucuguccauugaugagagugugguguugaagucuacuaccccuuuuauugugugaggugcaaugugugcuuugagcuuuacuagaguuuccuuaaugaauguggcugcccuugcauuuggaacauagauauucagaauugagaguucaucuuggaauauuuuuacuuugauggguauggagugccccuccuugucuuuguugauaacuuuggaagucgauuuuauucaauacuagaauggcugguuacugcagcuuguuuauugggaccauuugcuuggaaaauuguuuugcagccuuuuacucucagguagugucugucuuuaucccugagguggguuuccuguaugcagcaaaauguuggguccuguuuuuguagccauucuguuaguguauguuuuuuauuggggaauuaaguccauugauauuaagacauauuaaggaaaagucauuguugcuuccuguuauuuuuguuguuagaguuggcauucuguucuuggggcuaucuucuuuuagguuuguugaagaauuacuuucuugguuuuucuagggcguaauugcccuccuucuguuggaguuuucccuuuauuaucccuugaaaggcugaauucauggaacgauauugugugaauuuguuuuuguuauggaauacuuugguuucuucaucuaugcuaauugagaguuuugcuggguacaguagccugggcuggcauuuguggucucuuagggucuguacaaccuuuguccagaaucuucuggcuuucauagucugaugagaagucugguguaauucuaauaguucugccuuuauauguuacuuuuucccuuacugcuuuuaauauucuauuuucauuuagugcauuuuuuguucugauuauuauguguugagaggaauuucuuuucugguccagucuauuuagaguucuguaggcuucuuguauguucaugggcaucucuuucuuuagguuggggaaguuuucuucuauaacuuuuuugaagauauuuauuggcccuuuaguuugaaagucuucauucucaucuacuccuauuauccguagguuuggucuucucauuguuuacuggauuuccuggauguuuugaguuaggauccuuuugcauuuuguauuuucuuugacuguugugucaauguucucuauggaaucuucugcaccugagauucucucuuccauuucuuguauucuguugguaaugcucauaucuaugguuccugauuucuuuccuagguuuugaauuaggaucuuuuugcauuuugcauuuugcauuuuuuaauuguuguguccauguuuucuauggaaucuucugcaccugagauucugucuuccauuucuuguauucuguugguaaugcucacaucuaugguuccugauuucuuuccuagguuuucuaucuccagauuugucucccuuugguuuucuuuauuguuucuacuuccauuuuuauaucuuggauuuuuaaaaaauuccaucaccuguuugguuguguucuccuguaauucuuuaagggacuuuuguguuuccucuuuaaggaccucuuccuguuuaccagugguuuacuauaauucuuugagggauuuuugugcuuccucuuuaaggucuucuagguguuuagcaguguucuccuguaugucuuuaagugaguuauuaaugcccuccuuaaaauucucuaccagcaucaugagauaugauuuuaaacccaaaucuugcuuuucaggaguguugggguauccaggauuuguuauggugggccuacuggguucugaugaugcugaguggucuugguuucuguuaguaagauucuuauauuugccuuucaccaucugguaaucucugguguuagauauucuagcugucucuggcuggagcuuguucuuccugcgauucuguuagccucucucagaacuucugggaguccaacucucuccugagucccaguguucagagcauucucugcaggcaagccuuccuguugcagggaaggugcacagaggucuggagcucagaucugccuccugucugaagaugaagacccaaaggaacccugacuaagaagcucuauugcuucuguggcccacaugcucuccuguucccucuggugucugagagaccugggauacaagauggugcucucaccugagucuggggucagagcccucccugggcgcugacucuccucagugauccugguugugcuagggcuccugcagcauggagaguccucugaggacuauaauacugucuguugaguuuuugcccaagauggccuguggcugaugccaaugggaaagaaccccagcugcuguuugggcagguuuccugugccccuguuucugcuggcccaagccccucugguuuguuuuugaacagauguuguguuccacucaacaguaagauccugggugugugagggcgccugugguguggaaaauccucaggggaucaucugcugaguuugugcacaagguggcuugggcggaagaauuaauauuaaagcuuuaagaacagcagcuuuuuacagagcccccgccaaucccagcuugauugauuacagcugcuuuuguacaggaucuaaaagaacaaucuguauuaaaaacaacauucuuuggucugagcuugaacaguuccaaaagggguuuccauggggucugcccuacaaugugggcaauucaguggaagaagcuauggucauugccauugggacaguagcaucuaggcaggagaaagagacuuaggugaggagugacuggcauacauaacagagugguuguccuggcagcuguauucucagccacauucuucagccucuaaagcaggagaggaaagucaaguugcucuuacaaaggcaaaagcacacaaggguaagaagcugcaagaggagucagaagacagguguguuucagaacagugggcagagcuagggaucuccauccagaacucgggacaguggugagggauugcuccucagccuucacucucuaaauacccccacucuguugugccaaggcugugggggaguaaauacaucuuacuuugguauuucacacaugccacaguaaccuagcugguaaggcugcauucugcucugccccaauucuaugucuucaccaauuguguuuucuggauaauuaagaugaaacugaguagggguuuucauuuugaaaaaagaacauuuugacagguuuucacuguguagccaaagguggcuuuuaacuugugacucuccugccuuggccuccccacugccaucauuguagaugucagacaccaugccuggccagugaacauuuuaauacauacucaauggggccaucuguuaguuacuuuggacacacugaagauucugacuagagugggauauguagagaguggcagaaguuugcaucauugugugcagucagcacccuuggaugcuggaucaacaugaaaggcaaccuucaguaugaccugugacaaaaccugagaaaucaucagguagcucccacuggucuugcauaacacagauaugacucaaagauuuacuuuuuguuaaucucccauauuuuaauaaauuaaauguuuuaccuauaacaaauugguguuuagggauaagcauuccaaucacuacuuuuaauuaccauguauuauccuccuuuggggcaaaaaauaauaaaauauucugcuucuuaaaaaugcuuucuuuagugugauucuuaauuuuuuaaauaaagaaccuaauuuuaucauuugucaccucuuuuauaccugauucauccucuauaacccaacagcauaggcuuauguaaucuuacaaagagaaugucaggguaucuuuauagacagaucuaguucugguggaggcaguucagaaagaggcaggcagauucccauggaguuaaguuuugcagacuuuggccagcaugucaauaugcauaacuaugaguguucguuguugguggaaauaauauuacuguccauaaauauauuguucuucuaauuucacaagauaaugaaugugcuuuucagguauucacaaaucauaacacaacagaauugcagccaucccacauccccccucucucuuaucugcuaauuuuuauuuauuuaauuauugagaaguccauguauacaguaugucuugauuaaccacuuccuccccuuuaacuucugccauuaucccucacuacuucuccuaacuucacauguuucccucgcccacccccauccccagcuuggaagcuucauaaaagccaaggcaauuucucaagggucagagccucucuuagaauugguuagauagcacaguacucuuuuuacagcagcaauagauugcuguacuuaccuuacuucugacucacuucuagcucagcuuccuacaacaccaucugucacugcugcaggccugagaguucugguucaugcccagcauuggcugcagcaucuaccugcucuuuaaagucaaagucauucccauuuuucugucucauagguuuuccauggcgcucugucagcccucauuugaguggagaauacauauggaccuaggaauguagguauugaaaaauuccuuagagugaacuauuaaauucaaaccagagcuaguuggcucccugugcuuagcuuagaaucuuaucuauaaugauaguuuucacagaauauugaugaaagagaaauaaacaccaaauauguuucccauccccaucuccugccaaacucuacuaagaaagaacaucucauuacuuuaguuagaauuuauuaauacugaccuucuccaaacuuggaucauucagguuuagcuuacaaugcuucuauuuuacuguagucaaagcuauggucauauggauauaaaaauaaacacuggaauaugcuagcucaggagggugaaaggcaauaauaccuauaauaacauagcugcaaacauccugcuuuucucugcuauuccuaaaaaggaaucaggcacacagcagaggacauauggaagcaaugggcauuuuccuuuaaugugucauacguauuccucauaacccacucaccauccuuggcgccuuacugugcauugcuuuggagaucccuguucuuguugccaacaaauuuaauucaccacaaagggcgcuucccuucuucccugacuuaggaaucugaagccaccacuacaaacagaaguguggcuugcaaguguguucuguucauguuuuucuuuccucucuuggucagauuuucugcugugguuguuaccaaggaagaaaacucuuauuuuguuuaggaugagcaauaaagcaacuggucuuaggauuucuuuguguguuuguuugugauguuggguauggaauccaggaccuuacacaugcuaagcaaguggucuucugaagagcuauuuccuuggccccagaaagguacuuuuuaaaagcagauauauuaauugagauuugcaaugcagagguuuuaaauuuuagaaguucagaagggcaacaagugaaaauugucucuagguagaauauuuugcuuuuaguaagcuuuucccuguaacuauuacaaagcaagaguugugucaagaauuuaggugcaaagauuugggugucauacuuccuugcuuucuacuguguucuucaccaugaaauguagacugugaaaacuaagggauuauuguccuaguuuuguugaauaauauaccagaaaugugguugucagcagaugaacacauacucaauaguauguuugauugggguuacucauugucaccaaauucuauauucaagagacaugagacugggaaacagauaccuuguuuguguauuccaaugcaugguaguagaggaaaguggcuucauuuguuaaauaagcaugaaagauugucuggacacacaaaucugauuuguuacuuuaaauuuaucuaacaagcaaguuauugaggcaggaacuauuauguagaaucaauaaacaacacaguggugaaccaaauaguuuuguaguguuguauguaccagcauccaugcauugcgacaccuuuucugaaagcacugaaucauacauucuaguuaguguucagggaccaaauaacaccauggcaaaguguuuuggcuuagguaaaggguguguguguguguguguguguguguguguguguguguguguuaaagcccaaucuuaugugagaauuuugguuugggaaaucuuuauuguuguuguuguuguuuuguuuuuguuuuuucauucauuuuuuuuaauuagguauuuucuuuauuuacauuuccaaugcuaacccagaagucccccauaccaucccaccaaugcccuaccuacccacuaccacuucuugacccugcuguuucccuguacugaggcauauaaaguuugcaagaccaaugggccucucuuuccaaugauggcagacuaggccaucuucuuauacauaggcagcuagaaacacgagcucugggagggguacugguuaguucauauuguuguuccaccuauaagguuguagaccccuuuagcucuuuggguacuuucucuagcuccuccauuggaggcccugugauccauccaauagcugacugugagcauccauaucuguguuugcuaggcccagguauggcuucacaagagacagauauauguggguccuuucagcaaaaucuugcuaguguaugcaauggugucagcauuuggaggcugauuaugggauggaucccuggcuauggcagucucuagaugguccauccuuucaucucagcaacaaacuuugucucuguaacuccuuccauggguguuuuguucccaauucuaagaaggggcaaaguguccacauuuuggucuuuguucuucuugaguuucauguguuuugcagauuguaucuuguauguuggguauucuaaguuucugggcuaauauccacuuaucugugaguacauaucauguggguuauuuugugauuggguuaccucacucaggauggugcccuccagguccaucuauuugccuaggaauuucauaaauucauucuuuuuaauagcugauuaguacuccauuguguaaauguaccacauuuucuguauccauuccucuguugagggacaucuggguucuuuccagcuucuggcuauuauaaauaaggcugcuaugaacauaguggagcauguguccuucuuaccagauggaacaucuucuggauauauguccaagagagguauugcuggauccucugguaguacuaugucacauuuucugaagaacugccagacugauuuccugagugguuuuacaagcuugcaauaccaccagaaauggaggaguguuccucuuucucuacauccucgccagcaucugcuaucacuugaguuuuggaucuuagccauucuaacaggugugagguagaaucucaggguuguuuugauuugcauuucccugaugauuaaggauguuaaacauuuuuuuucaggugcuucucagccauucaguauuccucaggugagaauuccuaguuuagcucugagccccauuuuuaaugggguuauuugauuuucaggaguccacuuucaugaguuuuucuauauauuggauauuagcccccuaucugauuuaggauagauaaagauccuuucccaaucucuugguggccuuuuuuuucuuauugacagugucuuuuaccuuaccgaaacuuugcaguuuuaugaggucccauuugucgauucuggaucuuacagcacaagccauugcuguucuauucaggaauuuuuccacugugcccauauccuccaggcuuuuucccaauuucuaaucuauaaguuacacugucacugguuuuaugugcaguuccuugaucuacuuagauuugaccuuaguacaaggacauaggaauggaucaauucgcauucguguacaugauaacugccaguugugccagcaccauuuucaaccauuguugaaaaugcugucuuuuuuccacuggaugguuuuagaucccuugucaaagaucaagugaccauaaguguguggauucauuucugggucuucgauucuauuccauuggucuacaugcugaugcuauaccaguaccaugcaguuuuuaucacucuauacuacagcuuuagguccggcauggugauucccccagagguucuuuuaucauugagaagaguuuuugcuauccuaguuuuuuuguuauuccagaugaauuugcagauugcccuuucuaauucauugaagaauugaguuggaauuuugauggggauugcauugaaucuguagauugcuuuuggcaagaaagccauuuuuaauauauugauccugccaaaccaugagcaugggagaucuuuccaucuucugagaucuucuuuaauuucuuucuucagaucuuuccaucuucugagaucuucuuuaauuucuuucuucagagacuugaaguucuuaucauacagaucuuucccuuccuuaguuagagucacgcuaagguauuucauguuauuugugacuauugugaaggguguuguuucccuaauuuguuucucaaccuguuuauccuuuauguagagaaaggccauugacuuguuugaguuaauuuuauauccagcuacuucacugaagcuguuuaucagguuuagggguucucugguggaauuuuuagggucacuuauacauacuaucauaucaucugcaaaaaguuauauuuugacuucuuccauuccaaauuguauccccuugaucuccucuuguugucgaauugcucuggcuaggacuucaaauacuauguugaauagguuuggagaaagugggcagccuugucuagucccugauuuuagugggauugcuuccagcuucucaccauuuacuuugaugcugucuacugguuugcuguagauugcuuuuaucauguuuagguaugggccuugaauuccugaucuuuccaggacuuuuaucaugaauggguguuggauuuuucaaaugcuuucucugcaucuaaugagaugaucaugugguuguugucauugaguuuguuuauauaguggauuguguugauggguuuccguauauuaaaccauaccugcaacccaggaaugaaaacuacuuggucagaauggaugauuguuuugauguguucuuggauucgguuagcgggaauuuuauugaguauuuuugcaucgauauucauaagggaaauuggucugaaguucucuaucuuuguugggucuuugugugauuuagguaucagaguaauuguggcuucauagaaugaauuagguagaguaccuucugcuucuguuuuguggaauaguuugugcagaacuggaauuagauugucuuugaaggucugauagaacucugcacuagacccaucuaguccugggcuuuuuuuggcugggagacaauuaaugacugcuucuauuucuuuaggggauauaggacuguuuaggucauuaaccugauccugauuuaacuuugguaccugguaucugucuagaaauuuguccauuucauccaaguuuuccaguauuguugaguauagccuuuuguagaaggaucucaugguguuuuggauuucuucaggaucuguuguuaugucucccuuuucauuucugauuuuguuaauuaggguguugucccuuucccucacgugaaucuggcuaagugucuauuuaucuuguugauuuucucaaagaaccagcucuucauuugguugauucuuugaauaguucuucuuguuuccacuugguugauuuugccccuaauuugauuauuuccugccaucuacuucucuugggugaguuuccuuccuuuuguucuagagcuuuuagguuuguugucaagcugcuagugugugcucucucuaguuucuuuuuggaggcacucagaacuaugagcuucccucuuagaaaugcuuucauugugucccauaaguuuggguauguuguggcuucauuuucauuaaacucuuaaaagucuuuaauuucuuucuuuauuccuuccuugaccaagguaucauugagaagaguguuguucaguuuccacgugaauguuggcuuucuauuauuuaugauguuauugaagaucagccuuaguccauggugaucugauagaaugcaugggacaauugcaauauuuuuguaucuguugagggcuguuuugugacuaauuauauggucaauuuuggagaagguaccaugaugugcugagaaaaagguauauccuuuuguuuuaggauaaaauguucugcagauaucuguuaaauccauuuguuucauaacuucucuaaguuucacugugucucuguuuagguucuguuuccacgaucuguccauugaugaaaguggugugcuaaagucucccacuauuauugugugaggugcaaugugugcuuugugcuuuaguaaaguuucuuuaaugaauguggcugcccuugcauuuggagcauagguauuaauaauugagaguucaucuuggaagauuuuaccuuugaugaguaugaagugucccuauuugucuuuuuugaugacuuuggguaggugauugauuuuuuuagauauuagaauggcuacuccagcuuguuucuucagaccauuugcuuggaaaauuguuuuccagccuuucacucugagguaguguuugucuuuuucccugagauggguuuccuguaagcagcaaaauguuggguccuguuuguguagccagucugucagucaaugucuuuuuauuggugaauugaguccaucgauauuaagagauauuaaggaaaaguaauuguugcuuccuauuauuuuuguuguuacacuuggcauucuguucuuguggcugucuuccuuuagguuauugaaggauuacuuucuugcuuuuccaggucgugguuuuuauccuaguauugguuuuuuuucuguuguuauccuuugaagggcuggauuccuggaaauauaaugugugaaauugguuuugucauggaauacuuugguuucuccaucuaugguaauugaaaguuuggcuggguauaguagccugggcuggcauuuuuguucucuuagugucuguauaacaucuguccaggaucuuuuggauuucauagucucuggugaaaagucugguguaauucugauaggccugccuuuauauguuacuugacccuuuucccuuagugcuuuuaauauuuuaucuuuauuuugugcauuucuuguucugauuauuauguguaggggggaauuucucuucugguucauucuauuuggaguucuguaggcuucuuguauguucauaggcaucucuuucuuuagguuugggaaguuuucuucuauaauuuuguugaagauauuugcuggcccuuuaaguugaaaaucuucauucucaucuacuccuauuauccauagguuuggucuucucauugugucauggauuuccuggauguuuugaguuaguaucuuuuugcauuuuccauuuucuuugauuguugugcugauguucucuauggaaucuucugcaccugagauucucuuuuccaucucuuguauucuguugcugaugcucgcaucucuuguuccauauuucuuuucuagguuuucuaucgccaggauugccucacuuuggguuuucuuuauugugucuacuuuccuuuuuagguuuaguauuguuuuguucauuuccacuaccuguuuggauuuguuuuucuguuuuucuuuaaggacuucuaccuguuugguuguguuuuccuguuuuucuuuaaggacuuguaacucuuuagccguguuauccuguauuucuuuaagugaguuauuaaaguccuucuugauguccucuacuauugucaugagauaugcuuuuagauccgggucuaaguuuuuggguguguuggggugcccaggacuggccgaggugggagugcuggguucugaugauggugagugguuuugguuucuguuaguaagauucuuacgucugccuuucgccaucugguaaucuccugaguuaguuguuauaguugucucugguuagagauuguucgucuggugauucuuuuagccucuaucagcagaccugggagacuagaucucuccucugauuuucaguggucagagcacucucugcaagcaagcucuccucuuacagggaaggugcacagauauuuggcuuuugggccugccuccuggcagaagaugaaggccugaaacaggcccugucucagaagcuguguugcuuuggccugucacagaagcuguuaguuucuguaguccacacucucaccagugcagacaagucucagagggauccaggaaucaagaugucuccccguggugcucaggaaaagcccuaccaggcagggcagacaccucuccucuggcaggggaggugcccggaugucuggagccugaaacggugucugccccagaagcuguccucuagggaauugggggugucugaugacucugcgcccaggugaccuggugcuggcacugaccagaaaagauuuggacccuggucaggccggguuuuccugaugcugucucgggucccucacgauuggauuggaacagaaguuguguuccacucauagaugguccuaggaucaugugaagaguccucuaggggaccuugggggugucugcugacucugcgcccaaggugaccgggugcuucuggcugcuuuugauuguaugcacuucuuuuugaagcagagaauaauguccacauucagugccacaguccacagucaauguacuuuuaaaaaccauuuucgaacuuuuauaccuggucucucagagaccaauccaugcaggagagggcaggggccauagaagcaacauagcuucuuggauaggaucacuucaggccuucauccucagcaaggaggcagagcugagacccagaccucugggcaacuuacuugcaaggagagaccuugguccagagagugcucugaccacugugacucaggagagaguuggaaucccaggagugcugaaagaggcuaacagaaucacaggaggaauaaguuccauccagagacagcuagaacauauaacaccagagauuacuagacgguuaaaggcaaagguaagaaucuuacuacacagaaaccaagaccuucuucaacauugaccauauaauuaauuggucacaaagcaggccucaacagauacaaaaauauugaaauuaucccaugcauccuaucagaucaccacauacuaagguugaucuucaauaacaauauaaauauuucaaagccaacauucacguggaagccaaacaacaaucuacucaaugauaacuuggucaaagaagaaauaaagaaagagauuaaagacuuuuuaagauuuuaaugaaaauauagccacaauauacccaaacuuaugggauacaaugaaagcauuccuaagaggaaaacuuauacaucugagugccucaaaaaaaaaaaaaaaaaaaaaaaaaaaccuagagaaagcauacacuagcagcuugacagcacaccuaaaagcucuagaacaaaaggaggcaauuucacccaaguggaguagauggcaggauauaaccaaaaucaggacugaaaucaaccaagugaaaacaauaagaacuauacaaagaaucagccauagcaggagcugguuuuuuguuuguuuguuugguugauugguuguuuuuuuuuguuuguuuguuuuggguuuuuuuuugagaaaauaaacaaaauagauaaacccuuagccagacuaaguagaggguacagggacaguauccuaauuaaggagaucaaaacugaaaagggagacaaaacaacagaacccuaggaaauccaaaacaucaacagauccuacuacaaaacgcuauacucaacaaaacuggaaaaccuggaugaaauggacaauuuccuagaaagacagcagguaccaaaguuaaaucaggaucagauuaaugauuuaaacagucccauguccccuaaagaaauaaaagcagucauuaauagucucccaaccaaaagaaagcccaggaccagauggguuuagugcagaguucuaucagaccuucaaauuauuccacaaaauagaaacagaaaguauuauacccaauucauucuaugaagccauaauuacucugauaccuaaaucacauaaagacccaaaaaagaaagagaacuuaagaacaauuucgcuuaugaaaauccuuguaaaaauauucaauaaaaucucaaaaacugaauccaauaacacaucaaaaugaucauccagucauggccaaguaggcuucauuccagggaugcagggauggauuaauauacagaaaucgaucgacauaacccacuguauaagcaaucccaaagacaaaaaaaaaaaaaaaaaaaaaaccaugaucaucgcauuagaugcugagaaagcaugugacaaaauccaacacccauucaugauaaaagucuuggaaagaucaggauuucaaggcccauaccuaaccauaauaaagacaauauacaacaaacaaguagccagcaucaaacuaaagggagauaaacuugaaacaaucccacuaaaaucagggacuagacaaugcugcccacuuucuccuuaucuauucaauauaguauuugaaauccaagccagagcaauuagauaacaaaaggggauaaaggggauacaaauuagaaaggaaaaagucaaaauaucacuguuugcagaugauaugauaguauauauaagugaacccaaaaguuucaccagaaaacuccuaagccuaauaaacagcuucagugcaguagauggauauaaaauuaacgcaaacaaaucaguagccuuucucuacacgaaugauaaacaggcugagaaauaaauuagggaaacaacacccuuuacaauagucacaaauaauaugaaauaccuugcugugacucuaacuaaggaagugaaaaaucuguaugauaagaacuucaagucucugaagaaagaaauagaagaucucagaagauggaacgaucucccaugcucauggauuggcaggauuaauauaguaaaaauggcuaucuugcugaaaggaaucuacagauucaaugcaauccccaucaaaauuccaacuaaauucuucacagaguuagaaaggggaauuugcaaaauucaucuggaauaacaaaacaccuaggauagcaaaaauuauucucaacaauaaaagaaccucugguggaaucaccaugccugaucucaugcuguacuacugagcaauuguguuaaaaaacuaugugguacugcuacagcaguagacagguauaucaauggaauaaaagugaagaaccagaaaugaaccuauacaccuauggucacuugaucuuugacaaaguaauuaaaaccaucaacuggaaaaauaacaucauuuucaacaaauggugcuggcucaacugcugguuaucauguagaagaaugcgaauugauccauuuuuaucuccuuguacaaagcuccaguccaaguggaucaagaaacuccacauaaaaccagagacacuaaaacuuauagaggagaaagugggggaaagccuugaugauauggacacaggggaaauacuccuuaacagaacagcaauggcuuuuacuguaaaaucaagaaucaacaaaugggaccucauaaaauuucaaagcuucuguaaggcaaaagacauggucaguaagacaaaaaggccaccaagagauugggaaaggaucuuuaccaauccuaaaucugauaggggacuaauauccaauauauacaaagaauucaagaagcuggacuccagaaaaucaaauaacccuauuuuaaaaaauagaguauagagcuaaacaaagaauucccauugaggaauccggaaggccugagaagcacuggaaaaaaauguucaacauccuuaauauuuaagggaaaugcaaaucaaaacaauccugauauuccaccucacaccagucagagugacuaagaucaaaaauucaggcuacaguagaugcugaugagguuguggagaaagaggaacacuccuucauugcuggugggauugaaaucugguacaacuacucuggaaaucuuucuggugguuccucagaaaauuggacaugccccaguagaggggaaugccagggccaggaagcaggaguggguggguaggggagcagggcagagggaggguauaggagacuuuuguagcggaaacuaguaaagguauagcauuugaaauguaaaugaaggaaauaucuaaucaaaaauaaauaacacauuaaaaaauuucagacauuugcuuuuuuuccaaagacuggugauuuguuggcuuacuagagacauuuaaguuuucuguggauaagaaaguuaggacacuaugcauuuacuuucuuuccuucuuuaggcacuuccuucuuuaguuguuuuuugagacagacucucacaaucuagccaggauggccugaagcuugguuugccaaacaaacugacuguauacuuugauccucuugucccagcuuccuaagugcugggauuaccugugagcaucuucagugcuaacucauuggagacauucuuaacagguuaggguuucucccacaagccuuccuuauauuuggagcuaacucacugcacucuuccguaaagacaagaaaauguagaucuauuuuucccagauguguugucaacuagguugucuuuaaaaggccugaagacucagcagaauaagaaacuucaacuuuucuuuguugaacuuucuucucaugcugucucccagagcacacugguauuuguguuggcaagguguaugcaaggaaugaugcagaagacacugaagcagguucuuccacucaguuauauccucaccugagcuauguucauuauuuuuaaauuaaauuuuguuuagaauacagaaucaaguauuuccuuaauauguuuucauacauauauauucuacucugcucauguucacucucuuuugagccuucaccuucccuauacacuauugugcaaucacacacaugugcaugcacaaaugcaaacagauacacauacacacaugcacacacacacacacacacacacaccaccaccaccaccaccaccaccaccaccaccaccaccauacaccacugagcguucuguauaacuaaggaccuacaagugcuaguucauauagcugugaauuaugaguuucuuaagaauaaguuuuaagaauuuuucccauuuuugggacuccacauuuuucuaugauuagguuaaauggaauauauauggggaaaugguaaaagcuugggaaauuguuagauaguagaccagucucuuuaaacaacccuuuacaaugagugcuuguaaauacccaagggcuuguuccucugucagauccaucacaguaaaggacaggagugucuuuguccaaagaguucuuucuuucuauugcauuuuaaagaugagauauuucucauaauuaauuaaagacaacaagcaccuguggcucuaggcaacaccaucuuccauaaggggaauuggauugguaggauguuaaguagagaagaaaauguugagacaguuccuccuggcucaaucucuagcugguuuccucuacuuccaugcuuuccacagcuucccuucuguuccugaauuuguugugaagggccagcuuuguucucugagcccuacuagcccagggcaucagcucuucauagccauggugagacccaaauuaaacagccucuguaugaaauaccacauuuccacugcuggccucugugcuucuccucccagccacuuccacacagucacucugugccacugagccacuaagcaugugcagagcaugugcugucaaaggggaguguauguuuaucuaguugugagauccccuuagcaugaccuuagagagaugcacaucacaucuuaaggaaaugcugguauauaauuuauuagccuuuucagcauguuaacugcaaaaucuuuuaccaacacagggugugaacacuucagaaaugguguuugucuuguuugggacaguguuuuagaggaauggguccauagagcacuagcugauacaggugaaaaagguccuuuuugcucucaauguggacucuauacaagaauguuguugauuuccacuuuguugccaguguuucugaaauuagagcagggaggaaugauuuuaauuugaugucaaaauuacuugcaucccaaugaaugauggaggaacaaauacuuuuggcugcuuccaaauacaucagacaucuggacagccuugaacuacccugaugcuauaagaccaaaguggcuucaaccagacucuagacguuaccuggcccuaucucaaguccuauaguaauccaagccgugcagccaccucuuauaccaguggcuguucaugcuacucagagugcuaaaauauguugcugggauacucugagagaauuccaccuacauugguacagaaugauuguccugauaacugggucauguaacacuaaaagccugauugguauauaagaauuaauuaucucauuauuaacacuaccauaucagauuucuuugagaaagaacaaagaagagaaugaaacacauuuguuauuaagaaaggagaaacuagcuucuaaaaucuucuucuuacuuuaagaacccugggucacuuaaucagaggcagugcaaagugugggaauugugggacagguuaccucccaggcuugaauucaagagcuuuuaacuaucaggauccuagaggucuuacaauguauguuacugaaaccugaaucgaaucaaagguugcuuaagccagugugauuuaguaaucucaguugacaaauauuuauuugcacuuugaacuggacgaagaauaaggucaugcagguuauuccagaccuggaugaaaacuuuguuuccauccagaagcagggagaguacacaggagcuaauuaaaaacaacaggaaacucucucuucccugguacaugugcugcagagucagaaaaagcaaguucauaacuaggggacuucucuagagaagccaguguguuuugaaaaccaggcaggauuugacaggguagauaguuccuuagguaauuuauaaagacaagguuuaauccaggcagaaaccaacagcagcucgaggcagguaguucaacaaaaggaguguuuucugggcaccuacuuuauuccaggcacuaagauuuagcagugugcaguaaggaggcuuucagggagguccugcuguugagucuaagaugccuuguacaccaacacugacaaaugcuuucuuuuuuauuauauuaaaacgacaggucauuuuuauauaaaauaacaguuccacguacccagauuuuuccuguguacuuuaagucaucuccuggcuacuuauaaugguugugcugauagcuguuguuuauuaugguauacacucaguaccgaauuuuuuaaaauuuauauucacauuauuuugugacagggucuuauuaaguagcccaggcugcccucaaacgugugauuguccuaccucagauucauuaguaccauuauauauuuacacacacacaguuuuucaaccuacaguaguuugaauucauauauguaugaauguauaucccaggaauguuagggggcuaugugcacagccuucucccacaaaagagcugagaauguaauagggucagagaauguaugaggcuagaguauacagaagucccuacucaguuugcaagcuuugagaauuaaaauauggaaugaucagaggcuuggagacugguauuuuguagaacugucucagauuacagaugaaucuaacuguaugucuggacagcuccagaacauucuuggcugcugugagagggguguuacucaugccugcaaaccagccugcuggaacccaaaucccuaagggcuguggccucuuaauugcccagugugauaucucaaagugauucccauccuucuuuguuccuuggcaucaaggccaguggagauugugggcuaacauuuaauauccuccugccucuccagcaagccccugaaacuugagaggacaaaguguugcuuucagagugugccugcuaguuuucccagggagguucacgcauauugacuguugaaaccgaguuuuauuuuuagaagaaaucuaguggaaaccaacauaguaaggggaauuuuuucuuauauauauaauuccgugagggacaaacauuccaauuugaucguuaaaaauaggacuaaaaugaaugucauuuguuccaaaaacugcuagucugagauacuuguaguaaaauaucaauuuacuaaauccuuuuguaaaaaaaauuccacuucugcucugucugcaauucaugcaaguuacuucuugggcaaacauagacugaauuuuaaucauggccaauucuugaaaagcugagaggcucuggaaaugggauaguuggugacucaauccugcuccacaucaagccuaugacuugcugucaccaagugccaguaauacaagaaaaaguacucuuguggguuuaucuguuugucauuaaacuuugcuaagccagcaagccugagaaguaggcuugccauggacuuucaccauuggcauaugagcuccacaggcccuguuccacacagauuaccuugccugaugucagugugggucuggucuguacagagaucucugguuuucccuaguaacuggagagcacuuaucuguagugagaaagccacgcauggccacgccuguuaaguaucugguguguauacgucccuaagugauuauuuagccuagugucauaauaccuugcuuuauguuuccaagaaaaucguaaauaauuuaggcauucuguagcuuaacauuaaucacuaaguaaucucauuugugauagaaugaaugucugagauaguuuaguaacuuagaacaacagauacucagguaagugaaguggggugcaaugagcuaagccuaugccagacuuggauaucagugcggucauuauuauauaagauuaggccacgugagcuuccuugggguuuugugugugugugugugugugugugagagagagagagagagaaggguggcuggacaggagaaugcagaacacagcugcaaagugacagaucuucaauacagcauaugcaaaaugugaacaguagacaaagcagagccuuucuuuucuuuuuuuuuuaauuagguauuuuccucguuuacauuuucaaugcuaucccaaaagucccccauacccacccccccaauccccuacccacccacucccacuuuuuggcccugggguuccccuguacuggggcauauaaaguuugcaaguccaaugggccucucuuugcagugauggccgacuaggccaucuuuugauacauaugcagcuagagacaagagcuccgggguacugguuaguucauaauguuguuccaccuauaggguugcaguucccuuuagcuccuuggguaauuucucuggcuccuccauugggggccgugugacccauccaauagcugacugugaucauccacuucuguguuugcuaggccccggcauagucucacaagagacagcagagccuuucuuaaucugaccauccugaauugcuuaucuuuccuuucucagagaacagagcugacauccgauaaggauauguaccuugacaauagcuccauugaggaagcuucaggaguauauccuauugaugaugaugacuauucuucugccucaggcucagguaaggcugccuacuggaugccauucucuauaccccggcaugcacacauuucgcugugccuucuuccguuacaagcacagcaugugucauagucaugagcaugguuuggggauacaaauuccaguucaagcuaugagaacuuuggaaccuaacuuugcugagucucaguuucauuauuuauaaguggaaauaaauaacuauauuuaccacugaguuagguauucaucucugugaagagacaccugacagcaacucauaagggaaaacauuuaauugaggauggccuacaguuucagaaguuuaguaauuaucaucauggcaacaugcauggcaacgugcacacagacauggugcuggaggaaccagaguucaacaucuugauccacauacagcaggagacugugugccacacuagguauagcuugagcauaggagaccucaaagccuacccucacagugacauacuucuuccacaccuacuucaccaaggccacaccuccuaauagugccacuuccuauggccaagcauucacacacacaagucuauuaaggcuguaccuacucaaacuaccacaaucauauaaaguuuuucauggauaaauggaguugaggagauagcuuucaguuuuauuguuaaaaauuuuagaauauggucauagaaaccaccguucaagaaaucuuucaaauacccauuuaauaaaaugccugcucuauguuaagauuauacacaaaaacaaaaacuuacaggcuuuuaaaguauauugcucauaaguaggaggaacagaacugcagcuauguaauauaaagauagauuuaugucuuugauuucuucaguguauuaguugucuauugucucugcaauguugccuaacaaaccauccgaacacuaaguacuuugaagcagugggcauuugguuaauucauuauccugcauguuuuccaguuagaggcaggcucuacaauggcuuacagcugaagcuuggcugauuuuggcuuaacucugucgugagcagacuuggcuuuaguccacaugggcccuucagucuccaggugaccagccauauuuucacagagugaagcaaaaaucuaauccuaaacuuacaguuugguacaacgucauuucuauauguaugugcauguguaggcauguguguacuuauguacauaugaaugugaguucauguguguauguugauaguacagugaucaaagacaguauguuugcuuuauuccaagaagcugaaagaagugucacaagagaagaaggaucuuaguuuuagaugauuucuuucguccugugugcuuaugugggacauaaugauuagaauaugaauuggaggaggccauucaucucauaguugacaggaaccagauaauacagaaggcagugauaauuagguauaccuucccaaugcaugcccugcuguugacaucuacugccaucuaaaucuuauaauaccuuucaaaauagcaccucuacauaugagucaaggauagaauacaugagucuaugggggcacauuucauauucaaaucauaguaccccaugcaugcauacaacugaacaauguuuccagccccaaguugcgccucuuaauugagacagcuaucaacauauuacagaggauguagguacauggaggaggaaaugugcuuggacacuuuuccccaauauaucuuaccuggaaauguuucaccugugcaagcaauggcucaguggacaaaccagaaaucuuugguggguagcacauagaaaagucuuagcaagaccuuucuuucuuaguguguuuauugcagaugagauuuaacuaugguaauaguuauuauccugaauauaaauaugugccagugcaguugaccuagguuucagaauguccuagaacaaauaaaggucaauuguuucuggugaagaucuagacuuauaaggguguuucaguuugaaaaugaccgaucugaaaauauagaggcaguagcugaccuaguaacauccugcuguaaaaauaguucuaguuauucaagggagugugaugcauucacauaugcagaacaagugugaaagaguugcucucugaaacccacaacacuauuaauaucuuacacucaugauaccucuuuuguuuagcaucucaaaagugccuuauaacugucauuucaaaaugccuuggggaauaauaaauaugcaucuuugugguccccauuucgucacagaucuuaguauucaagggucgugggagaucguuauggguugcucaacucauuuugcugacuucgcccaagauuuuguuuacauuuaguauaagguauaugccucccugacucauccaguuauuggagugucacauuugaagcccugaacguacucaucauauggacuagauagaaaugagacuuaaaugugggcaaauuuuucuagccacagauauaacuguaggcaaguuuuugcugaaaaaaacaaacaaaacaaaacaaaacaaaacagaaaaagaauuauucuuggcuuuagaaacuaucuugagcuuugcuauggauauuuuuccacuuacuagucuguguaaguaaaauuugugaagcacuuugugcugggaaaagccuuauccauauaauucuguuauaaagauaucccugauucuauugucauuucuacuuucaauugauacaauccacagugcagagagaugaaggagcuugcucucauugauccaugugaggcugucagaaaguaagggaccaggaagcaagaaguguggcuuuagaaaaggccuugccuuucagcccuugggguuuuaccucuuauguugaaaauccccauuuuaccauuaagaggcuuugccucacaaauguccacugaaaucaguguauugcucaauguaccaccugaccuuccuccucucaugcuauccaguaggaaagcaaaugucccagaacaggaugucuaaaggcccagagaguccauuccagcaagaagaagggaccuacauuacauaaauauagauucagaaugggaaccaacaaacugagaaucuucacaagcauuugugaagccuuucacaccaagggcuaaacuuuuaaaacacacacagaaaaagaugguuuucaagcccaagagagcaagaauucauucacacaacucuagaaauuuaaaaaaaaaaucauuauaaugcugugauuggugacaacagaagguacugaccaacagaaauaaauaauagacuucugguuaaagaugacaaauugaguagaaagccugccacauucaagauaaagugaaauuaaaagaguagagcaugaacucaucagaauggugaugcaguaacccaaacaaaacccaaagaugcagugguugugcagcacuggucuuggcagcugugaaaagacagaacuggcaguucagaacugggaagcaccaggaccgcgcugcagaaggccacagggguucagaggugauggcauaaauggggagugaaagugaauagccucagggucaauaguugaaaaucucucuaagaaacaaauagacccuucccuccaucauaaguuaacccuccacagauugauuauugaaaauaaaguaugguauugagcaagggaguccaaaagacuccuaaaacaauguagguugucccacagaaguucaaguuccuauuguugaaaccaccaugcauuacagacaugaaacgcaaaggauuugagcuggauaagaccugaaagccucaaaaggaagagggaacagaaacucggaaaaagaagaaaauguacagaaaaacuaauuccaagaggcgagauguuuuaaugguaaaacaagaaggggacacaacaaaacaggaauguuccugagagugaaacuccaguguuagaaauaagaaacuuacuggaaaaugaagacaugcaaaagauaguuauuuguugagcacauauuuauuaagcaccuucuuuaaugugggaacagacaucguucauucuaggaacacuacaguaaacaagcaaaugaacaaacaaacaaauaaauaaauaucaaugcuuuuuaucauagggaaucacuucccuugaucccuuuaucuguuuuuccaaauuucauucuuuuuuuuuucuaguaagaaagaguguuaauccaucuagugcugaguucuuggcuacugcacgucugcagggagccacccuugaacccuucccaauagcacuaauucucuugcauuuucaaucucuuccacuauaugauauuuuugccaucucaaaacucagaacuaaucaaaacaugaaaaguguaaacucucuuucugacugccuuucucauggaaauucucuguuuacucuaacauuuuauagucaaccuucccaaaaaugguguggugugguccuucaucagcuccugucuuacccaugcccucugucugccuuccccugccauccacuacugauacuuuuuaagaucaucaaugucuuccauguuggaaauauucacaaauauuuuauuuguaaaacguguucuaaaucaucuugauucauuuaggauacuauaacaaauauuuuagaguggguaacuuaaaaaacaaaaacaaaaaacagccuaauuauauuggucacaguugugcaggcugggaagucaaagauuacaucagugaaugugguauauaugaguguuuuuuuuuuuuuuuucugcuuccaaggugauaccuucuugcugcauuuuuauuuaauagaauaggcaaacuaguuuccucuggccucuuuuauaaggugcuaauucaugcacaaggcagauagaacccucauuaccuaaucaccucuuuuucguuguuguuguuguuuuucaagacaggguuucucuauauaucucuggcuguucuggagcucacucuaaaccaggcuggccucgaacucagaaaucugccugccucugccucccaggugcugggauuaaaggcauguacuaccacuguccagccccuaaucaccuccuuaauaucccuuuuaaaaauuguagcggagacaacauucuacauaugaacuugggaugggacauaacauaaggagacaucauuguuauuaaacacauaggcccuggugggcgaucaagcaugugcagacaccaaugcacacuaaaaaucuuaaaagaggaggacuaaagcuuagccaugaaggauacuuguuaucugccauuuuaguggaggaggauaaauauaucuguuuauaauagcacaaaaguaggagaaaauagggaaguuguaaacugucaaaagaaauagaguguaucaaggaggugguaguucacaguguacaauggugaaaggaauguguuagucagauuuccauuaccaucacaaaauaucuaaaauuagcaacuuaaugaagaggaaauguuauuuggcucccagguuugaaggcuuuccccaagguauaauggccuguugcuuuggagccuguagcuaggcaaagcaucaugcuuggagugccugaugggggucaguuaagaaaagagacacaggaagaggucauggucacaguauacuguugaagggacugaucccaaugacugaucuuccuugaagccucgccuuuuaaagcagcaguucuccaccuguggguuacaaacuguuugaggguuacauaucauauauucugcauaucagauauuuacauuacaauucauaacaauagcaaaauuacagcuauaaagcaacaucaaaauaauuucaugguuggaggucaacacaacaugaggaacuguauuuaaaaguuacagcacuaagaaggaugagaaucauuguuugaaaggucucacuaucuuccaauagcauugugaguugauagccagucuaacacaugggcuuuggggaacauuuauccagccaauacaagacaagacaaacucuuuaaguauguuuuaauauaaagccauuguauaugacaacauggaagauauugaugaucuuaacaaaaaauaucaguaguggauggcagggcaaggcagauagagggcuugaggaggacaggagcugaugaaggaccacaccacaccauguugacuauaaaauguuagagaagacauuuuccaugagaaaagcagucagguaaaagagaguuuacacuuuucauguuuugauuaguucugaguuuugagauggcaaaaauaccauauaacagaagagauugaacaugcaagagaagcagggcuauuaggaagggucaaggguggcucccugcagacaugcaguagccaagaacucagcacuguguggagauuaacacucuuucucacugaaaaaaaaaauuaccauauacccaggggcccuacaaacuuacugaaguccauaggucuauuugugcuagaaacuuaagccugguaacuugagagcaugauucugaauaauaaugccugauaauguacagaucugugucgugagucacaugauaaacuuaucuucacuuucuuccuaggagcugaugaagacauagagaguccaguucugacaacaucccaacugauuccaagaaucccacucacuagugcugcuucccccaaaguggaaaccaugacguugaagacacaaagcauuacaccugcucagacugaggugcauugucuggcauugugaauacugcugucuuuugccuacacagaacuguuuucugugagagaagccccacauaaaauuauaugagggcuaauaacccuuccacuguauugcuguaaauggcucuuugcucuuucuuccaacauuuuacaguugaucugcuugcgguuuuuaucagcuaggacuaucuucuuuagggauauacuguuuugaaaauggcacuuuuccuugcagaacuucuguagcccaguuacaagacgaacuauuaagcuacuuagcugagaguccgauuuucuuuuccucauguuaaaaaaacauuguaaacuugacauccauuggaccagguuaaggagggaugauaugaaucuuuccuuaaggucucaaugaguguccacacccaccaucaguguugcauacacuugcccuacucucagauacauguguaccugguguagcugcauuuauuuguugugagaccuuaauaagaaugagaccuuggacuugaaacagggaaaacaccuaaguaaugaaaacacugaauuuaugcuuugauuuuguuaguauuauauuacaauuagcuagccuuccacuuauagauacacuguuuaauauggaaauuggauauuagaauccagugaaggccuaagcauugacuccuggaucuagucaaauuucuuggaucauuagaaagauuggaugugaauauuacauagcaggcaccugagcucuuguuccuuguuucacuguguaagcauuaguugaauuugguggagcagaugagaucaagccaguucaccaagugagcauguguaauaauuuagugguagacuuuacacacauuagggauggcauguugcuuaugaaaacuuaacaacacaagcaccuguuuuuucaguucacccaucuguugauuuacaaauaagaugcugccaagcucuugcagcaugcagguuuuguggcaggcuuugugggauaaaaagcaccccuguguuagcaggaacauaggcaggcuuuucuuaguagaauaucuguuccuccacuuucuugauuuuccugacucaugaguccaucaagucauagcacauaacucccuguugacaaagcucccugcagacaugcaguagccaagagcucagcucuguguggauuaacacucucucuaggcuuacaaagcauuggcacuauugccagcagugccauuccacagccaggaaccagaaaggcaaggagauacucugagagcacuggggcagacauaccuagcauuuccugggagcuguuccauugguuucuaaguugaauuaauaaaacagaugaggaaaggagagacaaaaagcagcaggugcuuuuggugauagaaucgcugaauaugucagagcaggcagguaugccagaauuaaaugaagcuuguggaaagccuguggaaagaugagcuuggucucucccacaguuuuaugugaucuuuuauaacaauguuuucaacucaaugaccguuaagacucaauauugcagagucagaaacucucuugguaaaguuuuggcuuccaaucuucaauaguuuuauucuaaacaaaccguuguuugguauaaauuuauggacuaaugacaaauauggauugaaaauugauuuaaguuuauagaaauuggcccuaaaacauaaugaauuggccuuugcuaacagacauuucguggaugaguuaagaaauuaaagaucucugaacauuuuaaugcaaauauuuuauuuuuaguucuauuuaaugagaugacaagaauucauccauucaugggaguucuauucagugugcaucaaacauuguucuagguguccaugaugaagauauugauaaugaauaacacuagcagcaauguaauuuucuguuuuauacuuaugugguacggcuagauuaaaccuugccauuagagaaaauuuuguguuuuaauaggucccagaguggcauuacugucauggguauagauagucuauccacuguguuguacagcuaugugacugaagaauagaaagagaccuuucuucauuuugugaagccuaguuuuuuucacagccucuagaauccagucauggauucaauaaacuuucaauuggcuucauucaauuaugugugcucccuuuucauaauuacacaaagcaccuugaggcuuauguacugacugaacacucuucuaagugccauuucuguggagagccuucuagaucaucacuugaauuaauucuuuuguguccuuauucagaaguugagucgaagggaacugagcaagucaacucuuaaaugacuuuagggacuuaaaauauuaacaaguaaaaccuuguagcuuaucuuaauaauaaagauaauaagcauuacauaaacuuggggucaaagcuucaguaucuuucucacuugcuaguuuucacucacaucuuucccuggaugcaaauggguaucauuccauuccuugauuuuuuuccucuucccuuugcuaauuucuaaaagcauagcaaccaaagcaaugcuaaugagcaagaaagcaugugcuuccuugaugaggacucaauaagccauucugcugcccuuucugccagauaaccaguuacugauggcaauccuauaagaagaaaauggaaagaaccuacaaaauacugccaacaggcuucucucaucugcauuacuugggcacagcaagacuuaaaggaccaaccauguuuucuauacucagacagaaaacagugaaacuugaauuuauauuuauacaguuauaaaaauuauaauuauuuauagaaaauauggcagcuuaagauuuaugaaguauaggguuucuuguaucuugggaaaaaccucuaucacauguuauuacuguguuugguggaaaccuuguguguucugaucacuaaaaguaguaccaauugguucacauugaucucuagaguucaagugaauccaccuggucuagacugcggucuuuucuagacauaaagaugacuuugaaacaguccaagaaaaugaacuauuuucuuagaccuuuugccuucuuuaauaggauguauuccagccuucacaaaacagcugaaugauucacaugacucugcuuaagauggcugggaauucauaggaaaaacuggaauagguuuggcuagggaggagauucagugucuacugauuuuguagcugguauuguguaaaccugacaguagagguaucagagaggaaggagccucaguuaaggaauugccucuacaagauccagauauaaggcauuuucucaauucgugaucaaugaaggaggguguuccuaucccugggcuggugguccuggguucuauaaaaaaaagcaagcuaagcaagccagaggaaacaagucaguaagcagcacuacuccauaacuucuccaucagcuccugcugcuaggauccugccaaguuugaguaccuguccugacuuccuucaauaaugaauagcaauaugaaagugugagccaaaaacaaaacaaaaaacaaacaaaaaaaaaacaacaaaaaaaaaaaaacccuuucuccccaacuugcuuucuggucaugguguuuggccacagcaauagaaacccuaauaaagacacagcuuaagaguugacaauguuuuccuaucaguaguguuagccaaugagaaagaaacucaccuguuagaaaacagcagcucauuagaaucuuaacuuuucuaaaucaggccuucucaaaccacaccaucaucugagggacuuuaaauaacaauaaaaaucagcagaccaacugaacagaauacucaaaggguguguguguguguguguguguguguguguguguguguaucaguggagauuggcugccucauggaccuagaagucacuuagcaagcuggccagagccuuaagauucuaccaugcccccaacaccgugccuucaugugacuucaaggggacaaacucagguucucaugcuugcaaacaagcaaguacuuuauugccagggaucuucccaacccagaaaguaaagauucuuagaauugucaacuaaaacaauuauucauaucauucuugucaucuuugcuucaaugauacuagaaccacaagcuacauggguccaaacugggacucaccaacuggcaaaauaaacaucauacacauuauuauucaugauauuuacuaaacuuacuuuuauggaaaaaaaccugggaauauacuuaguaucguuucuucuucccagcacguaucaaaagagagauaauuguguuuucuuucuuccccacaccagucaccugaagaaacugacaaggaggaaguugacauuucugaggcagaagagaagcugggcccugcuauaaaaagcacagauguguacacggagaaacauucagacaaucuguuuaaacggacagaaguucuagcaggugaguugcuaggagugucaagugggaaggaacuucaagaggccuuccugggauaggugacauucagaaagcuugcugcacauuacuggccuucaggaagcaaucuccaggcuuuuuauuucagaaugacaggugagaaguuaggacuacuuugucuauuuucuguuaacuccuccagucugucccucagccagccauugauaagaggcuaacaugggagacaauuucagguuacaguccaucauggcaaggacaucaaaauggcaggagcuugaaguaguaaauugacuaggcaaagaacuguugaguguggaggcagggugggagaugucggucagacagucauaauucaggugaucuuccaaguucaaaaccaacuucggagaaggaaaagguacaaaugcugcugcugcugcugacaugauaagaauuuugccucuaauugaaauucaccugaugaaaguacagguugagccucacugaccugagcaucugcaauauucuaaaccuccaaaacuuuuuaagaccugacaugaugccacaaauguccucaggaugugugccuauaacaggagcacacuacagaaacuuugucccaugaauagaauuauuuguuaacuuguguaagcuuuccuaugaacuauguguauaaaauauacguggaaauauaaauauauuuccuguuuagacuuguaucugaucccugauaacuuaauccauguauguaaauauuuaaaaaaaauccagagauggaaacacuccugguuccagauauuucugaaaagaaauagccacugaagucuguacugauauuuguuuuaaagaggaagaugcgcaagauuuaacaacauuuaauuuauacaaugcucuccucaaauugaagaauaaguagacaucugcaugcuuucuauauuuaaucuucuuuuuuaaaaaaaucuauuaugucauauuuugugcuuuuauugugauuagaagauuacacuauaaaaugcaagcaccaaacacaaguaucugaaaguguagaguuaggugaaguuacagcuggauuuuucuuauggaggcuuuguguugauacaaucaaugaaccuuucugaagaaugacuccugauuauucuguuuaaaacuugaguucuucccaaucacaaaagaacauauaugguaugcacucacugauaaguguauauuagcccagaaguuugaaauaaccaagauacaauucacagaccacauaaagcucaagaaggaagaucgaaguguagacacuuagguccguuuuagaaggggggggggucaaacaauuugcaaaacacaagaaaaucaagaggaaggaagaccaacauguugauacuucauuccucccuagaauagggaacaaaauacccauggaaggaguuucagagacaaaguuuggagcugguuuuaugugaaguuccuugauccacuuagauuugaccuuaguacaaggagauaaguauggauugggaaaggaucuuuaccuauccuaaaucagauaggggacuaauauccaacauauauaaagaaaucaagaagguggacuucagaaaaucaaauaaccccauuaaaaaauggggcucagaacugaacaaagaauucucaccugaggaauaccgaauggcagagaagcaccugaaaaaaauguucaacauccuuaaucaucagggaaaugcaaaucaaaacaacccugagauuccaucucacaccggucagaauggcuaagaucaaaaauucaggugacagcagaugcugguguggauguggagaaagaggaacacuccuccauuguuggugggauugcaggcuuguacaaccacucuggaaaucagucuggcgguuccucaggaaauuggacauaguacuaccggaggauccagcaauaccucuccugggcauauauccagaagaugccccaacugguaagaaggacacaugcuccacuauguucauagcagccuuauuuauaauagccagaagcuggaaagaacccagaugccccucaacagaggaauggauacagaaaaugugguacaucuacacaauggaguacuacucagcuauuaaaaagaaugaauuuaugaaauuacuagccaaauggauggaccuggagggcaucauccugagugagguaacacauucacaaaggaacucacacaauauguacucacugauaaguggauauuagccgaaaaccuaggauacccaagauguaagauacaauuuccuaaacacaugaaacucaagaaaaaugaagacugaaguguggacacuaugccccuccuuagaagugggaacaaaacacccuuggaaggaguuacagagacaaaguuuggagcugagaugaaaggaugguccauguagagacuuccauauccagggauccaccccauaaucagcauccaaacgcugacaccauugauuacacuagcaagauuuuaucgaaaggacccagauguagcugucucuugugagacuaugcuggggccuagcaaacacagaaguggaugcucacagucagcuaauggauggaucacagggcucccaauggaggagcuagagaaaguagccaaggagcuaaagggaucugcaacccuauaggcagaacaacauuaugaacuaaccaguaccccggagcucuugacucuagcugcauauguaucaaaagauggccuagucggccaucacuggaaagagaggcccauuggacacgcaaacuuuauaugccccaguacaggggaacgccagggccaaaaagggggaguggguggguaggggauuagggguggguggguaugggggacuuuugguauagcauuggaaauguaaaugagcuaaauaccuaauaaaaaaaugggaaaaacaaaaaacaacaacaacaaaaaaaaaaaaacaaaguuuggagcuaagacaaaaggauggaccauccagagacugccccaccuggggguccaucccauaaucagccaccaaaugcagacacuauugcauaugccagcaagauuuuugcugaaagaacccugauauagcugucucuugugaggcuaugccagugccuggcauauacagaagugggugcucacaaucaucuauaggauggaacauagggcccccaauggaggggcuagagaaaguacccaaagagcuaaggggggcugaaacccuauagguggaacaauauuaugaacuaaacaguacccccagagcucuugucuuuagcugcauauguagcagaagauggccuaaucggccaucuuugggaagagaggccccuuggucuugcaaacuuuauaugccccaguacaggggcacgccagggccaagaagugggaguggguggauaggggaccagugugcggggagcguauaggggacucuugggauagcguuugaaauguaaaugaauaaaauaucuaauaaaaaaauaaaaaaaaaagaagggggaucaaaauaccccugagaggagauacagaaaccagguuuggagcagaaacugaaggauagucuguccagugacugucccaccuagggauccaucccauauacaguuaccaaacccagacacuauuguggaugccaacaaucaauugcuggcaggaccugauauagcugucucaugagagguucugccagugucggacaaaugcagaaguggauguucacagccauccauuggauugagcacaggguucccaguggaggagcuagagaaaggacccaaagagcugaagggguuuauagcccaauaggaggaacaacaauaugaaccaaccaguacccccauagcuuccagggacuaaaccaccaaccaaagaguacacauggaaggacucaaggcuccagccgcauauguagcagagguuggccuugugagacaucaaugagaggagaaacccuugguuuuguuaaggcuauccaguguauccccaguguaggggaaugccaagacagggaagugggagucuguggguuagggagcaggggggagggcgaauggaugggugcagucgaauggggaaaugaggagaggggauaaaauuugaaauguaaguaaagaaaauauauaauaauuaaaaaaaaaaacuugaguucucaaaucauuuauaaaaauaucaauagguuggaacuggccaaacuaauuccugaaagccuugaccuucucuuuuucuucucuuaucucagccgucauugcugguggugugaucggcuuucucuuugccauuuuccucauccugcuauugguguaccgcaugcggaagaaagaugaaggaagcuacgaccuuggagaacgcaaaccauccagcgcagcuuaccagaaggcacccacuaaggaguuuuaugcauaaagcucccauuuagugucucuauuuaggagagcacugaacuuuucaaaauaaagcuuuggcauagaauaaugaagaucuuuguuaucuguuuuguucauuacagagccauacuggcccuuuaaugaugagaauuccauuguauuuaaauuuuuucguguauuucuuuagaaugacauaaaaguaaaaaucuaacaucugcaguguucugugaauagcaguggcaaaauauuauguuaugaaaaccccugacauucauggaauugauuugaacaucuaugugcaaauacaaaaugauuguguuuguccucugguucaaagaugacugcuacucccccuugucagcaagucuccaguuaaccuuacugaguuggucuucauuuauuuaucucuugucccucuucucuacccucccuucuugucaccuuucuuagaaacaaaaccuuaugccuuuuguagcugucauggugcaauuugucuuugaaugauuacaauaaugguaauuuaguguauaugugauuuuucucaaauauguuaaccuuaaccuccacuuuauauaauguuuuuaaauaucagacuauccauuuuaugcuugcuuuaaauuucauuacuuguagcuucaggcagauuugcaaaggcaaauuaauguguaaaauuggauuauuacuacgaaacuguuuaguccuagcuaucuucuuuugggaggauuugacauaacggacaagccucagcaaacccaaagaugcuaacaguauuuugagaaguugcugcagauuccucuggccacuguacuuguuaauuucuugucauuugaagguacgagaaagaguuuaaagaaaaaaaaaaaagaucaguuuuuguucuuaacaugcauuuaaauugcaaacaucuuuuuaagccuuugaagugccuaugauucuauguaacuuguugcggacugguguuaaugaguauauauaacaguuuuuaaaaaguugguauuuuauaagcacagacaauucuaaugguaacuuuuguagucuuaugaauagacauaaauuguaauuuggaaacaacaaaaaaaccugcugaauaaaucacauggccuaauauugaaaaugucacuguuauaaauuuuguacauuucuuaccaaauguacaucuccccuugcugugacugaccgucugcucucagugacuauauggguuugguuucugaguaucucauggugucugucaaucaagaccaaagaaccccucagugaggcuguuaauuacgagauuuaccucuaaauuguucagaggaaaaguauuguuauucugcauguauuugggugcaggaauaggaugacugccaggggauuucaagguuugcagccuuuguaguguagcuacugacaauauugagagagaugccuucuuuugcaauuuacucuuaaaaguauaaauuccaaagaagcaaagcgaccuuucuagaaguaggugucuggggaacagaccuauagaauugcuuaccugucaaagcuccccuacagaagaacccuguaagugacaaccacagccacuccaugggguaggagggaagguagggggcucugccuguugaaugacagccuggcugcuuaagauggauguuucuagaaaagguaaugccagaggaggaguuggaggcaugggggugccccgauuggguacucacugaacagagcauuuccuuuuuuuguucuguuuucuauuuuaccauuaguuuuuaguuuuaaacugugagccauggaaguagaaagaagacagcaagauccgcagcuuuuccagcauaaaauuaacuuuugauaaaguuuggcuacuucguuugagcaccuucccugagcuugucacagaacacauuuaaacaaaacuaaaguaacacuugaaacagugcugugucugaaucuuuaauggccuuaauucauaccuuucuguccaauuacagcuguaauucaccauguuaaaaggaaaugaugggcccuuccaaagcugcacaaugccccucaauuacggaggcugagaauguaguggguauaccucuaacugugugaaacaguggaauuuaauuuguagaauaacuugcuuggaauaucuaugccagggaaaaaaaaauccuggcaaauauuuugucacugcuguaaagcacauuuguuaaaagugccaaaauaaagucugucaugc

SEQ ID NO: 12526 - RNA, 6296 nt, Mus musculus
cagacagcgcggagcgcgguggcgucgacgucuagugucucagugcucccgucuguggcuaacuaagcagccagcagccaggcagcucgcgaccugcggccaggcagccaaccaugcucaacuucggcgcuucucuccagcaagcuucgguaaguuaccugaggaugcugguccuuuccugccggucaguguaggggagccagccggagcgcgaagcaugagccccuaaauaagccacgccugagaacccaggcugcagcggggucuugcaagggauuuccucccugcaggcuggaauaucaucgagggcaugugcaaaaaaaaaaaaaaaaaaaaaaaaaaaaaaaaagggucggaagaagccugggaccuggaccaggggagagcgauccuggguauccaggagacaaggaggacucucagggagaccccaggagacgagugagcuggaggggcugucucccuggaagcgcgguuuagauggagggggcgcccugcaccuggcucuggcgggagaugccccugucugcaccaggaaugcgacccggggugacaaggacuacucacggucugccuagccgagaggagggcgccugcucuucgggggagggggaaacccugccagguggagaccgcggggcugggcuagcccggggcugggggaggggauggccggcuucgcgcgggguauggaaggcacgcggacucugcggccgccaggggagccgcggcgcccccgcagacgucgggaggggacuccccauccgaggcggaggcagguggcugccuauagauuacucuuggcagggggcaggguccugccuuggagcccgacagcuuggcgggggagucgggaccgcgagacgcgggggccgcgugucgaggcgggaaccguggggccgcgcgccuggagcccgugcugugggcgccgcacgucugggagccugcagagacugcuugcgggggcucaggcugccggaaacagcagucggacgaaugcugcagaugcggguaggcugaggucccgcgggccgagugggcggagugccccaggcuccggccgcuccccggaggcggcgagcaggaggagggcggcggucgggcuuccgcggggacccggccccaccucccgcagccgaggcggaggccagggaugggcggcgaacgggugcacccggggagcuucucguccccgagugacccagccccggccuccgccaggggcgggaacgaggcccggcccugcugucgguuccuaagggaaccgcggcucggaggagguggaaggggcgggcgacucgggagccgacaccgcccagcccucgcgccgcccggcgcgcacuggcgagcgguuggcggcggcgcccgcggccccuccccggccgagcgggggcgggggcccgugcucaggaaguaggggaaaggugacggcgcggcaauucccaguucacguuuccugcgccgcccggagcagucgcugaucacgcuuuguucacaugccucgcccccuccuccucgcgcccccacccugcccgcccagccaauccggacgcgggccgcgggccggccggccaauggcaggggcggggcgcggggacgugcgcgcggcgggcaguguucccggugacucacccgccagccucauugagguuagggcggccccaucggucgguccccgccagcgaggaucucccccgccggccucccgcgccccgccccgccccgccccgccucgcuucugccuccacccggcuucccuuuccugccucgcaccagcucuucgcucccucccggcuuccccucccggcucacauucuucaccccuggcugccuuuuuucccaccccucuuucuuugaguuggugacuauaggcuuuuuacacuuacagucuucauccauugcagcuuacauaaaggcgcgaacgauuaugcaauuacauuguuagugauguuucaagaaccgugucuuguuuucccacacucagcaggaagauaggcauuuuuagaaaagcguuaagauuaucauugccauuuuauuuauguauuagguuuuugcuuugucuuuaugaguucaggcuggcccugaacuaguuauauagccagaguuggccuggagccuuauauuccaggcucccccacuuuaugaggcuuuucauaauuuuugcaaccucuacuuuaaccagaagaauuuggaaguucuuuuuaagaggaaaguagagaugguuggugauucuuuugaaauucaggucauggaacuuuuaaugugagacauuaggucgaagguguugcacacagagcaugaucgguuaucaaaucauguuuuaauuaaauuaaaaccaacuuguacucgggguuuuuuguuuguuuguuuuugcauaucccaagaacauauuuuaugccugucuggucccuuaugguacagaaaagcauuguguuuaauaaaucugauaaaaaucauagauauuaagagauugagacuugaccaaaauaaaauauuuuuuuccucuuugguugcuuuguguguuuugcauuuugagaugcaacuuccaacuucuuggccuccacauuccugagauuauacauguaucccaccaugccuggcuguauuuguguguguccacuuauuuuacucaaucuccaccguaugugaugaaguuaccaauuucagacuuuagguaacuagauaccacuuuaaccuggaaguaguuuaagucaaauuacauuuuaagacauucgucuuaauucccuuacugguaauaagguggccuuuaaccuugaaauaaaauagcaagcauugggcauuccugcgguuuggauaaccagauaacugauuagcuucaacuuuuguuuuuguaggaggggaaaauggaacuaauuucugaaaagcccagagaggggaugcaucccugggacaaagcugagcagagugacuuugaagcgguggaagcgcucauguccaugagcugcgacuggaagucucauuucaagaaauaccuugaaaacaggccugucacaccagugucugauaccuccgaggaugacagcuugcuuccagggacgccugaccuucagacagucccagcauuuguaaguauuuucaguggguagaagugacagcauuuuuuaagaguuuacauaauggaccucuaauuccucuccuugcuuguguuuguauuuguaguguuuaacgccaccuuacagccccucugacuucgaacccucccaagggucaaaucugacugcaucagcgccaucuacuggccacuucaaaucuuucuccgaugcugccaagccuccaggcgccacuccuuucaaagaggaggaaaagaauccuuuagcugccccuccucuuccuaaggcucaagccaccagugucauccgucacacagcugaugcccaacugugcaaccaccaguccugccccgugaaagcagcuagcauccucaacuaucaggacaauucuuuccggagaagaacccacggaaauguugaggcuacucgaaagaacauacccugugcugcagugucaccaaacagauccaagccugagcccagcacaguguccgauggugaugagaaggcgggcgcugcacuauaugacuuugcugugccuuccucagagacaguaauuuguaggucucagccagcuccuucguccccagugcagaagucaguacuggugucuucaccuacaguauccacugggggagugccaccccugccugucaucugccagaugguuccccuuccugccaacaacucucuuguuagcacaguuguccccagcacuccuccuagccagccaccagcugucugcucaccuguguuguucaugggcacucaggugccugagggcaccgucguguuugugguaccccagcccguugugcagagcccaaggccuccaguggugagccccaguggcaccagacugucucccauugccccugcuccuggauucucuccuucagcagcaagggucacuccucagauugacucguccagaguaagaagucacaucuguagccacccaggguguggcaagacuuacuuuaaaaguucccaucugaaggcccacgugaggacacacacagguacugaccgagugggcucugucuuugaaguggguguguauguggaguuagacuguggacacaaaugcaagggagggugagguagaugacucauugucuuuaaaauuagucaguuugucccuaggccuggugccacacccuuguaaucccagcacuugggaauuggaggcagaggaagcagcacaucugguaauauauacaugauauauauguauuuauuacauuauuuauucaggcgggguuucuuugugcagcccuggcuacccuggaacucagucuguagaccaggcugaucuugaacucagauuucuuucugccucuaucuccagagugcugggauuaaaggugugaaccauggcgccaagcuuugauaauuuaugaacugaccagcuuucaauuuuaaacucugugcgucaauguauaguaaccaucuggcuuucuuugcuucaggggaaaaaccuuucagcugcagcuggaaaggcugugaaaggagguuugcucgcuccgaugaacuguccagacaccggcggacacacacaggugagaagaaguuugccugucccaugugugaccgucgguuuaugaggagcgaccauuuaaccaagcaugcccgacgccaccuaucagccaagaagcugccaaacuggcaaauggaaguuagcaaguuaaaugacauugcucugccuccgaccccugcuuccgcacagugacggccagaagauggagacgcagaauaaacuuuggucagagucaggagccagugauggugucaagugcuucugcaaggcuguggcccuccaaaagggccuaaaguagaagcccuggccugggggaggccccgccugggugaaaugacaagaagugcuucagccacaggcaggucacagaggacagggcucaguucuuaccacagagagagaggagaacccuuuuauuccucccuuauuuuagucuggaaaguuucggcugaggugagcgcagcacagguuuugaaucacauacacauuggggacuuuguuuuugccauuuauacuugagaccagcuuugcagugugauucuuucaaaggauugguuucaagaauauagaggcuggaaauuacgguacagaaauggagcuagaaaaugaguuuguguuacacagagaugucaucuucuccuagaguuaucuuguuucuuauuccuagucuuuccagucaaauccguggauguagcuaaguauaucuaaaacucauuuuuccacuauuguugguauuugaaguugaacagcuguacauugcugugggggagccaaaggauuggaacccucauuaauuuaauugcuuggaaaugcagcuaaaauucuucuuuggcauuuuguuuugaaaguuuaggcauuuuacucuacuuuagauuuuaguuugcuugcaguuuuuuguguagauuugaaaauuguauaccaauguguuuucuguaggcuuaaaauacacugcacuuuguuuagaaaaaaaucuggagaugaaaauauguauuauaaagaagagaugucaagaauuugagauaacuccuugagaaaguuggcuuuaugucaucagcaaaggacacuuaacgucaagcauacacugugguuuuuuuguuuuuuuguuuuuuuuuuucaaauuagaaaguuuaaugaccguuacagauggacagugucuuuuuauuuauaggaguuuuucaggaugucagaguagauagguaggaaaauuguuauuagaacauucgcuucuaccuugaaaaggauguuaauguggucauguucuuagcaccacagugucugggcaucugggaaacuccgagacuuuuuuaaagugucaugaugugaucacaccugcaguuuggggcaucgaauccagggccuugcaugucuucuguaagagcucucaucgcugaccuguaucccccgcaagagcaaugacuuuugcuaacaguauuucuuuucuguuguaaaguggacagaugauacacuuggucgcaaagguaaauuauucaaaauccacagugaaaaccucaccacacuuucccauuuaaacuauuuccauaucucagagguuucugacaugcaaacuugaacccuugaaagaagaguuuucuuaaaaauuauaaaaaaucacgaguuacaauuugcacaauauuuuuuguugaacuuuauaccuuguuuacaauaaagacuuuucuuugguauac

SEQ ID NO: 12527 - RNA, 277922 nt, Mus musculus
gcgcugucgugucgggaauggaauguguaaguguaacauucagaaccggguaacauucggcgaccgaacgcggcggucggcagugauagcgcggggccugcgaagcaccgcucggggccggcacugcccgcggggaggacgcgccgccgccgccgccccgcgccgccucgugccgccggccgggccgccgcgcgcccggggagccggccccgugagcgcaggaguaaacaccggcggagugugggagccgcugcagaagggaauaaagagacaugcagggauuugugagguuacggcgccccagcugcaagaugcacuagccggcugaagccggggcggauugacuuguuggaaccguagugcucugcaccggaguguggaugaguugaaguugcuuuccccgggcucguucuccacgccgccgagaggaauccgagcggagaggcagucacuucgucuugccauugauuggguaucgggagcuuuuucuucccugcucucuuucuuuuccuccgucuuguugcaugcaagaaaauuacaguccgcuguucgcccgcccugggugcgagaucuucugcccggcucucucccgugcauugugcagcccaaagaugaaagaccgaaggggagaaaguuaaagaaaucgcccacaugcgcuggaucaguccacggcuuggggaaaggcauccagagaaggugggagcggagaguuugaagucuuuacaggcgggaagauggcggacuggagcugaaaguguugauugggaaacuugggugauucuuguguuuauuuacaauccucuugacccaggcaggacacaugcaggccaaaaaacgcuauuucauccugcucucagcuggcucuugucucgcccuuuuguuuuauuuuggaggcgugcaguuuagggcaucgaggagccacagccggagagaagagcacaguggucggaauggcuugcaccagcccaguccggaucauuucuggccccgcuucccggacgcucugcgcccuuucuuuccuugggaucaauuggaaaacgaggauuccagcgugcacauuuccccccggcagaagcgagacgccaacucgagcaucuacaaaggcaagaagugccgcauggaguccugcuucgauuucacccuuugcaagaaaaacggcuucaaagucuacguguacccgcagcagaaaggggagaaaaucgccgaaaguuaccaaaacauucuagcggccaucgagggcuccagguucuacaccucggaccccagccaggcgugccucuuugucuugagucuggauacuuuagacagagaccaguuaucaccucaguaugugcacaauuugagauccaaagugcagagucuccacuuguggaacaaugguaggaaucauuuaauuuuuaauuuauauucuggcacuuggccugacuacacugaggacgugggguuugacaucggccaggcgaugcuggccaaagccagcaucaguacugaaaacuuccgaccaaacuuugauguuucuauuccccucuuuucuaaggaucaucccaggacaggaggggagaggggguuuuugaaauuuaacaccaucccuccucucaggaaguacaugcugguauucaaggggaagcgguaccugacagggauagggucagacaccaggaaugccuuauaucacguccauaacggggaggacgucuugcuccucaccaccugcaagcauggcaaagacuggcaaaagcacaaggauucucgcugugacagagacaacaccgaguaugagaagugaguaagggcugccucccuucgaggcucggcccugggcccuggauaccugaguccaggugggagggugggggaugcgggguggagacagaagcccucaguucuguugcuuccuugggauccagcggcuggguucaaguguguggggugagcuugggcuucucaggcaaacucgacaagaguacucucuccagucaaguuggugaagaagggaaucuuccugauacuuugaaaaccauucaggacccaugugucuuuggcgcauuaugggggcucggauccaaguuuuggaaaggguacuaaaggguauuugugacgacucagagagacacauguucuacgcaaguccacagacucugaccccugggcuuugucuguuucucucaagaacauggguaccuguucucugugcaguuggcuaggcuuaaauuugcaccuuccccccuaagcuuuagauucuugauuccuagaauauuuucauuuuuaccuucccaacuugugacugccucuuacuuccucuacagcacugauguuuaugaaggguagaguguaagcugguuagggucauucauucauucauucauuccuauaagcccucucuuucuuggggaaacuuuaaaaucugggccucaggcccacugcagugaacuacccuuacuaauuuagauuucccuuucuucuuugucuuuaucuauuugcauauaaauguggacuguuacucuuugaaugggcuugagaugccuccuuagccucuguggaggggagaguuuuguuuaguugcuaaguaacugaguugguuacuuuguagccccuuucagucuuccuuuuccucgucuuucacagucgcugacacacaggauuucaggucaaaguuagaauccacaaaucugcuugaaaccgaggcuggccuguggguccaucggucagcuuccugauagcugaggucagugccccagacucacuuguguccggcugggaaagagugagcgccuauggugcauuuccacuuuacgccaguuaaaaaccagagcagccuugugcuagcuacccagggaaggaaggagaaaccucucagcugaguacaagaggaacuggcagagguuggcagauugugcaauugauucaugaaaugcagaauaggggaaaaggcuuccagaugggguuggaucaggaagggguggggguggggguaaccgggcccugaaaugaaaggugugauuauuuauuguccauggauucccucagacucucuggucuuggugggagugauuggaugggauaguaaaguccuccccgacuugaucauagaagggagaggaaauaucaagccuggggcuucugcuucugagccccuuggacguuuuccguuucaauccugggaaaagccugaggccaggaucaauugugaauccaucguuccuuuccucuuacacacggaaguucugcgugaauguugaguguuguugugacagaguaaaaauacucuuuaacuguggucagaaagaaacugcuuuguugaaaggacaauauacuuugauagauucugggggugcuugugccuucuaggaauuucuuuggcuggcgugaagaggcugaucuuuugauggcuucuaaagcaaucucuccaagcuuuauagaaagaucaugacguucuucauucggaaagagcggauguuccuuguguguucgacccccccacccccaccccagaugccaauucuuuacauuuucuauggaaaacuuuuguuuucuagagagcggagauggagaaaggugugguugauuggcuucggagcaacuuuguuuugcuaauugaauguaauuaauuuuucaccuuucgguccuugggccaagaaaucugacacccuccaccucuucuugauuuaaguuuaaagaccaccugggacggggccucaggaucgucucuguuugggacuguggcauccagaaagaaaacaaguuuacuauucuccugagcaggguuuuucagggcuuucuguuuccuuuuacaaucccgcuagcucugauuuuguuuacuaggauguguuaguagugcagacuggaacuccuagagauuuaacuccuuacccaucuuggauugucagaauuguuuacucacaaauauugcuggguguuuguuugcuuuugacuuuggaauacacaggguggaaauaagaaugcaggaaucuggaagccgugacuauacaccaggcuacaccgaugcugcacucggaaguaaagggcaaugcagaauuccucagccacacugaggcuaaccacaccagacccuuggagaugagaugcugaagucagaucuguggaagugguccuuccuggagucaucucugaguugauuuuuacccaggguuuaagcaguuuccgagguguucuaggcauucauuugguaauggcuuguaaagacgagaucaauuuucaucuacuucucuucugcauuagcaaguaccuaugaaaagguuucaacuuaauuugccucggcaagcaaccugguauggguuugcuggggacaccggaucugauaauuagauuggaaauuuauagccccuuggucaaguuaggcuacuagaagaacauaagcagauacuucaacuccaagauaucgugaugguguguaauguuguaggucucaagggaagugucccacuggugauuuugugaaaagcacaugaaugucaccggugcagaacagcuggguggcaugaaugggaauuacuuuugcucuagagaaaaaguuccugcaaacuuugauccagcuucucaauuacauuaaauaucauuuuuuuucauagugcacauaauuuuuacuaguuacauaucuuuuucauuuuaauuuuuucacuuuauuucauuucucacuguccuggaaggagcucuguagaacaggcuggccuucaacucagggauccaccuaucucggccuccggaguacugggauuaaagguuugagccaccacaucuggcuuucaguuacucauuauaaccgguguaguuggcaccagccgaacugagucacugcugggauuuggugaucuggagugagaccuucgagaaauucacuccauuuuagugcuuuuggccucucaggcauccugacaugacgacuacuuugcaugaacaucacagguucgauaccuuuggaggucauuauuagggaacuucaaguuuggcuaucucaaacagaaggaagagaagguagugagagguguccugaaccuuuggcccuuccaaggaaagcagggugauucuuucaaagcagcuuuucugagagcagucaaaagacuaucaagauugucagacccuuuucuguuugcuaaagcuguacuguacugggguuuuuaaaacaaaacaaaacauuucuuuagugcgugugugcgcaugcgugaaggucagaggccaaccuggagucaguucuccucuuucaccaaguggggucuggguaucaaaugcgcauccuuacguaggaugggcccucuuccccagugucaccucaucagccccagacauguacuguuuaaggaugguugaucauuuagcuucuagcacucgcuuuucgggaggaacaguuggaacucugauguguuuuaguaguaguuccagaaagcaggccuuuggaaucuuugauuagucagcguuccuuucauuucucauugcgaacacucuggaagcgcucagccucuaggacaucccauuuggugcugcugguguuucuacaacuugaugacaacuuuucaaagguggcuggcaggcauugaaaaaaaaugucaacuaguuuagagcugauguagcccuuugaagggacaugcuuagagucuugcgugagguucacgguucccuuuuauuguugauaaaaauaauaaguggguguguucccaaaacugcuuaguguaacucauucuuucuauuuauuuauuuauuuauuuauuuaauugagccuuucuuucccuuuggccuuaagaguugcgggaacagauggaauugaccaaauaaguuggauguagaugccauugcagaggagggcgacugugcuuaagacaagucauaguacgaaagggcuuuuucucucuuuccuccauuauccucaacugguuucaccgacacuuggagcacguuccucaccugggccugacucuuuggugaauguuuuccucuucugaagggaaaggcagaaaccguaagguccagccuccaaauguaaaauauuagcaccuuucuccccguaauugugugauggcccaaaaguguugcuaaaguagcccacagaugggaaaucaaaguaauaguccugugccgagcuaugaaguugacacgugugucuucugccagcgcaguuccccgucucccugaaccugcuuucugcagagagccccugaaagcucaacucacaagaaauucgggugcuacuuggagggauauuugcgagucgaaugaguccagaguaggaaauguugaaagguacuguuacuugagauauggguuuaaaggauuuuacuaugcuuaauucgugacaagcugcuaagauuuggacggaucccucugaaagggggccaccuuugguucucuugauaccguuugggcgacacagaagugaucaaaggagacgccauaccccgaggugcuugugguuugcuccguauccuggaagaucuacugucacagaauaggauuccagaaaauucugugagugacuucgugucagugucuuaucaaagguuuggcuggguagggccuggcugcauuucucucagcuaaccugcagcgugucuuguuagugcaucguaguguguaagcugaagccagaggugcugaggcagcguguccaaggcuucccagcucguaaguggcagaacuugggcuguagcccaggcuuccuggcucccgguucucugucuucucacccuggccugcuacugcuuucugacacucagucaaaucaggucagauguaguggucauuggguucugcagucuucagacagaaacguggaacccccuccuugauugaacguaauaacuaauuguuuuuauguaaggucucguuggucagauuugagcugugguuauaucagguguggauauaucagaugucucuuucaucgcuuugcggauuucccaaggaaaggcuuuagcuugugcaugugguaguaggaccucaguccugacauuucaacuuagaacuacucgaagggacgauucgugaacauuuccaucugaccugcauagauucugcuuuucaguaucuccuugucucuucaaggcaaacuuggccugcaccgaaguguccccugugugucugcuuucugggauuauacguggaccuccugggaugaugccccagguggcugugugauccaacagcauagaaaggcuuacugggagaguuugcugcuggcuagggugcagcccagacguagagagcuuggugggcaagcucaugcuuaguagucccaagucaaaacuguuuguuuuuuuuuguuuuuuuuuauaguaauaaauaauuaauuuuaaguaaugcagguagggcuguggagauagcuuagcaagcacaaggacccgggucuggacucucagcacucaugugaaaaagccaacuaugguagugugcuuauaauuucagcacuggagagucagagacgggaggauucuuggagcuugcuggucacccagucuaguguaauugguucagagaguaacaguaagugacugaagaaggcuccugauguccacauugaccucugcccuccauaugcaucauacaagcuugaucucuguccacuguaugcacacgaacaccccugucauaauaccgacuccugggggaaauagagaagaugcaggauacagcaaggugguacuccacuucguuucuuaccccauuaggagagcugagccaugcucaaguuugauuuagcugccuaaccuuuauauuuguauuguuuuaucucugcauauccuaacacuuuguccagcuaugugaauuauuuagucagugguaaauaaaucuucauuguuuguccaagcugcccacgugucgaagcuagggcuaaaacauugggaaguguagcuccuggccugcugcugcguagcuccuggccugcugcugcuacucuguuuuuugaaaguuaaaguuagaaauaaaaaaaaaaaaauucugcggcuuguguguuugcaacaacucauuaaagguguaugcagaaauaaaaaaaagaaaaaaaaaaagaaaaaaaagaaaguuaaaguuagacccaaguguacauguaugcuuuucccuuuaacauuauuuaagaacauuuuacuguccuaccgaaaugaagugggacuuuuuuuuuuuuuuuuuuuugguuuuucgagacaggguuucacuguguagcccuggcuguccuggaaguuacuuuguagaccaggcuggccuugaacucagaaauccgccugccucugccucccaagugcugggauuaaaggcgucugccaccacugccuugcaugaaguggggcuuuuaaacacacuauuuuuuuuaaugcacagcuguaucauagauuaacuauaugugcacacacauauuuauuuauuuauuuauuuauuuauuuuggaggguaaauuucaccagagugccugguucuugcucagggucucuuucaaaaacaaccaaggauuuaugugcccuucccccacucuucaucccacuggaguuuuuaaggugaggcugagcacccaguuagggaaguagcugucauuaaaugacagcuuagauaaacauuguaggugguaauuggugcugcagggggucuuugaagcuucaggcucuguucccuuugaaguuuuguuuuggcuccggccaaaaaccucucuggucucuuuaacugugcuggcagccauauagacuucucuugacagacacagugcuugcuuucuggggaucucagggucuguugacccaaccuggggaucucggcccuuuuucuagcaucuucuaucagucaggccuuuacuucuguuuucccuuugauuguggacucugugauccaugggaggugaguuuggacagcuuuuuuauaucuggaccgccaaauaaggaauucuuacaccuaguguaucguucuaaguaccuuuaaaaccaggcacaaaacaguuaauguccaguccagccuuugaaacuuuugggcaacauaacuccuuuugauggcacugagagauuugaagcaauauacacuugaguuuuccuuuguaccuuuuugucuuguguggagccuuagccuuaggaagcagagccugagauucucugacucauuuuuuaaccuuucagcuucaguuuuuguaucuggaaauggagauuagguuaccagccucacagggucauuaagaggaucaaaagagguggaguguaugugaauguaccuuguaaaugauaauauacucucuaggguggccguguuauuaaaaccaucuuccugucauggucuagucaacuguggaguggcucaguuaguuucauaacucugccuuuuaacugugccccugaaagaguucugcucaucucuucccugaaacugaauucccagguaaccgugggcuuaagugcucugguguuuaaucauugcccaguggaauguagaaagauauguguggaguuuucaggcuggagguggcagcgauugagagcagccucuggaguaacccagcauuuccuugaucccauguucucuguguucccugcaucaagaaugcaggcaaucuuuuucccauuuaccaauaccagcugaggacuacuuguggagagccacccuguaugaaugaaacugagccacuuaggaguuuccuggagcugguucuguuggguucuuaagcuacagugacaagcacacuaucucucaggccauguuuaguuacaggauuuauucuaaggggacaugggacagaaaccaaacuaaaaguguucugcuaaguuccuagcauacagugugauagcuggacagggugcuuuguuucugcucugaccagcucuucuguuucucuaugccugccaaccaucaucagugagucggucuugagugcuguuguccaugucuggggguggggguggguggggagggagggaacugagucugguugacuuuucuagagauugauccuugcuuuuguggagaggagccucucacagugaggccaugaauugagugugguggagaccugaucaauggagggauugaccugccacauugccacucuuaacaggugaacacauccuuuuucaaaaaaacauccuugaagucauuuccuggauuaggggacugugguuagagaaguuagccguggcagguacuuugaagccguauccugcugacccuuuugccugugaagccagaugauggcaacagccacuaggacuucuggaccuuguacugugugcaggcaguuggguuguugucuccucuuaaucuuuuugagcccuuaguaggaacggagcauuucuucuucacguuguaaaugaagaaacagaggcagagcgucuuuacauugaccuacacgagagcaugcggacuaugaaaauggagguguucugauuucuaggccugugcugucaaucauacagagcacccagugcuuuugaauaguccccacggcuagcaaggccaccacacgcucagcacuuuucggguguuugauugauggguggagucucacuugggcuuuucacccagaauugauuucaucagguuuagagaguguucgaaccauuucacggaucugauuucccagcucuaguggcuuuggagcagugcauuuaaagacaagauguuaguuggguucuugcaaauagagcugggaagauggggcagcugacaagacaaauacaaggaaggaggacagggaguuaugacacguagcacucagaagcaaagaagccuggcagguuaugaagagcuggcccggugcuccagagugugcccuccacauugcacagccugagccucugagugccuguaguaccuuaccugucacgcaguagaguuugguaaauauuugauaagcuacacugugguuauuguugacccgaggcaucauuuguguguacucaucuuuaauaaaguggaaaaacacugcauuucucuaacuugcuuaaucauaugggagauauagaaauguuuggacgaucuuaagaguaagcuguccuuuugaaaacuugucagccaagcuaaccugagcaccuugcuuacacgcucaagguacaggcauggaauugagaugcagagaaaggaaggacccaggagggaauguggagaccucuggccuauuuccuauaguuguccccaucagguauauugagguacaugauacccacacucuuagauagaugagaccugaugaacggaaggauagaauggauuccacccuguauucuguguagauuccagcacccuaagagcucaugauaggaucauaccucuauccucuuggaauuugucccagggcuucuugacucuguauggcugcugcugccucaguuuaauccccucugcaagaaauagccacacccuuccuccuccucccuuuuccagcaacuuucuggaaagugcuacccugcucuuucucaugacuacagucacuuccuggacuucuagucuguauuuucuuagagcauuucaugguuacuguagcuucguguuuccauuuauuugacugacuguuucucuuuuuuucaguaaauugcauaaaugcugaaggaaggaguccuggauccaguaauguuucuauuuuuaauuugcuuuaguucauccuuuuuucuuuuuuaaagaggaucagccucuucuuuuuuucuuuuugaaauauuuauuuauucauucauuuauuuauuuagugucuguggguacacugucgcugucuucagacacaccagaagagggcaucagaugcccauuacagaugguugugagccaccaugugguugcugggaauugaacucaggaccucuggaagagcagucagugcucuuaagcccuaagccaucucuccagccugaacacuuuagcuuaucuuaaucaauguacauaaaacaguuuugugccuaccauacgcauacacuauauaucagcagugacaugcacccccccucugaugucaugcagauggaaucgcauguuagaagaugccagauuucuuugaagaaaagcaacaucauaggcauugcaguagucccaugauaugguuguguacugggaucucauugcagcuucugucagugggucuugggugaaguuccagguuacugaaaagauuagccaggguuuuggaagcccagugaaaguaagacuaagagaugguuucaugcuuuuaaaaucuggauggaagaaagcuuccuugggaacauggcugggaacuuucccacaguaguucugaggcuggccagggugaagguugaaaggacaaucuuaggucugucuaccuugcuugaagcaguucucuaggcugcuugcugcugugugcccacugcuagguggcucuugaguuucugucucacauaggaggacugguauuagagacauauaauacugugucuguuugucuuuauuuguggacuggagauacaaauucaaauccucaggcuugcauagcaagcaccuagcuauuuccucaaccccaguccuaucaacuaaaaucaguuauuuuuaucgacccgccaagaacguugucacucucgaccauagguucaaaauaccaggucuguuaaaccucacugucuuugauuuauaaaguaggcuuuccagucucuccaccaacuucauuauguuauuuugcucauuuaccugguuucccuuuuuguuuucaaaggagaaauuucuuucaguauuuuuugaaagguacuuuuuccucuaaaaaaacaaaucaaaccaaaaccuguugcauugguaugagaaguagugaaaccaaaaucaaacgaagcaagaaggcuugaugcacucuagccuaagguauugaugcggaauaaaugaagagccauuaguuucccuuuaucauuuaauuguaauagucucuagcuacuagggacucccacauuuuuuauuuuuuaauaaacuguuauaaaauauaaacagauaaaaauaucacauacccaaauuaacuagaccuagagucuacacaacuuauggacuuacauacaguuacaaauggcauucggacugggagccauagggcucuguguuaaauuuagugcuuucaguaucacacauacuagaaaguccaugacagaauuagaacuagaaagaaaagcagcacugggcagugguggugcaugccuuuaauccuagcauuugggaggcagaggcaggcggauuucaaaguucaaggccagccuggucuacagagugaguuccagaacagccagggcuacacagagaaaccugucucgaacucccccccccccaaaaaaaaaacaaaaagcccagcagcuguaucuccucugucauaacgcguguucccccauuaccucagccagccuuuaucuccuuguguucagccuuucuuguucucuuuccuucauacugugccaaagguuuacaugugcauucauuuuauuggcuagauucuacauaugagagagaacauguaguuuguuuguuucugagauuucuuccccaauuuauuuacaguuucuuccauacccuucucagguuugguuggauaaaaauuuuggccuuuuuuuuuacaucuaagcugggcuaacugguacuugaaguauugcugcggagcacacaggaacaucaugcuuaauaaagcuuucaggcuucuaaugaauucauguggagauuuuucacucaauuaaaaagcacaggguggggugaggaagguguacuguuauuccuccugccggccucuauuuccugcguuuagacucugcuguggcucaugaggacccggaccagacaugcuguaucgcucacagaucgcaggguaucuagccuggacccgaugcacuguagugcaauuacuugaauucuuaguaggucuuaaaaacugacucagauuuggugacggucauaugacacuugauuaaguaugaauuauguuuuauggucuucugaagguuguaaaggcuauuuuccaaaauuauggcuagcucuguguaucugaagaaaucugaaaaucuaaucagagagggaucugacacuaaaaugcuuuugcuuugcugagaggcaaagaauaauuuucguguguuugugagagcaccauuucguauaugcuacaggcuccuuuaaaauucacaucacauuaagaaagcuaccuuuaagcagcauguuuuaugaugacuacauuuuuaagagugguguaauguggcaaaccuuuaaauuuagagaguggucuuuauugacucaaggaguagaaauguguauuuuuuuuuuggauuuggauuguagaguuacagugcuuugcuuuuuuuuuuuuuuuuuuuuuuuaaaugagcuguaguuauguuaugauaaaauuuaacuaccucacuucaggguuuagcacagguaauagauuccaguaguauuuugaugaauuuauuuuauauguugcccugucuaaggagagauucaaguaaggguaauaugggguugggggggggaggauuagaugccaaaauaaagauagauuucaguaacgaugagugaaacagucauuccgugugaguucaagaagggaagagcugaucuuaggaacaaugugagggcaacgucucuggauuuucuucuuuccccuagugagcuggugacccgggcagucggucugcauauuguacuugucugucugcaguuugggaguaugcgcugggggugggaguuuggggcacauaccccuuguuccucucugaauacuuggggucagaccuacuccuuuggaaagaugaacaggaagauuacagaagcagccuggcagaguugcaucaugggggucaccucagcacucaggagguggaggcaggaggaucagaagucuagagucaacuugggcuaaaaagcugcuccugguaauccuugcucccuccacaaucauggcaugguguaggugagaaauucgaggaccaggaaaguuggguaacucccguagcauggagacaguggcagaacacucaucucagcuuggagcucagaggcccccuuagggguauaaaaaugguguagugauuuuucagauagcagaacacgaggcagcagcaggccacuggcuugcccuucagcccagggcguuccuuguuaaucacuaccuucgucuagccaagcuccuauuaaguauuuuucuguccacaaggagcaagugugauguuaauuucagugguagguuccagagcgccugcauggagggucuucuuacagccucacccccaauguucccccauccuuccuaacuuuagggaugcaauaggcuuugugguuucuccuugugucauuaaggcccagcgacuucugggguuuaguuugccaguuaagggcucacuguucuuuugggccauuaaucuuuugacucugaauuacaauuuuuaaaguuauuaucuccucagacucaugcaccuucacgugggaagcugauucauuuuucucuggauuccagacgcucccucacaguguguuaauaugcuugauaagugcuuagcaaagguuauuauauuugacuagaugugugugugugugugugugugugugugugugaaagaguguugcugggguuugaacuuugggccuccugaaugagugcuuuacuacugaguuauauucugccuguaguauuucuuucuuuuuuuuuuuuuuuuaagugcagaaguuccugaaccaaaaggagauagauaagaauauagccagcucugggcuuaaaaaugccuauuuaaaggaagauggagagaugggucaguggcucagagcacuugcuacuccuacauaggaccuugguucaagucccagcacuuaccuaguaguucauacaugcacacgugcuggcaaacauacaugcauauaaaauaacauacaucuaaaaacagaaagcgugaagagaaaacaagucuuggcugauguuccaagcagccugagucugguugugcacaaggcagcucaugacugcacacauucaggcaggcuggccucaacucacagagauccuccugucauuccuuuccaaaugcugggaggaaaggaauucuccaguguacagacauuuuuuuaaauugauagagauauuuaaaauauuuuuagucugugucuuuuugcaaagaggccagaccccucuggccuggcuccuggugcaaaaaaauguucuggagagaccucuuuuccuaccauuugaccuaaauagauuuuaucaccaagcucuuuggauacuuucuccucugcuuguuaagcugcucauagcuuccaagggccacaccaugagaacaggaaugguguuuauuuguuuucugucaguuucccugguacugagccuauauugaauccugaagaaauauuuguuggaugaguaucuuuggucaugguggccuguuagugaagaaagacauauuuuagagcugauaugccugacuauuaauauauuuuuuugaauaaacaauucaagggauauugacucguaaaaguaaauuuagaagaaauuauuuuugcuccccugagcuucaauauaacaggaguaaaauuagagauuuaucaaagugagaugaugaccugcaguuuuaaaauaacuucagccuuuguuauuuuaacgacagguagagccuacuuuuggcccacagaauacuggauauagaagguguauuguucugugcugucuaagcugggcaauuagcccuuggucaggugcaccugacauugccucaaagccagccucuuugaguagcacacugaggaacacuccucuuguccuguugucuuuguaugucagcuugauauaaguuaggucguuucagaaaagggaaguucaacugagauaaacauccccuugaaaaagaccuguguccaagacuauauggcauucucuugauucugggagaguccagaccuuagugggcaauaagucuuggggcagcuuguccugggauguguaagaaaccaaacugaaaaagccaggagggacaaaccaguaagcaguuuuccucuguggccucugcuucaguuccugccucaagguuccugccuuaaugucuuucugugguggaccaugguguggagguguaacuaagccaaagcaacccuuuccuccccaaguugcuuuuggugguguuuaucacagcaauagaaaccuaacuaagacaaugguaaauccaugggggucugguggcgccguguguuccuguucauuucucugcugccuaucuuuguacuccuggguaagagugcuauauacucagugcuucagagaucuguagggacugggaagcucucagggacuccuccuugguagcaucaacagugcaugagggcucacagauagaauucugggcagucaucuccuagggcauggguuccacaagcuagucuuggguuccacugaauccuuagggcacuccaucauuuauacaugggcacuucuucccauuucugaaaggcacggguuuuguacauuuccucuuaggugugcuccagcaucaaggcugugcacagaagcccaucuuccugucagaugacuguacucccugguacuguuauuuuucuccgccuccucuuccuccucuuucucauucuccuauucuuuuuguaauucucccuuucuucuuucaagaacacacacacacacacacacacacacacaccccuaguuuaucccacauuuggucuccuacugcaguucaguuaagcucuucuagcaacuaagaauaguuccgcucagaguggagaguugauggcucacaccugaucucagcacuggagacugaagcaggaggaugacugugaguuuaaagccaucuugggcaaucgagugagauucuuuucucaaaggaaaaaaaaaauucagaaguuugauugauuuugaauugaauuuuugagagagagucauauaaagauuacagcauaacuuuggggaugcuguggggaaacagacggagaugacagcaccuacacagaagaaguuugggcuuacaggaaggaagucaugugauauguuucccaugagcacuuuggugcgucaguauauguucuuggccuagcacacugucaugagaaucaugugcauggucuuugggguaaagaucuugugauaguguaucaacuugcauucugcaucaacauauuuagcucucucguucucuuuugauagcugagaguuauuuuguugugaaaacagcacuuugauuauguuauaauugaguacaguugaugaauauuccuuacucgccucugauuuuuggagaccaauaaguacuuugaugguuucuguuugucuguuuuagcaaaaugaauucagggauguguaucuaugacuuaaaugcuacauuuucuguugcccauauuuauuaaauccuuuaaaggcugaaaagcuguaggaugugacuuuuuaaaauauaaaaacaggguaacauuucuuuucccauuuagccaaaaggccaaagucugauugucagacuguuagucuccuggagaaaaauaaagacaagcuuuccuugaggcaucgggacucuugugagacucggacuuguagagaguggcacuugggggaugaccccuucaacuccugugaguaaggguagaguuaggguugccagaccaggcccuggcuuucagguuacuuccugcagcgcccuuaaagugagcuuaguuucugucuugucacuagcaacuacacaucauaaugccacagaugaucucaaaucuaggaccugucaagagugguucguacugugacuggaucaaaagcaaacaacaacaacagcaacagcaaaagcagagagggaaaagguaagggaaggacccacauauuuuucuugugaggcucccuugcuguauguugaagcuuugcucucugauuagaacugaccguugaacagagaggauuuacaucuuuggggucaggaaggagcuucuagauuguagucucaguguucucuuuuucuggcucuccuuaggcacccccauccgauguguuuuuuuguuuuuguuuuuuuuuuuaaagcccuuaggcacccccauccgauguguuuuuuuguuuuuguuuuuuuuuuuaaagcccuuaggcacccccauccgauguguuuuuuuguuuuuguuuuuuuuuuuaaagcccuuaggcacccccauccgaugugguuuuuuuuuuuuuuuuuuuaaagcaugcuugauuuaaucagauggcagccacuguucaucagcaacccucugaggugagcagauaaagucagaacuacgcccaaauccuguauguauguauguaugcauguauguaccuacccaucuaucuaugacaguaucuaucuaucuaucuaucuaucuaucuaucuaucuaucuaucuacccaucuaucuaucuaucuaucuaucuaucuaucuaucuaucuaucuaucuacccaucuaucuaucuaucuaucuaucuaucuaucuaucuaucuaucuaucuacccaucuacccaucuaucuaucuaucuaucuaucuaucuaucuaucuaucuacccaucuaacuaucuaucuaucuaugacacaguuucuugccauguaguccugcuggguaugugaggcuggccuucaacuucucaugacucuccugucuuaccauuccaagugcugguaaugggcacacaugaucccauccaaugucuuucucucaacaacuuucccuaaauggcucauaaaggaccuauguaauuuuguaucagaugggcugugguucaguauaacacauugacuuuguauuuucuucucaccucuagacuuuauguucccaugaguguugguucuaguuuuccucaugcaagucaaugaaugaccuuguucagguaucccuugcugauuuccguuccugagaaauaagcuggggagugugcuccucccuuggcagcgcagagaagaaggcauucagcaguugcugguugauacauuuacuuucuaccugcuggcuuucaacaguauuaauuuuuauguacucauuguggauuguguuuaauuaaaagcaguucuauucacagaggcacuuguagguuuuuuuuuuuuucccugaaaugaauaaaacaaauaggcaucugguauuuguuuuguauaacacaauccccauaaaaugaagaguaauaaaacauaauuaucuguaaaggcuuguuuuauaagccugagaaugggcuuguuucuaucaggguuuucaauucuacucaugggauaaggacucucuuuguacauuaauacacaacuacaauagcaacgaaugccucacaauuacauucaugauccugccuuuauuaaacgaaugggguuucuuuugguuauaguguacauacuaaaagguugucauuacguucugucuguauaagcacauuccauuggaagaaaauucuauuuccuguucuauauucuguuuaacuggcagaguacuauuggugauuuaugccgcucaguacaagugaaaaaaaaaaaaaaaaaaagcagguuuaugcuuuguuguugagucuuuuaggucccagaccacuccgcagauuccuccgaguuggaaacugcacauuaagcauuuacauguguuguaucugguuucaugugcaaucauauaugcauucauguggaggccauaagacaaccucaggagcugcggggucuuuuacuggccuagagcuugcugaugguacuacucagcaggccagcaagccacagcuaccuucuccaucucugucucucgaacccuaggagagcauaugcaugcugugaugauggcuuuuauggguguucugggauggaauuuagguccacuugcaaucacuuuacugacugagccauuuaccuugucccuuacauaugcuuuuauaggguucauagaucuucugaccauuaguuaugaccuuugcuguauuuauaaucugaagccaagguuuuaucuuuagcaaaugaguaucaguugaaagaaauucauccagguuuuuuuuuguguguguggauuuuuuguuuuuuguuuuuuuguuuuuauuuuuuugcuuggcauugaauuuaauuucagggcuggguuccuuuguaaaaauggagcaguacuguuaucugggagaagguacagaacgugggaagucugagaauuauuaacucaaagguggauaugcugucaaauugacagcaaggacuguguccccagggacuucuauugccaggacuauuuuuguuguuucuuucugugagccuugaaguggugaauucauccucugagguugugugcccauugcugcaaggaaaaaaaaaaaaaaaaagaugggcggcagaaucaugcagcggucuauuucauggugacagcuuuaugcgguugugugauguugcagagccuugugugugauaucgacccucuuccuuugaaucaaaccacagagugugaguggagaaggguggcuucagaaauaaccaaucucugcaaaauugaaacccuacauaguucugccuacuacagauguaauuguguauaggaaggagaaguccaucugucuaauauucauggccuguuugaggaggaguuucuauguuuagaaugcacucuaacuuuguacacagaacucauggguaccaugcuuuuguuaugaacgcaagcugaaugaagagcauggaagcccgugguucucccccuucuccgcaucaucuuguggagaaugaacagcuuaaaauaagaccucgguuccuuauccaaggggaagcugcagguuccagcucccgagaagcagaggcucugcacgguuacuggaaauaccauuucugaacauacuuggcaacugaaaguacccaauuaaaaagcucuguggaaagaggaagucuguggaugugcaauuagcccuucagcuuuagagcgguuccuuuauguguggaaggccguaacacgaaaucacuggacgcaguugcuuggugccaggugguuagaacaggcuuuugcaugauggauuauuucuugcuccaaaaaugguucaccuaaagagguuguauuccugacucuaaaaaaaugguggugugaaaaaauucugaauguuuucuuuucuuuccccccacaaaauuuuagguaauugguaaccauaccuagcuauaaguggauguagugaacacacagagcuguaucuaagagucacuugaggcucgggcucuuuauuuaucuaguuguuguucuguucccuccuacuucuuauuuauuuuuuauuaaaagcggauugcuggguaccacugcuggcccuuacugccaugcucgcccuuacugaaaaaaugaagucuuguucuggaaagccaaaagagcuguauauucugagauuaucuuuaguguuuaugauagagaaagcagaaacauuaggggcuuaauagcuuuucuuauuuacaagucagauucaccuaagggauauuauuuuauguugugcguguguucgaaauguuccuuuaaaauagauuaucagagagaauaaacaggggcguagaauuuguugcucaugaaaauacagaauagaaaaagcuuuccuuuuggcaugcuuuccaacaaagcaguucuauaguauuccaguaaauaaacauacacacucacaugugcccuugcuuuccaguuguacaagagcucauuccauugaaguuuaguacaggaauuauuucccuccagagauuucuauaaaaauggcagucgucaaccauacugcucauguuguaaguucccacauaacaauacaccugaaagccacccccccaaacaaaacaaaacaaaacaauaagcaagcucuuuaaauaugguaagucuaaaggaaacauuuucuuuuuucuuuuuaaagguuuauugauuuuauguauaugaauauaccauagcugucuucagaugcacgagaagagggcgucacauccaauuacagaggguugugagccaccaugugguugcugggaauugaacucuggaccuuuggaagaacagucagugcacuuaaccacugagccaucucuccagcccucaaggaaacauuuucugauguggcuuuugagggcacucaaaauguugucccuuuauuuaugcuauggugggugucacuucaguaaucaguuggcaaacgacagucuccucauuacaugaaggucacugcuguuuuuuccucacucuuuaucccauucuucccaagggaaacaaaacucugacggaggcauuaacaaauagguuuguuuguuuauuugaggcgccugggauucagcccagugucucccacaugccuccucuugagcugucuccacagccccacaguugggguguuuuuaauaacuccaaccucccuaccuucagaccuuauaaaauugagauacaagcucuuuuuauuaauaugagcauaaaaguuguauucaguacuuucaaaauauuuucucccaacccuuuuccauuuugucacaagaucucugaaggaggagugcuugcuaaugaugcauugugcuuagccauggaagcauccaugcauucuuagcagcacgugcucccaccagcuccuuccagugaaccgucaugguggaauguuggguggccgcagugcuuugguccccagcacuuuaugucuguuggggggcgggggggacuguacuucccauguucucuuuccucuaguccuugcaaaagcuccacagggguaacacuguucugaucucuacuugcaagguaagcaaggugagaaguagacuugucccauucuuccccagagacaaagaaaagaugcagaguuagcaugugagcccugcuuccaguaggcucugaauccugagcacuuacccggugcuguccccuggcuguuuccaggagcugugcuaauaucuccaggaguguggggcucugggcagccauugcguucuguuuuagaggcuucgcccgugacccugauacucauugggcaacuuugagaguggcugcaguauauaacauguccagccagccucauuacuugcuuagcuguuuguuugacguuagcugaagaucuguucccucgaagacuuugagccuacauuccagggaaggagguuuaugcacguacagacauauacuaaugggaaacacuaugacaaagaauuacagcucuccagaucugggcuccacagugauucugcugagagaucucacacuggcucagaagguaauaucaucuggggucagagucacuuugcugagcccuguuuuuuuguuuguuuguuuuaaaguuuggaagaauuuugcaucuuuacauguaagcccuguaaguagcaggcagaagcagcuuauagggaucuugacuuuuucucuauuccguguguuugaagaggcauaguggguacuggggacugaaccuagugcuuugcacaugcuuggcucguaugcuaacagugagaucuagcccagcauuguugauuaucuuuuauguuaaugggauuauucagcuaagccuuaggcaugagagaagacuggacaggcauuaucauggugcugguuuuauuugcauugaggccugcugaccaaaagcuaauguuuugcuuccugaguuuuaaacauuuccuacuggcggcaucuucugugcccuaagugcuaaggauuccaaucugugagugacuuuguaggagccaauuaaucaaacuucagaggaggacccagacuucaugauacgacgggguuaguuguggaauucuuuauauucagacuggagcuggggccagguuggccuugacaaguggaacauuaaacacuuauggugacugguggaugauugcccacauaauaaaaggauacauucauaacagguaagugcugcaguggggacuggauggagaguaguaaguagcucaguguucucugacuguucuauaauuguggaaaguaccauucugugcauuuagucauucgugaauggaaugugcauuuuugacuuuuuaucuucuaggcacauucauuauuauuauuauuaccuuauuauuaaucugaauuucuggcuaauuaguuuguuuuaguuugagacagagucucacuguguaguucuggcuguccugggcagccucaaacucacagagagccucacuccucuccucuuggguaugaggauuaaagguauaccuaccacacccagcauuuaugucugucugucuuucccucccucccucccucccuccuuccuucuuccuuuuuugauguuuguuuguuugauuuuugagacagguuuucucuguguaguccaagcuguccuggacucucacauuauacaccaggcugguuucagagaucuuccugccucugccuccaguguugagauuaaagguaugagccaugcccauuuuuuuuauguuugaauuucaacgucaguguuuagauucuucaaguucagaguuuaccuaagagcacccucacaucuggagaaguaauuuuguccagauugcauauuuaaaauaaggggaaagucugccucucucugccccaugccuucuaguguugauugcuuuugccagucagcugccugggugaugcagaccucuggggucauaagaacacaccgugcucucccaguggcagagauugagagcgugguggcaccuguaaucacuagcucccgccuccucugucccuucagcgcagacuuaauucuugcaucuguguuuucaguuucccaagaacuuugaggaggauuaugaggaguuaggauagcaucugggacauccgaggagauuucaccagugacuggggagagaauguuuuaaaguuggauuuuuaaaaacuguggccagucagucuagcuaguaugguuuggguugcaucauuugaaaaauuggaacucuugaugcauuggugcauucauucuuagaauauugaugccuuacauauucauagauugaccauuccuauucggaugggagaggcugcgagccucugcuagaacguucuuguuucuuaaggacguagccgugacuucauaauguuuuuauuccugaggaguguugguucacacuggugauuggaaaagcacgggcacaucuuacuggaaaaauaaagucaaauuuuuccaaguagcagugucagaagguuugcagcugccaucugaagacauccuuuuauggugucugguuucaggcuauuuccaggugugucauccaggugugacaagcucugcuucucaggacaaagguaggcaucacguaugaauuguguugccuugcuguagggcgggcaaagcuuuagaagugagcacaucaggccugcauuaagacaucuacuauuuuuaaugcauuuugcuauuuuugguuggcacguucugucagggugagaaaagccacccuguugccugagugugaggucacauguggcugucacuucucuauaauggacucaaugauguuaugguuuuaaaauaacuggaaauuagcacuucucaugccaaugcuugugaccacagaacucuauuauuuuuauauuguuaaucauacucuucuuuugucuguuucccugucucccuucccucugaagugaaaugccauaaauuaauauauccaaauaauuccuggcuagcaucuuguaacuuuuuuuggcuugguuuuguucucagcuuugcaauguuacgggguagacagguaaugcagaggcugguugagagagaagcaaauagagcaauuauaauuccccagggauagagucagagauugugacuacguuauauuagugguaggagagccucugccuaaaauaugacccuacaauuaaaugggcuguuaaagcaugccagcaucaauucauuaagugacagcggcgauuucuuuuaagucccuuuccucuuucuccuucugggacuugguagggaugaaaaacagaugugcaaagucuaggaagacugcuaaggggaggcauggcuauucaggucggcuuccucaucuuugaggcugagucucugaugacaaagcucauggaagaauaggaacuccugaugcccguagauacccgggagcagaaaacacaguauuccagagacgaucaagccccuaucugcaggcaucauuugucucuuaaagcaucaccagucuaggucuagacacuuagagcagccuggauauuaagcagagguuuuuggggaaaaaaauuggauugggauuuucucauucaaauuuacacauauauacucaccuuaaguaaaaauugcaaaauucucucccuuuuuaaaacaaauguaauuaagaaaaaucagggcuaucucaguggguuaaagugcuccuuguguaagcucugcagacaaccugaguuugaugccucgguuccacggaaaaaugaagcuauuccucaaaguuguccuuugaccuacacucacacacacacacacacacacacacacacacacacacacacacuaaauaaauaaauaagugaaacauuuaaaaguuuaaagagaaaucaguuggcaucucaggguuugcgugagcuggcaagagaagcauuugacuuugguggucaagagugauuaacgucaucucccuuuauaucacauaacaaacugccuaagccacuguuucuccgucacuaugacaggauucuugucuucgucuuauuauaguugcugcaugacauacuaaauggaaaaacauuuagcauucugccugguguaaaugcccucuaauuaaaguauuuauuaugauuuuacuuugaggaacacccccacccccacccccaccaccacuguacaugccacagaaacauuaaugaguguaugcuacaguugaaggguggggaagcuggggccagagaugaugugucagaggaaggaucucccacuuuggguuuuaugaagccugguuuugagcuuuuuaaguagcuaaagauaauuguuaacuucucauccuccucuucuaccuuggaagugcugggaugcccccugccuucacucccuccccucccuccuuccugcuuuccucuaccccccuuuuuuuugauuaugucuugcuauuuagcucagucucuuaucacauucacggcccuccugcugcacugucuguccuucauacuagaauuagacaugugccaccaagcuggcuagaauccauuucugaaugauuucccacucauucaugggaggggauuucuuuccucauuugggucugcucugcauuugguaaagagaagucaacaucuccuuccucuuuguguucuauaugaauuauggcacgagacagggucugacaguguagucuuuuaugaccacauaccuggccuugaaccgcagagcucugacuacugccucaggacuccuaggauuaaaggcauaugccaccgugccuagcuuaaguuauauuugaaaacugaagaacacaguucccuauccucuaucauauaaguuccuuggguggcaaaaauccuuucaguuuugaaguuuuuuaacacuggcugaguuuuaaaagaucaacccuuggaagaaaaaugcaugaauuuugacuacgcugugcuuaaggccuucagaauaccauuaaaauuccaaggaacauaaaugggguuggggguggggagccagucuucuuuaaagacaaaugcuuggucuccaucagaucgucauuagugggacuugcaugugcuuugcugguagucaaacuagaguaugggaaaagcaaaggaaaggccagucaacagcauaauucaucuguuagcuucuaaccgugaucauuaaauccacagaaggguaacagagaugagagggcacagugccuaaagaugcaugacaucuguugcacuucaaggaagcuaagggagaccagauuucaagaugauacuacaaaauucucacugauaacgggcaaguggaauuuaugacccucugcaacucaggaagcacagaugauuggagcuguucuggguaucuguacaguguuugugugucugucugucuugaguucuguaucagauguaucuggccuuccuauuucuaguuuggaucauacauaguguuuuauauuuucauugucuggguaggucaucuaccacaagcauaauguccaccuaaauguuugccuuuguguccuucaaggcucaaguauagccugccuagauaccauccccucccaagagcccuucuuugccacaccacccaucuggucugaggcccauuucuuuagguucguaucuucuacuuuugcgucaucuccuaagcagugugguguggcauuauaauuguaccguuacugggacucacagccucacucuugucacccugugaacuccuugggacagggucuacuuuuguccuuucauccacugccuagcagggugccuggauguauugcugacugcugauugagaaaaaggaucgcauggaacccacuccagccagccuggcuuccuugaggaagugaagccuucuuuucuaagugaaaccauuuuuaucugauggccguuccuggucaucucuaccaaaguuaacuuuuauuucuauugaaaucucuacauguaggguggcuaggguuuuccuuuuuaauuuuuggaggggugugaaguacaagacagacuauaaugugggcuaagccuucuagaauguugagaaaguaauuagugggugaagggaggaggguguuggaagaaauggcugggauucuuuguauccaaaagaauguuucuccuuggugaugagguaggcauugucacccuuaugaauaagucccuaagcaaaggacaaaaacaccagcggcccugcauugucuggugggcucuggcuuuaggauugcaauaccuugucuaaguaaguuuagaaauggguuuccuggcuggguuuuggacaagccauaauguugaguggcagccuaaccuuugaacuuucugugucuuugacuucaaaaggaauuccgugcuuuagggggaaaaaguccaaguaauuaauacugcugaggcgcagagggagagcagcugaaauguguacucacgaggaagcugaagccuccucgaacguuccucccuuauuuauaugauaauuuuaccuuaagaugaggaggccaaggcauccugagagguuuuguuuuugucuucuguuuuuaauacuuuacaauuacccuuucagaugggaaaaaaaagccucaauuuuuuuuuauuccccugacucgcuaaucuauauaauuuguuuaauuuuacuccugagggaguauggcuuaugaggggguguuuuagcaacauuuuaaggacaucugaaaauguucauaacaaaacuauccaccaguaaacaugucuuuuaaccuaacuuuuaauggaacuucaaauuuuaccuugugcuucugcaggaaaucuuggugauuguagguuccccauccggagcuaggagaacuuggcuguccuuugucuccucagacuuguuguuuugaaaguugaaggugguuuggguucaauugugugucaguugucauugauuuuccuucucuuuacuauuuuaaaacuaaacaaggccuuucguuuguuguucagcauuccccauguuuugaaccuggcauuauaggauuaauaugaacuugauauuauaugaugaugcuuccaacacaguauuuucauauauaugauggauauugggauccagaggggauagauauuuguuuguccuaaccuuuuuuuuuaauuuucccuucauuucuauacaguuaauguccauauuuauaauguaaaacaucuucuuccauaaugacuuuuugggcugacaauucauuuuaccccaagauguuauugacauagaaggauuaugaauauaaguaaagcaacgagaaaccaagucagaugccucuuuguuguuuaacauaggaccagugaguuggaaaaguugggaaagaagccuauauauucaaacugauucaguggauauagguuuuuguguaauacauagaucugacuaaaucauaguucaugguugaggaaugaaaugauaaaugugaucagcauuaaaauaguuugcaaauacuuggugauaccacauagaaugaacaccuaacuuaugacauugucucuguuuuaagaaauuacaucugagcugggcagugguggcucacaccuuuaaucccagcacuugggaggcagaggcagguggauuucugaguucaaggccagccuggucuacagagugaguucuaggacagccagggcuacacagagaaauccugucucgaaaaaccaaaccaaaaaaaaaaaaaagaaagaaagaaagaaaaagaaaaagaaaaagaaaggaagaaauuccagcugaaaucaacgcggguaugauuugcaccgagucugauaguugaugagaaagugcuuuugucaauaaagacauuuuuaccccucccuuuggaaagauggagcuagcuagaaguacuagguaggaaguugacuccuuaaauuuuaaaacaugaagcugugcauuuaaugccuuuaauucaagcacuugggaggcaaaggcaggaggaucucugugacuuagaggcuagccuaguuuacauggugaauuccaggacagccagggcuauguagaaagacugucucaaauuuuauguguguguguguguguguguguguguguguguguugcauuacauuuaucuaauacauuuguuaucacuugcuugauauucauuaccagagccacccuguuaauaaauccggccugauugcucuucagaacagguagccccuuggcuugguccugugaagcugcuucuuguuacugaugucgcuggugcuucucaguccuggucucagguuuagaugaaaacuacagcagggucacucagcuuuaaaagagccccccggguauggucuggcacaccagugagggcuccuugcuuuugcugugaaguuuauggagagcugucugugcugcaguuacugggggaugcaggcuuuuuuuuuuucuccuuugguucaaauauguauguauguauguuccucuggggugagaauuaggcauggcagucacagcgggcuucuccacuauggcugccuccccaacccccccccccccccccagggcuccuggcauuccuugaauacuaccuugaagagauaguuuagugcuuccuaggaacucuggucucuguaggaguuguuuguuuauauauagucuaaaaugccuccccucccccaaagaaaaauguaccuauuuauuuaacuacaacaguuuguacuuuucuguauguuguuucuuuaauugaaaauccuaucuggagacagaucucuuuuuuuuuuuaaaagaggaaauuggaacauuguuuuccaaauacuuaaaaaaaaaacccuaaaaaguuugagaccuuauuauuauugcucugugcuuauuuuacauuaauaauucuugauuuuucuguuuauaugacaucaagcaaaaauugcuucuuaauuucaauuuggguacacagucaguucuauauuccaaauaugagguaaguuggguguggcuuaacaccaaaacugcagcacacaggagagaccuaggaagauguucaaguaguguguucaaggcuggccuugguuacauaguaaggcccuaucucagaaaacccaaccaacuaccgcccccccgcccccccccgcgcccugcuaccccaaaucaaauuaaaucaaaaauaaaugaaaugaaaugaaaucaaaacagcauaagucucugaagcaaaagagaaagacaugucuugauaguucuaucagacauucauucagcaaguaucuuuguacugauaggucacugugugugagcuccuugucugagccagguuugugagugaguaauggcagauuuagcgagaggcacaggugaagagcaacugaagacuuauucacguucauguuugaaaacguugaucccaaaugggcugugcuuggagcauagaguaccuggcaggcauacucgaggccccggauuuuuuccugaccucggcacccauaaaacacauggccuggaagauggugcaguggggaaaaaucacuuuucauguaagccuggugauuggccuucgauucccuugacucaugguagaaggagagagagcuaacgauugcaaguuguccuccaucaaguugcccaccaugacgugugacacacacacacacagcaccaccaccaccacuaaacuccccccaccccaauccauuagguaaauagggagguauuuagguaaaggagguaagguauuuagguaaggagggagaugcacuugaaccaaagcagccagugauaccuguaccccagaauggaaaccaagcuugguugcaguggaugaugucacacaucccacuagauaacuaagcuugauugauugcaauggaugauggucacauaucacacuagaucguauucuauuccuucugcaggaugaauccaauggagacuguaagauuuagcuccugaaacacugacgaugaaacuuugcauuuuuuaauaauuuguuuauuuacugcauguguguaguauaugcacaguaugugggcaccagggcuuguucccaugccaccucugcaugugcacgaggaggccagagguccacacugaguguccuccucugucauccuucuuaguguuuggagacaaggucuuuacugaaccugaaacccuccacuuaggcaagaaccagcuuucugugaguccugaaauuauguacuuccgcuugcuagucuccccauccugccgcccccccccccccaucggacccgucaccaccgccugcuuuuccgcgggugcuggagaguugguccucaugccuguacaacaagcgcucuacccugcaggccccguguuuacuucuaaaguagcccaguuuggguuuuguggccuuugaggucgcggagcucuguguuaagggcuucugacuuuccuucaaggaccuuuugggauugugucauguuuauuucaggguuaugugugucugcccugagccaugcuagcggggaacggauaaaucuaagccgcagucugaagcauaaccguguguucuuguucucuccuccccauaaacgauguaaaacuacauuaauaaaacccaaaaccaccaagaaagguagaacauuugccgccugcugugcaaguaucaacucggcuuucaaaagcuuacuuguucccuauaaguaaggagcaaucugaguucuuaguaacacgguuuaguguacggggcuacauggccuguccuuccuguugcuucuuuaggacgguccaccagccuuucggaaggcuggcgugugaguagcggauauugcacacauucugaagguaggaggccuggaaugaguuagggcuagcuuccuuuauuuauccuuccuucacugggcuuagccuggucucugcagccccccagccugcaugcugaagauucccuugcgcaucacugggaaaucugucguugauuagauuauuggaucuucauuuucuucaucaggaugguuucaagacuuaaaccaaguacagcaagauucaaaacggcaaccuccgccacacagacccaggacccuccaguugagggaaugugcuuucgagagacgaaaugccccucaaggaguguaggguaauugaaaacccacccuuugagcugugguuuauuguggaagggaggaaugaauggcaccagcguccacaccuacuaaauacuuauuagaaccccggcagccagccuucuugagcucgagguccucuggagcuacaguuucauccauuuccaguuggcccugugcugugacccucggccauuuuuuuuuccuuccauuuaacacaguuauaaagggauuuaugugcuuucuuuccauuagaacuuagcaaggcugcugucaugaauauuuaauggccaggacaguuuguuuucuuuugcuuucuuucccagccucgcagccgugggucccccucccccuuccuuuuggagcaauguaaauaucuuggccccucacccucuggagggaucccugaacaacgcugggcuuacugaguuccgaaggagucuggagggaaucucgccugcccccuacccccaccccugcucaugcccccuccucccgcucucccaggacuccccagcagcuggacggugggugggugggugcagugcacgcuuugagguccgcugcgaggucuggcaccgggcucagccucucucggucgcugagugcuccucccaguugugcucugccuccaacuccucagccgcucaauuccuuugaacuucacagcagcacaaaggccuccccgagacuuagcuggggcucccucggaugcauuccugacacuucaugggucgcugccuccuuucucuuuguaacagggaagagggcgaaugucugcgacagaaaaugacuuuugaagacgcucaaagauuuaccgugucuggagcaaccccugaacuuuugugauuaucguagagagacgcacuuucgcuauugguagauuacgccccaaccuucuucccccgagucccucauccuagcuuuuauuuaaggaauuucucccucucaugcugagaccuucucucagugcccaacccccauucugaauuucuuuuuauuccugugugcuuugucuacccuugugugggaaaaggugaggcugggagagggggcucaaggaggagagcucaaggguuagcggagaagaaaggguccagcuuagaaccuugucugcugccaaagaaucauacaugccugggcuugcccaccucagaagucuuucaaagauuaaacauggaaagacucauguuugauaccgcucuuggauauaguaauugcuuaauaaacguuagccauacauuauacaguuuuuaagccauuuuuuucugaaauucuucagucugauccaauuuuauuuauuucgcuugugcauuacuuaugaccgcacauguucccgugcacaagugcaugugcuaacguggaagcccuuggucaaaacugggccucugaaauugcuguugacuguacugcuugagagucaacaacuccaguugaaccuggagucaacggauucugcccaguugguuguugauauucugcucuuuucuccucucuagcucugggauuacaggagguuuuaauaaguaggugcugggccuacaaauugagguggucaugcuuggacagccggcacgaugcuaugcuuuguuuuguugaaccaaguccucuuucuccuuggugcaguuuucacugacagccgucccuccugcucucucuucccgacucagaaggguggacuaggccuaacccgucuccugucuugucauuguagcuucuaagcuagcgcuucacuucacugucuucuuggugaaacggaaauguuuuaaauuggguagcagaagcagacauguguggaaguccuguuuguuuguuuuggaaaggccaaguauauguguauguauguguuuuuacagagaaacguuacaaacauuuugcaaguugagaaacaaauucuguaggcaccuccuguguuauucugaccauagguucuuguagggcuuguguuuaccuucauauaaggguacaguggaaaaacccuacugggugagguaagccacuagccuuagguacaggaagggccauugaaagcacagaaugggagcacaggugagaucuugucagggaggcgucguucagggugaacacugaggaaagcauuucugguuacguuucccugaauuccucugugugugugugugugugugugugugugugugugugugagcacacgugcauaaggacguuguaaguuagcuuccgauuuuguuccuaagaaaccauuuaccuuggucauuguuuuuuaguuuuucaagacgggaguuuuucuguguagcccuucucuuggaacucugaagaccaacugguuuggccucacacuccgaaaucugccugucucugccuccugagagccuccgccacuagguuccuuuugcuuuuugaggcaguaugacuagauccuagugagccccagggaucuccugucucugccucuccaguacaagguucuaagugcggggcgccauaccuggcuugacauggguguggauguucuaugcuguggauggagcaggcugaguuaacccucuagcucuuuguaagugcucccuuaucuuugaugcucuccuaccucauuuaagucucccuaagagaccuaaaauucaauuagcuagcugauguguauguaaacuuacgucacaguccauggcauacuuaaaucaacuagaaucucuucauuaauuucuacaaggauuauuguaugaauugguucuuuggccuauuggguggaauauuuacauauguauauuuaaaaauccugaauagaguuucucccaaguucuuagcuggaugggauaaccauuggauucugcccugaaacauaguaccacgcacauaagacuucagccuaauuugguaagcuuguccuuagccuuucugguuugucgacaagaguaguaggucagagaccuccgauucacccuuuuagaccuaccugccuugagcuaggguugauucauuagcaggucucuuugaguaagaguuuccagcagcacugucuuccugucucucucuuauaccaggaagcugucuggaaagauuuugcucagugccucccgcacacccugccacaccugcaaacagauguugaacugauuaggcugggugcacagaaaaaaaaaaaauguucagcuaccuccaucuauagaacaaaccggucuccauauugcuuuugaucucuuccuguuauguuuucuucaaguaacguuugcacugcaaauguuaauugugguaagccaacaaguccugagaguuuagucacccacggcaggggucuaggaagggagaguaagagaaagggccucuuuuuaugggaggugagagucuuguugggucagauaauuagguaacaguguaaauauauaauuaaacagggugguugugaaauggaaauggagaugcuacuguaacaauuccagugucuuuagggggcuggagaguuguuuccugugauucuuugaucugcuccagaacaaucccuucuauuugugaucacguguuguccuuucugcuuauauuuuaugaugaccaagucucugccuggucucuggugauggucucagaacccaacuauuacaaaaucccugccuguaccuuucaggggcuagucuuuucuauucuuugcagauaaggaauccaagccagagaggcagguuuguuuuuguuuuuauuuuuuugcuccaaaugagcucugauuaauuucuuccucuuuaugauuuuuggcccuuuggugagugugacaaaguguagacauguuguauucugggggaaaauaaaaagacuuggaauuucaucuggauggcuuuuguuuguuuguuuuuuuguggguuuuguucuguguuccacccccccucccccuuuauagauuguuaggcaaguugcuuaacccuucagaguuucuaggcagaaaaaaaguagauuauaaagacugagauacuuucugugcaauagauagauggucaguaagugggagcucuuguguauugaaaauacuuaggauguugcuacguuuuuuccaccaaacaagaccuguuuuaacuauacagaaagggcucguuucugccuugguaggcuuuuaaaauuauuguaugauguauggauguguguuauaagucuuucauggaauauuucuaccauggauagaugggaggaagcauaaggagacagaucucaagugaaagguauggcuuuucaguuguuaauugaagcguccccuuuauagccuuaccuuccacugguaagcacccaauuuguugucuucggaagaaaauaaacaaaacuaucauuuccugugguggagauauuaacaguaaaaacucaccuccucauuauccugccuuauauucuagacaacaugaaaggacuuugucauauagugucaauaagcaaagaacuauguaauuuuaccacauauuaauacagugucgccugaaaggugcugucauuaguuggcagucuauaaaaaugguccccuagaccaagcacuggcaaaauuauguguucuccaauuaguuauucauucuaaaggaugcaagcacugacagacagugggaauugcuuaccuaccaauuuacaaaacuugagugauggaaucauuugcagacuaaagugguuuuuagugacacuauuuuuauuuauuuaaauucucacuuuuugcagcuuaauuuucuuuacuacaccuacuugcacaauugaaaugagaggcuguuuuguucauaaaagcuacuuuuauacaaauaaauuaauauuuacucugaaagggucaggaucccaaauugagguuuuauaacaggcccuggagcacccauauccugacuguuuuauacgguuuuuuauuuuguauuagguuaugcauuuuguggaaagucucuugccccuuacugaagcauggaccccuugaauuccuuuuugaguggcacuggagagaaccacuccacagguucccuugauaguagguaaucucaauuuagugcaugcauuccaagggaaugccccagaauaaccuuaaucuccucccccccccaacuucuuacuuguguuuagauuauucauauuuagucuaguauggcauuuuguacaguauaacagauaauauuuccuaacuuucuguugugguguuaggguaauuaaauucacuuuagcuguuaccauuuauuacugauguuuguugauccagaaauccaaaacuggugugaauucuuucucugugaaucaguuucaguuucucauagugauuucucuaaauucuugguuaaggcccaauuaauuucaccuucugauguaucuaaaaguagucuugcuuuaauuuaugcuagcauguuccuuuuugcaaacuuuauuuuuauuuuauuucauuugaauguauauuuugcuuuacguguguguuuguguagacacaagcaggcagugucugaggaaaccaggagacagugucugcugcccuagaacuggaugugcaaguugguccuuuggugauagagaagcuaauguucuuaauugcugagcuguaucuucagcccuuaaaauacucuuagaccaaagauuaguuuuauuuugaggauauugaaacauaauuguacuggaaagaauuucucuuauuuucauagauaccuuuaaaaauagacauauccuucucucuguuugugugugugucuauccuguacacacacacauguacacacacacauguguacacacacauguguauacacacacgcgcgcgcgcgcacacacacacacacacacacacacacagagaccacugaaguucagccacaaaucuaagguuucuucuguaagcacuuuaaacuuggacauaauuaguuacaucugccauugacuucccuuuacacaugaacacacuuuugccuagaagccucauuuucauggguaaaggggguuugugaaucuacccugcaggaguauuguuguaaauuuucuguauuuguucugggguuauagcuacucuuuacaaaaugauauugguauuagugcauuguucuuagaggcaggcuuucggccugucucuuccugggaucacccuguuguauuuggcaugcuguagaacaguaaguagagaacggauccuuaaacgaugcuucagcuagcucugguguggacuucacucuggaggugaaauuggcugcucagacuuuuuuuuuuuuucuuucuugguguccauuugguuccugcagcccucuauccaaauaguguuguuuaugucuccuucucugcccaaugggaaagcauugagaggagaggguguuaguucuguaagacuguucuccagcaggaauucugggaucacucauguaaagaagaagaagaaaggaaaacccaaaucacccguacuuagugguuaacauguaagacugccagguucuaguagaagaaaauucgaacggaaaaagagagguguauguccuucuauugugugauacugaucacaguaaguuguggcugaguacaaagagauggcuugcuuuaguacacagccuuucccaggcucuuguuaguucacaucaguuguuccuucuggauagucucucuauucuggcuaugucuaucugaaucugaaccugcucugagccaggcacugggcuagagggagcauaggcacuucagagaagaggacuucugcaacccauucuuuacucagagcugcuucuaaaaggcaagaguggaagcuugcuaggcuagcuuaugcuuggagcaagcaaauaacagacacagaaaagugucauagauugcugaaaauagccuuccaggaaacucaggagaaacauuuucccacugacuagcaaaauaaguauuuccccacuaaagauuguuuuuaaauuguuuugaguuugcuauuuuucaagcacaugaacuugagauuacgugugugugugugugugugugugugugugugugugauauucugauucacaauaagaggcagaguuuaugugcauucagauguuuugaaaguuuacaaauucuggguuccaugcucucuggcuauugcuucaugagccuguuuaacauguggcuucagaaguagacgugacuucuuuuccuugauguagaugggcauugaccuuuuuaaguuuguuucaagguuccacaaaaagucuggccacacaguuugaagacuauugggaacgugaacuuuaagauacucuugaauucaacgcagaaagagauggugcccaucuuggggaguuagaaaaagaugggugcuauuauugucauugcaaaugcuucccagcccugccaccacgguuaagucuuggcauggcaaauugacccuuaaaucuacccuugcaaaacuugaagcauaagucuugugaauaacagggcaguauaaacguugucaaaguaaagcagcagaaguagccagugcuaugauaaugucuuucugauuuaaugagcacgucugaaaacuaaccaacauuuaacucgcuuuauucuuacugagauaggaucucggcauaguugcuuggcaauuuuaguaauuggggaaguaugauugccauuauuucaauuacuauugaccugaccacuguuuuugguccggcccggauaucuuuguuucagugugcuuucuaugcucagggcuuucuuugugcuuucuaugaggcuugguaugcgcagucugaagcaaggcucuguccauuugccuuccugcccuuggagaguucgcuaugccuccaguagagcaguggcuuuuccugucaaaaccacuggccaucuagugaguaccacagagcuucuucuguccugcuucuuccugugugucucuugcuguagaaugaacaguuaaaguaagccagacaacugugcugugauaaauaagguauagucuggcaaaugacuauaccuauccccuacccccacuccaaccccugcccccgccccaucagguuggcuucgcccugguuccuaugaaggugguggcguccugagagggcaaugguggaaacugcagggcuugugaacgcuaggcuugugaguccugguggcgcauuucaaguaaagccucauggccaaaaggaaucacuggauuuauggggaaaauuacuguggccacacugcaaacaguuagucacguuauacuaaguacgcacuauacagauaacaaaaccaaauaugacagugaagcaucggccccacuucugcagcuccccacugucuaguuagcagguuugggauaaaugaaauguuguaaaaugucuucuugcuaaauuucauuuuccaaaauucuuuccauauacaaaaaugcuugaauucuuaaacaaacaaacaauccuguuuuuuuguguuuggguugaaaucugagugacaaauucucccgcuacaggaauucuaaauguguagauucaaaugcagaguuuuuuuuuuuuuuuuuuuugcuugaaugcuuuaguaggguauugcaauuuuuacagccugucccagauucacagauucauuuggugaaaacuccacaugaaaaccuuguaugauguuuaccauuucaaaccagaagagaagggagagauuugauaacacuucucuuuggauagaacuuggugagaugaugguuuuuuuuucauguguguugcuacaacuuaucuuuauuuuaaauuugauuugucccucugcccacuuuggagccucuggaaugauagcuguugccuccagaggacugagaacuguuuucaaaggcuccaucuggaggcauauuuaaaagcacgucuuacagcauguggcugcacagagcuccagucuuaaugaaugcacggugugagcuauauaauacuaauaaugcaaacuucaacaaauuaguccugugaguacacacaugcaggcaaggcuuuuuucaauuuggcuggucccauaggcaaguccaguuguaaacugaaggucagaauuuguaacuacugguaccuugguuuuuuuguuuguuuugauuuauuuuuguuuugguuuguuuuuaaauaaaaagucuucuagugugacaauucaacaacacagaauuccuacagagauguaaagccguucacgguagguaaggaccccaaccuacagaacaucugcgugugucuggcccaucaggugaugagguuggagcucguggcccucgccaugguucagucuguccuugcacgauuucaguagcccugcagugaagcuuaggaaaaugcuuccuguacuccugugggagauagaagaguguuaaggagagguuucuagugaacauuucaacccuguuacaguguacaccuuucauagagaaacuuccagaagaacugccauggaaugugccaguuugugauaauucugaaugaugugugauugccaugauuagcacuauaguuccuaagcagauacacacgucuuuguuuuuaaaaggaaccugauuuuuuuuuuuaauuuaaaaaaauuuuugaaacugccacugccaguucuuuaaacucaguugcuuuuauuuuaguucguucuuucccagccuggacccccaagaucuucaaccugauauguauuugccucugcuggcaaguuuuuaaaaguaguucagauuaagaaauaaaaauaaaggcagacuaugguggugcaugccuuuaaucccagcacuugagaggcaggggcagguggaucucugugaguucaaggccagccuggucuacaaagagagucccagaacaaucagggcuacacagagaaacccagucucgaaaaaccgaugaaugaaugaaugaaugaaugaauaaaugaaugaauugcacagaaacggucaccugccaaaggcuugaguuauuuucccuuggagcagagaagaaauacucuguauuucugcuuuuuggauauguacucuuaaacuuugugaacgcaggcaucggcacuaugugaagucucagauuucauaguguccuaguccugguuaggcgauguuugguaggaaggacagggugaguuacagagcacauuaggcagaaucaauuguguguucuucuuuuggcaagcaggccaguguguuuccuacagccuaaaugaaggacuauuuuuuuccucacucaaggauccaauuaagccuguuuccuguuuaaggcucggugugccuaccugcccuuuucguguuugaggcacagcucuuuugaaauccacccuaaucauucuucccggucaccuuuacuacugccagcauugcucagcagcgcugucucauaucugggcauguuaaccugcuauuucuucugcuuggaaucccaugacaccuccuucccuuuuucccuagcuggugaccugguguucauuuacauagacucacaucaaacacucccaccuuguaaaguccugggcuaauaagguggguaaggcuggcuccuccccaccuuccuggucccauucauggucuuucuguucagcaucaagcaccagcauugggaaguacauguugucuaccugucucccucuguaggugacagcguauucucccuuggaugucuuucuaggcaaaccagaguguuaucuauagugccguuuaauuaucuauugagcaagccaguguccacacaguugagcagguaacagacaaccuuuucaucucacgacauuugugucccccugggaaagauuguugagcaguacagacuauuaucuaggaaaugagauaaagucacccaacagguguauuuccaguuucuagaaacaaguaaaugcuaccuacuacuuagugucuggugacucaguuccuuucuuccuuccuuccuuccuuccuuccuuccuuccuuccuuccuuccuuugcucucugauuuuuuuuuuuuuuaaacuuagcacacuuaauuugauuuauguguauggcuguuuuaccugcauguaugucuguguaccagcugcauuccuggugucuguggaggccagaagcgggaacuggaguuuacagauguuugugagcuaccaggugugugcugggaauuaccuacugagccaucucucccguguguuuguguuuuuaagcuuuaacaugacaaaccauuuucccucuggaaguuuuaaguggaauuuuuuuuacuaucuaaggaauaacacuuugaauugcuuuuaaaguuaugucuuuuuauuuuacauguaugaauuugccuguacauucauguaccaagcauaccacuugugugcacugcccuuugaggccaguagagagcuucuaguauccuggaauuggaguaacagacaguuguaauccaccauguccgugcugggucuugaacucaggucuucuacaagaccgccaaguauucuuagagcuaucucucuucucuauacuuucugaguuuugaaucucagaaaucccauucaaaauauuuucucauucguccuacucaguuuuuaaaugugcaaaguaaaagugauauccuuucuauuaauuuaucuuauguggggauggaauggguguguuauaugauguauaaauccuuuguaaagacaaacagcucuaauuauugugcauuuaaaaucaucaaauguguuuuggcugaccaacuuaacaugaaaguguccugcuuagcaagccucauuauaaaugauuggcaggcagcuuaaucuugagguucaaguugugacugaaguacuuuucaaauuguaccaggaccaggacauucuuagccugacagagggguguccugaggcagccaugggguauuuauauauuguacguuagacauugaccuuuuuaaaauuugagcauuuggguaaauagcuuggguuguugaacuuuguaggauacaaaguguuuuuaugaguauauagagagacacugauucauaacugauaggcaauuuuauuagcccauuuucuaugggauguauuucuuuaacccaagaaaaauauccgucaccucccuguuggaaauccuucauuuucaggucuuucuuugauggaaucacuaucaaaggaaucucccuuccucuuuugguugaauaugcuuuuaauuuuggaaugggcuuuuuuaauuguuaagaaugagccaauuauaauaccucaaaccauggcggaauguguuuucuuugccaugcucagacuggcuagagccccuucacuaaauccuaccaacaaaacacauccaguguguuuuagaaugcguguugucaggucagagacccggagcaagguugagggagguaacucacucuccgagccacuuagcuacagggcacaaguugguggugcuucagugccuguucagggcuuucucguuucaaacucaggcaccuccugugcaaaucacauugauguuugagcagccauuuccgucucugcuuuuacuuucucaugauguaaagaaacaaaaugacacuaggcagaaacuuuggaauaauagaaagcagagcucucuuccucagacugcugucccuggugaagaguagcagacgugugccagaggcucugccacgugauucugaccagaagcagcugggcuaggugguguuucagcuuguuccuuggcguguugaugcagcccuuaauugcugaaaguacagaccucuuuuuaacagaaucuccuuuaagggaagggccgcgcugcagcaugacccggaaaauggaggcuuuuaaagcaacagggaauguaaauggccuuccccaacagaggccacucagauugguuccuccagcugaggaaacuuaaaugcucgaggaaggcgaaugucugucuuccaaaaccacggggaucaauguccuaagagggaaagcggguagcuucaggguuuuuuauuuuuauuuuuuaaauuuauuauuuuguggguuuggauauuuugcuuccuaguaugucugggcguuaugggccuguagugccccugagagccauaagaggggguuggauccccugggccuagaggguaacuccugguaguugugagccauggugugggugucagugaucuaaccuagguauucuggaagaacagggaaugcuaauuaauugcuaagacauuuucccugcccccgccccccauagcugcagcuuaaaucuucucaagguaggggcagguauugccagcucagaguggcagaggagauguucuccguaagggaaagggggggggugcggggagggagggggcuagaaugaguugucagaagcuggugguguggaauugaaugacagcccccccaacuucuaaguuagggccaacuggugcuuuuaaaaacaaccuugggcuagacucagucugcaggguuuuucuaggcuccauucuugauacccacgagugguauccuaccacagaaaaucuaagaaaauuuauguuaucuuuucaacaagaacauaaccuauaagaaaaaagagaaaaaagccauuuauuuauaaauacucaggaauuacuuguacaucuugcaaaguguuggaagcuuuguaaucuugugugugugugcguguguguauauguguguguguguugaguagccacuccuggugacucugaugcuuguggguaucugcagugguuccccaggucugcaugugcuagagucauaaaugcagggcuguagagcuguguucuuuauggaaccauauuuuagucccagcauucuuuuggauuagagugcaaguuuuuaaauccguggaacaguuaguaggcuacacaggcucuaugcauugagguuuucccucuguuuuaucauacuuuucaaccaggugccagucaacgaaacagaaacaugccgaguauuaugggauuaaaggauuuauuauagaaauuggcccuuccucaaauaugagagaugcuaggggaagcgaaggugcugcgggggagugagaggauuaaaggaaaguucacgugaagcccuggaguaggggugggcaggucagaaguggaggcugcugaguggaccacaggggauggguacacaaaaucucugaagucuguugugucuccucugugcaguucucagcauguggccuaagccaggcaguugcugaugggcugagccucugcccaucagcugggcccuuagacuggaaggugagaacagaagaaaggaagagcaggcuggcagcugcagucgccuuccgcaggcucaccugcaucuuguggggagguggggaggcgggcauagccuuacuuucccuuugcaaaucauaggagggcaaaguucaauaccgcguaaccuauggcuuagaagaaccaugcccuucaaacuaccccugagagcuguuggcucugucuccuggccucacuaaaaauaauuaacuguucuuaaacuuaggagugaaauaacagauuuuuuugacugcuggacaggccacauuaggcacuuuucugugaauuugcccuggacaggccacgggaggcucuuuucugugacucugcccuggacaggccacaggaggcucuuuucugugacucugcccuggacaggccacaggaggcauuuuucugugaauuugcccuggacaggccacaggaggcacuuuucuguuuaggaaccaccuaggcguuccuccuagcaucuuaucagcugaucauaugcacaucgagauuaacgauuuucaucugacuuucuuccuggaaaaauugggucuggaggauuguagaaauaaagaagcaaaacuggauagagaaacuuuggaguguggacugacaggagcuuaguucaacuuugccuugaguuaaaaauaaggaaauacacagauaaacacagacacacagucucucuuucucucagcacccccaucauauggauucauuuaucuaugguuauaucuagugaugcauuuaucugaguuuauauucacugcaauuauccaaucuguuucaaugggaauuuuaugaguauuuaacuuacgaguaauuaaaaaauauucuguaucagauaguugagaaaucuuuccaaagauggucuaguugccgaaauugccagucuuugucuuuccagcacauaagaaacucaaaaagcagccuuaacauggcuuugccucuuucccaucaguugguguaaaaauuggcuuuucucuguuugaggagaugcugggauaaauguaagcucccgguaccuaauuugccaccccauuaccugaccacaguguugccagagagguucaaucucugcaggaaagggaagcauauuuguaagucuguggcuggagcuggcaguguuugccaaagcagaagcugcucuucggugauacuucaacuuuuuauugaaauauuggcuacuucuccuccuugacugguagcuccgguggcugcugaacaagauaagguaaauugcuuucaaaccauagggcauuaauuuggaagcccgagagcaagcgcagagaggcagguuuuuccuccucauuuccuacagcugaaacugaacaguuuaucgcugacucccaaguugguggauccucguuaguaagcaaguguuccuugucguaaacacgaccaccggcuuuccuccuuaugcaguguguugucugugucugugucuguaucuguauguggacagagcagagagucgugugguaucgcuauaucccuaugaggguguauccuucugaagcuauuaaaugacaggcagagguagucguuugagugggugcagaucauuuaaagauuuuaagagaggagaugugaaguguuuuggugugaaugugugugcgccugugugaguagcaugaacuagacuggauaauuguaguacgcguacacucagauaaaauguuuuggugugaaucugaaauggccccauagguucggcuugugccugaguccuuagcuuggggaguggauuuggaggcuguagagccuuuagaaggaaggaccuggcuggcgggaggccauuaggaguaggccuuugaagguuguacaugcuucugguucuggaauguucuuucagacucgugcucuggccuaucaaaccauucuggagaaacugcuaccacacucucccgacaauggucauggcugccccuaguagacuuucauuaccaugaugcauggagucuauucugaaaccaugagccaggagaaagcuuuuaucuccuacauugcuuuugucauagcgacaagacaaacaaugaaaaugaccccuaagaugcuaguuauucacauccuugaugcuuugcugccccaggccaagcaucccccgugggaagacuauguugagacagaaucauugcuauguagcucugacuagccuuaaacuuacaauggauacaccgacucuggccucugaaccuugcugaucaucuuaccucaaccucuuaggugcugaucuugccuuagagaggcaccauuacuggcuuggaagauuaccuuuuuaaggacugcaggaaacuggucaugacccagguauaucuauauaaggaauggguacugagcauucaagaauccauagaucucauuucuuaguucaguggaugcuuauggagaaccuguuaggcacugagcauuaagcugggcacugaggauacagugguaagguaaauagcugcccuguuggagcuuaucauagacuagcuggggaagagacaauaagcaaacaaguauuucaguaaacauauacauuaacuauggcagaugcuuugaaggggagauggaccaugggaagacuggaauaagaaagugugcgugauauggcagguguucaggggagagauacucuggggaagggucauucugccugcucuucaagucuuugauaccauacccugaauucugcaugcugucuucagaaaggagagcaucucugaugguggcccugcccugacucugaucuugggaaacaaagucacaucaccauggccauuuauuaacaggaccuaguuggcuuucuuucugaggaacaugaugucuucccguguucuugaacuuugccugccaaaaccuagcaggcccugcauucccagccuaagguugggagcacacaaaguucuccgaaagcuccugugccuuaggagcacccuugacaaauggugcccugauucuauccccgucuaguuagagugcuugcugaagaggaaaagcuuccugccugccugagccacccucccagcacuuuuccugacuuccucacagacagccaccugaggcgagugacagagccaguuucuuccucauucagggugaugacuuuacucugaaagcuccaguuucaaacuugcccacccaugugaaaggccaagggacaaagcucagggggacugauaguuuugggagauagggccaaguaugcagggaauauuugcucuuccuggaaacuggauuucacaaguccauucauuuccuucucucugaaugacuagucaggugagugagucaugggcagcuccgguuagaaggcugcagcauagucuuacucugugcccuacgcuaccagaggagaaagcugcaucugaugcaguuuguaggcacgacucgucuaggaucuuuuauccaucuaucuaucuaucuaucuaucuaucuaucuaucucaaagaaacuaugguuuuaaaagcacuauguaagacuuuguuuuuguuuguuuucugcaguaucucaaaguggcaaagucucaguaaaaucaauguugggaaauugauaaaaauaacagguauuuguguuugaaggcaguugugaggcaccugaugugaggccugggaacuuggguucucuacagaagcaagaagcccguaugacugcugagcccgcucuccagcccccgcagaguuugguuucuuacuucuuuuucuuuauauuagaaaaaguguuuaaaguggaucauauguuuaugaucuggcaaacuuuucuugagaugaaagcgaauguaaaagagaauggucaaaugccugugaauguucacagcaguuuuauuaauaucugucaaagcuucaaacaaugcagauggccaucaacaaaugaauugauaaacuaugacaugucuauacaaugaauuucuauccagcaauaaauagugaacuuucauauauggaugucacaucauuuauacauauauauauauauauauauauauaauaguacaguugaaaguaaaaauauuucauugaguaaaagaacccagagaaggaaagaguaggucaguuauaugcugcaacuuguguacauuucuagaaggugugaguuaacugacaauaagagaaagccaaauguaauuucauuuuggucauugggaaaacacagacgaaggcaucuauuucaaggccagcguaaggguuagcaauaauaaacauuaacagcucgguuuaaauguggacaacugauagaaacguggagguagugauuauguugucagugaugucuggaggugacuuuuaacuguggaccugagacacccguucccuagagagucauugacucggaggccaucuaaacaccacgggcuacagugaacugggcuucucuagcaaaaauguccuuaaaauaaguuuugaaguauauuuaggugucaagcgaaagcacagaaaugaguccguacaaauuaguuaggucuugugggaagugggagaagggggccaggagagaaagccuacacagagggaaucguaauuccuuugauaguuuucagugugguauaaugaugggaaaaaggaaagggggaagggagaaagauaggaggacucaggccaugaaagccuucuguugacuauucacuuugcugauauuuuggucugcuuggcuugugcuuggggaucuacccuguauguuauagguuucuuaguucccacccucuaccugccagauaccaguaggaaccucaccucucaucccugugacaaaguuaucucuugcuugucaaaacauccucugggguguucaguaggggacuacaguugugcugagagguagcaccguugauguugaguuauuaauuucuguacuggaagcaggaagugagcaaagcccauuggcagugguagaacucacugcucucauuguguugguuuaguggaaauagcugguucagagcauucaccucagaggccacggaccaacagucugucugcgagcucccuguuuguaccacagggcaauaauaguacuuaccugaguugcugugaggaauaaauaaguugaagcaucgaguguuugcuuaaagaaaacagugguguuuucuuuuuuaucugagagacuuugcaggcagcuggaggggaagaaaagagacuuccgccugcaguucucucgaguugauuuuuaaaguggucaucacuugaaaaggucuguuaaaaaauuauucugcagugaugguauugaaggauaaauguaggaaaugguacuuugucccugagcugauucuucuucccugggcccacugaaagauccucgaguuguuacagaagagcaggcuccuugagugcagcugaaaaugauaucgagagcaugaaguggcuguuagugaugucaguggcagaguuuggagaaggaacucuugagaaugagguuguccccagggaaaagucuuucccugcauucaccaaagacuggaagccaucuuggaccauggagcugccuggccccuauuccagcaggacuuccagugacucaggaccuucuguagccagauugugaacauuuucuaaccuggcccggugcuggcuuuuuuuuuuuuuaaagauuuauugauuuauuauauguaaguucacuguaguugucuucagacaccccagaagaagacaucaaaucucauuacggaugguugugagccaccacgugguugcugagauuugaauucagggccuucggaagagcaagucagugcucuuaaccgcugagccaucucuccagccccuauugcugucuuuuagacauuuaguuuuagaaguuuucugaaaaugucuuuaaagaugugucaggcuucaacuaauuagaauuucuuuucugacaaugguuaagagaguauauacucuggcacagugacugguucaucggcuuaucaaggucaagaguagcagcuggccccauugucuucccagauucaaggaaagaucccccaacagcacccagauuucccggaucucaaaugcacagagaagucuccacucuuggagccaucauaaggcagaucauuaucaugccuucauccugucccugucgacagaugggcugcuccauccuaagcagaggacaguuaauaacauuugccuccugucauuagcuugcuuucuucaccuaaugggaugacucugaaccgcuuccgaacagcaauuugaaauguuccaaaacaaagcgagaauaaucacuuugcucaugacuucuguuggaaaaugaguauuaaacaggguuuaaaguuuaaaaaguuaauuuuaaccucucagauuuggggccuguucugugaccuugcguuguuaucgucuugcaaauaugaugccaacauuaucccaguugucuuaaaaacaauuuaaaguccucccagcaauuuaggcucauuugacauucuugcuaaguuaccaggguuagggcuggaagaagaaaaaauacagaaaugcaaauaacuggaaaccaguaagacagcagcuaggcuugguggcacauaccuuuauucccaguacuccugaggcagacauaggcgacaucuguaugagugcaagaucauuugcucuacauaguaaauucuacaccugccaagguaacauagggagauacuauuucaaaauaugauguuaaaauagaauauaaaauaaaagcaaaauguuuauucauaucuuuuuaucuuggccugcugaguguaugugcuggcuaguuuuaugucagcuugacacagguagggucaucagagaggagaaagccucaauugagaaaaugccuccacgugauguggcuauagacaagccuguauggauuuagacaagccuguagaacacuuugcuaauuuuagugauugaugggggagggccuaguguauuguggguggugucaucccuaggcuggugguugcuaaaagaaagcaggcagagcaagccaugaggaggaagccaguaagcaauacccuccauggccucugcaucagcuccuucuuccagguuccuacccuguuugagauucugcccugacuucccucacugauggacauuaccuggaaguguaaguaaaauaaacccuuuccuccccaaguugauuuuuuuguuguuguuguuguuguuauggugguucaucaaaacauaacuaacuguacaaugauuuuuuuuuuuuaagggcaugaggcgaucauacagauuuucuugaguacuuuuucuuaaauauuucaagcugauuucuagccaccauauagguuaucuucucauguuuuuuuauaccccaccaacucaaaaaacacagcucucacuugaauggaaaucagagauaguuuguucuggauccaaaucugaaugacuaugcaugccccaggagcacagauuuagguaacuccaaacuccgugguuucaacauggaaguuguuucaugaaguuuuaucaaggaaagcugugaacccaggcagguuuaaaauacuuuggugagcauauaagagaggcuguaauagcaagaaggaggaagcuuuucuauagaccucagaugcuaucugaugacauuuuggcuuuuggguuggugggaagcuaaguucauagauucagaaggcucuuaucuguuagucacaggauauuaguuccaucacagagguggggaaaggauggcuuuuuauugugccucgggaccuguaacauuccaaucucuccauaucacccuaguccuaaucacucuugguagacacucucagcuucuuucuaggcauucucaucaaccaccuuuaacccuugaguucuaggaaguuguuucuuuuguuuuuguuuguccuuuuccgauagugccuugguaggucacuuuggcuagccuggaacuuguuacuuaagccaggcuggccuccuacuugcccucgugcuuguagccauccuccugucucugccuccccagugccucgauugcaucaggcaugugcuucuaugcccuacuagaagugauuccccccaccucccuucaugccugugaguguauggguaagaagugugugugugcuguguacuuaaguggacaucuucuggugucauccucgggagcaucauuugucuucucugaaccagggauuccgaucagcguggcgcugacuaguuagguuugauuggcagaucaccggguuuagcuuuauguggcugugcuggggaucagacucacaucuuggagguuuuaaagcaagugcuuugcccacugagcaaucccaccuccagcuuaggaaaucauuuuaaaucuaguugccuacaauguucuugcccaugauuaaaaguuggaaaaugcugucagcuguuaggguuuauauauaaccucagaggccggugacacugaaaaggcaaagccucgcacuuuguaaguccaauucauggaagcucuuagaaaaucaugaaagcucuuagaaaaccccucguguguacauguacuuucccagaaguucacagcaccacaguuccccucucccagggccaguagccaggcuguuucugacuucacagugcgguugguuacaucuuaugcauggauguauagcgagucauagagcagccucguggagaaugaagccagaagagacaguauauuuucaggagcaauuuagagcaugauugaucuuucugaugcuguuaguguauuguuucuagcugacuggcuuuacccgcagcuccugggcaacacugugcuuaggaagaauugugggagaaacugcaucgauuacuugguaaguuagcucuacacucugaaaugaggaaaucagauugucguuuacccgcauagaaacucugugauacugucacaugugucaccagucuuagagauuucuaugcccaauugcauguuccucuuuauuuauuuuuaagcugucuuuauucaguuuuuguuucucauuggaguagcaguucuucacagaauaguaaccgaaucucuaagaugaaucaaagauauaaaaaaaagggggaaauuguggggcuggaaagcgacucagaggaugaaauccuuugcugccaagacugauaacuugaacuugagccccugagcucaguguguagcacaaaaggagagagcuaacugcagaaagcuguccucugacuacgugcuguagcaugcucacaagcacugguauacacacacaugcacauacgcaaauacacacaggcacacauuccugcauguacacgcacauagcugcaucacacacauagcugcauaacgcacaugaguacauaugugugugcacaaagaguauuugaaauuguauacuaacaugaacugaguuugcuuuaauuaaaucaucacuuuguguauauaaauucugucauugcuaauaugcugauagauagccguguucuucuguuuuuuuguuuguuuguuuguuuuaagauuuauuuauuuuauaugacuacacugucacugucuucaaacacaccagaagagggcaucggaucccaugacagaugguugugagccaccaugugguugcugggaauugaacucggguccucuaggaagagcagucagugcucuuaacugcugagccaucucuccagcccccauucuucugguuuugacuugugugguauacuagaaaaagccaccacaagggggggggggagggggaggaaggagagagaagcaccuuauuucuguuuugcuggcauguauuccuugcauagacuguuucccccccccacccccccccccccgaacaucgaccauuucuuuuacgugugucaucugaguauaagucaggggacacucaaugacauaaaauuuauccuucauucucccauuuaauccuuagaucauuaucaccucucuuuaauuuccuuacccccagauucaccuaacuagcauugauggguagugagagggaaagucugaguucuugggagccacauuuuauggucugugggcuaacaauaguauucacauuccuauaauaguuaaaaaaaaaguacaauacucuguaguauaugaaaauuaauaagaaagucaaauguucauguccauuggauuucugucacaccuauccaguuacauauauaccaugucugacagcuccaauggcagaguuaguauaucagggucucagggcucuguaaagucuaugauguuucuucuugccucuucauagggaagucugcugacccuggguacggaggcauaucuugagaacaacgagugacaggaaaaguacacagcccuuuaaguuagacagucgggugucaugccucaguuuccuuaaagguaaaguugacucaaguuaucccauauuuaaggguuuagaugagggcgaauugaagccuauugagugcgagagugcccacagccugcuaaccaggaccucagggacaaaagucccuugccuuuacaguuacuaguccuuaggucaucuguucaaauagacaaacaaaccaaaaucaaaacaaaacuaacaaauauaagcaaccaaaccaagccuuucucaagacuaguaauagcuuaugggauagaaucuuggucuuugucucugucugucugucugucugucucucucucucucucucucugucucucucucucucaaacaaacacacacacacacacacacacacacacagcucccucaccgucaccaaauugguggcauucggugucagugggcuuuuuguugagaugagucucuguagaacuagucuugaccuugugugagugacagugacuggggcaguagggagcugguggagcagggagauugcuugagagguugaagggagccuaagucaggaagaaucuugccuccagucuucggaguccuuggccucagucuccagggcuauuuccccuguuaaauguuucucguuaggcugaggugcuugcuagacugcacgucuagccacuggcaggcaagaaaacgcuucgccacaugaagaugaaggugcguuggcaguucuucagucucucuacagaaacugcaguuggacgccucccuucuuccugauuuaagugaccauguuuuucccccuuugcucuuccuuuccugccuggcagccuuguaagaguacuguucaagcagccugcuucagagaugcggggugccaugaugggcauuucuuguccuccugaccuccuccuaguccuuucugcugccuuuccccauguuuucuuagccaccuugcagugugggaacuuugccaaggucugcuuugaguccuaggcuguugugugagucugcugcuuguaaaguccagugaauuacuuucucuuguuuauaggggggaucugauuguaucagcuccacuuaggucccuaguauauuuauagcucagaaacugagggccaugcaggggcuaagugcuucuacaugugaaucaaucucucucucucccucucucugaaugaauguugaguccucuggccuuucuugucuuucucuuccucucuugcuguuaaaaauauaucucguauuauucuuuaaaaauaguguuuucaugugaucuaguggucugagauaguugcgucuaaauggcaaaaagcguugcuuguacccuuuuaugccccuggaugucucccgagggaggaagagcgggaagcuaaguuucaguucucauuauuggcuucugaugauagucuggaauuauuuuauagguuguguuuggcugccagcauggugcuugggugugauuaauuucugcagcuugccauuggguaaauaauuuucauuccuuggauccuuguugagaagggauuagccaagugaacuggaaaacaugccuuuguaggagggcuuuggcuguuugugauaaucaaugaacaaucuaguggccaauuuaauccagcucuuacagaacuagcugacucauuggcucuuaaugcuucuaaacaucuucaacgguguuuuuaaucuuaggggacuagguauaauucagaauuuagcuuuuccccagggaucugguucugggcauucugaauaaacaucuugugaaauggguuucaagaugucuuuuccaugagaacucuuucugucuucuaaguguggaaaaaaauacaagaaagguugguaucaauuuagcucuuuuggaaaugaaaaguuaaagcacaauaaaaaggaaacagcuaaaacacaacccagccgaacaaaaaccccagagaaucaggaucuaucuugcagaccuuggaggcagaggaugcucagagccugggacacgguucucggguuuggcaucacgucauuccaggaguaaauaaucuacagcugagccuuugccuggugggaugguuggaacacuuucugcccagggggcacgaguuucuacucacguguuccccccauuugauuuaugcaccgacugacugaggccgagaggucacuuuaggaaagcuuucuccucuuguccucuuggccucgaauaguuuccuccuguuccaaguucucuucugaacauugccuugcccugccugggucugcaugcuggcugguugcuugcuugugaguugcagcagcaugucuacugacuuccaagaaauagaauggucaagaucuuagguacuugacuucgauuuucuuuuaaaggaguguggugcccuuguggacuagacucaggcuuugacaauuuuagccuaaaucuagaugacaggugagugaaggcccgacagacuucacagagcaaaauucaagacauccaaguaaaauugaauuugagauaaauaacagauaauguccuauuagcaggucaagcuauccucugacagucauagguaagucaguauagagaagcugggggucucucucucucucuccuuaaaggcucccggauuaauccaggauccauggauuauugugaauaggaaaauaaucauacaaccaggaaaagagccugccaauuauuaagaauuuucuauauugauuaccuuucaguucccaacuuacagaacaauuguugucaaucauugcccauuugauauauauaguugauguguguguaugugcauguaagucucuggauuuaucuuugugaugcuucuuauguaugcauguauauaugcaucuaguacuuaaaaaaagaugaacgguuauugugauuccauuucaaaggaggggaaacugaggaagagcagcgagcaagggacuggcugagguuaaaguaaaggauggggggugggguagggauuuaguccaagguuuucugagucuuggguggcgccaggguucuaagaugguucuuuuucuccauuaggucuuaucauggcguauuggaacucacuggacagcuuuaaaaacacaugagucugagcacacccccagagggguacacucaguuggucugauauuguccuuggcauggggucagguugggauuugaaauuuccccaggcgauguuacucuagugccgggguucaagccugcugcuuccuucuauuuuuggagucaaaugaauuaaucuucucaggaaaucuggucccucuauguggccaugccuguagguucuaccccucccccacagaaacucacuauuccaaauguggcagcuaauuuuucauggucuuuguuucuucagaauuauuuucaggaaguccugguggaauauauguugggguauaaacaaaccacaaagaaagaccucuugggggucuucuguugauggauuuucugagcgaucuuuucuuuuucauuccuccauuauacuuccugcaccgggaaaugucccuuuguucuucauuuagcuccagcuggguaccaggcucaguauuugaggagguuuacagauuaauaaaacuagaccacugcccuccgggaguuuucaauuuuggaagggaaguauauaaauguaauuccagguuuaauuuucuaagagucacuucagagggacagaggauuaaggacuuccgugucagcagugacagagaggaaaugggaagaauguggcccuggucuccccuuggcuugguuccuguccagcauuauacccccuagaguaguacucagaccuggcuccugagcccaucugucucucagugggguccugaugaauuugugcuucuucagagcacaccagugaucaggcucagggcaaaggcuuggucagugacagcagccauguucagugugccacuggaagcucucaucagaccuucaaggcuuaccucagugagcugaaugugucaguaacugguggccuaaggguguucuauuggccuugaaaucacaagguuucucuuaauuugacagucaaugaagagcugugaagguaucugaauacaaaguuagacauaggcguggauaagaugaccuguggcugagaguagauuagaauggcaagccuaacggacacucuaauuaugcaagacaaagaugaaaaccucuaggccagagagagggggauugucuuugcuuaaaggcagcagcaacugaagagaaggcauuuggagcauguuuggaacacauguggugaugggugggaguguggaacuguggcugucaguuucagcggcaaucagacaugggcagcauggaaggcugauuguuaaaagggaagggggugagaacugggcucuggguaaaguucuuuugguguuaguguacgcagugcagugucacaugccaugcgauuacacacacgcugugauuguacacuuggggauaguguaguaugucacaauaucaaacuugcagugguuuaaggaugcacugccacaaggcuucccaccacagcuacugucccaucuguccuuuaugucaaaaucgagcuuccuuccuccuuugcuuaggucugugcauaacucugcauaggaaaucaguaaaucuuucuuuuguaguuugaccaacagagcaauuucuuuuauuaccagauaguucuguaagcaauaaauaguucuaauauucugagcauauucaucucuaaaugggagcuagacuaaggaggcauuuaguaaugccaggcuugacuuacaauucacaaacagaagguagauggcuuucgauaggguuuuaaggucauuuacacaauuaugugcaguuggaaacccuguacuuuggguauggugugaucgagccuuucagaaguuugguagcaucaucauuucauuuugcuggaauagcauggauuagggcuugguagacuuugcacaaggggccacacaguuaacauuugcagcuuugcaguugaaucucugucccaauuacucaguucugcugccuuaucugcaaagcagccacagacggcacgcaaacaaauaaacuuugugaugucauuguguagcuuugcuuucacagagugggcugggcuugagccucaggcuugucgcuuucugucccagguuaguauuugugcucugugacuuguuuucucuaguucugacuuuugucacccguuaaaaugguauugauaggaaaacucauuucacggggcuauuuggauagugaauggggucucccaggggguuuggcaaagugucugggagggcuauagaaaaggugagguaaaggggauaaaaucuguuuuagucuguacuacacagugacucugguguuuccuggcgacuauuuaaagguaagaagaagagaguagcaaagcaaacuuuagaagccauuuagaauaacaguucuguacaggggacagaugggagcagguagauacugacuuuuaacagacuaggaaaaaaaacaaaaaaacaaaaacagaucauggaaaaugccacauggccaauguuguuuauucuuuggauuuuuuuuuuucuucuucuuucucuuucuuaaaaauuguguuucauucccuugcuggauuugaguuaaacuuuggcucagguuuuggcauaggcuugcucauucgccccuccuccccgcccagcaccccagcagcugaaguguaagaagagcuuuuccuccacauucuguagggagcauuuaucaagugccugcuaugugcucacauugugggagguguugcagcuguagagggaggugcgauaauccuagggccugucacagacuuggacagaaacacacgcacaugcaacagccgugcacacaugccaagacggcguauaaauaaagagggcucguguagcacauccguugagaugaagcugcagaaggacgugaacgugagcagagucacaucagguggcagcaguccacagaagcaccacagagaacacuccagggacuuuguaaguggaguucaucucaguuugguagaaccucuucccuaggaagugacucugcucgucuuaccauaggcgugaagcuuggucauuggcaggcaaguaucuccuugcuuuaaaggcuaaugaaucuccaugacagugaccuagagguagaccuuccuggggacccuuaaaggcuuugaggcauuuggcuuugcuucacaauucgaagaacugcaaagggagggcgacuguucauaagaauaugccagaugcuugacaucuuugccucuggccccuggacggcuugcuaggcuaaccugcuaucaacaguuggcgaaagcaguaaggagcacuuccccauuaaggcgcaaguucagcagagcacacugggacucuuggguugguucuaguguacccagaacaguagaacagaacacaccaagagucagugaccguuuguuucuaauuaaugacugagagaaauaucucagguuugccugugcccuacauuuaacguuggugauaaaagcaugguugucaaaggacagacucgacacauugcaaggaagaugaauucagugcauagggguuacuuugaguaucaagggggcacaugucagcaugaccaccugacuguuuucuggcagcucacgauggcggacagaugugcggugugaauugagccacacaauuggucacugugcuuggauguguagaauuauaugucucaaauauaucuaggaagggcuguccagccagaagaacaggcaaagguauacuagaauuaaagcauaauuagugccccauaauuuagcuacuuugcuauggacuuuuuaauguuagacaggaaccacaauuggauucucagaaaucuugcuucagcucuaaauaucaaagacuaacuguauggcauucccuauccuuaauggagagagugauaugaccugggucagcauuggggaccaagcagagaggagggccucauuuacauagcuggcuaguucccaugcauuaaccccagcauuagugaggucccagauacggucaccuagucugccuuccugcuuuccaugcuucucuucuucuagagaaacccagcguguuuucucuaguuugcauggauucauaguuccugcuuuugauacuaguuauauauggacagacaugauucaugugccagauucuauuaguaggauacuuguagugcuuggugaauaauuguuguuguuguuugcuuguuuguuuguuucuucaagacagaguuuuuuucuuuguagaccugguuggccucgaacucaagcaaucugucuggcucucccucccaagugcugggauucaauaucaguaugagacagaaugagagaaucaguaugauucugucauguccauugcuaccgcaggaaccucccuauguauuuuauuuacuuuacaguguccuuugccuaggaagguguacaaacuaaguacuggaguuugaauaggugaauuaaaaugucaaauacagacagaguuuggccguccaugaugauuguugugggaguuggagaccaggucacuaaagcaccaaguccugugccuauuagccaggggugagggggguggcaguugcaucuuuuauaugucacucuccuggagccucccauaaguuguaaaauuguccacauugauuccuuauccucuaauuuauuuuuagauaaacauuuacaacgaaucgucauguuuuaaaagguagcuuuauguuucaaacauuugcagcaauauguguaugcagcuuccucaauuccuucucuuggccaugcacaauuuacaggaguauuggguaccuaugcaauaacgugacucuaaaacuaguagauugggcaccugugguaacaagcacaagcccgaguccaaacugguuuuauaguuggaaacguaggggcucaaccgacagagcuucugggaacaacuguuccuuaguaacuagggagagcucauuccguucucagacauuuccuuagacccugagucugugccaugagaaacaaaaacccagacagauccuugagccagagagcuuaguuucugauggaggggauaaacuguaagagacaaaaaggugggaagggcagcuucgcagagggagcaaaugcaauggacgcccugcggguuaagcuguggccucugagacaugguguuucugagagagugagacuuaaacucauggacauggcccucgcccaggagguuuguaguccaauuuguugagacaaggcaaaaauacagaggagaaaaggcacuaaggggaaauaucccuggaauaaucaaaaagguagacgugggguuggggugcgggucugugguagacgugggguuggggugcgggucuguaguagagugugugcuuaaucugcacaagggucaggcuuggaucucagcacaccccuaaaaugagaacccaagcagauaggacuggaaucucuucacaccuuaguucuugaggcaaucaaaguacuucugaguagauaguuuucuguaguuuacugccaccuuaaaugcacuugguguuucuacuucugggauaauacagucuggcuauaaggggguuaguguucugugcucugaggucagcagguuuuuaaauuaagcuaaagaguauuuuguuaagauaauguuuuucaaaaacaaaacaacacaacaacaacaacagcaacaaaaaccaaaaccaaguuucuucccauaaugaggagaaaaguucagaggucaaacauuugcgauuuauuuauuuauuuauuuauuuauuuauuuauuggccaggaaguuucuuuguuaacuugcagugguacccaugcaggccuguauguuuucuugagccauggucuuauagaauuuuugaaaugugccacaccccagaauaaaaauucuaggcaaaaaugccauguggucuuaacgaagccaugccacccucucuucuacuuggguggauuuguugcaauguugugcuuguuuauuuuuggaagaagccaucagaccuaccuagucaguaguccaucuugccaggucaagcccgaggggauucuaacccuuucuuuccuuccaucauucauguaaauucuugguggcugccuguguguucaguggaagccauccaucagcauuuccuucacaaauucuccuuucuaugggguuuugacuuggcauuaccacuugguggucuuuucauuguguacuguguucaaaccauagcuuuaacuuuggaagaaaacaaagaauuggcaaguaaauugucaggacuaaucucuguccaguguauauaaguuuuuguuuguuuguuuucuguuuuuguuuguugagacugccuucgcuguccuggaacuuucucuguagacuagguuggccuccaacucagauauaccugccucugaaucuucaguguaagaauuaaagaugugugccaccaccacuuggauggucuacacaacuuuuuaagaaacaugccagcuggacauugguggcacacgcuuuuaaucccagcacuugugagguagaggcagguggauuuccgaguucaaggccaaccuggucuccaggacagccagggcuauacagagaaacccugucucgacaccccucucccccacaaaagaaaaaaaagaaagauaggaaggaagaaagaaagaaagaaagaugccaaugucacugucaauccucgaaaauuuuauuuauuuucaaaaauuuaucuucuguguaucaacacucauaccaaauaccaaguucugggcuuuaaaagaagauuuuuuuuuuaaaguuauguauuuguguuugaaggauuuauuuauuuuuuuaacucuuuuuuauuagacauucuuuauuuacauuucaaauguuaucuccuuuccugguuuccucuccaaaaacacccaucuccuccccuuucccccugcuccccaacccacccacucccauguccuggcccuggcauuccucuauacuggggcauagaaccuucacaggaccaagggccucuccucccauugauaaccgacuaggccauccucugguacauauacagcuagagccacgaauuccaccauguguuuucuuugguugaugguuuagucccagggagcuuugggguuacugguuaguucauauuguuguuccuccuauggggaugcaaaccccuucagcuccuuggguccuuucucuagcuccuccauuggggacccugugcucuguccaauggauggcugugagcauccacuucuguauuugucaagcacuggcagagccucucaggagacagcuuuaucaggcuccugucagcaagcucuuguuggcauccacaauagugucuggguuuggugguuguauaugggguagauccccuggugaggcagucucuggauggucauuccuucaaucucuguugaagcauuuauugaacuggguguucaagguaguauucaguggccugcacaucagaguucaaaacacuggcccuggagaugccuguguucuucuuguucauguguaugagaaccugaaugaauaauuuaacauccuaacaugaaucugagaaguaggaauuagauacuguccaaaaguaagccauucuuccuggaauguuuggucauuguuuauuuauuuacacauauuuaauugcaugguaguacuaaggacugaagccagugccuugaguguauguguguguauauguguguguguguguguguauguguguauguguguguguguguguguguguguguauguguguguauggcaagugcuguacugcugagcucugucuccagcccuggaguguuuuuguuuggaaggcuuaaugagauuaggguccagacagauugcaacgguagaggaaagaugaguaaaauauguucaccagucaacaaggugacagaauguguucuuuuaugaauuugucaaaucuaaggucucauaaugacaagguggaucguccuaaaggagcugucuugucagccuggguuuuuccuguucuuuuuuuaaacuuggaagaaauccaaaauauagaaucuuuauagauuaaagaaauguaguugugugguggaaaaaaaaaaugcuuuucugaggaagcuaccuuuuaaaaugaacugcugcuuccaagaacagugacacccgggaggcagaguugggagacguucccuaaguucaaguugagccugggcuaugugccgaguuccaggccaacuagagcuauagagcaagacuuuuguuuccaaaaccaagaggcuauauuuguaauccuagcacuugugcagguuaaaguaggaggauugccuugaguucaagacuaccuagugaguaccaggccugccagggguccagagugugacacuguuucaaauggcaacaaacaaagaagaauggacuucugggaaacagcgacuuaggaguuuuggagacugauacuuacuugaauggaauucauugaaaaugcaccuaaaaucacugacuugacuucaggaggaaaugaauucuccaugccuuuugcuccuuugccaacauucuaugcucuaaagaggcagcaaaguugaaauuccacauuuaaaaugugcaacuagaacgaugaaauuuuauuuagccucaaauuagugaaacauacuuauaaguggacuugugauagauaucagcagugguuuggagagagcacugccuccuggggaauucacacuugaguguuguuguucugagauggggucuuguuauguugcccaggcuacauacacuuggaaucccaugcucaacuggcugcuuuggucagccuuccaaauaguagggauuuagaugugaguuaucucaugccuacauagacuuguuuuugagucucagcugucaccccagggucugggaaaagggucuuugucucugaguaucagguuucacacuugcauaugagggcacugcucugaaacuguaggguaguuggaauuguaccaaggaagaaagcccaggcuagaucaaaccugacuagggugguguaaagacaucuuucuccuucccuuccuauucuccccucccuuccuuccuuccucccuuccuuccuuccuuccuuccuuccuuccuuccuuccuuccuuccuuccauauauguaucuaucuaucuaucuaucuaucuaucuaucuaucuaucuaucuaucuaguauguauguauguauccaucuaguacgcuuucuaauuuuuaauuuugcucuucaguuaagacucaucuuuugugaaugucaccuauaagggucauuucuacuucugcuuuuccaauggccaguaaugaguuuuguuugcugugugcugauagaaagacaauugcuauggcacuuuguccauugguuugauaagcucuuuucucuccauguccuguauuaaggguuaaucagaaugguuccaagccauagcccccacaugcuuuugaauucagucaccaggauuguugagcagucucgaauaauggaaauagcaaauuuggacacuugucaguagccacaguccaucccaagaugcugcagauaucaagagcucugugacuucuggugggggaaugaggcucaucuguuguccguccaugucugugugguccccuaaugucaaugugugccuucaucagugucagccugcuguuguuucugcuuuuucuaaaguuguagacuccagcaagccacccacacugcagaacccuggaagguguuaucacauuuaucaguguucucuccaagaagacauagacuccacacagcuuaagauaccccaucuuaagagaucuggaaggaaguguuugaaauggcauacauguuugugguucugguaaccaaggaaacgugucucuagauacaaagccuccuuuuuaaaaaugauggcacuguacugggauugucucagaaucacccucagcaagauuccaaagggguuugaaguuaaacuaggucaucuucagaaccugaauccagaguuagccgacacgugggcaacaucucuuaaaacaugcaguguuuagaaggggggccagugcucuguggacacggggagccgccgucugcauagucagaggcuuguuuggauagauguguaaugaaucccuccuggauucaacuucccuugacucuuguuuuuuuguuuacacuguuuuaauuucuuguuugcuuccuuuagcacgucuuuuggaacaguccuuaaaaucauacagugaaauuuuacucaccagccaccaauacuuaagguauaguuuuuaguaacagauuuuuccuguccaucaauguagaaacuggacuuggcuuagaaucuuuuuuuuuuuuuaaagauuuauuuauuuacuucauauauguauguacugucgcuaucuucagacacaaaagaagauugcaucagaugcccauuauagaugguugugagccacuaugugguugcugggaauugaacucaggaccucuggaagagcagucagugcucuuaaccgcugagccaucucuccaguccuagaagauaaucuugcucaaacuuuguauuccuuuuuuuuguaaaugguaccugaauggaaccuggugcuugagccugcuaagcacacguucucccacugagccauuccccuaguucaugucacuccacaaaugagaaagcaagccauuaccaauagugaagaggcagaggcuguguaugaaucugaauauacacaccagggcacgaggccuggaccauugguacagauugcugucauuuccccgacacacagcagcgcuucuuuauguuacagaggacuucugaguacuuggcaacaggaaagacaucucagggucaucacuaauaaaggaguacggcagccuuggccaugagcaucucacccucacacucuagugugccacacaggacuuagaaguauguagacaggucuagggcagcggagcuugguguggggaggcuuucagugacuugcagccgccaugaauaccugcaguuacuuaacucuggauggacucuugacaggcagaucgguagcaaccucuucucuuagacuucauuguaauaaccuguaaacugaaauugugcuacguuuuccuaagugauacacuucauaauuaaagagguugaagugggaagaaguguucauagaauuuccgcuugagagcaauuuugacacccgcugccugguuaccuauuaauuaaauuauauaccucaggauaaaauuucaguuuaguuagaaguuaaguucuuguucucuggaaggcacugugaagcuuugauggaauuuuaaaccagguuauuagagagucaugaaaauuagcauagacccccgaaacaaauuuuuauuauguaccugcguguaagacuucugggccuuccuccaaagcucccauucacuagagccaagggaccuugagaauuugaguguccaguaaguucccagggaauuccuacagcuggugcucuggacuacuguugaggguuccuguauuggagagagccugcuuacguccccaguuuaauagagguauuauauuuaagcuggugcuuuuauuuccaucugaacugaguugcucugccaguuacuuaggcaucuaauccaggcuuugugcuugguggcuugcugaugaacggucaccaggugacuucagguugggcagcaguccugaagugcggcaucgcagguucugugguaucagcaauuucugagguucucagagggcaugagccagcuuaucaauuucuuguaugucuagcaggccucucuagaauacucugcuaucacauaaguauauagauuucaaagcauguguugaacaugacccuuagcugcgauaaccccuuaucauccuuuaaaggucagguuuggggaagauggaaauuaagucauuguuuacccccaaggaaagcgugacugcacaccaagagguuuuauuggcucaaacugauuuucguuuugaauuggucguugacuagagauuuuucacacaggaaacacaaacaaacaaaaaaaaccuccaaaaaccuuguaucauccucuaaagggaacuuaaagguggaggcaguuccagccccaauucucacuuagcauucuuugagcugaagagaagggguuugcccgggcacccuugccugcugaagguggggugggcuaucaccugcuacuucucccguacauucccgaugaccuccucugcucacacaccuggagccuguuuucugccuccacagguucaggugaugguggucuaggcauuugaucaccuugacugaccucuuaacaagcuagcuguaggugagaggguacccauugcuucuuccuucaguguucccuuuacuuuggggaggagggcggugaugacaagaaggaaagagaaaugacauugucuccaaguggaagucaaauucuuuacagcccucuaauuccucugucugagcuucagaccuggguucucagucacgugcuuccugaagaaugaaugaauguuacagaugcguucauuauuguuuaugggccucauacauucuccuugcuauacuccuguuauugguuuaucuccccaguguuucuguccccuugcucucugggucuguccugccuuguccaguuuaguauuuauauucuuagcuuuuuuuuuuuuuucaaaggaugggaaaauagaguucauauagucgcccacagaagucacucugugguuguuuuauuugagggagcuagaaggagagagauguuugaagagcaucagagacagaaggcacuguuucaaucuaaucauuaucagauugagagcucagugcgcuugcaacauuuuucugaggaaauacuccugggaaugaauguucuggguaaauaccggccuuauaucuuggcaguguucacauuucuggccacccacaugggguguauggggucuaaccuguuucaugaaguucaaggaacauguuucaagaguuugcgugcucucguaauuugcccugggaaacaacagauaguuucccuugggaaauauuuguguucagaaaucaauagggagcacggaagcgagucucuugcacucugggcgcuggaguuugcagguagaguuugugccaaguggcacugggaaagagccaguggacaacagcagaguagacaggaagggagggguugcuucuugccuggggggucaguggcuugucuaaggcacucugcuauuggcugccuggcucaaguucauaugaauaaucccuaugguguacucagcagucacuuggugcuauacaauauaacacaggccuuuugcauucccacaauccuugcuugggaaauagaaaccaacugcugaagaaguuggccacauugccauggucucauagcuuucauuuagaauuaccuaucuguagaugucaugucccuuaagaaagcguuagugguaauuuuaagaagucacacugggacagucugcaaacagccagagauucaggagcacucaauccuaaauggaaugucugcaucagacuccucccucagggucagggagcccugcagaagugggguuagaaagauugugagaaccagagggcuugacaccaaguaaaacaugccuuccagacacaguaggaaugaugugcugacguauguaaagaguguggcagcacacacagggccugcacagguucuucugugaucacgcacacacacacacacacacacacacacaggguauucacagguuuaagccacaugggagcccagugcugagcaguggaaguggacaagaacaaccauccuuaaccaagaagccgucuccaguugaccucugcuugcaaggaaaaauuaaauuucuccaguggagucucauuggucauauuaaucacauuuaaagguaggccccaugcccaguaguagaugacccacagaaugugaacuuaguuuuguaauuuuguacacuuccuuuugucucuuagugauuuguuugggucuuucuuucuuucucucuuucuuucuuucuuucuuucuuucuuucuuccuuccuuccuuccuuccuuccuuccuuccuuucuuucuuucuuuucuuccuuccuucuuuuguuuguuuguuuguuuguuuuccauacuggucuuuugcuuuauauuaugguuugcaguuuggugguuuuguguguguguguguauguauguauguauggugugugugcuugcauguuuuuuguguuuuuucuuuuuuuagauucuuguuuguuuugguugguuuguuuguuuucuaaagagagagagaaaggggauggaguucggugagugggaagguggggaggaccugggaggaguguguguguguguguggggggggggggaguguuggaaaccauacaagaagaaagggaagaaaaaaaagaauagaaaagcaaaaccguagucauugcugaauguagugaugccucuagcauguacuguuuaccccucuagacacuauucaguauuuuauuucuaauguauaaaacaucuuuacuuuguuaucaugcguuauugcucaguuucccuuuccuuuuucuuccuuauagcugauuuacccaccaacccgacccucgugcauggguguguuccauguguauaugugugugugugcaugugugauaauuuacaugcaaauagacauauuacucauucagaaaaauuagacaauacuaguuuuucuacagccaccuaaagugagcauucagaaugguguagcgugugucuggugacuugagcgugguaggcuugccauugagaguucucucaugcuuccguuuucuguaguugucccgugcuaccuagaaguaaguguguauuuauaaagaauguauuuauuuuuucauuaaggccagauucauuccugcccuuccucucacauggcccuaggccagcaguagguuguagcucugggaagagagcuguugcuucggggacccaagcauugggcuuucuugcuuucaguguucuccuuacuauaggggccuuuaggaauguggccgcagcuccuuccuauucucccauugcagccacauaauuaguuauaaaaugcucacuuggaggagaaaaacuuaucucggcaaccauuaauucccacuguaauuuauuuagaaucugcaguguuucuauuaauggaaaacagagugugagcaucaaacagcgaggcucauauugauaauugcauacugcugguaacugugaacuaugagauuacucucauaaaagguaauucccaugacaaccuggaggggaaccaaggaacagcugcaagguccagccuuugucauuuuugccccucauuugguaccauuuaccacgugagugcugaucuugugcuggggauauuuuugaacuaaauaggaauggucagagagcaguggacauuuuggguagaucgagggcacucggugguugcucuccagcuccuggcuaagagcucaguggccaguacaccugagaaagcuucaacucaguagaaacccacggggcaauaggagucugcucuuccaguucacauuuguguaagugaaugcucagaguagagauggaaagagauagcuggagggagaccgucagacaaacagagagacagacagacagacagacagacagacagacugcccaggcaguagcaaacgcucagaagauggacauuaagccugccucugcgccugccucugggagagacuugacuuuuccauucuugaaacccaagcaucuuccacuuuugcauggucuuaggaagucguccagcacauuaaaugagcugucucccuaauauggcucuguccacugaagaccguucaaaccuaagcaaucuggguuuguaaguugauaucacgacucacacuuuaugcccccacccccccgaauauuaguucuaaguacuauuuacagcuucuuuccucaaaccuuaccaccaggaagucacuuugccucccccuuugggcccaaguaccuuucuggaagcccagguccuugcggcucugugauagguuauuaccucaagugauguggucaccaagaagcauguugucuguguuccagagugaaccauguaggguucauuggaaaagauccuauucagaaguguacuaauggguuguuguacgugcuggacaguguccauacaauaucaagaauccgugacuuacuauauugucuguagaugcuaacccuagugcccaaccuguuauuuuuuggaaagaugaaggaaccagaagaacgaaaugaaauguucuaacuguaacaaugcccaugacagagcugccagucagaugacaguucgcuaacgacuaaucuucaaugcaccucucccccuguggcuuagcaugggucacauguccaacuaaaguuaugaugaugauauauugauuccugucucaaggggaugugucaaaaguuuaauuggucugcuaaacaccugcaaccgaggcgaguuuauuuuauuugcuugauuucaaagaaaaacagagauaaguugaaagcaagaaagcuuagagguuguuauauuguuuuacagucagacauaaauagcauacuaguaacuguguguaaauaaaaaauaauuucaaaggcuuguuuuuaucuuggacugcuaauuaagccagugacuuggauaugcugcuuucucuuacaguuuugcucacugccaguauugagccucuggacagggaaauaugaauuauuuggggggcaggucaggagaauuaucuuagcaguaacugugagguuccuaagaucaaagaucuugacagugguccugguaccucucuaccuagccucacaacugguaccaucuacauuuacccuguaguaacagugguggcuggcaaugcuuauuguaacugcagcauugcugggcuuagcuucuguaacuugugacaaugacugccuccccucaccccacccccauccugacagugucgggccuccaugauuuaugacagugauugucagggacucuugaaggccauccaauuugaggaucuagguucucguuucuugucacuucuggcacauuugauggauucuugcuaucagcuggcauguuucauaauugucagaacuuugauugaagugguauuuuugcaaaaaaaaauuaucaaagaguuauuuaaaaaaaauacuccuucaccacauuuccucaccucugugcccaaaacugcuuugugugagguucacagucccaucauuuaccucucugugacuugcugaccuggcaaaacggucucuucacuccucuuuuauaguccugugccuuguauuuugcuuguuugagccuuuucuccaccacaggauaaaagcuuuuguaagcagcauuaccgaggccugguacagugauucacuccaguaaucccagaccuugggagggagaucaggagucugaggucaguuugaggauagccugggcuacaugauaccuugucagaaaacaacacuaucaacucgaaagagaaacaaaagcaaagcaaaacaaaucgacaaaaccagagcuaagcaaaggagaguggcaccugggaggaaguugcucagcucuccuuugagcagccauuuaaggcagaugugggugggguggcacuagacgguaucaggcucccuucuuaucuuaaaccuggugugguuuguucugcuucuguuuuucccccacaagccaacauucuuuggcuggaaugccuguucuguagaucucuggcugccauugcuacguagaaaucugccccuggacuuugaaacucuacucuuggggaagccacagaaaucagccaggggccaggaauaguucuagucccuucacacaggaaggaaugcucccucucaaugcugaguaucuuuccucucucccucucuccuccuauaugucagucuuacccagugcaggccggccucuaaacucucaguguaggaagguuagggugagugugaacuccugaucccccugccuccaccucucaugggauuauaaacauugccacuauccauccaccuuucauuucccucuuucuccccucuuucuccucucuuucuccccuccccccugcucccuuuucuguuuuugagacagagucuaugcuauagucuaggucagcgcgggacucacuguguaucccuggcuggccucuagcgcauccugcuucaggccuuucagagaguagccaccuccucucccuucucugugugccaggcacaguaacaggagguuucuccucuugcuuuaauuacacagcuucuagaucucaguuucuuuucucagaagcaaacccuguuagaaguccuuuuuuguauuuggacggaggcagcuccaugcauauauaguaccagcucacauccaucuguggaaacacacaaacacacugacaagaagauaugguauacacucauaaaccuccacuuuuacucugcucuuuaaacacccagucucuagcaucucccuccugugcuuagaggaagaggucuccugaugucuccuccaauggccaggccuccuuucaagcuuccucuagcccuguuuguucucccuucugccucaacccucuagucuccugagcuguuguuacucaggcaagugugucucaagccccuugcccuggaugcaguguccuggacuaguucuugauagcacugaucagcagagucuuugugguaaguuaauaacucugggguggagagauggagcugaaggcucauggaggcaaaagcuggguuccauacccacaaccuucaguggaaggaaagaaccaacuguucaacauucuuugacacgucugaccugacauguguccuggaaagaguuauggucuauucucaggcucucaacuccucucccauccccuccuuucuuugauuccauucccaucuuucucuuucuuugucuuaugcaugcuaguuaggcaugcacuuaaacaaucugucccgccuccugagugcaguccuaucugggcacuccuggcauuucccccccucuguuguuucuaauaguucuugagaggacagucguacuaagaagccuagcagcaaagcucugagaugucuuggcaguuacuaagaauagcuucuggcuuauuuucccacucuuuccuccucuguuuugucuuaacucugaagcauaagagcucccucuuaucuuauuaacaaaauaauacauucucuccugggcaauuacacgaguguauaugaucucuuccgacugccagccgucugugucuguccagaagucagcaaggggaugaaaaggguucaaggaagggggcaguaagugacaacagaacacacuguagacuacuugucagccugaggcaggucugauguccagcaucucuauguucccagccccggagucacugcuucuaaugcaucauggcccuggaccgugagaaugaaugaucagugggaagaaaggaagaagugcuuuguaugagcuucacagucccauccuuuaccucacugguccuggccccgacacugugguucaggaacugcuagagccauguauuccucgguacuauagccacuucuucaugucauuccuauguaggcuccuuccuccccuccucagcaguagcuuuuuauuuuuagaaguuuuuuauuguuuauuguuagcauuauuuaaagcagggucuaacucuguggcucagaccggcuucaacguuaucaucuugauggcgcagcuuuggagugaugaggcugaggugucccaucaugcccagcuucuguauuaaucuuuggugauuguguucaugugugcauaucuucaggcauacaugcuccugugggcguguaccuguggagccagacgucaacauuguuuuugaaacaguagcuuugccuggaacuugcugauuaggccaggguggcugaccagccagucucagggaaccaccugccucuacucucccuguacugggauaauaaguguauccugcugugcuaccgcaucuggcuauuuuacauggguucugaggauggauggauuucaguuccucauccgugaguggcaugcacuacccacugggcuaacuucccaacauuggugauggaguugacacaggaagguuaaucugucacauggcucugcaucuggaugugaucaucauucccuuuggaaggcagaggacuugcuucugauucccauagcuccucugucgccugggagucuucuaaauguccuccacucggcucagggauguuccuacuucgaaguugccauuggccgacuaagguuucuucugagcaacgccagggagggugucccuguuguccucccauuguucugagucuggugacacuguauuuaauugccaguacucaggacuguuaugcuucguaaggauuacuggguuauuuauaauuaguucauugucuguguaccaguaaugcuacuugaaguucuggaaaauaguuuaauaagucuccuuuucccuacucagagcaaacuuccuuuuucaguaguuauugggaaaguaaacuuuacccucauuuaucucaagcaacguaacucucuuacucaugaacuuuauaucauagucaguuaacaucuaggaaauaaugugaccuugccuugagaugacaugucauauaacauagguauuguguugguuaguuuugucaucuccacacaaacuagagucaccuggguagagggaagcucaggugaagaguaggcugauuaaagugggugccuacagcccauaguagucagggccauuccuggacagguugcauggguaguguaagaaauccacugaguaaaccagggagagcaagccagggaguagcaguccuccaugcccucugcuucaccuccucccuccagguuccucagugagguccuguccucaaugauggacuugggagugugagauaaauaagcccuuuugucucaaguugguuucgccagcguuuaaagaaugcaacagaggacuagcuagaauguggauuaaaacucuagaccuaaguccucuagcccuccuacccccuuuccugccuuucccuuggcuuuugauaaaaccaucacauuaacauaugcuuggaugaaaaaacucuauuuuguucauuaauagaaaauauggaucaaauuuaaaaaaccuuuccuuaaaaauuguacuauaauccuuuuuguaugauuguuuuuguuguuuuguuuguuuuguuuuguuuuuugagaaauauaucuguuuuaaaauagggugcugaaagguugugccaaacuauuuguugguuugaguggaagauaaaccauuuacuuuuuggaguauacacacuugauauuguguguauacuaaucguaaugcacugugccaaaucaguggggguggggugcuucaauggaaagccucauucuguaaauguuugaccaugggaaaaaaauacaggacuuuuuaaccugccugguugcauuccauaaaauaauaaauuaauggaauuaugaaaauaacagggcuggugagauggcucaguugguaagagcaccugacugcucuuccaggcugcucuuccgaaggucccgaguucaaaucccagaaaccacaugguggcucacaaccauccguaacaagaucugacucccuuuucuggagugucugaagacagcuacaguguacuuacauauaaauaaauauuuaaaaaaaaauuaagaaaauaacagacagucauuauagccauuuuggucaaacuuugguaguucauagugaggccucagggaaaggaagaugcaucuuuuaaacacguauuauuuuuucucucucuuuucccaacacuauuuuuucuuguuuucucucugauacauucucauauauauaucaacuucauagacacccaauagguuauugcucauaggcaacauaauuguacagaauauaaagccuaugauuacaguuucauuggugguuggcuugucagagauuuuaugagucuugagacuugcuugaaaagcauggauuucagccacguuucuguuugauuucagguagaccguucuuuauauuuucccucccucccuccuucccucccuccuucccuuuaucccuucauccauauguauauuauaguagguugaucagggcaacuaaaugacuaagaggauggcguggauugagauaaacagcaaaaauauuaggauuugagaguuggaggaugaagagugacguguagaguacuguucuggggaacucacacuugcuucccaaaucccagaaggcuguaauaaaagggcaccucucuacagcagaaggaagucguuuaaguuugaauaaaaggaaaaaggauguguguguccagaugauaacaagcaaauaggauucaucuuccugaguauguuuguagugcucaaggauauguguucuagagugacugggacggagccugauagcagagacuccaggauaauacagggaaacccagacaccuucucuaauccucccgucggucaucacccacagaagggauucgaugcagucuguuugauugcuauuguccuacagaaagucuggugggaacuggacuucugcuugacccugagugacaauuuuuaugcuuuuaaaauugguuaucuuccagacuggucguuuuuauaguucuuacgccucaguaccucaacuugugcagaacaguuuuauuugagucauaaauuuuuaaugucaaaaccuuccugacaauuauuagcuaaauguuuagcucaauagagagauuaaauacauacaucuuagaacuuagugaccaaaugacuuaaccuauagaaggauuuucaagucugaaguaauuucccaggacuuuaggcugauacacacuugaucuaauauuugaagucagaauaaaaaugcuuguaauagaugauuacuguuggucacgugaaaaaauuccauagagucagucucuaguaugcauuugggauacucaucaaugcaagcuuucucccuuuguuguuaaaacaaaaguaauuuacacaauaagugacuuauagagaaauuuuaauguguauguuuucaccagcucuaacugaaauuggaaagcuuugaaaugaacucauaaauacagcucuaaaguacaaaguauacuggaagcuguaaaauucgcugugccuuauuuuugaaaaauauuagccuacauuaaauuuaaauguaauugaacauuuuaauugaaaaauuaaccuacaucaaaaagaaaaagauuugguuuaauucugucuucuccaaguugcucaguaauaucacuauaugacagccugacaauuuguguuguacauuuuacauguagcauuuuauuuggucuguguagcuaagcauaaugucagaagcaucugacuuuauagccagagaagcugugguccagagagaagaaaggcuccauggaaggccacugaaauagcacggugagggcuaaagaaccacacagaccacaccuuaccuuacacauccuacuccucucccuuuccaucaugcucgcccguaugugaugcuguuuaaucaaucagguagaguccugaaagcaacucaguuagugcucagcugcaaagggcagaugcugaauucgaaucaaugaagacugugcuacagccaugguuaacuacacuggcagccuugucucauucuggccagcugauuauuugggaaacuaucccuguguuugaucagauaaugcacuaaaacauaguuguaaggagcguuaucgaaucuguaauguauuuuagauaacgcaauuaaaauaguucuguuuuuacuugauggguuuaaauccaagucucucuucgacacacauaccagcaccuagcaaggaguggaguggaauguggcauaaaaguugaaaucggugauacguaaagaagggaccaugagguguucuuuccaauuccagcaaggcugaaaacaugaaaaucucaaauacugugagguuaaccacuuacuuaccuuuccggugacugcagaagcggagaugggccuguuaucucagcuaguaauuucugcaugaaauucuauuaaaaccgucuuuggguagacuuuuuagaaggaguccuacugaagccccgaauacagaauuuauauucacucccuuuuuuaaaagaccuggcaacuugcuucagagacacuggaggagccuuugaaacgagggcugccugacauuuuugggugucuuuucaacaaugggguagucagaggucugcaacaugagaacauaaaagaaccauuucccguguguugaauuuacugcuuuugguuauuagccacugcuggcuucaaggcugugcuguuggugcuucugugggccggacgugaguaccucaucucugccacuuuccauuguuaacuuugggaagacucguuuaaccuuugccuuaauccaacuauaaaagcaggaugcagacacauguuuaacaguacaucaaguacuuaaaauagugucuggcacccagaaaagaugucuuuuccucuuaacuuguuagaaugggacauaaugauagggaaggaaauaguccgccacccuacagccuugaaggcaugguugaaggucauucugaggagccuuaagcauuccuuuucccagugcagacgaugagagaugcaggaucacaggacacgacucucccuguucuacaguuuguacccauuauugauugugugguggcuucuaacaguguaaugcuggcuucugcacuuuaacgauuauucuucucguaagcaugucucugccucacauucuguuuucuauacacaggcauccugugcacagugguucccagcacugucuagagauaaaugcucgugacuucagucucccucuacggaagacgccauucugucuuucuaccaccucuuuccuuuccugucccauuguccugcuuaccacaugaaaaggaccaaggguggaaaucaaacguaggaaacuaacgguuucagaaacgaagggcuggauuucuaaagccuucauaauauauuauuauuuugauauuuuuguguuuggaucuuuaagguuuuuuuguuuguuuacguguuuguuuucauuuuuauuuuuuccuccucugcuuccaaagucuccagaagcacguuggucaugguuuuacagcuuugcagugaugggugcgauaguugcuuuuuuuuuauugaaccauagauugcagcauuguaaagcuuacucauucggaggaggaaugaaggccauuuuuaauugcacuugggaagugggacagucuuauuaaauuaaaccugcaucuguauugaaaggaagagagagaaaacaagauuguguucucuuugggauuuggaguuucccagagcuggagugaacucagggcugcaugacaaaagcuguagcuccagucucuugggauucugagucagaauuuccucaguccugugauuaaccacaucuacccauaaccaugacaaauuaaccaaccagggacacacacacacacacacacacacacacacacacacgugcuuacagcuaggagaguggcauagagaguuuuauaguaaaaacaucuauggcuaugccuguccacuuuguuaguuuacuaggacggccauggcaaaaguccaugaaaaucaguagcuuaggccacaccagccuuauguuauagagccuagaggucuaagaccuggguaucugcaggcugcuuccuucauccagcugacagaugccuuuuccuuuucucugcuccuuugaccuuccuugguuuacagaaccuuuguccugucuucaucuucaagucaguaaugcauucaaguuuccucucucuccuccccccccccccccccuucacuuacaggcucauccaaacccagacuuucuccucuuguaaggacgugagucauauguguuucagggcccauucugcucuaucauaaccuuuuaacauaaguacucuuauauaacaaugcucuuauuuccauacaaaaucacagucaagagauaaugaggauuauggcuaggagagggacauaauucaaccucaaacauacuugugaguuugccuuucuugguauuccucuguguguguguguguguguguguguguguguguguguguguguguguuuuaguuacaacuuucugugauagguuguugaguaguucucacaaguauugaaauugcuuggaagggggaaaagcauuaugcaacgaacggcacuaauuuccgucuugacauuucagggagcgauucuggaaagugaggcagcucugagccaaugcguggaggagccugugcgagagagcucauuccuuuuguugcauuuuuuuuuccagagauucuuuuggcagcgcugggcccaguccagaugccuuccacgucagguggcuuaagcaugugugugcacgauugugugcaggguugugcgcagccaauuacaguuggaaacaguugcuuagccagcaauuagguuccuugccgucuagaauuacauugcuuuaaauuaagauucugcagauuugaguugcuuugauaauuuugcaaaauccauuuugagguuauagcuaaaaauguaaucuuccaauuaggaggguuuuuuuuaucugauaccuguuuuguucauuaggcugugggccuauuuuaauuuuuuuuuuuuuuuuuugcuugcuuuauaaaucagucgcaagaguguaagucagccagaggaagggaggggaauccugugucuuuggcccuaaaggugacuuuccuaaggagccgauucaguuuuguuacuuuuucucuucuaaaugcaucauauaguuuguguguguguuucaaguaaagcccaagguuuuacaagaggcaaaaccucucacaacugaacucuguuguuuaaauaugaacuaguauucuauuauuaaaccaggccagcugagacaagcuuuuuaauuagccuacaaaagagaggaaacagugugaggcgaaugagguaguuuuacuuaggaggaaugucuuggaggcuuaaaaaccgucuuccgcugaccagauuuggauccauuuacacuaaaaucuugacuuuguucccucugacgauuaccuuaucucuguaaaugcacuuaccaguacucgagggcacagaaugcuacgagccacaaacauuguuaaaguguacuaggaaguugaccaguaugccguguguccccggaauucaucuuuaugguuucugcacggugauccuguuccuuugaaccagcacgaggaagagacugagccccaccaugaucgagaggccugcugcugccugucuagucucuaacucacuauucugugauggugggaaccuuuggcuuguuguuuuuuuuuguuuuuuuuguuuuuuuuuuuuuuuuuguguuuguuuguuuguuuuuuugagacaggguuucucuguauagcccuggcuguccuggaacucacuuuguagacuaggcuggccucgaacucagaaauccgccugccucugccuccugagugcugggauuaaaggcgugcgccaccacgccuggcuaccuuuggcuuguuguaugcaagcaguaagcagaggugaguuugagaugaguuugcacgugcuauagguuauuuuuuccugagaugauuuuuuugcgucuuguucacucugcggcagcuuggcguagcuccugagagaguugagccuucugguuggcaaggcucagagcagaaggugaccucaguggggcuaguccuucagcccuugcuuccccucccaucuucccaccacacugaagucccuuuuguucuuugaaaccaacucugcuuuuauagaucugcaaggccuuguccccauugugcaucuggauggugucuguccccuuuggcuuauuacuguguucguuuucuugggccauugaaagagaacacugcaaauugugugucuuuacacagcaggggagaagucuggagucaugagguuuggagggcagugcucccuugguaguuucuagccuuacuaugucucuguuccuucuggugauagcaggcagcccuggcuuuuggcagcuuuuucuucuaccuuuccucuucccauuaaauucuaauaaguaucucccauaauuguugccaucugagccagggcaauucagauagauuaauuaauuagcuaacuuauuuauucauugaugugcugggacuagaacccaggacuauguagauguuacgcaggcauucuacuguugaaccuguacccucaaccuuagugauacgaauguguauauuacacacuugugcauaagcucucauauucaaaucauuagaacauuuacauuauugaaauauggauugucuguuguacauuaugacgcagcuggaaauacuggugucgacgcugucaucauguccguuuuggagagggagguaacacacauugguaaaacaaaaggcucacauaaaacauuggcucauccuuucugcuucugagauccuggacccgcaagguuuguagaagcuuggcucuugagcucugaugguaagcagauguggcacaucuugcaaggguaguagacagcuuccugauccagcaguuggaagacuguuuacugccugcgcuaacauuaccucugguugccugucuuaauucauuuuagauuaaucugucuuguaguucgaagcaaaaugaauugagucaguaacuucaagaguuauguaaaaaucuguauagugcuaaauaauugaaugggguuuuauguauggucuugaaauuggagugucaauuugacacaaaugcuccgaagcagagugcuggaugaucuggccgcuuccucauagaaagguuuugacgcuuccgucaugggauggcucgagaguguguccuuccccuuccuagcagacucuucaggcuucuuuauuucucuugaggaguguuaacuuugggaaaggcgagucuguggcuccaggguuugaaguacaguagucugcaggaagaaacucugauguggcaacucuauaguuggucccuggaaaucuuuugccuucagaacugcuuccagugcgauguccugagaugugacuuuggaggucuccuguguaggggugugagagagacuggucuacacacuccuaagaagagcuucaaggcuguuucccauaacaugcacuuaugagaaaucaaagauacugguccuuguugcugucacuuucugaguaggaaagaggggccauuuuaaaacuggugaacaauagaauucuugaaucuacgagaaggacgguguaucccucugcuuucaagaaaauguauuuuaauuuuauaaucaguacagcuaacccuguuuuccugguaggaaguauuugaagggugcuguaagugaaggaaacuaaaaugggcugaucacugaaagugccgcugucauuaggagcugcucuguguaccauacuuuuauuuuacacaagcaaugaccucguggagaugccauuugcagguaggggaagugagaauuagguaggugagguaauuaaugagugcuuacacacauaguuugagguauggcccagauucacacagcaaguuuauuuaagucccaaguccaugcucugugucaggaacauuucugguaaaaugcagaaugaccaguuaaauaugaauuuuaaauaauauguuuuugguacaaguacaucucaugauauauguaagcauuuuauacuaaaaaguaguacaccuuauuuaucauaaagccuuugcauuucagucccaaguuuucauuuuuuucucucuagauaccuuaugugaucuaggacuuuagugucauccuucucacuucugacuccaaguccaccccugcuuucuaaauggcaugcuaugcccaguccuguccugucccucuuguggcuuauuugugucagcccucucuggcaaagcaggcagacuaacucaggugauaaaaggcuguccgcaaagacacggggagacacauucccuucagccacagccuggaguuucugcuugagucuagcuacaagagugagaacuugucaugugguuuccagggauauaagaaucaguccucugcauucuauaacaaacagagagaaugguuuguuguaguguuuggcauuagaauauaaaggugaauuuaaaaguaaacuauuaauuuguguguguguaucucaaaaguaaaaacuacuuuaggcuuugauacauaggaucucacugucuugcccauaccacccuuaaacugauggaaauucucuugccucagcuuuguuccacuuuugauagucacagaauugcuucaagguuaaacugacagccuggcacauuagggcauuuguauacaugguucuuauaggcccugggcagcuagucauaauuaccacuucuguuggggagauacggaagucauuagaucaauaaggcccccaggucaauaggagugauggguagagauaugaugacaacugguuuucucuucuaauuccuccacucacuuccucuugguuaugaucgcugcucuguagacagccuggugagacagcuuuguguuugguggugguggugguggugggagaggaggaggaggagaaggaagagaaggaagaagaggaggaggaagagaaggaagaggaggaagaggaagaaaaugcuuuggugguuaagagcggucacuggcuggucuuauggaggaccuggguucaauuuccaguacucccauaguagcucacaacuacugccuauaacuccaguucuauggaaucuaacauucuuuucugaccucuuuaggcauaagacacauagggauacauaaagacaaaacacccaugcacauaaaauaauaaaaguacuagaaacuucgagaacagcuaaauagcauuguggaagcucugugguuuugacagucuggaagcccaaagaacuuucaugggaacaucauugacagucagcuccgauuuccagacucuaguuauguauuccauuuggucuucagaauagucucuucccacacaaaggaucaccccagagguggcucuugacaucugugacaaacugggagccauaguaacaccuucaggaauuaggucugaagaucugcuuucuguaugcucagggugcuuuauguagcucucuuaaccauuuuggggggacagagggcauaggguccuauuauacagcccaggcuggcuuugaucuuguggcaagccucucgcucggccacucuuaacuuguguugaucacauagguacuuugcacuuauaaaccugccaucuggcacaagcucaugugcaggccccuaacuuggaugaaagccugugaguuuacaucuaucaguaaaccaucaggaaacauggucaagacaggaggcgggucaugcuggcaguggcagcuucgugaagaguacacaugaggcaagagugagucugcgggccucucacgggcucuuguucuuucucugggacucugacugucacaaacagcccccuuccuugaaccacuuaugaaaacagacuguucccauuucuaagcgauuaaagggguuccuugaaacagugagaucaaagacacacuucaaguuugucucaaagugaauauuaacugcauguuggagaggcaugucagggggaaccugaucuuagcaaacccaaaugagagcuguaaggagcucgaaggguggggggaugcaggaggggagagucaaagaagcgggcaauuuuggauuuaaacacauuggaaaugguccuuuuuacauaugugaguggauaccuugucuucacgucugagccucuuucuuaaugugaaacccgguuaaugaugcugaucucacagcaucgugagaauugagugaggugaguaaaaugccagguagggugcaagguguagcucaguggaacagugcuugacaagcaugagugaggcucuggguucgguccccagcacugccugaaaaggccagacgccgugacccagcguuuacccgaugcuuuuucaucucuagacaucccaguguaguucacuguaggagaguauuagcgagguggacuaggcucuugccucagucacuuuccaucccaacagggacagggagguacuuagugaauagauuagucaguagagggagcgcacuguaggugaccuguuuaaugcugaagaauauuuggguaaggcacacuggcauagggguuuggcuagaguggcuuguaagagccuuuuugagaaaguaccaaaaguuuuuuuguggugaagcuaagcugcuaaguguuugcagugcuccacacacacuuucacaaaagcaugcucaucuucuuucuugucucucagcuuuccuuauccuccuucucuucacuuucuguuuguccucucaguauccuguucaaaaaggagccgacuuacccacggaaugcugucauuaaucuugcuccccacugggguagcaccaguaaaccuuagcauuaggagaggcugcccuggcaguggcuucuagcaaaugaagaaauugaagucugagauggggcgcagugagaaggagugagaugugagccaagagaguccuuaaacauuuaugacauucgaggcagcuuacacuaaccuuagaacugcugugcugccugugagaauggucccuucuguccaugguaacaggagcugcucagcaggugugaugugccaggcaaacacaucgguaaggaccaggaugguaguaucaggaguuaccgcuccgcuccguagccucugcucuaaaauaggcaagauggauuucaggaggucagugugacacuuccaggugcuauuuauguugguuuucuugguaagcagucacaguuggaauucuucccagcuggcggccaaaguguuguuucucauuuguuuugaugagauuuagggaaaguugaaguggagaugggagguguggaaugagcuaaaauuuccgagaauauacuugggcauguccugccaaaucuaagugcugggcccugucuuuucugggacuaacaaagauacuggugaacagagauuguucuauuacaaguuagagaacaaaccuaugaacguguaauaggccacuuacuucccaguucuuucucagucucuuccgagcugcuugcuugacaaucaguacacuugcguuccagguagcuggaauccuggugcaugcaaauaccgcuuaccaauggaacauggaaguaugaacugguaucaggucacuagcuugacuccugcuucacauuccucucuugacugucccugucagaaccacuacaaguuccguccuuuagccucguuuucaaguuggggcauggggcccacuagaguuuguguuguuucuuccaagacugagggaacccgggaaauguuauuugucuaaggagaauuuuguguuuuuucagacacguuggugguuuauucaaaauagcagagaaauucgucaggaucugguggggagguuacuuuccaaagcccgguuggugggugggugugggugcgugucuuucaccgugaaggacuuagaaaucucucaaguugggauugcauguggcgccugggcacauccagccucaguccucacuaaauugauaccaccucguuuucuugcugcguaugucauaucuugggguccuccacauuaaugccacuuccuuuuaaaugcucuaguaaggacaucaccuggaauguauuccugagguaaagcuaauaaauacuauccaccacucacccgcuugcuggguguuugcuugacuuggggaacucaggguuauauacaucgccaggaccuucuguucuuuuuguuuugguuuagguuggcgacuugaaauauggccugucucccuacauggccuugaaauuguguucuuccugccucagccucucuggugauugggauuacagaccauguccugcccgccauuuucauuuauaaauggacucagugugguugguaccaucuuuauuuacagauaaaacacuuuaaacaggaauaacuaaaaccuagccaaagcuguuuugucuuuauuaagaaagggauugcaacaaccuagucaaaguguguguguguguguguguguguguguguguguguguguguaugaucacaggcuucauuguugacugugggaggugguacaguuuauggaaaauggcaucagacgucgucuucacauacuguuaacaugggaagagcuccauauacaugaagagaaaacagaugaguguauauuuagauuauaguauuccauaguuccacaaggggcuggaggguagaugacuguaauuuguagaacauuccugggggggggggggcagugauaguacuuaucugugguagaaagggacgguagggaagcauauagaagcauugauauuugauuggaaccaugcgacucuacuaucucuuuacuauuacuaagauaaaaugucugcagcauugcuguucgagaacauaaaggaauaagcucuaccuuguaguuuagacaguacuaauggcagcugcuacggaugugccauaguccaagugcuuucuguguaagguuuaaucccaacagccugugaccaauagcuguuguuggcagagguauuuuuagccuuauuucucaggugggaagcuagggcuuaugugguaccuugaugaacaaaagcucuagcuuugagauguguggucuggcugauucugaagucugccaugcuucugcccugcucuuuugggucuuuacaucuguucaaaaggggacuuaggggacuuaggcaaauuaaggcaaaaauuuuggcuacauuguaaauuuauuuuuuugagagcucaaagauacaucauauuuaccuuaaguauaaaucuuaaagcaggacacugccacuguuauuggauugcuuugcuaaaaugaaugcuucuguaauguugcuuugccuuuauuuccaugaaaguuucuguuuaaaauaauacagaggucuggaggcauggcuuccugguuaagagcauuucuuucucuugcagaggacccagguuugggucccagcacucacauaguggcucacagccauccauaacucuuuuagcagggaaucuaacacccucuucuaaccuccacgggcagcacgcaugcacgugguacacagacauacaucuaggcaaacucuacacaaaauaaauagaucuaaugaaaaauaaaaaaggcugagaaguguuugcacacguguaugcauguguguagcugggacagaacccagggcuuuguguguccuguauauuggucuauaucuuuacaugggagaagcugucaauuagcuuuucuguucuagguugucuuugcaagauucugaauuuuuuggggggaacugcuauucuaaccugggagccuuaugugggcuuucagaaaccccugaaagcccaugaaacuguaggcuaacuuugguguaaguacauacugauuucucagggcaucuguccuuaggugggagccucuaguuuguaguaaggucucaaagacaaucaggagccacugagguuacuuuaaacuguuuuaaacgguugucaccgugcaaggaggcagaggaccuuauacaaccugucuauucucucuacuuguucguuaugauugugguacuuagucugacugucaguugauaguguuuugaguuaagagagacaucuagaucugucaggggggaauuuccagaggaguuuaucugaggaggggaaaccccauccugagugugaguggcaccauccgauaggcugggcucccggacugaacaaaaaggagagagccauuguucuucuuucucugcuuccugacugggcacaaugugaccaacugccucuccugcccucccagccaaggcugcccccugcaccacaccuuuccagcugugauggacaguaccaagaaccugcgaucccaagggcacccuuccuuaaguucuuuuugucagaucucauguuauaauaagaaggaaaugaaugcuuuaaucaccaacuguuuaaaucauugacccccccccccccgccccccagcaugauauaaaacucuggauucugugcuuggaaggcuaggcagcccuugguugcauuuuuaccuggagauacucuugcagagcuaaguguccucucaaggugcuuguguucucuaguuuucccagguccuuuuaauggaaaucccagaaugcuguggucuaaaugacauuuacuaacuagcuuggguagauaaggaguagguucuagucuguuuucguucaaaagcaacuucugcaugugcguaguguuugacagauaauaugagacucggagauuagauauuggccuaagacguuaguucguugcaggauguuagaacaaugggaacuuuagacucaggacuaucuggcucagcucucacauugcuuccacagagcuucaguugucucccauuauugugucaguagacccucacaguguuguuagcaguaggaaaguaucauuuccaguucacaaaugagcaacccaaaacuugguccagcucucuaaggaaugcacuaugccugaaagaaagggcuggagucucgccccauguucucccuuaguuguucauagaaccuuuagagguggaagaacuccgaugucauuugcagccaagauauuaaugauucuaacacaucugauauaaagacaaaagcaggaaagguguuauguccccauuguugauguucucuagggacuugugcaguguuccuggagucaguuggauagugauugggagagaccuacuccuagcaaaaugcuaacugguucuggggauuuuaaggccuggccugcaaagaggaggaguuguaagauugggauaaggaauugauuuccagagccccaugaaauuagguagcacaccuccccaauacaguagaaaggacucauuacuuuuuagaagacuagacaucaacgggccauaugaauguugccuuagcuguguucauacuaaagugggaaagggauguucuguugugcaguguuaauggagaccuguggcaguucauugcaugggaauauguuaagcacaguagugaaugcuguauauaauaagagacauuuauaaggcaaagaacaaugaaucauagaugugcuguuuuccugggcaaucuacuuccuaucaaagaguuucaagucauuuuacaauugugauguacauaugacauagaagaaaagguagagagauggcccauuaucucacaggagagcauccauggcgaacacaccucuuaccagauguucguucuggcugccucaugugccaguucucauggccuuauuugacugcugguuucuucaguuuucuccucguaaaauaagcauguaauaaccccgagagacuacuggacagguuauugaguuaccacacacuaaacaccacauagcuguucucagcugcugccucuguuguauguuuccgauaucuccuucugaauucuccucuuguaauaaaaggucaccuagagcguagacacuggugagagcccagacauagaagcuggaaguuuggugucuuuuguugcuguuccuuaacucugagagucuguggcuguagagaagccugggauauccuucaaagacaaguggcauuauugaagcaugggauggccuauggccugagucaccuauuuuguugcucugugcuaucuuguaagucauucuuagguucaaggcugcguuccuccaucuccucauuaaguugggauaaaacgucugucuuucacacauuggcaacauguaauucaugacgauuaagugcacauauguuccauuaguccuuguaacucugaggauuauuaugggaaacauuucuagucucagaucccauacaucuaaauaucucaccucaguccucaucagcacaguuaacucaccagaauaccugaagauacagagauugucuaucaccuguggaagugggcagucugauuguuugugggcagugggugacaugcgugagauggcagcagaaggaaauuccugaccugugaugugagggaagcuggauuagaacucugaggaugcugaacuccagcugcaaagacugagaacagagaggguccaggccguugcugagugcuggggagaugcucagcagacugcacuugguggauguccacacggugcuuccuuccaccuugucccguagugccuguacgcuggaguguccaucuuuccucuuccucagccagacauuuggaauauuuugcuauucugcucacccuucucuuuuccuccugcauuggcucauucuuaaaaacaaaacaaaacaaaacaaaaaccaaccccuuuuuagcguuugaauauuuaucuaggagaucacuucucaggcccacccaguaaaucacauaugcccauacaaauaugcacaugagcauauacauauacacagacacacaugcauggaagucccuguucuaugaaguucucauucuagcuugaaacaggaaaagaagaagacaucuaguguguucuugaggauuguuacggguuucuccacaguuuaguuucuccuucuaagaccugggagguuguaugcucauugggcauucuuucaucccugggacuuacuagucuaauugccuaaacgguacaaaccuguuuuuuaaaaacggacuucagacugucucuuaagaggccuuauuuuuguaauacagugaaauuucagggaaaaaaauguuuaaucugguauuugcuaagaauguugucaacauauuagaaugugaagguggcccuggcuuuuaguucuuugugcuggaagggaaagcagagauaaguacacaaugggaaaaugggccacauuugaaguaaguaaauaagaaaaugaaggauguuauuuagcuaugcuggaggucaguuuccaaugaguucuguuuuucugugggguuugucucugaggauauaauaaauaguagguagguaagcuuuauacugagaaauauuuaaaucgaaaucaaaguggaggaaauguauguuuugacuugaacacguauguuugauuauggggcaaguagaaaguguugccugugagaauuuuaaaaugucugugaaguuuuuuguuuuguuuuugaguucauagauaaaaaaauugcaagcucugucucucugauuuugcucguguuacugucuggcuuuuaaggcaauugcuccuuuucuccuucccuguuuaacauaaacaucugauccccuugaauauuauguaaaaggcuguaaugcagccugucucaagcuauggguugugacccguuagaggucaaaugguuuguauaucagauaacccugaauaucagauauuuauacuaugauucauaacaauagcaaaauuagaguuaugaaguagcaacaaaaauaauuuuuaaaaaaagauuuauuauuauacauaaguacacuguagcuaacuucagaagcaccagaagagggcgucagaucucauuacgggugguugugagccaccaugugguugcugggaauugaacucacucaggaccuuuggaagagcagucagugcucuuaccugaugagccaucuugccagcccaacaaaaacaauuuuaugguugggugucaccacaacaugaggaaucuuauuaaagggucgcagccuuaggaagguugagaaccacgguuuguagugguaucugggaauuauugaagucuguuuccucaguggcuguuuggagcuaaaggaccuaccaggaaaaguguaaauacauguugugauuuaauuuugucugguauaaaguugacaguuaaugcaucaaaagugaccucuuuugcaaggcaguuauauugaaaucugauuuugaacauauuuuauuuggaauguuucccuuguuacauucccuuguauggugcugggcaagguucacuuaaaaucucagcacuuuggcaaucugaggcaggaggaucaguuuggguuugaggccaaccuuauguaaauaguggauugcagggugaccugggcugcagacugaggccuuauaucaaaaccaacgcaagaaguaauacguuuucuucccacagggacucccucuuucucacuuuaaagcaacauugaaaauaaaaauaaggcuggugugaccguucauguccuuaaucccagcacucaggaggcagagguagaggcagagguagaggcaggcugaucucugaguuugaagccagucuggucuacagagugaguucugggacagccacagcuacacagcgaaaacccugucucaaaaaaaccaaauagguagguagguagauagauagauagauagauagauagauagauagauagauagauaaaguuucuuugacaauuuuugaagaaagaccacuaagacagugggaaaacuacagugucucauuggauuucaggaaaccuuuucuuuugaaauuguggguaggaucccagccccauccugguucccuuccuacugcacagucucuuaucuguguuuauuuucucaugcagcuacaacgcucaugaguuccaaguaguaggagaagaaaaagccuucugauuuuacacucagugugaaucacuggcucagaaaucauaaacugagauuaaaaaggaaaaggcguguccacucacccugcuccauuaauguaucauaaacuugcuucagcauugcaucuucaucucaguuuguauacuuaacaauguguauuuuauaucacuacaguagacgguguuuauucccuaaaaguaaaccaguggauagggucugcgugcuuggaaagguuugguguguuaguuuuuguggcugggucuagcuauguagcccuugcuggccuggaaauugccuuguagacuagcaggcuagccucgagcucacugggauccaagugucucucagaaauguuuuuagauggugagauggaugcauauaauagaaaauuuagaaacuuucugugugaggugauauccuuuguuauacaaggguuaauaccacuuagcucucugguaccucccugauaguggccucucuagaauugacuccguguguguuuuauuauagucauuuuaggaaaugaaauaucuuuuuaucaaaugaugaaaacguacaagaucaugagaauaagcuacuguuuuuuuauagggugugcuugacuuuguguagccuggugauuuuguucuguucugggucagauuucuuucuuuaugcacauagaaucguaggcuucucucauucucccccguuacagacacagcuauuaucaccuaugcugaggugacugaaaaagacuugccuuucugguugcaagggaacucugggagacagcucuuggccuccacuuagcuuccuucagauuggcuuuuuuccaagggcccauaagcaccauggugcgugaagugcuaaagggcaguggcagggucaggccguauguauugcuugcuagggcauguuauugaccaauaagaaguuaaauagugccuagcuacacagccgggacauugucuuuuaagcaggaaaagaucaccucaggccauuucccuuuauaggcaaguaugugaaacagaagcaaguugcacaguucuaagacuccuguaugccugauggacugcaggugugagagaugacugggauacuaggguucgcccuacuccuucugccuuuggaauaggacugaaggcguuuuuugacaagugcuugccugcugacuuuugcacccacuguuuuaugacuuucuugacucagcuucuuuuuuuuuuuuuuuuuuuuuuuuuuuuuauuuauuuauuuauuauauguaaguacacuguagcugucuucagacacuccagaagagggcaucagaucucauuacgggugguugugagccaccaugugguugcugggauuugaacuucggaccuucggaagagcagucgggugcucuuacccacugagccaucucaccagcccuugacucagcuucuuuaaggauuguuuaucuugaaauuuuuuguagauacacccaaacucaugacagugcuuugucuaggugagagguacgggcuuauguuuccuaaugcuaaccaaaugcccucccguccaucucccuuccuuuucuuagccccuucauaacaucuugucuguacacaauuuuuuuuuuuacaacuuucuuccuuugaaaauguaacuuaucauuuggugaugcaugagagauuuugguaccauuugaugcaauauaaguucacuuaccauuuugcaagcguuuagaggaauaaggaauccaaagaugcauuacacagacacucacacacagagcauguucuuucucccgcucaguauauagugaaaaaauauuaagguuuugacuuugugcugugguuugaagcuuaccucugagacuauguucuggcuaugaaaaauaaaauguuuuucucugaaguuuuaaaacaacauuuccauucgauuuucuuccuagguguaaagagcgccguucuaagccauugaaugcagaagcagaggcaggaggaaggaaaacaauaagaaaccaggcugaagggcucuacagauuaaaagcaccgccccacuggcaggcaccauacuagagcucuuucacugugguuccuggaauugaaguaucauugaggauuaaaauugugggagucucacaaaacucagaaaucacguguuuuuccaauuuuuuuucaaaagcauauuagaggauguguuuuuauggggcauugaucagagugcuaccagaaauccaaaaagaacgucuaaaacccuagcacagaugucuuuugguaucuauugcuuaaucuaauucaacauaucuaugaagauaauaaauagcauaugucugcauuaaggccugguagggagugcagucuuuguguagaccuuuagcuuucaaugcuagagucacuccccccccccuuuaaaauuggcauaaaauauugacuuuuuuugguuuuucgagacagaguuucucuguguagcccugggugcccuggaacucacucuguagaccaggcuggccuuuauugacuuguuuuuuuuguuguuguuguuuuuuuuuuucaagauauuauaugauuauguuuucauuggcuuagucagugggagauguuuucugcagaacuggauugcuuuagcucuaaaguauggguuuucaaacauucuauggaacauuaaauuaaagcacccaaaugccugugugaugcaugguuaaguaacugcugguuuuguccuuuuuaaaaaaaaaucuuccugucauucaugugacagacucaaggaagaggaagaguguauuacuuuguguuccuagauuggguuguuuguggcuuuuguucuugacuuucccugcagcuuggacccuuaggaagcaaugaucuggacuugacacauguuagugacuucuguacuuccagcccuucugccucuguuuccaugaaaugggugaugcauucaaacuccuauacaguggaugagcuggucuugaggaacauguacuuaggguucuuuaacaugcucaucucuucuguguuuguauggugggucuagcgcacuuucuuauugaugauuccugugacucccuugacaaaaaauccucucccucuggaaaacgccgaaucaucccuagucaugaaggucaccaggguccugucuugcugagaagacccuuugcaaaaacaaacuugccagucaccaaguguaccauaggauggacucagcaaaugugguucacuggagaggaggccccaagagaccuuggggaauagaagugagcacaaaugaauggcggcuucguacucaccauugguuuucagaguggugaaugggagguggagaugaagcaaaaguccuuaugcuguccuguagauucucauuagcuugauaagggacucgcuuauuaucucuugacauugaagaggucagacaugguggugacagcuguacaugccaggauggcagcauguguaucauuugaccagcauucugaaugagugccacuuggcaauggugcugcaaaaggcucagugaggaagagagcauggugggagaugagguuugguaucauuuagaaagggauccugguuagcuccuacccuuuuguggaauuucuuaggccaagacaguuacuguuguuaaugauuuuagaaagacguuaaccuugggguccugagaacacacacagucauuuguggagaacacagcauuuccucuaggaaggagcuggcagaguugagugccaugaucuguggcuuuggguccugagugacuuuucaccagugugggugaguacagcauaaaggaagacuuacucugguuccuggcaucagagauugaaccugcuuggacuucucagccucuagaacagagacacaggugucuacuguuuauaaaugaccuaguuugcuauuuugcuauaucggccugaaugaauuaagaagccaucgaagcagacguggccuuuaaaaaugcuugauacacaaggggaaaagggcuuuauaauucuguggcuucuugugcacuaagauuuuaauggcauaguaagcuauacuuaauaacuuauuaaaaaaaaaaaagaaaugagcuaaucugaguuaaugcuuucagacaaaggaugaaauagguugucucccagucuguguuccuacuaaaugaugcaaaauguaugugucagcuucgcuggguuaaguuuuuaucuuucuugaucucuuucuguaaccaguuuucuucugaguuaauggcauuagcuacuuguccuuuggucuauaucaagagcugacaaaagaugacccauugcccaagucugaccccuuacuggaagaaaaugcuugacucuugucuauacugaugacuuugagguuuuuguaucggccuuuuccuccuccuaguaagcaguuacaaauccuuccuuaaagagggcuagaaacccgaauguacugucuucuaguugcugcuauagagagcugagacuccuccuuuuuaguguacaauggagauuuauaaaaaacaaacaugcagggugagccugguggugcacacuucuaaucucagcagguggaucucuauguauuugaggaaagggaguucuaagcuagcaaagcuaaauagagugagauguucacucucaauaaaacaggagauaaaaagcaagcacaauauggucauugugccgugcugggaaguggcagucagggcuucaacuuuaucagcccuuuaguguagggagagaaagcagaaggggacuucccuuucccauaacuacugacuuucacugcaguuggggcugaaccacggugaucuggaucguggacaucuuggcaucugauucuccaucuucagagcuggguaagaucaugagaauaaaaucaguguucagcaggcugggucucagaaaagagcacucauggaaaaauuuagccuuuucuucaacaaaacaaaacaaaaacauuaguugcuuggcucaggguggguagagggucagugaaagaggaauauucaguugcauuacaauaagccauuucaaaaaaccgacuguuucccauuugcuugugguucuucucuucccuuuuccaauuuacuugaagaacuguaggaauaauguaguuuuacaaaaugucucagauguuccaauaugaagauuuguuuucccaguuacugggcugccucacaaauuacuauaugcuuugccagcacgaacagcuguuuauuacaaugauggauuuaagagaggggagaacauuaaguauuaagauugcagauaccuuugcuuugugccguucagggcccuggcugaagagcaugggugggguucagcucaucugaaguuauaguaauagaaauucuuaugccagggugguggcgcacgccuuuaaucccagcacucgaggaggcagaggcaggcagagcucuugaguuugaggucaaccugaguuuuagaaugaguuccaggacauccaggacuacacagaggaaucccaucuugaauacaaaacaaaacaaaacaaaacaaaaaauacaaaaugaaauaaauaaauaaauaaauaaauaaaaauaacggugugacugugaccacuucuuucccaucacaaaauagguuuuguuuuguuuuaaagacagcccgucaccuggcuguccugaaauuuauuauguagaacaugcuggcuuugagcuuacagauaucugccccccucugcuacccauacuaggaguaaagggagugucacagugcucugguuuaaaaucuguguaguauaguuccuguccuacuucuuguggugccaagaguuuauacaaugccuguuugaggaaauggagugacacagaccugugaucuucaugguaauauauauaaggguuccaugcagacaagcacuaggcuaucugaacaauugauacaguccugagugauugauacagcacauacagugugaauaugcuggacuaauucagaauagcacgcaacaaaacucuuggagaugcucauuucugaagauuuccauugaauauauucuguuguuuucugcgggcucuugaagcuuuggaugaugggaguuagcugcguauuugcguuguccaacaggguggcuaguagguacacaggacucuugagcaauuggacuaugagccaugcaaguaauuaauuaauuaguuaauuaaucaauccaggucaggggcagcugccugaggauucccauugcugaggaaugacaaauuucuagauagacauuagagaauguucauaucugcaaccagucuggcacaguucuucccagcaacccaguccagacauucacuuguugauucugcagacagugcauccuguguaccagacaucauuaacuuagaagauggcaguggacaauaaggaugcuuguaguaaaguagaugagaagguaagcugagguuucuauaagaccaucuauaaugucucuggcaugguucugugaggaaugcauacaagggauaacugggucaaacauguaagucccuuugagaaaguguugugaaacuggaucuuagcucuaagccagaauuuuaaggcauuuuucuuagagguggguccuuuaggcaauaaggaaaacaagagauuaaaaaaaccaaacacaauaugguucuugugccgcacugggacggggcagucagagcucaaacauucucagcccucuaguguggggagaggaaagcagcaggacaacaagcuaagcuuuuuucuggagacuuccccaccagacaaugcuuuuuuuguuagagagagcacuguaacuuccccagccagccacaucuuucacuuggaacgagcuuccccacccacaccaugcauauugagaaccaggaacauacccagcaggucaccaguccagaaaaauccauagcucaaggggauaucauugaugaauuacaggcaaguugccugucagcaggaaacauggauuggauuagagacuucuucuaccaugcugguuuuucuaaagaagaucuggcuccaaaacaaagaugccugaacacacggucagcacugaaaacaaauauugauuggcccccccguggaggagccaagcuagagugggucggaggcugaugucaaaaagugcugggguguggaaaaccauuacugugcugaugggucagaaugcuagcuccauuuauuuguaagaucgcaggagugggaggggauauuuaagugguagaaggaggagggcaaaggagaugguuuggguggacacucccgugggccuuacuuccuaugggcccguccuccuuguugccugcucugcauuuucugacucgaucccuucccacuccccuuuaaaagugcugugcaagauucacuuaauugaaagaauauguccaaacagcugaugcucuguaauguuuagauucaggauucagaccauaggcuugguguucuuauuaugccgguaggaaaaaaaaaaaccaugcugguugcaucugauuucaucugucuacuggguuagaaguacuguggucucugccagauguacgagauacuguaaaaggagcauuuucucuagugaaucagucuuccuagcgccguagauguagcuugucugaaacagcuuguuccucuguggacgaggcuggcuuugguucagucuccucucgugaaauguagaacugcagaagcccaaucuagaguucuuucaaugaagacaaacaaacaagcaaacaaaaucuucaauucaaagcuugcauugaaaccuacgguuuuguugcacauggagagcgacauucuccagaaguaucucuaaugguggaauauucuaaagguacagggcaaccauuagccuuggguugauauugaauauugaaauguaaauagugcgaaugaggucuaaauuccuaaaagguagccuugcgugguccgccaucccgaagcccagagcuugggucugcguuuagaggauguguuagcagagguagaaggagcacuuugucagugcucucacuuucaacagcaucuccguucgagauucauaucuuuccuuccuucauauucuagaaagaagcagcgguggccaggcugccaccagcagggugcagggcugaggcuagagauugcggaaacugccauuaaaauacugccauuuuaacucugucguucauuuuccuaaagcacuccagccagacaugcaggccuuuggcagugggaaccauauccccuaccccugaggagccucugguucacugcaaugcugaaaguucucugucugacauguugacucagccuuaaauaauauuguuacuuaacucugccaaugaguagacauccagguuucucgggcuauacugcauaucccacaaggacagaggaacagauauauacguauaggccaugguaucuagcacuaauauggccauuucuucucuccauagaaagcauaugcaguuguaugcugaucaccgcugugccuuuugcccuugauuucucugagugauugaguuuugugcuucagguuggacaaacaccacuguuucucucuaucucaaacugucuuuucuuuguugaccuuuauauaaacauaagcaugagugugaauauuugcuuaguuauuucuccucuuuuagaaaguaguuucaucagcuagcagggucuacauagaguucucuguucacuuaucacuugagucaagagagggaaagagaaauauaaaaauggagauacacucucuccucauucucuuucuuuuaaauuguucaacaaguuauauucaggaagcauccgucucccaaggaaucaauauaauuugguuucugaacuccgcaugucucccucuggcuggaaggaagugguuuugccacccaacagaagugaaaucagcaagaugcugucgguaaaacggaaauguuggccuuuccaugaugacagaagagcgguagcaagugugugguuuucuguucuacugugccaccagugugggauaagaaacgggucugagaagagacggacaggggaugcguguaucaguguauauguggccuguucacugccauuuuggacucccagccucaucuucugcagcuuuagccccacugugugggagccaucuccacuuccucuuggcuggcuuggacuuuuggggaacauuccgacccgggauuucuaccccaccuuagaccauuuaaguuccuggaugaaagacacacacacacacacacacacacacacacaccuucauauuuauaagucuuaaacaacacaacagcugggcagcugccuaccucuaugcuaucagaaucuacuuuucuacacauaaccucgaguuguuacuuacucuauuuugucuggguugcucuuaacuccaauuggccagcccacagggccauaauuucuuuacuccuaacucauggcagcuucuuccucuuccuccugcacuucuccugguuccccuaugcccccaaauggcuacaucuaaaucccaccuaugccuccucugcccaucuauuagcuguuggcaucuuuauuuaccaaucagaaauaacuugggggcagggucauacagacucucuugucucugggcaaccgucuuggggggagaggggggcaauauuagcauuaaaauauacuauacauagcauuaggcuaacccacuacauuguacugauuguuuugucuagagacuuagcugugaaguuuuaaguaggugccugugcagagugucagccagacucugccucagcaggggaacuagaagcucagaaguccugggagaaaaacgcauggcuaauggacgaagccugaagccucuuguuucuuaagauucaugcauccugcuagaguagaguaaugggguuaggagaagauuuggggccaaagccuuugcauccucugucuaucugucuuucucuggcuuguugaaaagaagagguccaauggaggauuauuuggacaaauauuugcucugucuaauuauucaccuagagaagcuuuccugaauguuuaaugcaaagcuuaauauuuacaauagcauaaggaagaguuuauaauguguuggggaggcuuccgacuugaggcaguaauucuucuuugcaaguauguauauaagacugcuuucuuccuaagagacaugagccauauuuaccuuagccacuauuugaacugagaugaaggaagagggaagaaaacuccagagaaggaaggcacccccguaguccugcugcuaacaaguuuuacagaugcuugucuuugccagauauuuaacauguagggauguaaguacgcauucacaguuccuuccuauguaagggugacagaguugucaugggaccauacuugacugugauccugguaguggugcccuuauagaucuguuccuucuuuucuuucacccagccugcuucuaaccagugucaagguuuagugagucuugacaaagugacuucuagaggcccucucuguacauugcaaagaggcaugaugcagaacggagguugaagucuucuuccauaccauauguggcccuuaagaggguucuuuaccucuggaugccucacuuuccccaucuguaaguaggaacacuauccuaccaugcacagaugagaagugcugcaggccagcacugguuuucaggcucuuaccuugguguggugacaccuaggacaucuucagguuacauagaaagggcccuuguugagacuucuagcguauaucuaucucugagcacugcauuuagcaccaaaacaaaccagaccuuuauucagaggucccauuuuuccuagaacaagagauggucacuggcaauacuagcaaagugacaggcaugcauaugccaaagccucaaggaaaucagaugacagacagugagggacaagugaacggaugcucugucuacagcauuggacuuguggaccuaugcuguucugcucacuuacuauuggggugucagccaguggaaccaauacaaaugaugguguugaucugcugccgggugaguagcauaaaucauacuuagguaaauguauguacccucuacuugcuagcacacuggaauguugagauauagugugcuagauaauaugccugccugcuugccugcccucccucccucccucccucccucccucccucccucccucccucccucccucccuccucuuucuuucuucuuucuucuuuccuaucaggucucauuuagacuagauuagucuccaacauucuauauauagcuaaagauaaccuucaauuccugauccuccugccuucauuucccaacacauuuccuuuuacaccaacauuuguuugucuuuauuuguuaagcauggauccauagauacuguacccaacuguggagugguccuaguucucugagauuuguuuaaaugaagucaguguuuuguuuuguuuuguuuuguuuuguuuuuuccucugucaucuugaaaccaaaucuuccuuaauuguuucuguuuucuccagugugagaaaaacuaaccuaugcuacagucauuugauuuuuuuucuccccaucuuucauuggagcaaauguuuugauuuguagccucauugguaccaucugagcuauauagggagaaaacagccaucguccagagaggauaggauagcaucaguuguucuagagcauaucucaagguugauguugaaagucaagugcugguuuaacgcgugucuuuugagugguugacuccucagacuccaguuuugcaguugguaaugaaguugagcaggcuucaccgaaguacgccuuccacgugagagacccugccugucgauagaccuggaguugguccauuaaaaagcaggauuaagugaguacuaugcacaccuucuugagcuguaggcuacaggagugagcugcacggcugcaaagugccucacacagagaguauaaccuagcaggaacagacaauagaaacaaaagccuacaucagccugaauaaaugagacugguggcaguguauggaaacagggacacccuagagcacucuuuuauguacuugagaacacaguaauguggcuuaaaucagugguggggcugugggggcugugaggggaaggcugagguggaaggccuggggagccagggaaagaauucauucuguguauuagagacugagcccagaccugcuaggucuugcuccugcuguggcuuggucugguauuuuuuaucuguucaaaaccuccauuguuuccuguucuaacugggagauacuuguaaauuccauaguuuucauaguuaaaauaauuguuuaguuuucaccuuuuaccugagcauguguaagugaacaaguacuucaccuuguuuguaaaggagaguccuuguuuuuuuucuagacagccacccgucuggcuuuaauauaggccggcaggaacccgugcuuaccuguccauuggaauccacgggcaauuugcauuaagcuauuugcccugcuucuucugcucuagucuuucuguuagacuaccaacuccuggagcuaccuggccagaggcugggauauucauccugcaggggcugcuguugacucuugaaguggaggaugccaaaacaugucugcugaggauagaggguugaaauugcagaucuggucuucuuccucccguaccugguggguuuugauguuuucucuauccucaccaucuucucugaugcucuaguuucugguuagcagaauggcuauccacgugagaauacagagacaucuccugcaucagcaucaccugagacaauucuaucaauggcucugaugcucugaagcggugguucucaaccuguggguuugagggucacauauuagauauacugcaugucagauauuuauauuacuauucaccacaguagcaaaaucacagcuauaaaguaacaaugagauaauuuauaguuggggcucacuguaacaugaaaggguugcagcauuaggaagcuuaagaaagaaccacugcucuagaccuaguagauuggaauuauaaggacuggaccuagaaaccucuuucaguguaaguccuaauuuuaugaaccuugugcccucuaauuuugagaaucuuuuguuuauaagaggugauuuuucuuuuagaauaguaauaacagcuaauguuuacugaaggccaauuauuugaugauacuguuuuuuuuuuuuuuuuuguggauagaggaagaaucaauuuucaaagcaucuuugugggauaugcacaaagauaaucgugcuuggccauuggggaucgugauuggcucacccacaguuccaagucccaguuccucaacccucuccuucuccuauguucucccuugcauaaugguacuccaugaaugacucuuuguuaaacugagcaagcgcagugacuuccugcugugucucagguaacauauuagacagcauauuuuagcugagccuuagauuacaaugaagucuaggguucagcucagaguuugacugugucucccaagaguucacucacuuugcucaaugagaauccaugaugcauccaggcuuuucuugcccccucugagcugcuguguaccucugugugugggcaggugccuauguaguccugugccugcaucuggaguggcauccuuuuaauuggccagcacgugaagagguugaauccuucauccuucaacugacccugacccuagcuaaaaaucugcaucaugagagccuagguacgaaguuaucuaaauuguuuuccaaguaguuggugauugcuggaaggaguuuucccuucuuaacaauuccaguagugcgucugagaaaaaauuagcugcugaaauaggagcagcccaagcagguuugaagauaaaaaucaaccauuccauucauaguccuuucuuauuccagguuccucgugcuuuauaccccccaggaggaauuugcuaaggaagccucccuaauaacuucagguagagaugguuuucaugaccacgagugccucaccgagcaaugugaagaggaggcgggcgccauucugcucagauuuucucaaaccuccaggguuaugaacuuuucaaaaagcauuucuuauuucucaaagugaauccuauuugccuuucugaaaguggcuugauuuguugcaaucacacuucaguugugcgcacaccgaaagcaacaaagccuaauuuuuacuaaaagauaauuuuaaacaagucuuucacauucaacaaaggucauuuugguuugguuauggccacucaagauucaugauuaacugucccauucaccacuggccaaauguucccaugucuuugguauacauuuugcaagcuguugauaaugagaacccauggggcagccaggcaaguuuucagaaacagagccugugauccugugcaacuuuugucuggaauguauuuauaucacacauuacuuugaguuucuuuucuguauugaaaggcuguuuguugaacccaaguccuuaggagauauaccaugcagaucuugugcuagguuaauaagcuuugguccugcacuuagccucgauguuauucuauaugaaagaagggcacaaagggguagucgaagcugagucugggauacuuauaaaccugaacuucucaaaagaaucaaguuuaaccuuuuuuaucacauacaucuccuucuuagagauguaucauauuguauuagcagcugcauagaaggaagaggagaugguaagaagaaaggaaaaagucuuaggguucaugccugccacugccccaauagcaaucucaaacccuaauaguauuuuauuugauacauaaauucuggagcauacauacauacauacauacauacauacauacauacauacauacauauauaucuguuggauuaugaccacaggaaaucccugauaguuacauguuuguaaguuccuuacguuugcaguuugccccaauucauucauugaagccauguuuuagagucccagugcucccuguuggguggugucucagcgguuagccuggccaggguuugggugguugucauuuuaggugcccauuuuucugagcaaugucucugcagaugugcaagaaaucuuguugcccagaccucaggcacaggcuucucgguucuucgcacuuaagacaaaucagugugucuccugcugacggccagcuuuucugaaaugaaaacaaauauaauuuuucauuauaggucucaggaaaggaacaggcagcacaguguaaauacuuauccagugaccagaggcccugugagcacauggagagaaacacccuauguagaaguggauugcaugacauaaggaagaugcaggagauagaagaaagggggcagaggguugaaagaauacagggggaaaaaggaggaagaaacuuucuuuuguuuuguuuuuuuguuuuuuguuuuuuucaagacaggguuucuccguguuacccuggcuguccuagaacucacucuguagaccaggcuggccucgaacucagaaaucugccugccucuggcucccgagugcugggauuaaaggcgugagccaucagugcccagugacaccagguuuugucuccagugaagauaagaggcauugugcaaaaugucuguguguguguacacauaaacacugguguaugcucacaggcauucacccucauguguagucuuaggauucaucuggauuaucacagguggcaagaguuuuauaccuuuuauuuccaaguagggccugaggauugcauuuugacuguucacugacucucuuuauuuucacugacaguucuuacgguaacaucuacuauuaaaucuucaaugggucuguucaagaauggccucacacuuaggggcccacgguuuucuguuuugguuuuuaugugcaaaaaagaaacccacuauucagaguugcagaaacagugacauggaauucaauucuauggcucaagaugaagaacaugagacaggaggaacaguagggagagagaaagacacacaugaagcuguaguucagcacugccaaaaccaaagccauuucaaacauuucagacuugccuaacucauaauaugacaaacuaaccgaagaaccagaaauuauauuaccuugaauuaggaaaauuuuaaauccaaggaaguaaaucaaagcagcuacccauccccaucacguugucuuuguccaaagcuggaaaaagacaagcggacagaauuuguauuuuuucgguuuuuaggcagaauucuuuauuuugguauuuuccauguauguguguuugugccuaaguguauaugugguccacucgugucuguggaggagcucagaggaauuagaagaggcuuuagcucucagagaacugcagcuaaggacaguugugagcugucacgugggguccaggaaccaaaccccaaucuucaacaacagcaacaguucucuuaacugcugagucaucuguuuaguccugucugacucuuuauuuuuuuauuuuuuuaaauauuccuucuaauaucuuuuccauaaguuucucauugucucagggucagaucuuccuccacuuacagcaaccugggcguguggaugagaguguuaaguacccuacuuuugguuauucccaugugcucuagauaccuaguggacccguuucggaugcccugccaaugucgagccaugucuguguaaagugcuuugaaggccuccuugagggacugacugagcuacaaggugauaacaggcaagaucagugccagcuacaggcuuucucugauaucaucaggagagagagagagagagagagagagagcagcugugauuuguagaaguuguggagagaccuggcuugugcuugcgccugggagagcuugaaggggaguggggaggacaugggcuugcuuaguaguccagaguucuucagcucccugugugcuccagaguucgauuuagcaaucguggacuccuuuuauuaugauuuuguuccguacuuuugaugcuuaaaguaccagacaacaguuacugugaccugauuuauaauucuuggggcaccugaaaaggaaguaaugcuuucucuucccgaucuacccacaagaccguuccuuuugccucagcuaugcuuugaugugucugguagcuuuuccuagcccaggcucuggcuuuucuucuucuugagcaguuagaaguagcagaaguagucaccacuaacuuugguacugucuccuucucguauuuugguuucaggagauugguuggcagcuucuuucagcuccagcucucauacacacccuugagagucuggcuccugucuuguucugccuccagcccuccucuacucuguuuaacaccaaacuccccugaugguccuuuccacauguuaaagcuuaucauggccucaucucuuagaacccaucuuaguggcuucucuucugcaugauauagcuuuagcuacuuuucaggccuggaugcugccaugcuccuugucauggugauaauggacuaaugucugaaacuguaucucaagcucagcuaaaugcuuucuuuuauaagaguuaauuuggucauggugucucuucacagcaauagaccaguggcuuagacucucauagacccuacagaaacagaguggguucuguuuuguccaugcacgcucuaggguuuaguauauacuuguuaccaaagugaagaguacguucuuguauuuucuccuguaugcuccagggagaagagucagagaagacagccauagagcugaugaaaagcacggcuugagcuugcucauuacuguuagcuuuggaaacaauggcuugcccccuucucuaacccuuugaagcaaaugcacacauguguucucauugcauggcucuaaauguuuccauuaaaacgguauuggacuguuugaugucugcaauauugaccuggcuuccgccaagaccaguucugucuuuuuagugggaaagggagcuauuaagugcucaugugugacguuaaagcuauuaugucugaguuagcaaauacaaguuuggauucucuaucgcucacucccucuuucucucccucuucuccccccucccccuuacuuguccuggucacuaaggcugauauuagagacucuuccuaauauacccuggaugaugguagcauguugaaaaaagaaaaggacaaaucauaucagcuaccccuucaagaagaucauagaucuuauuugggaggaagggaaccuuaagucaaauuauugaaguauguagaauauugaauuuaagguuuugugaccaacuuugagugaugggaagaagucaaauucuuuuuuuuuucuccccccccccuuuuuuuuuuuuuuuuuuuuuugagacagaguuuuucaguguagcccuggcuguacuggaacucacucuguagacguuggccuugaacucagaaaucagccugccucugccucccaagugcugggauuaaaggcaugcaccaauuuuuaagcaacuuuacaguuauuugugggggggagggaagggaagagagagcucuuccucuccuagaaaucagaggacaacuuccaggggccaggucccuuucuuucaucauguggcuaacgauucagguuuggcagcuugugccuuauuuugcuuagccaucuuuccagccugguagauggaauuuuaacaugguccccaagacuuccauacucuacuagacucauacucuccaguugucuuguugaauaaacguauaagggcuacuccgaaaggaugauuuuguagauaaaauuaagaccuuagagauaggaauuaucuauuagauuauugugacgagaccuauccuauucugaugaucuggagccuucagaagguacuacauauguccugcagauaaggauugacaugggcuggagcaucuccuugcuuuuaaaaagggagagaguggacaagaaagucagguguccucugauagcagagacuagcuuuuaacugagggcaauaugcaaacagagaccuaaggaauucugccacaccauuccuagaccgagacccauagcuccaaaggacaacacaauuuuaacuauaccuugugcaauccugggugguagagucagccaaauugugucugugagccaacagucaguggguggucuuuccaguugcucuguuuaugguaauugauuaccuuggugauaaaaacaaaacgugugaauucuaccgucuaguuguuggauauguuggaugaugggggcuggggguggcagcggguaguggucaucaagcuagaaaggggcccaggagauggggaaaaacagaggcuauaagggaagccaugugagcaauacaagggccauugcugaggguugaggaugauaguggggcaggggcagggccaugccgaugggaggacaaagaaucaaccgagucugaguauguaugaaaaugccauaugcaaaccuguugcucugcaugccauuuaaaucuuaaaaauuacagagacuauaaaguucuuccuuuaaaaggaucuguuuacaguuucuguaagugcagagagccggucagugccaaccaggaggaacuaucagcguugcuugccuugcuccuuagggacccagugaaaugaauagauaaaaagguuuuguaauuaguagaucaacuguuuauaaauuaauggguagcuccaaaguacuacaggggacccaaaauaguuucugccaaguguuuuaucuauucuuggaauggccuuauucaugcauuauaauuugcuuagccguucguccuccauagacagcacaaagauuaguuacaaccuccucuccuuugaauacuguaguuuccuuauuaguaaagucaaaccugauaacuuuuaaaaacaaacaaacaaacaacggcagcaguuuaaaaacaaaaacccauuuaggaacauuaugaugucugcagacauuuuccuacggacauaauacucuuuaagucuguucacauccucauggcuucacucuugaggcguaggcucacccagccucuggauagaagacaccauauuugggcagucaauaaaccugcaaauggucccuugaaaaggaagcuacugauggaucuggcuuuuccaugaaugacagcauagccacagacagcagaggaccgcuuccuggcccacagcaaacaccacccugcugugcagucccugcauggggcugcccucccagcagggauguguguuuccccgggugccugaggacugcagcuuggccuuuuuguuuacaggagagaggacagugaccucugucuuccagcugcugugaaugaaaacaguguuggagaaccagagugaaguuuccacuuuacgagucacugaggggggaggggggaaggaaugggcaaucuggguggggguggggcauauucucaaccuucccuagugaaagagugggugggauaaaguucagaccuuuggauuagaacacagaugaugggaaaguggaaagagacuaguucuucagcaaacuuucugggcaggcuuuccauauauugaguuuggaagagaaacagaaaaggcauacacacaguuuguaaggacuuacuuuuucaaacaguggcauuaauuguguacgcuuagggaugggauucuccucucucaaggucucucccgaagagaaacagcugcucauuagcuagcuuagugugacuuaaaaucuggaggcuguucagcacugcuguguggcuguuucucaaguuuugcuuggugguaaccgucaaagagaagcuccuguccagggucagggaauauggacgggguggaucccuccugggucaccaccuccugccaggaagcaagcuguguggaagcaagcaguggaagcuugccaaaaagacauccugaucucggcacuccuggagcuugcaaauaccaauuauuuucaauugaaaguuaaaugcauaauuguauacuguaaccuuaucauuagaaauuugcaacguuaccgaugacacagacaggguacagugauucaaaaauaccuggguuagucagagaggcagugguuuuaagcucugacaauucaagaaggucuccgaggugguagcuuuugaacggagacagaaaaucaggaugaaucggccaugugaggagauggggguagaguuguuccaaauaggcuggauguaggcagauguagaccaagaggucaacaggaacucucugcacaugauccuuaugacccuccucuuuucuucauucuucuuguuuguuuuuguucguuuguuuguuuuuuuaauuucuuagauuuauuuuuauuauuuuauguguaugaguguuuugacugcaugugugcaccgcuuucuagcuuggugcacgaggaaguggugagccuccguguaggugccuggaaucaaacccuggucuuucucaacaagugccccuaagugcugagccaacucuccaucccagauccacaggaucuuucuucucuaagguuacuuuagagcccagguacaagggagacauggagguacagacucuguuuugcauuuuaaagaacugcuuguuuuauuugcuuccacuaaccagcuuccuugguccccccucccuacacuuuccaucacccucuuuccuuuuggagucuaucagccuguuuguagagaucaugugaucuuuuugcauuuuaaccuaauaaagcaaugucuuacggucagggaccaaaagcugggccugucacuuagaaucccuucuacuuguccaaguggcaaaccucggaagcuucucugcucugauauuuugucuccuugggucuuauuauaucuugcccuaucucuauggcaagauugcagggaauuaucaaaccuaaaagcggucuaucagaagugcaguuuccccucucauacuuacuguaauguguggauuagucauggaacugguugguuggccacaaaccagaccuagccuucccagugucucuauuuucuggagacagucaguagaaauaugucucaggaggucagcacuaagagugugacucauguagcuaagacucaucuguagauaaacacuucggagcuucccuugcugucccaccacauccccagagagaaacagaaccuucuuccugucccacuccccugucucacuuucucguauugaauguaagacuugcauuuacuuaguuaauguuuguauguggacacacuuuuuuguaccgugaagucaguuuucugauggucagagaacaguguuggggaguucuuucugucuaccuagugggaccggagaucaaauguaguuuguuggccuugcuguccauggccuuuaccugcugagccaucucaccaacuccacgguguuuccucucccuuuccuuucuucuuuuccuuccuuccuucuuuauccuuuccagaguuguaacuuagagagaaacuuucagauaagaaguacuuuugcauaguuaaauacaaacauuggacuccuuaauguaucucagcauuugaaauuaagauuccaaaggggagauuuauggcugggggaggcugauggggugggggguagggggggcuuguuauugcucagucuucauguuguaagcauguggaagaaggaugugugaaauacgaguaugaugauaugaugggagagcugcaaugugguugcuuagacaucacaaggcgaggaccgggacagacacucagacugacgcuagguaugaagucagguuggugguagcauucccacucuacaucaggaaagagacuccuucaugucacaggaagcagaaggccugcauucugugggucucuccagacagacccacauuucacagcccuagacaaugacuguggugacagcucuuucaugugaaaggaaaugaaggccagggcagcauggugucuccauuuacuccuugguugaauacccagguuggggacuagcacuacuaaggaagaucugcaguuucacuggaggagagaagccuaaugguggcuggcuucccccugagccuucagguuugaaguauuuugugugugcacggcagagcacuaguguugggggcggggguagaucuggggcuacuuagaugaacugcacauuguuucuuccucugugggucaaaucccaaaccagacagugauuuagggaagcuaaaacugaacucugguugacagugcuucgugauacaaguauuaaucugcccugucuaugacaguguucauuccuuuuuauggaagugggugguugcggaucuccauagcaccucaacucauuauuaauacucacucugauuucaucccagaauuugauaauucccuuuucuacuaacauuaaaauaucacaacagagaaaacaaauaacccuaccugacuagggugugugaaauccucuaugaacaggcacguggagacauacuagguagaugaaaagucugaggucugaguacuuaauucugcuguucuguguaucucaauaaaaacaccaagaccccagugucagggccgugcucccuccucgagucagaccuaggauaccuauagcugguccuuacuucucuuuuucucacccuuuauuccccugguuuuuaccccuugucacuacauaggagaaaaagaaggauagagggagagagagagagaucccuuaaucuaauuuguuuccuuuuguuucgucuuugaaagacugcuaauaaaccacaucuaaccuucucugaaugaccaacaaucacccccgcccgccccccuccucccccccccucccgccucuggggcccuagcauuuacauauccugugagaaguucccagaauuccaaaugucacaccaugacaaaacaacacgccugguagagcaugaggcaaaucauagucagcugcuguggucagcccgaagcagcccuauaacgcacacaugagguuaaaacgaaaacauauucuuauaauauuucuguguuuuuuuaaagaaaccaaaauuccagaacuuucacagauaccagugcuaacaagucauuauuuuugcuguccauuuugcacuuucucccuuugauaggaucuuuuuccuaaagcuuaccaagggcuccccuuacccccgcuguccccuguguauuuugaaucuucuugauuccacuauuuuaugguuaaauuucccauuuaagauugaaaucuuagccgggugauuguggcacaugccuuuaauuccagcacugccuccauaggcagaagauuucugugaguucaaggccagcuuggucuacaaaaagguccagguuagccaaggcuacacagagaaacccuaucuaaacaaacaaacaaacaaacaaacaaacaaacaaacaaguaagugguugaaaucuauaucauuuccuuaacucauugaauuguaugcaaugccaccuguugaguacccggccccaugagcuuugaugaugccuauguuuuuauaauugccaguggauucaaauaaauaccguaaugccccuugugucucacucauuuguuuugcacauuguuagaguuuauacaggggaagccugggaguauguacucauuuggcuccugcuuuuguaauucagcaucacgucucugagguucauccaagaagcugcauguuucuguaguccauucucagcuauucccaaggaacaggaguauuguggcaacgacgacgaugcucuaguguguuuacccaugcuucucucacugaacauuccauuggacucugguuugggaccguuuaugaauggcgcuucugugcauauucugauacauaucuucauagagccaaacauuuauuuuuguugguuguucagcugcaaguagaauugugggugauuggcuaguuguauauuuuaaugggacauaagagaauuugauauuaaaaauuaugauucccaaaaggcuuuuuagaauauguuuuucauggauugagagagagcucugauguagaccugaaugcauuuuacuuagucugagauacucauuuugucuuuaaaguccaaaacaucuucccuacaucauguugcugucuucucugcuagccaucuuucuuuuccaguaucuagauuauuucugauaaaaaaaaauacuaaugugugcuuagaaucaucacuguccaaaucuugcauuaaaaaugacuccugguuugacauuggacuacagacaaguguaucgaaucaugugaaugaaaauuaaaguguuauaguaguugacuuuucaaauggguuauuuggauauccaucaguugugacgcucuaguucugucugauaccauaaagcacuucuguacucugaaugaagcagccaguuggaacagaagaaggaaccauugucugucauguucuuuaccuaggucccuccuccuuagaagucaggcuguggugucaggaacaaugucgccgccuggauguaagaaucuaacaacaaucagacaagacuuccugagguugugcgucugaaggaagagacaaaauuuagguaguuuuuuuggcgauggaguguuagagaagagucuguccucugggcaaagcaacugcauagcauccuuaagagaaaggaggccaugaaauggccauugucuucagcugucgauuuaagggcuaaaacaucauuuauugaccucaugauguuacugcuaucuacauuucugaaaugccucucacagcuaauuuucaaaccacaucagggggggaaaaaaacagucuugagauuuuaaagcuuuuaccuaaguggugaaucccagcuggagccucacuagauuucucuucugggaggaaggccauauugaauuggcccugauuuuugcuuaaacuagcuaguagcuauaggaacaagagccaugucgggacagcagugaaaaauagaaccuaggcauugaucauuuauggugucagcugaugagagcuaguaaagaaggcagguccagagagccaugggaaaugggguugggggaggaggauacuggggcaaguauagggcuggugaaggcaggugaugcaaccuuagggaggaugcuaacuaguuccauguuuuccccccagcuauauauucuuaguguaucuaacaguguaacauauaaauaaaagugaagggaaaggcuuuucuauugucaauguuaauccuagccacugauucccguuugaucccauugaaucaaaacuaauuaaaaauauuuaauguuuuuauagagugcgugcauuuugugugaguguguguauguauuuauggaugcaagucagugcaggucagagaacaaccugugaaaguucuuuccuuccaccauaugguuuccagggauccagguuugggauugucgaccuuuaucugcugagcgaucuugcuggccaaaccuaguuauuuugaagauaggagugcugcaagagccagugguuggaaggagauagaagcaaugauaaguuugcgauaaauacauccuucaccagcugaagaguggacagcugaggcuggucuguggagaaaucccucgguuucacuuuuccagucaccccuguguuuucuuuaacuugccuugaacaaaaauaccuacaccaaaaacuugaguuauaaaagcaguuuuggcuuuuaccuuucuuuuaaauguauuuuagauuuuuaggugcuaacuccccauguuaacuaacuuaauaauaauaacuuaauuugcaaauugucacuaacaccugugauacugcagcuugucaaagcuuuuuuuuucccuucacuugguggcacucauuucacuacagugagccgagccacacuugagauccaccaaugucucuucucccauccacucaaucagcugggcuuccuuccuuccuuccuuccuuccuuccuuccuuccuuccuuccuuccuuccuuucuuucuuuugcuuuuuucuuuuguuuuuucgagacagaguuucucuguguagcccuggcuguccuggaacuuuguagaccaggcuggccucgaacucagaaaucugacucccucugccucccaagugcugggauuaaaggcauaugccaccaccgcccugcuucagcugggcuucuaaaagccacaaggugaauuuacugucuuuuccacuuuuaucauuuuacuuuuauuauauaucugcgugauguccacauugagucaaggaaugggaucuucagaggagauuucauacuucugcauacaaguacuggccccuaauuccucacaaaaugaaauauuuuauugguggaucaagaaugaccauauauagcagcccuuaucuuggaaucuauacugcuugauuacuugaacaauuuaaagucucacuaugacaccaugagcggcaaguuccauacugugaaauaguucaagcacaaauuauuagggauauuuuauauaauugcgauguaggcuauguacauacaguauauaugaagcauaaacaaaauucuuguugaguccugucuuaaaauauccacucuuauaugugugugugcgcgcaugcaugugcauguguguguguucauauguucagagguauguggguaugcaugcaugcaugcauaauuacaugcaggaauuaugagguuuagaaccugaaauuucuagucucaagucuuuugguuaaaagauauuagccuguaguuuaugucugaaaacugucauugaagguaaggccagcauaggucuguuucaugguuucucagaugcugaugagauauauugagacuauuaaagcaagcuaugcuuucugccaucaugguguguguguguguguguguguguguguguguguguguguguaugcacgcacacacugugugagugcguuuaucuguugcccuggcauguaaaaaggcaaccagaguauaaugaaguugcuugcuugacacuuuaccuccuugugccaucugaucaagaacaauuucauuuaucaucgucuggcaguugaccuuucauguuucucccacuugcuaauuuuaugugugccuagcacucuuccuauucguuugcuucccaguagaacguguuucucggaauguuuauugcacggaaaaguacgcgggcagagguuauaaacuacuuccugugguguagcuucuuccucucuacuucucccucccucgucaugucuauuuugguuuccuucguucgaucuugaaguuguuucguguuauaaacgguccucuuaguuguccugcauacacugcuguauagaucuguagugccugggagguggaggauaaagaagggagugcauuugcagaagaaggcugauccuccugauucgaagcaucuauaauuuuuaaugaauuccuucuaugggguuuuuugcuuucuugggaaggaggagaacgcucauccaguccucucuuagcgagaguguuguguacaguuucuuuuucuuucaguugaauuauuaauaaucauagggcuuuauacagucaggguuuaaucuucauuaaugaauaaaacucaaagacugucuugacugugaaugggcugccuuuaaaucucuccucauagcucacccucuuccuuccuccagcccuuaacucugagacgugagugccuuggaaugauuuugaucauggggagcccuggcaguaauuagucccugcuggguuuuauggcguggccaacguuugucaugcaauucccacuucuggaauuugccuguguucguccggaauugggguuauguggagucagguuggggaaagggaauaauagcuucauuuucuuuccaguuugugcagugagugaaauggucagauuugaaaugagugcagguggcuggcugcaggucacucccuuuccaaacaggaggagugaagagcguuagauuuuucugaaaagcggagggcaagccugcacaggugagcgcccgaagggugcacugugggcagacaccugggggccauuccuguucugcaggcuagcgcugggcagcggaggguuuguguggugaauggagccaggggcgggcuguugucaccuguucuggccuaagaaccacagagaguucugggagauaacauuuccugcagcuggcucccagauggaaaaacugaaaacgccccaaguuacuuauacuuauaaaaaguagaaagugcugaaauuuuacccucugucuacagugagucagaggcacuaucuauagugaguucaaaugcacauucuuaguuucuuuaaguuagcuuuugagucuuuuuguaucggguccaacuuccccaaucaccuggauuacagugaauucaaaauugauguuucucuaaagguuaccuguggaaagcagggaacuugaggacuacaugagagccuuggcugucucuguccuaugagcucagaagcacucgaguugggggcucaaggacaggccuuucggaaguuucuauuguucacagaugaccuugcaaugagaccccuuuucaaugcuccaauauagaaauguuauuuuggagaagggauagccgucuucacagaguaccuguucgugaauuuucucuaagaacaacugcugcuuuuguguguguguguguguguguguguguguguguguguguuuguuuuguuuuuuugguggguggguuuuuguuuuuguuuuuuguuuugguguuuguuuuccuugauugacacacaggguaacugguuuugagaguuuuaguguuaagguucugguguuguugugauggaaugagaccagaacuggcuuucuuucuuccccuccauaguucauuaccuccagccuuuuaaaaaucagcucaucacagcaacuuggauccauuucaauccggucagugacccuacacucaacauaaaagaugaauccugggagaccagcuauucuuauucacacuuauuugaauguugaaaaaaaccaaaacaguacauuucuucagaguucucugcaggagguggaacuauucaguaagcuguauagaaggguuucuaucucauacccccauuaccucccccccccccagccccaaacauacacagccuaaguguucaaaccugaaggaggggacuggcaaacaccuauaauuuauguagaauuugaguauuuggaaucaauuuugucaacuauacauugaaauagcuguguaaauguuaagucagaggcucugaaugggcacuacaguaagagaauuuguuauuuugccauugggguuaauguauauaauuuuaaaggcgagacguuucccucuacagcacagagagacacacuaggugucuaauugcuugacgcauacaguuuuacuuuguuuggauuccaaauaacugggcuucucgggaaagccuuggccccgccuuaggccuuuggucauccaugcagcugauuugcuuugucccgucugguucauuugucaaagucuuuucuugucccaaggaaugaugggcuccuuugaaccagguuugcuuuucacguuguccuucuuuugcacaugacuaaggcaugaacuucauuuugcuagaugcugugaggccccagaaauaaggcaccuuccccuuagagcgaggagauuugaggugacacagacccaggauugaacuucagaccugauucuuacuguuccacccaagaugcacuugaugguaucuauuaagaugcuaagaggcgaugagauucuguuuaguaaaauagccagaauaugguacgguauccacugucauucuuauguauagcucuguagaauucuuuguccugcuuauugggcaggugacuuaauaauaucuuuguacggucuucuuaaguuauugaaacucucucuucacuguccuaaggaauggcagcaaccaugaauagacaucaauaaaugucaaauacaauggguccuguuagcaacagcaaugguagcagcucauuauugcaggggauagugggccuaguuacuacauguucaccucuuuugguuuguggaguuacccacaguuucauaagcauuuaacuuuuauccuuggaauguaacuaguuagauuuaaucuuacguuugauauuucuguuauuuuguuuuucccaauucuuagccaguuuuuuuugugguuuucaucuugaacguauucuccgaugauaacugagguaaaauuuugagagugccguuuaaggacccccuguuuaggacuuuucuuuuuaauuucaugacuccuuaugguucugugugagaggaaagggaauuuauuuccuuggccaccguucaaaacaaagacuaaugacacaaaugagcagaaacagugacuuugugagugacagguggggccuagccacagcucucccuuccucagaguuuucagguacauucugggaaaguuagcugaauucaaaagacucaccuugguggggucaccucuccgugcccagcacaaaacggcaaggagcuuuuccaucccauaauucucccuuucaugauuuucucagcuggauucuucaaaggcuuauuuguaaagaccuuuaugguguguuaugauuuaaucagauguagcucaaauuucccaagauguguuaauuauccuugucaugcaagugcagccgaggaagcaaaaugcuuuucauuuggauggguugaggguuuguuuaaaauguacuuagggccauuaggaucaaaucaaaacauagugcaugguaauuauguauggaauaaaagauuaccugccguuuaaguagccaguuucccgaucagauugcagcaaagucuugagagaaaauuggcauccccauagcaguagaauacaggagaauaccuuauuuaaggaacauagugaacuacacuagucuacaaaauagaaaagaaaaguagguuuuuauuauuaaaauuauaaguggaugucaucgacaaucuuaaacaaaaguaucagcuucaucuuuguuugaucauaucaagaaugcuugguguucauugagguagcugaggaauugauguuucagauaugaugaaauagagaaaagaauaaauccguuaugacagaaaggaaauacaucugugagccuuaguauguuaguugccauagagccgagcuucugaagucaaagaaagcccaaaguuaaaacccagucucugggcuggcugccuggcuggcuggcugugugagcuccaugucgcuuaacagucaguuucuuuaucagugaaaugggacauugaccuaacagacccuguuauggagguuaagggaaacaaugcaugcaaaguacuuagguaaauacagcagugauuuauuacuagauuaauuaauacuagguguugcuguuagcuugccaucggggauauuguuggaagaggaggaaauugcaggagggaaaaugggaagcuuuggaggucugaacaguucucauccuggagagagccgggcaaccucaagcgugcucccgugcugagggcgccgugcugagcggccuuuagaagaacgugggagaaucgugcuuuugucuugcuccuuugagccuuacguuuucuuuuuuuuucuuuuuuuuuaaaaucuuccuccuauacauugccuuggucaugguguuuuguuuuguuuuuauuuauuauauguaaguacacuguagcugucuucagacaccagaagagggagucagaucucguuagggaugguuaugagccaccaugugguugcugggauuugaacucaggaccuuuggaagagcagucgggugcucuuaccugccgagccaucucaccagccccggagccuuacauuuucuauuuggaaaaauauuguuauuaugagaugguuuugcucauaguaaggugguccaaguuaaaacaaaauugauaaacucugccaagguuauuuauuuucagccauggcuuccuuuagugggugagaaagaaagucuugguuuuccccuccaugugaaauuuggccauuuucuucuguugguggcaagggaguguuuuagucacuacacaugucugaacuacuuguguguggguagcuaggacaucccuaggguuaaaaguuaacuauuggagaaaacacauuaauuugggguauuugaagaaaagcucaagagauuuccggauugucugugucuugcugcgguuccucaauuggcugugagcugguauguucacagcuuuuucucuaaguucauuuuuuaaaaaaauguuggaagagggaaauaaaaguccuuauucuuauuuuaacccucagaagagggggcccuuaaaaagauucagcuccaaagcuugcuccugaaugcuguaauaucucucucagaauauuaaccacaugccccugacuccagaauguccuuccuaguggucacuggaguuaauuugcuaaauuguuaaauuguuguccuauauucauugaaaagcuuauuggagauacuuaggacucugcacugagggaggucccaggcuagcaggccagaucccauuccagguuguuaauugacaggagcaaucaaccugucugaucuuuaauauucuaaugcugcugacuaaugcccagacagacauuugguaagacggaagaaaaacaacacauacuuggugccauguuucaucuuuauccucaucuucuagagucugugcuggcuaugcauucuuauggccaaguucauacaaaaaacagucaguacuucaaguccaucgugggagauacugagaguaaaugcuugagacgauuuuccauuuuucauuuauucaacaguuguuuagugaccacuaccuauguauuuggagacaugaggagucuagacugggaacagugacugaagcaaauuucuuguuucuguaaaauucacauuuaucuuaaauggagguggcuggaaacuuuuguuaggaaagaaaaaggacccugaagaugaaguccucuauacauucuguuuugguaacuugcugagaguaauuagccuuauucucucuucuucuccaacuccccuccccuccagccccccccccccccccccccaguaaauaccauuugaacuuacacacuguggagggcggugaaagagaagacaguucaguauuuacuguguguggcauucuagaagccagggugguaguuggccucggggaguucuuauaaaaaaguuaacagacaagaauuaaaagcacuucacuggaauucuacuaauucuggauuuuggauuugcugggaggcucgucuagacugaagcuuaucuucaaagauaaugcaaauucaaaggacuugcagggugggggaauagcugaaguauauaaguaaacaaaugauaagaaaugccauaauuccucaaagcagguucugugagaauacaccaggguuuguauuuugaauuagcauuccacauuuuaaacauuucauauuugcauuauuagcauaacauuuuagucaaaauuacugacuuucacuacaugggccuaacuucaaagaaguggaaguggguugaauaggaggagaucagcuguguuugggguaaacagaugcacaggcauaauauucuugacaguagcucaauuugaucuuuccauacuuuccauaagaaucuggaaaaaaaauguuugcuuagcacagauucuuagaaagaagagcauuucaacuagguaauuuggagauuuuacauauuuuauuuuuaaucuuuuuuuuuuuuuuugguuauuucauacuguguguuuuuaaccuuucccccaacuccuuccagauucuaccugcccaacuucauauccucucuuuuuuucucucugucauugcauugcucaaccuggacuagagaggcuccaucuuucaguggcaaauucacaauuggucaucuuggcaaagaauaagggacaucaaaaugcucaccuuaagugggagguguacaucgcaucucuucuccagaaguucuuuuaaaaggaaaacguuuacaucacuaccuuauauaugguauugauugagguauucaccguaccaagcaugauuggggauuucuccuucuagguuuagcugugacaucugagguccugugcaaacaucccugagaguuguagaaacacgagaguucaaauaacaccagaucagucagccagcuuauaugguaucaccuucagguuuaccuggauguaguuuucaaaaagaucuaucauuaagguauaugagcgauauaagauauaauugcugcaaauauaucuuuccucaccagaauacagcucaguuucacuuugugugccagcucuugaaauaagucgaugcaaguugcauguuucuaauuggaaauugacuugaaaaaaaauuauguaaaaaugucuuacagugaacucauaggaggagacucauaaugucaaguuacacccuaauaguccuuuugguacaugcagauuucugucagcuaguuguacuuaauuucauuaugcauuuuaauugcaaagcauauucaaaucagugauuaauguuaaagguagccauuuaucccaaggccuguguaguuggauuuucaucucauucccuugaauuccauaugcucugucuucagacucugcuucaacaacaguaagccuguuagauaacagagccuugaaauuuggccuaagguagagucuccuuaauuguuccucacuguccuccuuccagaucaaaaacccuaagagguauugucccuccucuggucccuugaugcugauagagucaccagaauaggaguguagccuggaccaucucaagcacugcugugaaauuccuccccuuuauuugggaagcaaaggcuuccuugaaacccuucccuguaccaacauucacaaagccugcccuaggcuucucuuagcagucucaagucaaguaucucauuuuauugcuucaauaucuuuguuggcuccgaaucuggguuguucuuaucucuugcccaagauggcugccuuaggcaguugacucaggaauuacacuguaauuaaagaaauguagggguuccccuaccugccucaccuuguuuccccagcuaugugcguggugaagaguccuuuacacccagauucaggcggcgccaaggaauugauuuucuaggaauuuguuguucguuuaccuguguuucauuucaguugagcacuugugauagcaguuggagaaugagaguuugguguagggacugaaagcugcaggaguuggucaugaucagaccuuucccuaaguugugaagaaaugaaguggaugauagaaaaugcguggggagcaugcaucucgguuucauucauuucacaugaaaggaguacauuuuacucaauuugaaccuaaacauuuaacuuacugagugcuaacuuuuauauuagcuuacaaccaaauugugcuuaacccugaagcuuugagauggucucccagagaaagagaguaucagcuuguguucccaggguggaauagggacaugcuucuggucuagauuugccauagauuccuagacuccuccuuugcuauagauuccuagacucuaccacuaccuuucaugcccgacucagugcaguuuccauuaucuguauuaggaagaaccagcaggucauuauuauaaaccugggcuuuggaacucaaccagacuggguccauucaguucuuuccccuauucucucugaccucuguuguccuuaacugugagauguggagaugaaauaaaauaguggaaggugcugaccuguguuugcuuaagaaaggaggcugguaucggagggaaggacgauggugaugauagcugugccugcgguagcauuuccucugccuagguuuuuguuuguagaaaggugagcauaggagggagagugaggcuggggaagaaggcgugggucaguagggaccuuugcaccaggcauggaacucucugucuucuacagaaauugccaccugucccuuaccagcacuuccugaugacugcaacucugaaaagaagguagcccccuuccuugccauuucccccuucccauucauaagugaccaguuuccagcugccaggaaagcuaauuggaggagacggugaauauuagcccucuucauaguucaaaugugaagcuguuguucagugguucacauccuccuuguuggucacauaucaaauaucuugcacaucagguauuuacauuaugauucauaacaguaguaaaacuagaguuaugaaauagcaaugaauugacuuucugguugcaggggggucaucacaacacuaggaacuguauuaaauguuacagcuuugagaagguugugaaccacuguuccaguaguugugccucagcuaagauagaacuagacuaccuaggaaaauagaggguaguagcuggaagucagugagauaaauccacacuguugcuuguucuuugggguuucuguaaggagaccugcuuguggaggcaaauaagaaugccauuuagcagacauagugaguaaaagacuugucaaggaacacaguguacuugggcagaagaggaauugaucuuaaagugaauaauuuaagcccguaaauuauauugucuugguuaggacagcugagcaaaguucccaguuuccuuuggaaggacugcaaagaauauuuguggguacagaggaaaugcucaauaaauauuuauugguuuuuuuuuugcuuaauuuuuacuauuuauuuauuuauuuauuuagucuuucaagacaggguuucucuguauagcccugacuauccuggaauucacucuguagaccaagcuaaccuugaacucagagauccaccugccucugucucacgaguguugggaauaaaggcccgggccaccacucccagcggaacaaauauuuguuaacuaaauaccaugaaauuuguguuucucuaauacggcauuugaggaaucugauucucuguuauugcuaccuuaauuugaagagcaaguuagcaacagagauauaauauaaugcuguuggaauagaaggccagaccaccuuaacuccaacuugagaaagucguuuugaugacuuaguuucugcuugagcuuauguguaaccagcuucagugcccguuguuuccaaagcuuuggugguguacaaggacgcggugacuccuguauucaagugugaacugaggcucgguuucgggucuuuugcuaguccaguuacuuuuaggaggcuuagggucauguguagaacugcgauaauguagcucagcauaucuuuuuuauguucauaucaaugaugcuucacucuuugccaacucccauguccauguguaauuucaacuucuggauauuauuuaugaaaugaaaacacugcgcacaaaggacuuuguaccugagggaaguucugaaacuuucccucuuuagacuccauuuaaccuaguccccaagucuucaaauauaaauacgugugccuauaagcaaaaagccuuaacaggaaccugagccagguuucaguuugucuaaccaguuagugacucucuuccuccucccuuuccaggcuaacguuagguagaguuccagcuugaguggucuuaggaaugccaucuucagugugagcugacuguguaguugcucgugauaagguccugucagugucgacuggcaucgugauaucacuuuaucugacagucccgugugugucuagggaaaaccgcuaacagaaauaagaguucaguauaucuugaacccuccacaugugcuuuugacauaaacuggaaaugaacauuuuuaucuucuuagagaacugggcaaagagggaagcaaaagaauggacuguuuucaguuccuuuuacccagauccaccguuaauuuugaaaaaauacaaacauucucacauuccuggaaagccuuuauggaccacuaaaaugucuccaacgaggccauauaaacagaguagaguuuuauuauuucaaaaacaugcuggggaacccuaagaaggccacguguugauaaaucgucccccugugcacaaaugugugcacgcuuucccaaguacccgucuucuugguucccagucuuuuucaaagaaaagcaggcgucuauuuuuauuuucuguucuagcagcuacugugguagaucccugugaaguaggaucugccccugaggaaggacgggcccuugaguucugagcaccgcagacccaucgccauucuaguuacuuggcugcguguuccagacccuggcuucuguggagaugaucagauucagcagccaugcuuuauuuauugacuaguuugcaacuuugucaaaaguauugccucuaaccgcuuuccuugcuuuuggccccaugguuuaagcuagcccuuuguggaaacggcaauuaugaggugaugucgaaugucuuaaaauacacaggcaggauuuucugcuucuaauauuucugugguuuuucugccuuucaaggcucuuccccuuggugcccguauaacuccuggugacuguuaacacaguguggucguugagacacaaagaccgagaauguaccaugagccacucgugucucuaaaacagucagaugguuuaaguuaagaaggcaauccaugaguuucuaaagccugggaaaauguagaacaguguguuuuagacuggccuguucauuuaacagaggagacagugcccagacacagccaaggucugaggccccggcacacguccuccuaaccagaugggcaccuuucuuauggaggaaaagcaucgugugcccaugauggcuguuuccaucccgagccuuuucuuccuccccuugaaauacauucuuauuggcagugaugcacugugacccacauuuaaauuuuaagaugacaaaacaaagaggacuuuuuuuuucuccuuccuguuuuaaaauacuuccuugggaucuuuucuuccucuuuauaggaucauaguugccaccuugcaaagguagugaggaaaugccacaaacacuuucuauuucacucugccugccaaugucauaaugaucacuuuggggugcuugcguucuucuguuuguuguaucauugucauuuauuaacauuagaaauagaugggcuucauguuuugauuuauuauugauugauuguggugcuaaggaagugcucugaccccgaguccuugcuuuaucuauuaaauucucuucuuugguuaguguauuaagaccuguugcucuggguaguuuuacugauucaugggagcuagucuuuucaggggcauaccauagucauaucauugccauugggacguggaggauucuguauuucuggcagaugugacaccaugagaauuuauauacuccaguuugguccccagcuccugagacagcugccgaugguuuugugaugggaugaguggcagagaugcuuggagcaacuuuugggcuuugauggaaguuucugacacacagcuagccaaacccuuugguucccuaaguaaugggcugauaagagcauccugcuuagcucugaaaucucuuagaacuucugaguuuacagaaccuucuuuguccuaaggauaggauuccuggacagcuugauugagauuaggagccaguaacuagaaagacaagcuaagauuaggagcccugaaauuuccaccccaucucccauccugguuggaagagggaagucuuagaaauugaaugcaccauaaugaugaagcauagucuugaaauguuucuagcuuuaaagagagcuuucagguauuuucuggucuagcaaauacguccaggagagaaccgggcagauaaaaggaaaggcaugcgcuuccuccuagcucuggaguggugguaguagcuaaccccaucucuguaggggcacgugcuuuuauccuuggacccuucuguaccucaaaccauguuucccucacuuggcuucucauaucugucuuuccuaguacagcaauacaaaugauacuguuuuucucaguucuuuaccuagcccuaccaaauugcugaaucaaugcagagggguguggaaagcucugauugacaacuaauuguaucaaaagcucaaaaguguacagguucaacagcaggacugguguuuggugucagugauugaaacugagcccccacaccugugaucccacacuaauugaauguauagcaucagacacaaauugagccauuuagcaacucauuaauauccagcaaguuggggaauuguaguguggaaaaaguccguuuggugucugagugcuugugaauauagaagcagccauuuccccuuauagguugauaugucaugcuguugguagggcauugguuuuagauaauucaccauugcagagaauguguagaauaguaauagaguuuugaauuauaaccccacugagcaccauugggguuaaaaauaaggcuccagauauaguuuuagcgcuaaccucggcuuuauuuauugcauguuuuaucagggacauguauucauccacagagcaaggaacagauucauaggggagccucagcugguuuauuuuguggcuuagucauauccaagggguuccagacacuuuaugaucucuacucgccaccucagcacuccaguuuuggugacaaauguauuuuucucuugggaacaagauggccuggcuguagcuauugcaucaaggcauagcucguccagagaggcuuccaugauggguccugugguaugaauauauauaugugcagguaguuggcugggaagaccgccugugaguugaacugguuaagguucaaaauaagaaaagaaucuauaaaucuugaggcgcucuaaagaauaugaaagggaccuuccuggaacccaaauccucuugacaaaguugcucauuggagagaacagugccaugaauggcuggaccaucagaacauucugugagugggagcuggugggagccagacauuauaccaccagcagucuccuaauggagaacagauuguucuagauuguucuagaaaggaggaagaaaaccagcaauggauacugaaggaaccaucaagguacucagccacaccuguuucuucccuaguacacgagaauacuaacauugcuuaaugugauuaucaugaaaaucuagugacugaaugguauaaagacagggccaggccccagaauaagcauucaguaaauggcagguccugcugugagauugaaagucuuauauuccaucaguuuuauauauaaaaaaauuaaauugaacagcugcaagaaugauucauaauucacuguaaucaaaccuggggcaaagguggcuggcauucacugcugauaaguugggccuggucaucuggcacccugaaccauaugcacuugaaacuuucggaugacccagucaccaggaguguggucagggagauaagagauagguaggguggaggaagcagaguaauuaagagcucacauagggcucuguuaagacuguaguccgugagguuuagaguccagcagaagaacacucacaguugugcauccuggcaacuuuccucugccacccgggggucagcguuugguggggggggugguuguugucuguucuuacugcaggaaagcaauguaccacaacucuggcuacaaggaaagaggcugaaguugugucugaagugugugucuaugugcauacauuaauggcuaagcauccaacuaggugagagucuaacaaagaugauagucugcacauccccggaagcccugagaaaccaaacauagauuauuauuugggacacaguguagaaagugggugaagaguagaaaggugaaguaauuaagauaauuagcacauauagccuugccaguagugaaacauaguaaguauuugguuuucuuuucuuucuuuucucuucuuuuuccuucuuuuuuuuuuuuuuuugauuguauuguucagauuuugcuaaauauggcuugcacuaugucagccaaugaguaacuuuauaaaauggaugacgcgcuucaguacaaaugucuguuuucuguuuuuauaucacuuaagauaaugaagagcugaggagaacaggagcauagaggcuugauuaagaguuggagaggugggguggucagguguggcugaggauggaagccaggggcucagacauacugaacaacuacucuccugugagcuaaauuuucaucccuuuugauuuuaucauuuauauauuaucuucuuuuggaggucagagucuccgguguccaaggcaaauacuaaacucauuaugagaugacagugaaccucuggaaugcuggauuauaggugcacacuaccaugucugguuuuauguaaugcuggagcgcaaacucuggcauuggugcauacgagucaugcauucugcuaacugagccaugucccugguaucuuuguucauugguuuguuuuuauuuugacauaggaucuuacccaguugcccagcaugcuuugaacaagagcaucauggcucacugccuagaauuuuagauaccuauguccaggccuggccuuuagcauccuccucuuuuuugucucuuuaauguggaccguccuaaagguauuauuaaaacacugccucuguucccacuuucugauuuuccugagggaugugacuccaaauaauauuggguuuuccaucuaagagccuggccuuuguguuuuguuacuauuauucucauauucauagaguguacuccuaccuaaauuaggccuaguaugccuuucccuaaauacagacuguuagauuguuuuaaauuggauggaaacacacauuuuggggguuggugauauagcuuaaugacagagcuuuuuuuguuuguuuguuuuguuuuguuuuucuuaauaaugcacaagccacugggauccagacaacaugaccaaaauuccacauacuuccuuuuaauaaauuuucuuuuuguggauacauauaaauguuguauggugggcuguuuuccucccagccccaagcaaccugauuagugacuaagacugaaaauuuacuuauaaauacuuaggccauauagcuaggcucauucacugacuagcuaauaauuuaacauaaucuacuuacauuaaucuacauucugccauguuacuggucaccucugcgccggcaccacgugucuguccucauguuuucccuggcuacucuucccauguccaacucuauccuagaauucuuucugcauaccugauguccuaccuucuaguuuaaauuuuccuauaagcuauagauuuuuuuuuuaauugacaggugaugcacccauucaauacacaagauacucuuucuacauauaaaaagcagcaaacauccuuguccuaagcuuauagagaaaggaccaggccuagccaaaugauaguaccuggagcaauccagguagcugaccugcagcagugugcacaagucauggucccacugcagcaacauucuagcacaccagggcuuagacucuuuccagacccaaauuucauuucagcccagcucuuccccaguguguucccacccgacucuuagguuaagcuguuguaaagccucaaaaggacaauucagggcccaucaagagcugggcccaagacagguuucuuccuguccuuccuccuuaccuucaguuuuguccucauauuuugacacagcagagacucauuguugcaggcgcuuaaauaaauaggaguuggacucagcccguuuccaggaaaaaugagaacagcagguguuaucugauguaauuaaaguguguugaacccugaacaaaguacucaguguaaaucucuguuagucccuuacaaugagccagcuuagaauccguucuaugaauuaccugcuggucggaaggucuguggccuuugggaggacguguuguaaauuuuauagcaagccuacuaggaagcuccuugucaauaaguuuagaaggauacuucaaggcucuuuaaucuccguugucagcccaguuaucuugucuacacaugggcauaacuuccuucuccacuugaauuaauguuggacuuuuauaaagagacauuuuaaacucugagugcaguuucucagaugagcugaucuacaaaaugagcgguucuucugccucuucuuuucccaauguccauuuagaaaguuaugguaaaugaaaaaucccuugagcucggguguuuccugucauagucucgcuuaggcaugaaaaaugcuuuauucuuacuucauuuuguauuuuucacaaaugauucauaaucacaccuaaaugaguaaguuugcaauguuuacuuauuuuuccugccuaaauugcacauauagacacauugcugauagagaauuacucagauauuauaaauaaugucagcuaauucuuuaguccacugugauuuuucucacguuuccagacguuucaaaagccuuuauuguguaggcuuaugauggacuuauugauugacugcaaacagacauuggguauucaaccuaaaugcuauuuugccagcuucaacugcccuuugcagcgcguucuucuuucucuaaaggugaucucaaagcaaguugcuacugcucuuaagauaauaaagacuaggagcggggggaauguguggaaucgggugguucuacagaugccaaggagacuuuaagauguuugucucucaaggacaaguuaaccucacucuuucuuuuaaagaacaaaaucguuuucuuuuugugaagcagaguauuuucuaauuugugagcuuuggaaaaaggaagagggaggaagcagagagagcgagagagagagagagagagagagagagacagagacugacagacagacagacagacagagacagagagagucagagacagagacauuggaagaagucacagggcaacuuuucgccuuuacauggguucuugggacugaaagcaaauugucaggcuugugcagcaagccccuuuaccaacugagccaucucauuggccccugauuaaccuacuucuuaaauuuucauucagcaaaaaaaauaacaugagaucacuagauaacauuuaaauucuaggccuaucugcccugcucgguuccaaguuggaguggaguugucuuccacuggggaauaauuugucuccauuaauugaggacaaaugugcaugcguguuuuaauuacacaguaaauuaggagaauuuaagaugcaagaauucaaaaccaacaccucaaaaaauagaaguagaaaagcaggagaacuaucucagcagaagaaucaagcaggugucuccagauaaagaaagggggaaaacaacaaggcaaagacaaaugacuagauuuugcuaaacauccuuucaaguagaaugacucugauguauggcugaaauccuuguaggcuguaugugacaauggggauggcuguaugccacacucagggcauuacucuugugugcuuggcugcagccaguagcuaacuaagacguuaguggccaauauagaguaaggauuuccuguguggacccaaacuucacaaacuuccauagcauggguccccuuuggcucuaugcacuuuaucaucugugcaaaguuuguauguuguaaaguuuuugugagggaaggcuccagaauguuccuuaugcuuuaaagcauccauucuccuaaguguagcacuuuaaggcugcuauuugaguaacaacaaggacauugguugacuuuguucuuugucauguagauguaaccagagauacccuuccccaaauggcuauugcucuuuccuuauaagacaagaacauucagacuuaauuguguuuucuccuacuucacugaggauggcauaauaauaaagucuuuauucagauauggagucuucugggcugguaagaugcucugaggauaaaggcaaaugucuguaagccuggggaccuggauuugaucucugagacucacaugguggaaggagagaaccagugcccaccaauugccccuuuaucuucacaagugcaaugugcuuuggugagcacauaaauuuauaucacaaacacacguucauaccacacacaagaacauaccauauccacauccacaccguacacauacauacauauauacacaucccacaauaaaaagauacauaaagaaaugcaauaaaaagacagugcuuucuggcauguucaaccuuuuccuaagccagucuauccuucucuagccauauacauauuuagguuucucuuaaaaauugcccuggaucuaugagugcuuaaguaagcuacuuuaaaucucuuuuggaagaaauuuaguuauaaauaaauugcauaccucuccacauuguaaaaccuggaagacugguuacaggggaagggugcuggauauucacucaacuaugauugggggcaggaauggagcccuggauuuugcuuuugcugauggaaagaaggccugggagcugggucauagggccucuggccgaucuccaaggggaagcuaagauaaucucuaccuuucaaguacuacgugaagcuaauuucucagguacaauuacuuauagucugccaugggguugcuuaucuuguauaccccauuagacuuugagccccugaggacggaaagccaucacuacccuguauguuuaucauuugguuugaauguuuucccuagaguaggcagaaaugagaaucaagcuaaugauugagacacaaguugggugacuuuuggcucucacguggaucaccauaaggucauucucaguauuaagacugucuuaaguguuguggaacuguuuggggugaaaggaccauuagcuuugagaaagcuccaaaacuuagugacgacugguauuuuuccagugcagauuugcuguccuagcucuuaagagauugaacgauucaucuuaaauagaagugaucuaguugauuccuaaaauuuauaggauguaguuuauguuuuuucauauaaauauuauaucaacagagauuaauuuuuuuuuaaaagcaaggugacucuggaugaaggucaaguguauaagcccugagcagacuuuaggccgugauuggaacuagaggcuacccuuccauuguaacuggggugcaagcauccauccccaugguccuggcuucuucacggauauagauucuacauuucugucacgacugcuccuuuccuuuucuucagucuuagguagaacugauagcacgcuauggccccauuuaacaagacaaaacaggucugggucucaggcuccugaggaauuuuguaaugauuccuagcuaagguggcucagacccaucucagaaagccaccccaucagugacuuugaccagccugaaagucauccauguuuuuccucuaugaaaugcugaugaagcaagcggggaacaaggaaguacgggcuuucagagccaggagucaguucuguuucacucuccaauauaaguuuuuauuucccccaaagaggauggugggaaaucccgcagcacggugccagguggcagucagcauugaugcugaagacugcacaggagaaguuaauaauuaagaaggugguggcccucccacuccugaggcaaugucuguccuuugcuaaaacaguccuccagccagcuccugauuucaaugccaagaguuggcucuauuuguugcugacucuuuuguggcuuucucgcugucuuuaagcuacaugcugacuccuguagauugcucaucugcagguugagucucugcaggcccaggccugccugugccuuccuuuucugccacaggcuuccggaacaggcacaaagggaaaugggauuaagcaucucaagguaucaagcgggacuuuaccaugccuaaguauuuuccugccuuguauagcaucuccuagaacaguagcauaaaauaaaaagaaaagggaagaaaacgagaaaucaucacuuggauuuuaaugccaaauggggaaccgagucauacagucagcuauuucacuggugcgucuagauuuaaaagauacuuucuagaccccaacauauuuuuguagguuauuuccucauuguuaauguagaaauuuugcacauugacaacuuucaaauauucugcauauguagauuuguaguccagcauauaaguuagauacagaacuuuuugauuaguaauaggaagaacccgcuuagcuggguaagugguggcucagguuuuugcuuccagcacuugggaggcagagacaggcagauguuuaugaguucaaggccacucuggacuucuuacuggucuacauuguguaauaacuuccaggacauccagaguuguguagguagguagauagguaggaaggaggaggcgaaggaagggcagauggacggacagacggacagcccuucugacucauuaaacuugagcucuucugccauaugguuauccagagagcacaugaaguccauguaagcagaaugagcuggggaaguuacuggggucuccuuuggaaugccaagauugaggagccagacuguguggugugauaaucugauggaggaaaugcagaacacagggguaagaguucugauaccagugccuggccuugcaacuugcuuaguucucagccucggucagacucaguuucccuguuaugugaggauaaugaaugagaucgucucuuugauagcaacucggcccacauugguuuccagaaaguuaugacaagguuauggugauguucauuguugguauaaagagucaaugguaauuuuugcacuuugaauuuagagaauaagcuuacaaauagaaguggugccagucauaaaaacugccuguucuuuuuaaugugugcauucuuccuuaguaagcauuucagccauggucggaguguuuccaauuuaaaagccaugcaaugauuuuuuuuuuuuuugccuuaaaauacacaguguaugucauuucucagcagucuuauuuacacaguguguugguagugggcaaagcuguuauuuagugauuuuuuuccccccucauuuuuucuuguucaaguaagaauacaauaccaaaucaacacugcuugggaauagaagaaaaacauugaguucuacaaugguguccucccugccccuggggugauagauauuuugccccuacuuuuuaaagucaaggguagauauggggcccaaacacagacaaagcucuacacccuuucaguguccugucuguucauuaagaagugauguggagaguuucucagaauggaaaugacucuuguauaggcaauggaguaauugccaaggggcagacaaucgaagugaaggcauauuucacagugagauuuuaggcguaccugcuggggccauggcacaagauaccuugcuaguaggcaugugagaccuagguaaccagcucauggccagagaagagagggugaucuaccccacucagugacaacaacaauaccaacacacacacacacacacaugauacagguagcaauuaucagugugacaccaccugugucacauguggguacacaugaaacuaugcaugcuuguacuugcuuuuacagaauucucaggacuucccaacaugcuccauucaugcaguaguuuacugucagaaguuuucuguucuaggaagcccacuuacaugaaugcauguugauuugugaaugugcauuauaauuuaugguuauuuauugggagcuauuuaguuuugcuuauaauaugcauuauuacagauauuguugagguuauuauacuguuauuaauuuccacacuuuuacaaguaguuugauagguuagauugucagauuucucuccagaaaagaucuuccaauucauuugcuuugucugcuuguuauuuguuuuuggagauagggccuuacuauguaucucuggcuguccuggaacucacuauguacaacagacugaacucaaacucacagagauccuccugccuuugccuccugguaggauuaaaggcaugugccacuugcgauucacuuucuuaaccugcagcauauaaaugagcccccagugguaaaaguuaggcaguagagauguaaguaaaaccaucuuuugaaguugccuaaguaaauauuucugagaaaacaauuuguaagcaggagaguggucaggcuuucugcuuggacugcauggggcuucuacacaaaugauguuguugauaaauauuuaaaagaguugcuagaaaauuggacauggacuagucuauuacaguguaaauguauacacugauuagauucuuugcaucaauauuuucaaauuccaaauacagaauuggaaauguuuuuugagaacugccaugcuacuacuauaaguggaaaauuucaccuuaaaccucaugugacaacuugcagucaaaaugcagguacaccugcauaaaauucccuucagccuauauguacaaguauguguaugaaaucauaugugaaucauguguuuaaacuuugguuucauccccaauaccaucauaauguguacucagauguuccagaaucucggggaaaaacacaaugcaaaauugucugguuggaaguaugcuggauauggcauauuuuaucauuauuggacauuuuuuuaaagagucaagcccaggaguggccuaaugcuucaggaauccauguggucagaggagcucaggggucacuauaucucagggcuucaaguggagacuuaccauuggacauuuuaucaagucugauuuuuauuauaugagaauguuuuacggugcuuaguggauuaaagcuaagcauuuucuuaucagcuauucauuccagccacuaugaaaggcucuaaggauauaaaagacacaggguuauucugccuucgaccugcugucuuagcuauacccagccuugggacaaaaccugaaaggguuguggguaauacaugccuucuacaggugacaugauuauaaucugggcaccucguguagaggaugcagagaaagugugauagugugauucuuucaggcacacacuuaauaagagggaagucugagcuagguuuuaaagaugugagaaucauucauucacacacacacacacacacacacacacacacaccccuguacguucuccagacaaauaggguuaagcauuaaugagguuaagaagguauccugagguuggggaauuaucauggucuuccagcuguuccuucucugguuugcugucuuagagcuucagcuguuaugcgcaaauagaaugauaaugcauacuaaccuauaguaccagaacuugagcacagugcuugguaguuaagagggagaacagaaguagugcacagccaaauggaggcacaagugggguggacugacagaguuggcaaacucaacugcuaucacuuuucucauaugcauaaauaauaaguugaugcugugaggcuaggguuucuaccuuguguuuucacuuuuuuuuuaaaagaaggcccugaacauagcacuguguucuguguguaaaguuuauggaaagauccauuuuggaauaacgauguuguuaugaugaagguguaaaauguaucugaacaggccgcuucaaugccaggccgguuaggaagucugcaggggauugaggcugagaaaggcuuaugcauaaucaagcuuuucuaugccauguuugaugcaggcuuugguugguuacuucuuagucauuggcuguaagcugacccuggauagaggcaaaaagaauuacccaggcauuucccuguaaguagcacuagaggccuuuguuauaaggagagucaguauucaggagaccuugucaacccgcagucagucacagcagcuugggucuauugcauugcccagcaaaagggaucugggcaguguauacuuucauuaugcccacugauuaaacucccacugagccuuuaaggcccaaacaggcccuacccuggagacuuuauccccagacaagaaagcuucuuuuugaauuagugaugcuaucaaucucuacuucuuggugucucauuauaggguugaucaagaccuacuuuccaucaccacagauuggcuuaaugucugauucccugcuauacuaaugaguuucuugaaggcauagcaaguuuuaauucaccuuuaaacagcuacuccccagaccccagggcuguuccgguguagcuguuuaggaaagguucuuugacuugaaaugagcuacaacauccuucuaggcuccuaaugcuuugcucuuagagauuacugcccaagccuuuucuuucugggguaucuguucuagcauccugcucagccugcuucucuuuccucgacagaauuuuuuuuacaauggacucccuagaugcucucugucuauaacuuacauccacccacucuguagaauggggcuacccuacuguagcuccccagugagucucggcagauagaugcccuguugugccaccucuauggucugcaccuuagggaaaaugagcaaacaucauuuucuccauaauagucuggcuccucucaggaucuggaaaguuccggcuauaucagcgaaugccuugauuuaucacgauuauaaaaauuguuuugaggaaagcuugaacauggucaguagacucaagaaucauuucugggccugaaaaggaugagcgcuuccuaguguggacugaauguuguaguuacaacccacuagucaaauagaaauaguuauuuauguauuuauguacuaaaugcaauuuuguuucuucugguuggggcaacaugaauaagauuuggcuuucuuuguauuuaaggaauuuauaaucaagggaagaaaauggacuugacugauauauaccuaacuuauacucaucaaaggaguaaugugauguauaccagaaggaaaguguguaccagcuuagaauugaauucuacacaacaacaaucaccagacaccugaagcuagagagcccugugccaaauugcagcuauaucauuuaucaguugugaaacuuugagcaauaauuuuuuauucaguuuuaauauuuugaucuguuagauggaaauaguccauaccuaacaguguugugaaccuucuguaagaggaucuucauaaaacacaacuugauggauguuaacaguugugaugaaugugacuggcuguaagcagaccaguucuugcacagguaaaaagguccuggugcagguggcauuugaguggagcuuugaauuuucacauuuagugcauagaaacagauggggaaaaaaaaggggauaaaaccuugcaugcuuucuaaaggagauagaauauaguaugugcucccuggaauguauugaucagagcuugauaaauguucaguuccuacagacauaugguggaguuggguuuggagagaugucucagcagucaagagugcucgcuucucuugcagaugucucuucauucccagcauccauugcaggcagcucacaacagccucuaacuucagcuccaggagauccagugcccucuucuggccuuucugggcacuugaauacacauagcauauguucauguaggcacacauaugcauccauaaauaaaguaaaauauuuagaaacagaaacauauggcaaggugagugcuaaaaauauugagugcuaaaaaagguuuccugaaauuuuuugauccauagaauuuguguguguauucccauucaucugugugcuaauacuuguucaucuuaaggaaugucagaggacacuggggucaagcauaccuugaauuaaaauaguuacaaguauagugaguuuaacuuagagaucacccuaaagaaaaguugcuucucuagccuguuuuuuaaagcuauauuauauuuuuaaauuauguguuguauguguauguucgcucucucucucucucucuguguguguguguguguguguguguguguauuugccugugaguacagguaucuguggaggccuggagaggaaguuggaucccuuggaguugguuuugagcuacccagcauggauguugggaaccaaacuugucuacucuaagugguauaugaucuuuaucucugagccauuucucagaccuugugauuuugauaguuccacaugaagaugguauuauguucuauguuguagauuuggaaacuaucugugauccugggaacauucucuaagcuaaaaagacauaauuguuuuaaauuuaaguaguucaggucucucaggguuaccauaaugcauaggauagcaaucaagaaucaacuugaggucuccacagaggaguguauggaaguaaaacguugaauucagauccuuacuagaggcaggaggugguuuuuguuuguuuuuuguuuuuguuuuuguuuuguuuuggcuucugguugguuccaaaauguagaccuauaaaacuauauguucauuuugcucaauauuguuuuaguggguguucagaacaacuaagucaaaaacaacaaacaaacaaaaaacaaacaaacaaaaaaccuguguccuaguggagugcucugcaaauuguuagauugagguugagguuggagucuauacugcuguacuggcaauuuuuugucaaccugacacuauuuagagagucaucaaagaagagggacaucaaauggggaaaaugccucuauaagauuggcuauaggcaagccuuuaggauguuaucuuaguuagugauugaugggggaggauccagcccauuguggguggugccaucccuagguaggugguccuggguucuauaagagagcaggcugagccagguacaagcaaagagccagugagcagcaccccucuguguccucugcuucaguuccugccuucagguuccuacucugcuugaguuccugucuaucuuucauugugaugaauaguguggaagcacaagccauuuccuccucaacuugccuuuuuuuuuuuuuuuuuuuuuuuuuuuggucaugguguuucauaacaccaauaauaacccuaagagcaagccacaggaaacauuuguaaguaccaggcccuuuuaauaaaccggaaaccccaagccaguugugugugcaugcuuccuugcucuuucuuugaaucuugggcucucugcauaguguacaacagucuucuugcuagccucauauuuuaagcacuaaagaaaugcccugaagugcauugaauacagaaagaaaccuagccuuuacuaugucuggugggcuaaugacaagagcccucuuugugucuuguuuccuggcuuucagccagcacuuuugcuuugugggauggcugucuucaagcaugcagagaugagcauccaucaaggaggggacagcauaaagaaacacagacuucaucaagccguccgcuucagcaauauuccauuugaauugaaucagggccaagggcaggcacgcaguggaguaucuguguggaagcugacauuuuaaugauuugauuaguuuaggaagaauguuuuuauggguugugucaucaauuauuugaaguccuaagugaaguuguuauauuaugaugaacuucuuuuaccuaccucuccuggggacuugugcugagauuucagcccaggacccuauggguaaucucaugcaauccucuuaaagaaacaguguuuaaugacuaaagcuguuaaucauauuaaauacaugcagccacccuggggaaaaacgccaaacaagcauaaaucuacaaaagguuuuugagugagcuaagcaggguacuuccucagggugggaugcuagacgccaggauuguguuggagggagggagggagggagggagggagggagggagggagggagggagggagggaugaagagaaaggagggaaggagggaguaguugaaauaguagucaccugacuacgaggaugaccuaguacuuagaguguggcugcuccaagcuauucguagaauauguccaucauagaagaugucugacacacaguagcuuaaacuguagcugaaacaagggggguaggcugguuuacauaguagguacuaugugacauuuuguugauagucagccauuuguugguauuagaauaucaagguuugauucuuuugguuuuucucuaguuuguuuguuuguuuguuuagugaugcuugauuuauaagaauaacaggugcagccaaacuuugcaaccagugaguguuuuuugugccuugugagaugccauacaagggagagaugggaucuggagguuuuagagccauacauugucugagauucuaagaauagacacagagaccguccuuacaauccagaaauagggaggggacuucuggugcacgggacuuccuccuacccgugaccugcuuuuuuuccuuuaaacaauuuucaguggaguauguugacaagucauacuuugugaguguagacuggacauuuuacaaaggugcaagacucaucccuugucaucagucuggagaaucugaaguagacaagagcuuggcagauucaaccaacaacagacaggccagccugcagggaggagguaaguaaaugaaaggauauuaaaaagguuaggauugcauucuaauuggguaucuuugagcacauaacucugcuucucugggucuuaaacgccagcucauggcuucacauuagaucuugguugucuauggaaguaaauccaaucauucuucaauuuuuaucuuggcgaugauuuuaccaacagucacaaaguggguuuuggguuaucuugaugcugcaaagccugagcaaagcuguggaugucuuaacuuuguauauggcauuauaauuagucccuguccaaacccagcucagggagucaggaagaucaucgcaguugauaggaaaauggaacaggaggagaaucaucuguaccacacucaggaacccaaggcagaugcucaguaccauagugaugcuaggaguaggcucccagggcuaccuaccagcuuggacucaagagcuugacacauuugcugaagguaauuuuagccuugauaggcugcaggcuugucugcauuuacccucagccuuaguaaguagaguggacuauucagucgggauucagugcauuaaaacuagccuuaucuucaggcaaacaaaauaccuucugauuuuuaccaaauacaucauugaaaucuuccaaaaggcauugcucccuggccagugguugguugaguggaggucucauuaucaugagccuacaaacaaggcuuugaaaucauuaauaacuucccuguccaacuuaauuauagagacaagcacacuccaauauaugaguauuaaugcaccaaaauuccuucuguauaggacuuuguccaaagacuccauuuuaugcucugaaaugcaauauggaucauuuuaguauagugcaucaucccaagucacaguaacuccaaucccuuuuuaaaagagaacguuuccaugagugcauaaugcauggugauaugauaagaaaaaaguguguuuguguguuuauuauucauccaugagggcaguuucuucuuuacacguggucuauaguuauuuaaguuugagagacucagcuucauugacaaaguuaagucuuucaaaugaucaagaauguaggucccagagaguggggaugcaaagaagcuuuggaauucugcccuuagcuguagugggaacucgaggggugaaucuggugacauccacugcaaggauuggcccugaaggguaggcugggugauaauacagagagagaaagcauaagauguuguaguuuacaucuaugucacauggcuauagcugcacaggguacaccaggcaucucgugaagcaaaguguauugugggauauagguguuccaucugcuuuauuuaucaagacugauaaccuugauagaacaagcauaucauuaucaaguuaaugaucaucucucugcccuuuguccuguaccuguccauucuuauucuguacaugugcuugugcgggcucucucucucucucucucucucucucucucucucuauauauauauauauauauauauauauauauauaucacauacauaaauuuaucaagauagcuuauaauuuauaaagauuuaugaaucccugauagcucagccuaccuugugucuauuacaggaaauguauccaauuaucaguagucucucugccuguggaagaggacucugucaacuugucauguugcauauauaaauauagaacuguauauuuaaaacuugauagacacucugccaucacauucucucuuccucucccacaucucugcaggcccuaucuguuuuuagaaaugguuuugaggguugaccguauagaaauauuuagagauaaguuuagagaaugaagaagacucuaugauccuugacauauugauuguauguguaaauguccuuuuuuuaaaaaauauaaggaugaaauaauuaauuugcuuucaguugccuggauuuuuauagccuagggaagaaaggaugacugccaaucauucuccccaacacuacuaccauuucccuccaugccuccuccuuucucuucagagugagcaucucaagauguuaacuggcucuacuucugggagugacagugaaugacagauagucuugcacuucuugaucaaugacaagcuacuccacuuagccuacucucccacucagauaucaacacacucauagaagucuggauugagagauaaacacccauauguagacggauauccccauuuuagacaaagcaugucauuauggcuguguaauccccaguugauaauuccugggaagaucuucauuuucggcauacugcuuuuuuucucauccccuaugacccaaggugggaacagaaauguguaauuuggcacgaugacuuacuagaaagaacugcucauaguacuuugagcuuuugcaagguggcauuauuuaucaucagcucacucauucacaaacuguugaacucauacuccaugucugauaaguaucuuucagcuggucuuugaggaagacaagaguugaaugaucuuuguugcugcuuauggugugguaucucuuuaccuaucacauuauagagucuaguuuuuauguuggagccugugcaaggaaugacugggauuugaagaaauuagaaaaucacaaccagacggauaugagaaugcaugagguuaaguaaacaaaaacugagaaaguuuuaugauuucuguugagcgugaagugauuuauuguuuuauuagccauuuauuucaacuugaucauuaacaacauggcagacgguguguuaaauucuagcuuaccaaaaaugagcugacagauaagcccugccuugcuuucucagguuuaucaaacagaacugaaaguccugcagaguucacuggccuuggcuuuagacucuuugcuaagaacuaccuguucauucagcgaugagucacccaaguguccagguucuucaccuucaaaaugaguccauuggccuagauuuuuuuuccccuaagggcuccaaagaucuaagauauucugauaagggaugaaccuggcauucagagauuagcacagcauucacaauaggccuauucugcugggcggaagcugccucucaccuccagucuauucuggauggguaacuuucacucugaaaguugacccacagucuauaacaugaaagggaaccuuucacaagcuagagaaacucaagagucacgggccuuagccuaauuguaggacuuacggcauaauuuacuggcucuaccacagaaugcaauacagaacugcuuuccuccguucaaaauugguaagcaucucaagaaauaguacaauaguaaaugaagcauaggauacuucuaagagucuacagagucaccugccgugugauuaaaucugauguaaaauggaaagagcuuucaguuuuguaaguagauccaauaccaaguagcucucuaagaguguguuagugguuagugguauugcuauuacaguauccaucugcccauuucucucuaugagaguaaacagccccgagacacaguuauguaguccuaccgguguguauuuuccgagaacaguggcuaugccacacauuuggcagcaggagaauucuaguucuguuucccacagaaauuaguucuccccccacaaacacaugccccagggaaaaaggauucuuuaaaauccaucuuaaugaagccaaaguaacauuuaauaagauguucagggaaaccaggaugggcuaacugguagaggugucucuaaauagaacugggccuugcagccuaagaaggaagcucuuaagaaaaccaguucuuagaaaccacuuuuguaugauacaaccaucgcugucaguaguuggaaguucgggaacgacaaccagaggaggccuaagcgggucaaugagcagagauacggguguuuguuacucugcauuuauucugagugauauuugaaauaaaugguugucucauauagggccagguuauuacugugcacaucccacauggcaaagaaucugaagagggcacauggaaggaguuauaaauugcacacgugauggcuggacuuuugagcauuaggcgagccuccaaggaaagauugaugaaauguguucugacauuugagucuucaguugcuagauuucuucuagaaauguuggcagcuccuuuaacccagagacagcaguggugcaguuauuuucaauaacauggacucuccaggaaauuuuugaaauccauuuaaguagaagguaaauaaagauguuuauaggcaaagccuuuucuauggcuguguuguuguguauaugucuuccaaauccggaguugaaucaucuucucccuugccuuaccuaacacuuuuguucuuaggguauuuuuuguuuaucagcccuuccuauuguuaauuuuucuagaagcagauuauuguuuuuauuacuagaaguauguauauucuuugcauuuuucugaguaauuuugguacuuaauuuuuuuuguuggggguuguauaaauauguauauaugucugugugugugucugucuguauuuauguauuuaguucuuggguaccgucaccacauuucugcacccaacugagacuccauucuuccuuccuuucuuccuuucuuccuuucauauaaguacacuguagcugucuucaaacacuccagaagaaggcaucagaucucauuacggaugguugugagccaucaugugguugcugggguuugaacucaggaccuucggaagagcagucagugcucuuaaccucugagccaucucuccagccccgagacuccauucuuaaugaugcagccuaaaugaugaaggaguuuugaauggaaguagggaaaaugugucugcaugagaagcagacaguuggauggucccuggggagccuggcccgccuaguguuuuaccaagcaugucuucauagguaaucaccugagaccaugucuuaaaaggaagccaucugaggucugauuccuagcucacaggguauagagcaguggucaauuucaaucuacuuugggugaaaguaaaacuuucuaaacuauuugggauacagaggaaggaaagaaaaggagaggaagagaaaggaagagaaaguaguuaagucccacuucucagugauguagacaauaaguuaaaguuaccauggucauuguguuuggucauuuacuccaguaaggacacaauggucuugcaagggcuguuuccuugggcuuaguucagacucuggguauuucuugauuugaauaaauagcucaauggaaaacauguaaaauagcccuugcaagacgauaaaugaaaaauauuucuuguuguuuagucacagcuccuucaaacguaugcucauagccaugggaccguaugugcggauuccagaacuagaagagagguuagggcaccauuuuccugcaggcccugucagugcaagagaauauucuucacauacuucuacuucaucacuggugccaacucucccucuaaccacugauguauuuuguugguauugugcaccccauuuguuauccauuagggcuuucaacaauuguaugcugaggacuagacuaaguguuggaaucaggaaccgacuuuguagaucaccuuggaacccagugaugacggugaugucacccauaggcaacaggaacccuugcauuuguugccauggcaaucacuauacauucccagcauccauuuggcucaauucccaccuuuaccugugagugguugucacagccuaaauaaaaggcagacccucuugagccuugcucucucuuccucucucuuucccccguucgucuccauugcccccuuuuugcccgcacccacaauaaaucucucucacauagaacuucauuggccugguguggucuguccagacacaagccacgauuccaacacaacauuggugcuauuugggacaaaguacuguggaaauauugauguauaugucagacacuucuccuguucuugcccacccaccaagccagcugucgugugagaaaagucacagaacauaaguguggaugaaggggcaggacgcugucuucaugaaagggcuucaacagcauuccugugccaagcuuagacaugcuuaggguggcacugggauaaucuuaacgauagucuuaaccuaguguuuucuacuuaggagacuacaucucucuauugauggauucuuuuuucucugaccauggaaaucaugucaacacguugauaauuaaaaccuuuuagaguuaaaaugaaccaaauaaguacuuaagagauuuagugugucaagaaaaugagcugagaguuugagguagucuucacuugaaauacacuguuuugacucacauauagcacaaaauggauuuugaaaugguagaccacuauguagaacaaagagguucuuauuuuaccaaugcuuaauaaaacuuggguuguuuuauuucuuuccaaaugauacuuuucccuacaggugacugugguguagaaaauauauauugucuuccaugcucuucuccuuuaccuauuuuggcuacuagucauaguauuuuucucugaaguuaugauguaaccaaggaggacuucaggaggucaguaguguccucaaggcauaguaauuacuggcagcugcugauugccuuugugcuuuaggaaagauguagcauaaagguguaaauagauaauuuccuucuagguucuguucugcuaagcaauccaaagggauucccacucauuuagcauuguuccuguuggcuuuuauagcagccaaacauaaaaccccagagagcaccacucuggagggaagcugaugacaugugaaguaaaucucuuaauugcaucugaacucaauaucugaucggucaguuccuugugaauucuaauagugcuagaccagcccccacccccaaaaacagagugagcauuuaauaaauaguuaacuacaaaaacagaaauaguucacagaaucagagaaaggaauuuuuauucucaagucaggaaagacucaguuaauguuguauaaaucaaaucacaaauucuguucugcucaggucuagucuuuccccuccccuccccuccccuccccuccccuccccuccccuccccuccccuccccuccccucuccuccccucuccuuuucugcccuuccccuuucuucuccccucuccucucuuuuucugcccuuccccuuuccucuccccucuccuccccuucuucaaaagaaguuccaugucccuggcuguccuuagaugcaguaaguagccaggaauggccucaguuaccuuccugggucuguccuucuaccucccgagggccgagggccgccacacugguuuaugcagugcuggggauuuaaccugcauuacauccccagaugcacuuagcuauuuucuagaacuacugauugugauucgguggauagaaagucucacuggaacuucuguucucaacauguuccaagaugauguaguuccuccuggacaggcaagguuggagccagaauccaccucuccucauucuuaguguuguaguucuuuuuaguacaaauagaugauacauauaugccacccgauuuuccugaaagugacacuuauugauggaugaacucaggucccugagccaggauagagcauuugggugauucuaaaugccuuguuucaugcaguuucuauggacugaguugagcuuuauucuagaucauacccagagcuuggggugggagaaaucuuccuuauaauuccuguugcuuacaucacugagggcccugaggagguagcucaguguuuaaaccacuugcugugcaaauguaaggaucugaguucuaguguccagaacccacuuccagacagacacagcuaaaugucuaauaaccucagaggugcacauacaugcacuguuaaaccugagaaucccaagagaaaggccagugccacaauuuuugagccaauuuuaaagcaagcuuuaauuaaauacuggccaggaugauggacucuggccaggacuauucuuggguucccaggaaaggucaaggagucaaaguuugcagaggcuucaaaaggcaaacaaggccuacguauuugccaucuaauccaaucaggggcaagcauaggccaccauauuauagcaucauaggacaaaugagaauuuauucucaacugucuuaacugcaaacugaacuuguaaccuacaagguauuuuuuuuuuccuguuuuggucucccaauaaauuacaaguuguauuguucuuguuccacuuuuagucucacagcacaucauagacacagacacagacacagacacacacacacacacacacacagagucagacagagagacaccuuuuaaagucaaucucucuuugucuugggaaucaaucaggugcuucuuucucucaccauuuucuuucugcuccuugccgagcccccgagucccucuguucucuuuuucuuacaggucuugagucagaaucuugccagguagaagaggguugguucauugucuuucauuccccccucucuugcagcaucucugagauaaacugccucuugaggcuuauugagaccucuuuugugugauaaauccagugaggacacugcaaaaaaaguagacucuggcuaaauugaccagacaccuuugaagaacuccauagucuauaguauggacaagacaaugaagaccaggcuggaccugcuaccaaaaucuuucuuaagaaccuccagagccaggcagugguggagaacaccuuuaaucccagcacuugggaggcagggucagggggaggggcagaggggcagaggggcagaggcaggaggcaggaggcaggaggaggcaggaggcagagaccgguggauuucugaguucgaagccagcaugguuuacagagugcguuccaggauagccaaggcuauacagagaaacccugucucgaaaaaccaaaaccaaacccaaaccaaaccaaaccaaaccaaaacaaaacaaaaaaccccaaaacaaccuccagauacaguggaugcuagcuugucuauuauccuuggaaaugccauaccaucuugguaaaaguacuauuucucaucuauugcuaacugagcaagaggaagagaaaugguuuacucacaucuuacagagagauagagaccauuccauucuuagagacucuuucuguacugaauucugcugcaguagggaauuugaauggugcuaggcaucucagucaaugacagacaucccuccaccguaaugcuuguagucauuucucuagaaacagcaugauuuuccucuggauuccuuguaguucuaacuucugauuacuucuuacugcggaguuaacugcuugagaacagauauuuuguagauuaaguugcccagcgugucuuuugaccuggggagauagaaguaauugucaccuucuaguggauggauuggucccuccuuggucuuugggaagaggacuucugggacuucagggaguugcaagcaggagaacuaggaaauguuugguucaaguacccuaugaacaauacuagucuuucuuaaaugcaucuaaugcaaaaaggacugugucaucuuguggcaagucucauuggcauguaaauauuuucacuccuuacaggcauuuaagugaaaccuucaaaauuacaauauuuugaaccugaaguaaagaagagggaaggaggaauggggggugggauagagagagaaugagaaugaauauaauauaaagcuaaacaagccauccuuugcacaguuuggauccuucuguuaugaauggucuuuagacaaaugagaaacacuuucuccuauuuggagauaugcaaauguuaaagccaaggguaaucguugugucuguaugcuccccuuucucuuucucuguuuuccucuucgccugcacccuauaggaaugugaucacagcauagaaguauauucagcauuuguguaaauaauacccaagcugcuuggagcaaaggcuucuugcauugcguccaggguuuggcaauggcauuuucugccugaagucuacauuugguuuagauaaagauuaaauauagcccuuuauuccuguggacaucagaguuugcucagcacccuuacagcuguuccuucaucugaucuucacucuaagcccaugaaguuggcagaauagauguuauuauucucauuuggccauugcuuacaagaaagcauccagauuagagguuucuggguaaugcucauaaugauguccuccaguaaaauugcugcugcucugucaaguaugugaacugguugcuguuuucucccuuuuggucaacaacaggguuccccuuuaugugucucuucaggucugucuucagagaguccccauaagacuuaauaaggagcucuguaaggugcacuacgcugcucugauaaaaggagcgccugcugguguuuauuaccuguguccuuguuguuaaugaagccgggcagaggagcugcaggugcggcuuugccugaagccucuauuagucaucacucagaggaaaugcgugcccaccaggcuguuccuuuccuagcaguaauugcauuuuuaaagcggagaaaagacagcaagcauuaccuuuucgaauggaaaugcuggaggauggccugagauggugugcuuuaccgaagcccagucuuguuuuaaaguuucucuagagcuuguugugggcuugggauugucaguguugaggagcggguggauaugcucaguuagugcaagcgcaagcuggcaggacccaggcucgccccgaaggagccccgcuuuauuuggaaaaugcuguuuucauaggaaugcguguguuuuccucucaacuuuggucaccccugagaugguaugcauaccacuucccaaggcguuuggaaagagaaaccaccaagaggccaugcaacauauugauugcaugaaggcuugcuguaaaacacuuagcagcagcaaguaauaaauagcaauaacuuugguccaggccuucuuucuuccaggugacuuugcauaacaauuaucugugguacuuucuauauuaaaagacaauuuugccuacucuuaguacauaagacaggggaagaacacuggagaccagaaacgagggguguguuauuaacuagugagugguucugcugcuguaauuucaugagugaugcugauaaaaaccaaaaaugugauuucccaucaucucugcuucuuuuuuauuggagcuuuccuuuucacccucauguuaucaacuguuaagauuauaggugaucugugucuuauuaauuuaaagcaaucagagccaggggugugguuuucagcacucaggaggccacucagugaguucuagggcuaugcgugcuauaauugugagaugccgucaacaaacauugccugcggaaaaacucagugauaaagauaguagcugugcaagccagacagccugaacagcccuacaagacaacgguggaaagagaagaccaaguuugggagggcuaaguuuaaucucuagaauccacuugacaggagaaaggagcgaccucuacaaaguuguccucugaccuccacgugccggauguaggaugccugucccuccccaaucaugagugaggacaccccccauuguuauaaauuuaauuuaacaaaaaaaaauuaaaaaauagaaagaugagaaacuauguucauaugagugcugucuuaauaagcuuaacaaggagcuauauuacucaaccuacuaguaacugcuccgcuuaauauuauuugaaacuugaauuggggagagguauuaaauaauuagcucuaaaauagucaggugucuuaauuuucaccaaaaggaaaaacguuaguauuuuaugaaguaauuaguauuuuauaaagaauguaaauucuugguucuccacaguggaauuaagaaaugcacacccccaccccaaccccgaggaauuuuagauaguucuuuuagggaaaaggucuguggacauuguuuucaugcucugcucugaccacaugccuaccccaucauguugcugauuguucccguaugacuuaaaucaggcaucugcacuuucugaggaugcugucuguuaccuguggucccccaacuccagacccugugaaucugguuccuguggugacggcuuguagcuggcaacucaacugggugucuuggcugguucccauguagcauccacuccaguggagaauguggcuucuuuacaacauggcugcuaggucagauuccuaaggagugaaagcagacauaccaagccucuuaaaggcuccauuccacacagacagggugcuuccugccugucagagcuaguccugccacuggcugagggggagaaaagcuagacuucacuucggaaagaagcaacacagcauguacucugggaaggaaacucucgcuggagaccaucuugaagaucaguauauccauuucaccuauuuagugugggcauucugugacauuggucuguauugacaaguggcuauagucccuggagcucccuuaggaaaggacccaugguacuccuggcacccuuuggguuuaggcugaaagcuuauuucuguugaaagaaccugcugugaaauuuuaugaaguuaaguccuacaaaguagcaucacugagaaguauaaaaugccaauuucacagccccugcaguggcgccuuuguuacagcaccuuaugcuguccguacuguccuacgaggcuuuggaguucugaaagaagcuaguuagcagauaggaugcugacucagggucuuagcuagcuagcauagugcucaauacauugccauuuuaugggcccugccuguuacuaacuccuaacccccaacauuccuggcggagcuguggccauggguuuauuucuggaaccuaguacaugaaacuccugagauggucaguaaguguugucaucuaaugacagagagggauggaugagugaaugacagaggcggaaauguaguuucugugcaggcuacuccauuuuguguuccuaaggcagcaugccauagccuaugcaucuauccgaaauaaaacuuuauuuggcucaugguuuuagaagcccaaucuccaagggcaacagccgccuuuuuuugucagugccauuuaugggagaaggcaucuaucuuauggcaagauggagacaaguuggaacucaagagucuccaguucucuuguaaucaguguaaauccauuuaugaagcuggggccuaauaagcuaaauaugaggcucggacucuucacacuguuguaccaggcauuaaguuuguggcacacaugauuuuguuuuuccuuuuuuggugggaucacagucaaaccauagcaaaugugugugggguagaaugucuuacugcuuguccagguucuuccuucauccccaggucucguuagaguccauccaaccaaggagggaagauguugaaauuaaauuauuugauaaaagcuggcuuugcacuuuuaugguuuauauucccaaaugaaauacacacacacacacacacacacacacacacacacacacacacacacccuuuacauuuugauaugccuuaaacaguuggaccacuuccuaaccuccuccugaguuauuacuuacuaaauucucuauccuaccuuggcugcccuggacccaguugggcagcccucuggccggagcucuccugacuccuucacuugguggcugugccucugugcccugcacucuucugagccauggagucucucuugcccuccauacucucuugccaguggucaggcuucuccucuccuuuccucuccugguccccaacucaggaaaccuccugccucugucugugcuucccaacuauuggcuauuggcaacuucauuuaccaaucagaaccaacuggggacagguuuccagaagcuaagggcagacucuccugcaaacauuuuuuuggggguggggguggagggugggcagggauguaauuagcauuagaauccaagcagcuacaggaagaggcaccaguauuaacuuccacaccagacauugcaagcaugcuaauuauccugucucaucacgugucaaagcuaccccauuaucucagucagaugagaaccagaccagaaauuuuuggugagaauuuuuugaaauuauaauacccaaaacucacuuguaagaccaaccuggccaaggagcaggugacuuccuggaaugcuaaguguuguaguucuuggaaaauaacacagccuuauaggaaaauaggguggcuugugacuuuuuguccauaaaagaccugcaacauguccauuggaauaaccaaagcccaucucuugguuaguauuuacuaguuaauauacuuugcuucaaauuuggccuaaagugaugcaguugguuuauccuccugcaaaucuuaggauuaacaaaauuaucugaacaauagaaauauucaagaagcagcagcaaguuuuagauucucugaguauuggaauaaggaugaaaaaggcugaagaaagaaagcuaauaaguaaaagagccuugugugugguagcgcaugaaacuguauuuuuuuucuuucuuauugguaugauuaugaauauugcuguuuugguuaugcucagagagagggaauagauuuugauaggccucuugaauuauuuguguuccuucuuauccauuauauuuucaaguagcuuuucuuuaguagugguauuaaauuuuaaacagaauaugaggacuuugguaaagugcucaucuccagcuugaguuccccgucauuuuaaacuucuuuccaccucaugcugauauuuuuuaugcauauauugucacuuccaaaacucaauggcagagcaaggacaagucuccauacugaagaguauacaucucuugaagauggagaggccucuauaggcuccuugaguaaugaguacaacucucucucucucucucuguguguguguguguguguguguguguguguguguguguguguguguguucguuccauggacacucguguccaguagacugauguuagaauuacacugaccuaaaagcguacucuggauuuuaaugcucccccaacaaggggaggggaaacauuugcagcauggaauuaacagucuccucagcacccaggugccagugaaaagaauauucucacguacccgaucacacucaaucacacagaaggauaauagccuuguuaacaugggcaaccuuacugcccuuuugugucuaaauaacguguguauauggagauacggcaucauucaguuccuacagaauaacagcuucucaaugaggaaaaaaugaauugcccaaaccuaacauuuucuaucaaagaaauccucaaaauacaaugguuuccugcuccuaaaacucuaggaaucuggauuuaacacaacagcagcaucuuuguuuuacaguuugaacacucagccuaaaccaaaugcuuuagacuuucucucuuacagugcuucauauauuauuucuuuaauugauugcacaaauguauuugauacugcuauauuuuauaagaauuaaaaggaaaauagucuaaauuuuuaucacuggggaauugaaaacacguuagugcaucugaaggguaaaauacuagguacauguuggaaagaguggggauauauuuaaaugccugccugaauguuuaggcuguacaaaaguauucaucauauggggugaguaggcacucaaacauuaucuguagaaugauucaauucaaauaucagccaaaaaaggagaacuaaacuccuuuccaaacuuuggccuuuggaguacuagggaucaaacugcugguauugcaugugccaagcaggaacuuuuuaacugaggaaccccccucuccuaagcugaagggugaugaugaagaacggcuaguaauaaagcaguguaaggaaaccguguugaaguagucugaauuccucagcagaagacuccuuuauguguccauuaacuucgaaaaagaaucauauauaguucaagauaaagcaaucauuuacacauacucugcagaccccacuucugaaagauaaauaucgguuuguguguccuuacguagcaaguccagcccaacucugauguuguguugauauggaaacacaccagcauuauagcuugcuggccaagguucaagucaugacuuaggcaaauugcuucaucuuuccugucauugguuuuguuuaaccccggagcccuaaauuucucacugggaaaaaaugaagugaguuauacauucuuccaauauuguuguaaugagcaaaugagauaauggccguggaauuauugugugaacuguaauguacucagccuccauuauuauggaauguuguuggagccacuccaagaaguuaccguucccacugagugguucccucccagagcuaaggaagagcagugggccaccagauucugucuuuacugaagguaacaugaauggcaugaaucauggauuaauuagccagggaagaggccagaagcaccuugacagucucuggaaaagguguugagugaaagaagucuucgauuuugauuuuauauuugacaaguagccacaacaaaagaauccuccauagcauguagaaggagaguuugucuuauugucucuaaaauaauaaaagacuauaaaggagggaccugggaaggcagagagagauaaauagcuggggugguuguagauaaaggucaagaagacagaaugaaauaaaucccuaacuucccaucaugcaucaggcccccaggauuagagguaagcccaagcugcaguuucuagaacauucucugcauucugugaggcuugauguuaacuuccgguaauggcucaggcaagcaagguaggaauucuaggauccuuagacagguuggaguucuuuugggcugccuuggugccuuuuagcaagugcuuaguguuaugucaacaauuuuuccaaccccccaguuggucuuaguucugugauguccuguaauuauccaggauccaucuuguaacuuuuacuuggugcccaguauuggagagauaggugcugauuuuccuggcauuuccaaaauucugggcgugcauuuuucuuccaguuggucuugacuugacuugacuaaauuuccaagccuucugguguucauguugcauaaucguguaugacucaucugaggguucgaagccagucuagcaaagcaaaccccauccucccuggcugcuccccacaagcaucugcagccaggcagcccuagaguguugcguaaaccagaaggcaggacagcuuggcccuaacguacaaggcgugcauccuagccccgagugguucucccuuagccaucagcuggugcucugugaagcagaccccugaaguuacucucuccagaucccuuucagcuaugaagacauuguuuuaaauuaaaugagaacuuguaauacuuaagucagggaaggaaggaauaaagucaaaagggaguguuuaugugucccucccauagguccuugaacuuagagcuuugaagaagaaauuucaggaauaaaaacuugaugggaccauacuuagugguuacagaauauggcccccuuaagguuuuugaguagcauaauaguuuacuaggcugagcuguagagccacgcauuuguagacaggggaugucaguuuugaacagucucccucccucccucccucccucccucccucccucccucccucccucccucccuccauagcagcaugguuccacuguuggccauuaagugcaccucuucccacaccuugucuuaaauagccuuuguuucuucuugaauugauagucaacccaccccugguuuguuuguuuguuuguuuguuuguuuguuuuauucuuucuuuaacuugucuuucuacuccuuuuuuucuuauuuuucauuucucccaagguaucuuaauccgaaaaaugacaccauagcugacuuaauccauucaaaccuuaucuuuuguuacaagccuugcuuuagcaauuguuuacagccaagcucuuguuugugauagaguuaaaaacuccaaagcuccaagcaguuuaucuaggcagucucacuauguagcuuagcugaucuggaacucauauguagaccaguuggcuuggaacuugugccacuuucccugccucagccuccagaguggauuacagacacaagucacagaccugucuugucucuugguucuugguuugcuguauguuagacagggcagcucuguagucucaauagcuuugauggcugggguagacuuuugucccuucuuguacuuugcaauagcuaagcuuaauuacuccucgaugcagacucuguaccgaccguuuagacugacggaugcuccugcuuagguuuccuuggcuggagccaucacuguuuagucuguagucuucagaugaucaguggagcgagcucguucucuagcuguccagaggauacgagaggcaucuuacuauggggaaggcugauuuguggcccucuuaucugagaucuuuugugucauuaguuuaauuauacagaugggggaauuuaauaccgaaauuacuuaauaauaauuucaaagaauugcugugagccaugcccuggccuaagaagcaugugcuuccaguaugaccaguuccccagucacacacauuuagagcaaagguugucaaacuuuuguagacuguggugauguccagugacccucagccagagaggagccuggcaccagccaccagucuuggguggcuugucucugguucaucuggcaucugcaaucacugugggcuggcauccuuuagauuucggccuuagaggcuucuguguucuaugccauguccuagcaguacccaacggcagagucauuucucagacacucaaacaauacuaguuggcuauauugauuuuuuucuaguccagguucucauggacacugccaugauuaucuagaaagaauccucaagguagugccaaaacccuugcccauuuucacuuuuuaagccuuugugaauuuaucugaauaauggggccauugacucguaggccagguuauuguagcauuuaaacuguauagccuaggaaacagaggcaggcccacacauaacugguucucagguugauuucccuuuccccauugacaccucuucccgcucuacaucagaucacccggaugucaccuuugcucucacaguccuuccgugcugaccuuucccagggcuaggaaagcggacaggaugugcuucccauacuccuaggguuucauggggcauuuucuggugugaacgugcagugacugcauccuauaucaaccugacuaucuuaccuagagcucugcacaggaaguagaguccugccaguagacaaaugugucaccuuaucuaugaguaggcugacugggggacagugcucuugcucugauuuaccuuucuucuaguucagacucugucuuccuuagcagaccaccuuggccuucccugccuucacguaugugaucuaucuggagcugugaaccgaugacuccuaucgaauaucuguugaaacauuuugucuuauauuaaggcacaggcagcccuuauaagaaacagaaauguucaguguaugcuaggcucauaucauggccaucuuuacagauuaauuuguaaaauucucuccuccagaauuacuaaagagguuuuugaacacugaaucaugaccgauagauagcaaauacauauugcauccuacuaaggaguuguucuuuuugaacuguuguuguuguuguuguuguuguuguuuucaagacagaauuucucuguguagcccuggcucuccuggaaaucgcuuuguagaccaggguggucaggaacucagagaucagccugacuccugaguacugggauuaagaacaaugugccagcacugccuggcucuuuucaaauuauuaaaaaguaagacuuggaaagaagguuuuuguuuuguuuuauguacaagucacaagagcaguuguaugacugugaacaacuaacguuccauugauuuagcuuuagcaaauaauuuucuguuugcaauaugacugggacacuuuggagaacucuauccaccacccagcuuccccuaaagucaacuuacugaacaagagauguucccagauaaaccacugacuuuggguucugcccucccccaaccguuaccuccuuacccacccccaaauuccucaacccuccacccccuaaauccuuccguuaauuuacucauacuacuaauaauuacuugaugcucuguucuguccuuauaguacaaccuucauaucauggcuagguguuguuugcuuguuuguuuguuuacuuuccauuucauuaaaugaaaaauucaggacaugcuguacuaaauggcuagagguucucuaucacaaauucaagaggagucagauaguguguuaaaacucuuaaaaccuucaaaauuuuuccaucacacuugaacugaaccccauucaucuucaaaaacccccuagagacuggucucagucuccucagcucacaccuuauccccuaccccuuuucuguucauuuguuuuuccuggccacacuggccuuucuucugcuugcaguccaggcacaugccuaacuccugcgucgggguuauugcucuuaccuuucuuucuacuguuaaacccaaggucacuggagaaaaaccaaucccacaauuuugagccaaauguaaaacaaacuuuauugaauacuaaauacugaccaagagauggacuuuggucaggaccauuuccgggaguuucccuuuuuaaaaaaauucugguuaacuugaacaguguaaggaacagauagcaggaaaaaagguaaaugcuucaaagguauuuaagugaaugucaucucugucaucagcccuuugguaugucuguuucauugagaaaucuguccucuuccccuuaaggauauuccggcaggacaccuuuuccccaaacaguuggaguugaauuagauuucuuaaaggauaauaaaaugucacaguuuaaacaguucuuuuacuuuugacagcucuaucauuaguccauugucauaggaguggcaauugaggggcuguugaaagggccuuaacuagcagaucaaaagcccggaagugcuaaaagacacugaaggacauggaugcccuggcuggagccagcacagggccuucuuuccuuaggauuuucaggcccuggagacacugcauuguuagagcuggauggcccuguuuuauguaagaguuggguuggcuuucuuuuuuauggaguuuacuuagccuacccauuuagcaugauuuacagaggcugauguagauaaaccgguagacuuaccuaggaaaggacaaguggccuaaauugcaggaagucauugagaaauucgacuagucaggccauuccgacuacaguggaauuaggaaacuagcuguuucauuuacagcuaauuaaagaucagucaagauuacuucuggccuggcuaucuguguaaucccguuaguccauuuuacagaugagagcucaacacuggaauugggagaccucggguuuguguccccggguggucugccagggucuuagccucauuugacuuagugacuccuaggacagacaaguaaauuguauaaagacuuguuuggguuuuucugguuucauuuuguuuuaucuuuguuaaaaaggucagaacacucagacuacuucagagucccuuguuggaaggacugguauagguuacgaagacuguucaucaucuucaacacccuagcuguuuagagccugggagacagaaaacgauuuccgaauucuuguguacaaguaacucuaagaugccauugccugauccugcuaacuuguaagagacuaauuuguaguagauaugaaauagucuuaauuuucacuuauuuuuuuguaaauucaguuuuggaaaauagcucuguggaguucucccuaacucuacauucuuguuagcauuucuuuauugaaaaacgccccucccccaagcaggcaguuaggcuccuauguuccuaugacaaagagcuguugcccagguuaaucagaaacuugaauguuugacuuaaauaguggagaaauuaauucuuuaaaguuuagaugguauuugagguaauacauugcccuucaguguuauaaauaaggaaguguaaguacuuaaccuucuuccaaagccaugcuuagagccgcccuuauuaaguaaauugaaaaguuaaaguguaaaagaaaagcgaaaacaaacgaacaaacaaacaaacagggggcagguguguuuuauacacauauaaaaccugaacuuuuuaacaagcugaucaccaaacuuuuuaugaguugcuuuaaaaaaugagcuccuccugaugucagauaaauucuucuaaggugauuuguuuuuaaaauguggcuuuaauaaggaagaccuagaauggguuuccccaauuucuaaguguuuugugacagugaacuucccagcauagcucauggguuaguacacaguauagcaucacuugugguuacuaaaaauggcagacggagagcuuauuuuucauucagaacaucucauuuuuccaguguuaauaauuaauugagcuuuucaguuuucaagugucacagcuguaagugccgguaugcucagcucugagcauaggagugcagaauguucaacuaaugauguuuccacccacugucaaugcaaaaacacagcucuuaccucagaggaagaaaaagacgguuuauucuggagccaggcuugagugacccuagccaaggaacacagacucaguauacccuaaaucccauguucagugugguagcagcuuccuagagguuuuacagugaccaaagaaagccaggaaucaagacuccuuuaaaguaccucuauggagaccacagguaggaagguuagaccaaagcugggaagucucagguguaggcgcccaugcuaucugacaacauucuuaggcuuuuguuugggggaaaauaggguucugcuaguguacucccacauauuuuaccugauaguuacagaaguguuaggucagacacagaggcgaggacggacuggcuuuuaaugggacuaaagauagugcaagguacauuuuuguuaggcuauggacguuuaauauuccaaacucacagucauuaaaguucuaauuaguuacuuugccuugcaacagguuuagugucugguguaguucuuaccaggggcuuuccuuuguauuaccaauaucaaaagcccucauauaagaacaagaaacccauacugcaguagguccuccuccugacacaguuugugucccucggccauguguacagggcucuggugcugggugucuaaagcaacccuggugcaguggucaaaagaucaggaaaacuaggagcgagaguagaaaaguaaagaaugaugagggcaaauugcuguacucauggaugcacaacaugcauuauuuaguaaaauguugacaacuaacucacuugccuguugggcaauagcuugguuauaguaauauuuacuuugcuggggcagccuugcugccaggucugagauuggcuugggauaaggaaagaaggaaaggggaauuucuugggugauagagucucuucagcagagaacuagaucuauuugcagauugacauauacaaucaggcacaucuaggcuguuuuuguaucugguggugaaagagaugcguaaacacaagcuaccuccuuuucuuuauuuuuuuauuugcuucugugcucagaaauguuuugugacucuccauguuuuggauuaguaaagcuguguaagauggggcuugggagugaguaaaaucuuuaugacacacugguccucgucugcugucucagguggcgugccaccacuguucuccuuaaaauuagauguaagccagaugcucuucuuuccuaaugagacaaguauuuuucuuguaagaucuuuuucacccauuaauuuuucagaugcguagggccuaugucaguauuugguuuugauacauaccaguugugugugaaguuagacacacaaaauaugaauauuucaugcuccaaggaauuuuuuuaccucagauauuagcagaguuaacacaugcucugggguuaugaggucuucccgagaugucauauuggaggguaacacauuccuggaaugauugauagauuuaaacuagugacaacucagauugauugguuauggcuucuugguuuuccauauuagaaggcuuuugaguguuccugacuucaacagcuaugagaucuauugcuaaugucugccauggauaucacucuugacuuuucuuauuucauuaugacuccuuguauacacacucuauccacgugaaacuaguugagcacagagagugcauacaccugucauuacacaacuucugaaacgguguuccaagaauuauaucaagaagcaaauuaauagccaggcaugucacucaugaucauugcacuggggaagugguuguugaaaauguaggaguucaaggucagucuaggcuagagacagaggggacaaaguaaacauuuuaaaaucacuuguuaaauuccuacugugugcuucagccucugggaggaacaacuaugccaugguacguggaauuguuuggaaagacacacuaaacggugccauauugggauugguuuuauguagcaaauggagcuucuauaaacuacguuuagucuuuauuuauuuauuuacuuauucacuuuacaucccucucacugcccccauccuggucagcccauguccucauaacuacgcuuuuuuucuaaagagugggaggacauggccuauuggaagcgguuggcuguaauuagaagauaaacgacaaaaagguaauaagggcguggggaugaugagcccacuggcccaccauggcucucuucuucuugcuacaguguucuagaugaaagcuccuuuaggaggucagaaacuggcuaucaaucaccuucuuuuuauucagcaguuuacugagcugcuugccggguguugggcaccauaucaagauggcagggcuuggcuguugagucugaccagauguucuguaaguuccuuucuuauucuauuccgaaaauguuuguuuagacuucuugauugacuugaucccaaggacauccaaaagucacuuugugggaggagcggggcacccccuuuugggaaucacuggagcuacagagagcaaauguggaggugauuuauuuagcucugcuucaagcucuggcucguagcaugcacucauccgaucucuguaacaguuuagaaauggugccuauuuuaguuuccgucuauacucauuccacacacaaaggaacugaagucaaacaggcuuaagugacuuucuuaccuucauccauuuccccuuaaaauauaacguagccaccugcuuuuaccaccauuccuugcugcauguuugccggcuuaaaaauaaauugaacaaggagagcguaggcaccagguuuguugcuuuuucuucucuuuuccuuuuuagaagggcucugauuccagauaauugcaguccuggaaauagaacagaaucuaguacuugagaaggcucggguuccccuuccaagcuguuccuugcagggcccuuaauuccaguacguuagcaagagcagggaaucuugccugcuuaaaaauaaagcaaaucugaagaagagauagacaccagcguugcugcucgguuugcucuuucuccguguguguguguguguguguguguguguguguguguuuucuguucuuuguuuugugucuauuugguuucuuuggauuuuauuuauuuaugcuuuuuuuuuuaaaaaugcucugucuacauguauaccugcauaccaaaagaaggcagcagaucacaucauagaugcuugugagccaccauguaguuucuggaacugaacucaagaccucuagaagaaaagccagugcuuuuaaccacugagccaucucucuagcuccguuuguuuuguuuuuuuuuuuaacagggaauuucuguguagccuuggcuguccuaaaacucauuguguagaccaggcuagccuuaaaccaccugucucugccucccaagugcuaggauuaaaggugugggcuaucacacccagcucucauuuucauuuuaggagaacucuggauuccagauaauugaauuccuggaaguaggacagaauccaguacauaaaaugucuccggcuuaguccccuuaauuauuccaacguguuagugagaacaggagauccugaagagacaccaagcgauaacucagcuucccuguguucuaguucaugaacagauuuuuaaggcuacugguccccgugacuaacagauguuauuuuccauacuauuggaauugggacauacgaaugaacucaaagagaacuauaucugagaaugugacucuuccuaacauccaucauuagaauagcaguuguagugugauguuuugggauuuggaccugcccuguuauuuccaguuucuucucacacccuggacaacccaggaaacucugacacacugggucccagccuguucauagauuccugauuagaauuugauauuuugauaaagcuugucugucaacuugcuguaagacuuaauuuuuccagacaaucaagagucugacuaaaaauggaggaaccgggguucagcuauaggucacuggaaauggaaacggauuuuuucauacugucugacugcuuucaggaaugcuauuuuugauucauguuuaguugaaucaaugauaaaucaucaaauuuuuaugagucaguccuaacucaguagugaucuuacacauuggaaacauaaaaugcucuaacauauuaauauaauaagcacaguuucaaaacagagcauuuucuauucucuagucacuuguucacugggcaguugugguacagcagggaaagauacauugaaaauguccuuacaauccaugcacggagcuaacuugcuguuaaaaugcagucugcuagucaggguggcacaugucuuuaaucccagcacuugagaggcagagacaagcuucugcguuucagaccagucugggauacagagugagacccuaucucagagcaacaaacagagagucaaaucauauugucuucuuuuuuucuugccuuagcaucuugaauaguguuugggcuuuccguugacaguuucuuauucugccucuccuugguuugagcacucaaacauugcagaacauaaauaaauagaaauaaauaaauacauaaauaaauacucucaaguaggugaguucccaaaggacagcuuuacauggucucuuugccucuuuugugcugcugggcacagauuuagacaaacucauugcugccugcauauuaagagcuuaauaaauacagaugggaggaaugcaugauuuaugacaguguugccuguuuagcuuggugauaaugcucacagauccuaggacuauguuucuuguggaguaaaaauaaauaaacuccucuuuguaaguuagagaguugaugggaaaaaccaaggaacgccuacagacuuuuuuuuaaaaaaggaauuuccugugcucagauaguugaguucauuugcaaugucucuuguccugacugacaaugcugaaggauaaguguaugauaucaaaagccugagcagcuccaggguugcuacagagaggagaggggaauggguugaaagaaaauccgcaccguccugcuucagugucaucucuccucuuuguacaggguggcugaaggcuaccuuaggucucuauacuguuugccugguagguuuguuacuguuuuccuggccugaccuggugaugcuggugagcagccaaguguucuggaaguccacacucugguuuugcgaaggagguccuugguaaauaaauggggcucucacccuguagagugcauuucuugccgaccagaauugaagcuuugccugugcuuuugaccagugcuggcugcuuucuauaagggcagggucugugcacagagucacacaaaugcacuucucaguaggaauuguagaauucggcuuguagaggaaaggacugucgaguuggcuagaccuacgcuugaccccgcucccuacaugggcugauaacuaaaagaaaagaaugucaaaugcuuaagaaacagugggcaccgacagaaagguugccagggcuuugucgauaaccagcucuccuuuucuucuucugcccuuuuccuccucgggcucagcuagccacuaaaugaguaaauugcuagcgggaaugauccucaccaggcuugugaaaccaggggccuagguaggcagcagauugccagauggagugugggucucuccugccccaggacaugaguugccucagcuuaguagcuguguguuggccaaaugugcugguuuuucuccaugugucaguguugggagggauugcaaggcagaguagaucccaaccccagaauugaacuugaggucaccaacauccucuaacagaggauguaaaugguaauuuuagguccuguaucucuguccauucuuaguuaugaauuggaaugaguuuauugagccaccuagcccagguggucuccuccagacaguaauccuacuacuaaaguguuugaacuugcuuuuauacaacagugugaagagcuuccuuguuccagcuguccaugugaaaagugcauagccuguauaaauaucauagaccuucacggagaggcauuccugucucccucagccuagggaccuuugcuuaggccacaugucaugucuguccaucucucugucuccugccaggucuuuccuccucuucuuccuccuguuccuccuuguccccauggaacacaaugcacacacgaacacuuaggcuuacccuacuaggauccaugauccuggaagccauccccuaauauccagugaguaccuuccaauggccucgcugcuuccauuuugcacuggcugaacugaaccucauugacugcucauugaacucuacguuggcuagagaucagcaccucugaaauaaacaaaaguaugucuggacauggaauucuccaucuucaaauugccacguggaaagugauaguuuuuuccuuaaauguauacuuuccugacuccucaguuccaaagguggcaucaucaaaacaaacaaaccaaccaaccaaccaaccaaccaaccacaacccucugacagcagauaaacuuugauuucccuugaauuucauucaucucucugcuucuugcaaacacaggccugguguaccuuggagguaugaucugcagccuccucuguucguuguguaggauucguugacuuauggagcauuugaacacaagcucccuguguugcccaguaggaacccacuugauccuuuccaaagccacucuuguggagcuugugauguucaaugaacacguuaacaagcugucacugugacuuugucaccaggcaaaucucagagcaucuccaggcucauuuugccuaauuauuuauacauacagauuucagucccucuuacugggcuuagucagaccugugcagguuaucaaguauggcaagauaugucaugaaugcuuugccauuaaaacuggucacuucugucuuggggucccgcuaaucuuaaagugaauagcagaaaauuuuauuuauuuauuuuuuaagcuuuggaaguuacaaaauuuguuccuugaaacaacuuaccuuugaauguuugccagugugaaccuaacaccuagcccugucaguuuaaaaugugugugccuguauuugaacagagaauguaaauuuaauccuaguaggugccuauucugaaaaccaucuucucuccaguguaaaugugcacuuaucagaacagaacaaauguauucaaaaacaggagaguaaauggccuuuuugauucagauugccucuacacucucccccuccccucccccaucauagugaaagcuuuauuaucaaucccuucauuuucuuccagcuuuagauuuggagggcagaacaggaaaacauuugggggccaguuguuuugaaucaaaacaaaucaagaacuggcaaaaaacagucguuuccuggcucucugcugaucugauuggugucauuuccccagcucaggagagcuguguuugcucaucuuucguuugcuucugcagauugguguuagugggugauguaaaaacccucuaacguauuaaauggcagugagguaacacagaacuggagccccugacugccuggccuuguuuuagggauuuccccuucacauacaucucugcuugacaaggacagacaggguguuuuucgguggcuuccuaggcuggcauaggaagugucugguggcccacuuccugugucacauuguucacacauuugacaaaacccagaaaaaaaaggcagcggcaagggaaguuaggcuucacuuugccaugaaggcauaauuacauaagaguggcaucuaaaagugccagacauggucuuggagcaaccacaauucugaucagugggcugaauuucugagaauaccacuacccguggcuuugaagucccuaacucugucuaaccacucaguuugcaagauuggaacaagaaaaguggugaguuugcaaaccuuagucacaggacaauauuugggacagugugccugggaucucucagaggcacaggcacauuccuucauuccccaccccaacauggagccguuuuauggagcuacaucuugccucagcuucucucagcuucugaguggguacaguuccagaugugugcccccaugcccugcucugugucuucugacaugaaggucaucagacagagucucugguuggggcauaaaggccugggugcauacugcuaacuugaagccuugcuucuuaaagaguccuggacauucugcauguguccuuuuucucuguaagauaggagaguagggcacagcagcugcuaccuaaagaccauguguggaaccaaauaacucaguacacaccuguaaggucuguacugaugaguuugaagcucaaaggucuuuacaguucaagaucauguaucuaagaggauacaaaacaaacuucagggcuaggaaaauagcucagugggaggauguuugucuagcaugccugagacccuggguucaauccccaguacuagaaaauuaacuaacuaauaaaauaaaaaauuuuuaaaaauccacaaaaguaaagaacacaaacucaacccaaugaauacaaaaaccaaacacaugaacacacaugaagucacauuauggaaucccuuccucacuuuguuuuuuuagaugacauuuacuguuauuuauaaauuugauauaaaaauaauaauaacauuccuuuacaauaaaucaugguuaguaguaucucauaaaaagccuucugugcuauguucaugcacacagagcaagcacaauugaggcuugaaaaggcucgugacccucuuggaaagguggaucugggauugaaacaugucugcuguugggcuguagcuccuuagccagugagacuuacagagaugguuaacaguuguuggcugagaucauacgagggguggguaccuagcacagguuuagggcacaggcaagcagcacagcagacagcuuauggaugaaacaguccaguggagugggccuuuagguuucucccuuuucaguaagauugucacacccuauguuaggugaccaccagccaugguugaaaucacuuccccugggcagggcaguauguaugcucugugcacugcuggguguuaguauucuuguuuagacccugagcauuuacacaggcuguagauuaccgaugaaaugcuucuguuuagcuaggacagccagaugaagucuguugcaguuguucgguucuuaacugucugcugauuuuuggccuaauggaaacauggccgaagucaagcauucuuuccaguugacagauacaguguauuugcccagcagggaaauuggggcacauuugaagcaaggaagaugcugagcaaaugggagugacaggaaacaaggugagaagucuggugugggcaggaccuugcagguugccacccaaggaggcaaggaggcaaguauagaacagcgucuuucuccuguggggaugcaaccugugagugugagcccuucacugaaggccguggguuuagagggcaguuauucucuuugugccugcucuuucucuggauguaauuaaggagacuuuagagaaggaaucuugugcuaaagcccagauaagagccugaacuuaucuaccuccccaaaucccuaaagccaaguuggauuuuaauauuuuucuuuuggauuugacuuugcugcugugcgaaggggcagcagguggggaggagagagaggagaguuccuggggaagaagaaaccuuuauggagacccauuuuuaaucuccaugauggcucaguaauguaagcccugagaguuggcaauggaaggaaaacugcaggauuaauggccuugugccugcuucucugauacccuuuaaaaggccagcuaaccagcuggcucccuccugcuccaaaugcucucccucucaaauccugaguuguguuguuucuuuuuggcugauuuuaauuuucuucuucguuucugaauuucagcaccaaggggguagggagacuuuuccuuccuuccuuccuuccuuccuuccuuccuuccuuccuuccuuccuuccuuccuuccucccucccucccucccucccucccucccucccuuccuuccuuccuucccuccuucuuccuucuucuucccuccacaccccaugugugugguggggugggagguuauagcacuacagaugaacaggaagauuuuauaggaaagagauuuaguucaucguaauuuagggauuuauuuuggugacuauuuuccuuaaauugaaacccugugugugugcuuguauuuguacacauuuaaccuucugcaauccugcaacauaguacauauauuuuuggaagcagagauacaauccaacauguacucaauucuuaagauguuccagauacaauaucaguacauagcccccuuuacauuuuacagcauuauugcuuuucccacaugucuauuuauggcucugaggacgccaugucauguguuucacaguggaucaauguagaagucuacagcuguuuuguugggaugaacauaugaauugcucaggucuaaaugaucacuaaggaaaguuguuuuggguguaagaccagaugcuagacaggaggcaaaagggcuugcuucuuucacugcuagaaagaagcacaugguaauuguuuccaguaggaaaccuuugacguaggucagcagucaaggaaggagcgacagagagccaucauggaagaauaagagcucugccuguuaccuauguuauucugguagacuuuaaaaugccagucccugauaguuuucuggguaaacauucucauuauuuucugucauuggcauugucauuggcagguaauuaacaacaguaccauuuuuauauaacacucagaccuggaugggucucagugaugucccuuuauuuuuguaugacgcuguugacuguuugauuuucuuuuuccaauacgaagcucuuuggugugcuuauuacauguagaggcuauugggccugcuguggggagauuggacuggcccccuggaguggagggucuuuucaaacugacucuugccaauaagauucuugcuaaagugagguagugcaggcaugacauggauggacaaccagggcuuuggggagccuggaugaaguugacaaggauggaauuuuggccacuuucugagccagaaucgcagccgcugugccaaguagugcccugucacgaacaauggccuguuucaggcugggcugagagauggagcauaguaccagggauuaggggugagcucacaugcugggcucuacugggugcuuagcagccugcuggaguacaagcauuucagaugacuacugcuauaucucacagaggucagcuuagguuucucaccuuaaaacacaaauuccguuuucacacaucaguccucagaggauuccagggaucuucauuuuccaugccuuucucccuacaaacuuccaauauggccuuggcauagagaaguaagucucucuaguucuaauaucauuguuuccuuuguucuugaagaccuuugcuucuguccaaauggcuuauccgugcuuuaucugucgauagauuggaaaauuguaauguuuuucuuuuauacuucauuguaucaaugugcagguagguguucucuuuuucaguagacaauucacuuagaaaucaacaugaugauacaucucugguucugaaagaaaaacuaaagaaggguaugcaauuuacccauccuucagcccacucuuaauuucaauacacuucaauacucauauagaaauacaguuuuguauguauguauaccuguguaugugucuucauauguggguguauauuauagauuuuacgcaaauaugccuacaaagugucuggaauguuaggaaaugaaacgggagaaacacuuucagauggagaaaauugugaugguauuuuucaauaacauauccaaacccaaguuguucguuccuuucucucauuugaucccaccuccauccccgcuccaugaccugcagacacccaaaauguucuuuucagcagccuucucaucucagggcaaaauauucuuugucuuagaaagguuucuuagaaaccuugaugucuuaggcucuuuuuucauuguccacauccacuucaugugcauaccuggaugcuauagcucuuguauauugguaccucacccaccacagcuguggucaccuccagucugaccagggcaauaaacuccuugucuucucuguuuccacaucccacaaauucgguacuacucagcugccccagaggaauuccugugggagguaaaccauuucuucucuucccuguucuuggcauugucagugaugcuccuccaucucucauugagagccacauucuuuacuaugaccucaggguccuauagguuuauggcauccucuacuacuccuuuuccuuuccauucucucagcugacaaguguucucugagucauaucuccugaccugaaauacucggaagcacaagggccuuagaauauuuguauagauuuugccaguugaguaucccuucaccccaauaucugacauugaaguauuuuagacuugagggcucgagaagccugagcugaagcagaaguugcucucuucugcuaauuaaagugguuuacuugguaaugauucuccaaucaaagguguccuaugagauacuuaacuuuucauguucugccugguguauguauuucauaccuucuugacagagcaaugccuagugguggccgcuauaguuaggagcagguauaaucuuccucuggguguccugcacaaccacauguugucaagauggagccaauuguagugucuuaccuggauuguccagugcaggccauauuguauauaucgaaaaucuauuauguccccuuucuagauccuguggucagagaaggggcuucaggagugugggcaugauugauugagagauacacagggaauagcuaaaggggagagaugcugucauuggucaucuuggcuuuggguaaggcugguacaaagauuuucuuucucagacucacuuaggauucuuccucagucuaaauaaaugcaguucaguagaagaagcucuucugaaaugaaaaugaccuaugucagaaaagucuagucaagccaauccaguggcguuuaguaccaucucuacuuacaaugcuggggaguuuuuuuuuuuuuuuuuuuuuuuuuugaguucaucugaaaagcauauuuaaaucuguugcaccaaaacaaugauuuugaucacaccuucuccguugucuugacuuuucuccucaagcgcucuucuaacaaaggagcauagcuuccagauuuguaaacugccaccuuauuaucccauuagucaauuacagcugcugaagagcaggguaagugacaguauggcagauucgagccauuuaucugcuguucgcauagccuuguugagcacaucaucaagcuguuuaaauucauugauaggacuuauacauguauuucagagcacuuaacgugccaucagaauguuuaggauagacucuggugaccugaaauugggacugccuuccucagcagugcauauacagcuggguuguaguccugauuagcaaaacugauucaaauuaggagaggcaaccugcuuucaagaggauauggggcuaguccacauauagcagugcaagucaaauuggggacaauuacacacacgcacacacgcacacgcacacgaagcaggauaauggagauacaucuaucaaacuaguagaucaggaaaucuuuuguaaaugcaucauaguguaaguucuaaguaaacugcaacccauuggaguuugcuuuacuuccggugaaccuuguagacaaagagguuucacguaaaugcuacaccauugcaagcucacagagaaacuugacauuuggacucugugggugaagagggagcugcaggggguugugucagcaucacaaggaggcaucauggugaaggagcccuguggguauuggaaaauagcuguucuguucgucuugcucuuccugcuaaggacaagaguuauacuaugguaguguuuguauugcgaggaaaagacaggcugcaaaaagacaaagaguuggccuggagguggugguacgcaccuuuaaucccagcauucaggaggcagaggcaggcggauuucugugaguucaagguuagccagagcuacccagccaaacccugucuccaaaaagaaaggaaaggaguugaguggucaaauagaugcuaguuccuuuucuuuuuuuuccuuucgagacaggguuucucuguauagcccuggcugucuuggaacucacucuguagaccaggcugggcuugaauucagaaaucugcuugccucuaccucccaauugcuggauuaaaggcgugugccaccaccgcccagcuauggaugcugguucuuaggagaugaggcgagguauuggaggaccugucaacuucaguuuuuuuccuacuuucaguuguauugagaaacucuugguuccaccuaaauaacuacagaucugaaaugauaaugcccuguuaauuaugagcagcacuaacccuuguagacuuggugguucacuuuuacugugcucccagaguacuguaucgacuacauaguaaaaggcccugcuuccucugacuuuaagcucaaagugugauacuagccaaugccaaaucagauucucucaaucuuguucauauauuaggucugaaaauugccuguguauuacaagaauuuuagcagcaucucucuggaaccuaccuuaccccaacgauggcaaccuuaacacucucucuguguguguguguguguguguguguguguguguguguguguguguuucuuguuguuuuuucacuucuccaaguuacuuaaaaugaccuucuaagggaaauaauuguuuuguucauguaaaaacugaguccagcuguagauuucucugagaaagcuggguaauuaacuuacauaaccauugugagccaugaggcagaacagugagaccgcugccuuuuccucuggagcuacaacucugaugaugacaucauaccuuuggcauauugcuguccuuccauaaaacaccaccauugagagcggaguuauuuuuggaugcuguuuucugaagauggaaggaagguagacccauauauuuccucagcaauauccaaaaacaguacacuacauggaccacuucguauaugcucaugguguuggggauuaauagugauuuccaacuucagaugccuccaucucacugugagguuaaaauacuuaugcuguuauguccaucaaagucuuacuggauucccgagagcggagcucuaggcaaauccuuggagauguaaaaucaccggagaaaacaacuccagcucuccaaggaaauuauggucuauuggcuaucaguuucaauuaaaauguuuccaacacaacuuguagugcaaggagacucuuaaacgaaauguguuggccacauguuuuuaaauaauucaugacgcgcauuuaaacacuugccauggcucagugggguagaaguacuugucccaaaaccuuaaugaccaggguuugaucucuagaacuaucagcggaaggacuugauucuuguuugucucuaaccucuacauguuugcccccacccauucauaacacacacacacaaacaccacuaauuaaaaauugugaauuacuuacauuauuaaugaaggugaugagcagaaaugucagaaaucuccaagaaacugugggucuaguaaaauaggauuucauuuuucuguuugcagaauguucguagcuuaagguugaggaguaggcuucaugaaccccaggaauguagcuccugcuguuuuaugaucucacuguauuaaagguugcuccaguuccagcuaucacaacugcauugccuaccguagaaagagaauagagaaggacccuuccuuuguagacaguucuuggaacgguuaccuuuaaccauuccucagguggcuagagagacuucuguaagcauccacuguggcuagacauguguguuugcuucaaccaucugaaaaucaaaauauguaacuuagauaaacagagaaguaaagaacucaaguauggaugacaguacaaagaaaugcuggcuucuggcuuccuuuggggccaagguucaaggguuauaagcuaagagcugagaacagcauacagugaaaaugacuuuaagaguaucuaugcaaacucuaauugcuugccaugcaugauacuauagauuuguuagcuuuuugcuuuuaauguguucuuauaaacaacuauucagaauaaugccacugucauuaaauagagucaccuuaugcuguuauaauaaucugucuuguggguauuugaucagaaggaaacaucagcuaagcaaaguaggagauuauugaaugggaagacagaaaggugauuggagguguuccuagaacuacgugacgcuuccuauuaaguccuaagcuauuuuuuugguagauugaauacaguaugcucuuucuuuguggaggcaggauaaagagacaucauaguuauauaaauauucugaaugaacagauaggccuaccuacagaauuaacagcggauauuuuagaaaaccgauaacuacagcaaugaggugcuaugugcccucaggcauaaaaccagugguauuguuacauguuauaaagaaagacaaaggugaugccuuuacaugagaagaaaggguucuugguaaaguuaggaugcaaggcugcauuuccaaugccuccuuuuccugugccuuguguucuuacuuuaugggugcaagcuugaggcauggacagacuagcuaacuguccagcgucacaaagacacugaguccaacgucacaaagacacugaguccaaaguugauguucaaacucuggccaccugauacaagguucuaagcuuuucuuuucuuucuuguucugguuaaaagcuguuaaccucuaucuuguauuacauagauaguuuuuucugccaggaagauugaagcuuuugaauauuuuuguccauucugcaccaucacuuggcauugaggauggcuaccuucugaaguugauaacaaauugauaaaaauugauaauuaaaugacuugguuagauuacccuaaguggcagggaacaagcuuucccacaaggcuuugcccaucaguggguggcaacuggcucagugucuugucucucucaaguugaaauugccuuuagaauuuaauuguuuuuguucccggccacuuugaaauggaauuagacacacuuguguagugucacuggcucaguacuuacuauaugcugagaccuagcuacauuuuccuugaugagagaauggccgcacucacuuuuaugugggucuuaguagccaccaauauuuguggaguagaauuaagggccaggucaauuguggagugcgucuacuagagcccccauaggggcagagaaacaaccaaccacuagagccccggugaacaguauucuccauggaaguuuaacuucugcaaugcucaaauaauuucaugccaggccagcucucucuaaacuagaacuuuggauauaauauagugucuguuuuguuuuguucucuaaaucaugugacagguauuuaacaaaugugcugucucacuccugguuuaucacaaugucauaacaaauauaugaucagauccaccaagugagcccaaaaaucucaaggauccugggaaauaucguucaguugagcuuguuuuaacugguuuugaaaauggacccacuggacucagacuuuuaagcacuugcugcuuuuccuuuacaccuccuaucagcccuugauuaaugaucaaaggaucauugucuggugcagaagaccgcaggaguucuggcuuuccugggaaagcaggaauugggaaaccucccaaguaugucaaaaggcaaagggggaaaauuaauacguuguugucagggagccucuaaagaagaguucagauagcgcucauuugggaauagcuaucagaagaaacagaagcagagcaggagagaaaugcuaaggggccuaagaugcaguuugggcaaacauuccuccaucauuccuagaagcaggcuguacauguucccuuuuccugaaaagcuagcacauggacuuggaggaggcugagggccucuucacugugucucaaaacugacaauucuugaucuuauuucuuucccugauacuuuucauuucaagggaaauaaaaaucuguuuucggguuccuuucuccucccuugccacugcuaaugucaauaucgccagaacaacuucagacuuuagacauuaagaaacguugaguuaauauaacaauuugacguugcuuuaaaauuuacccauggaucucuaggcaagcuccaucuuuaaauauuuacuuaaaauauuugcuuuugcauguauaccuggccauuuguaggaauguauugaaaaugaguugauuuauuugcuucauucuuggguggauaauguugacucuacugaaguguauuagaagagagucauucuauuagcuauuccuucuuuuaaagaguccaugguggcuggacucugccguauuaauuauuccgugggcuucagcaaucucuaacuggguguuuucuaaauaacaacuauauguagauaaguuucuuuagauaagucucuaauguagcacucagggggggaaaaaucagcagaccugaauuaaccgagaaaccacuuuuguguugcguuuugauccauuuaagcuaaacugauuagcacuuuuugaaaagcaaaucuaaauccuugugcuaaucaagggaaauugagccaugcuguuauuccauguuguuaccgagccagugagaagcagcaagcucccuuuuuauuuuauuuuuuauuaaucacucagcauauagcuggguucagugcccaccuccucccucagcaaaccacucuccucagcgcuuguuuaauaaaacugcacagcgggggaauauuggaguguuagugggauucuaggaaguucauuccggugcaguugacgaucgggugagugcuuuugcuuggggguggggggaggggcggggauggucuguuugaagcaggcuguuaagaaaagcaugaagccuguugcacacacgugacucaacugaaacacaaguagaaagcaggcuugccugguuuccaguacucaguggcucuccaucagggguggauggacccugaggcccaccucaugucuucaccgcugauaacuucauucaacaaaaggcucacuacuuacucauauccaccccaaguagaugccgacgguagcgacucggcaggcuuacuguguauggaauucuauucuuuacuaagaauugaucaucacagaggccugugcaauucauuaucccuguaaaccccacccucuacaguuccauucuuuauuggcagugauuaggcaggagacauucguuuugguuuucaggcugucugguauggagcagcagauaccagagaaugaggugggggauggaaagggagggauaauaauauuuagccuuauuccuuucaugccuaaccagaguugaggaauuuucagagcagaaauuuguuguuucagggauauguccaguuuucagcuggaguuacuuauuaaccucuacuugcauaagcagacacccaugagacucuaaggauacauggagaaagaagucucaccuugcucucacccucucugagucuucaaaugccucucucaucagugagcugagagggugagaagcuuccacccucucagaggcaaaggcaaagcaguuugcaccuuucugcuucugcugugaaaccuuugaaauugucuuacagaugacaacuucauacgagucagauuuuccaauguacaugcaaggcuacagcucacccgcagaugcuaguagagauccagcuagucugagaucucugcaaaggcccugcguaccccagcugccugcauggcucccuagcuguuuaaagccuucccagguggcuggcgcuagcagguacacauggcaagaacuacccauggcaaggaccauuugcugguugugauaguugggacgggucuccaaagccagaaaugaguaucaauagacauuaucuuuagcacagagccugugugggcccaggguuuaauccuagcuggugugccuggcugaugaauguucuguagcugugaucaucuccuugggcuuuuauugcuguuugcucuggcugugccuuuaggagaaggccgagcacugucugcugaagagugauuucagaaaucacuuggaaaugguuguaaucuuaagaguguccacacaaaggucauagaaagcagaaauuggccuggauacagugcagaucauauacaaccuucgaugucaaugucccuguccugaucucuacuccccuuuaaaugccacaaaccuguaccuauuuuaaaagguuccaggacuuagaaaaccuuaugucacuuuuucuagaccuuugcuuauuggugacagaggacaaaacuucugggcagguuaaccagauuagguuacuucugugaacaguuaguauugacuuaguguuuuuguugcuguaaucaaacaccgugaccauaaacaacuuggggagaaagagguuuauuucagcucacacuccauugaugagggaaaucaaggcaggagcucaaacagggcaggaaccuggagguagaagcuggugcagaggccauggagggaugcugcuuucuccuugugacuucccauugcuugcucaccccacuuucuuacaccauccaggacaauguauagggccuggggguugcaccaccuccagugagguagaccuucuuuucuucauuaaucaucaguccagaaaaaugcaccacaggcuugcacagaggccaauaugguagagguauuuucucgacugacaguacuuccuuccagaugauccagucugggucaaugugacaugaaacuagcuagucccaauauccuauaguacuauguuuuaagucugcuuuuuuuuuuuuuuuggauccuuggcauuguaugggccuggaccuuccuuuguucuuagacaacaaacugugcaaaguguaguauaucaguucuguuagacauagagaaccuaaauuccugacugccacuacuaaggaacugaucgaguagccugucugaagaggaaauuaauugaccucuugggcuccucucagguucaaugucaggcuuggucccuguucucccuagcauccaaucaacguaccuaccuguuugccacuaaagcuaaauaacaaauuuagcuugcuugaauugcccugguuaccauguucuuacuaagcuggcacacugaacaugcuguaucaugguagaaauuuuuugcaaggcuuaucucuacauggcuuuuaguagaguuucucaucagaauaagauuugggcaaacauauucaccucaguuguucuuugauuucuggaaggaaaacaugcauauguugcuaugccacuugggaugggaggugaguguggguuuuuaaaaauuuuucauuuauuuauuuauuuauuuauuuauuuuaauuuauuuuucaagacaggguuucucuuauaacccuggcuguccuggaacucacucuguauacaaggcuggcuucaaacucagaaauccgccugcuucugccucccaagugcugggauuaaaggcgugcaugcgacaccacgccuggccuaggugugggguuuuuuuuuuuuuguuguuguuguuuccauucaguuuuccagaguuaucuucaaccacaaagucacugccagccuuugggagguggaagacacacuguccaauugacauuuucuguuucuguuucaagauaaacagugaccugggcuuguagagacuggcuggcuuggauguguuugcaguuccccagucgagucuucauagcaguaugaguugcuuugugauggauaaccaaucauugccuuacaacuggcuucaguucugaaaccgcauguauuuggaacucugagacucaaguagccugacuuauaugucacuaugacagagucaacacgcaugaccuuuucugugaggcugugaugcaauagcuuuuaaaugggugguaagugcuggccggcccuacuuucaaaaccgagagucauucaugaauucauucauuccccuacuacauagggagccacgguauaaacuaggcagugcuccagagugggagauggagcaaugaacugcauccugagucacaagcuuuauuucuuugaagugccagauaacauuuuacacccuguaggcuuuaguguaccuaauguagcuauugcacucagcugggguuugcacaaaagcagauagaacaacaauaaagggaagguugcugaauuccaauggaaguugauuuauaaaagcagguagcccauggagcacagguuaccaccccugcaucagagcacggccugcucuggcugagugaacauugucaucaucuacacggaauugucaccagguauuuauguuucuuaugagaauaugugcuccuaaacaacaccucauucaaaauaagaaucagucagugcaguugaaagcuuagguucuucaaagggaagaaucauaagugggggcugggacgauagcccacuggguaaagugcuugccuugcaagcguaagcaucugaguuugauccccagaacccacaaaacauaaaacuuacuguaguggcgugcacucuugcaaaaccagagccaaagaagagacaggggguugucuggggcuggcugcccaucaagccgggcccacuuggugagcuccaggccagugagauacuuaacuucacaaacaaggggaagggccuacugagucauaacugccaacgcugaccucuggccuccaaaugcacgcacacacacaaacacagacauucuacuacgucuauacagaaacauacaugcacggcaguaaagucaacaaaaaguugacaucaauauaucaugaacgcguauucugauauauuuuaaaacuugugccugggucauuguuuacuaauugugggcuguauuuucuaggucuuaaacauucacaggaaagcuccuauagcucuagcuuuugaugaauugaccauaccuuucgagccaugaaggcaauaugaaaagcugucacuaacuagaacacucugucccuucaucuacaagcuccaucaauaauuuaaaggaacaacuuauucaugaauuccgucaggucagcauauuagucauggaucugccuuuggcgagccagcgagguggccauucauugcucugauggcuuuggcauguugauuuggggcaaaugaagcugaugugguaugcacuagucuagguacagguugucacuuaaaagccucguuaggugaauggcuggaugccuccggagaggcguucuuacuaguacaguauugcuaguuguuugcauuauaguaguuaucaaaaguuccuggccagugaggggauucauuucugauucuguuuaaaauaccucaggaaccaauucugugcuuacaaaguuccccuaacauuuuguuuguaaacuaaugugaguuuccaaauauguagaagucuggaaagaauuaucugauggacaucgguagggcuuagggauuuugaauccuaagcagguggguagcuguuucaaaguaauaagagaauaucaccucuggccuuuuuaggaguaugagucuuuaggaguggccagaaacuaaaccagaucaguuaucuauugggucuccuucccucuaugcaccccuccacuuacuucucuugucuuccauuuccuuugagauguaaucucaguauauuacccaggcugauacaacugucuucugcuccuaagcucaguuugccuccguuuccugaguauuuaggauuauaaguguguaucaccacagcagacucuuauuuuuugggaaaaccccauaaauauugcaccacgcuguugcccuuguucuuccuuacuuccaggaaguagagaaagagaaagagaaagagaagcagugaggagaagggaaggaacucuuucaggggucuguaggaucacuuagcgagucaugauuccugcucucaagcccaggaagcugaguucuaucuguagcauccacaucuguagcauccacaucuguaacauccacaucuguagcauccacaugguggaaggagagaaguaacugguucagguuguccucugcccucuaacacacacacuguaguacacacacgcacucccaccuacauacacacauaguaauaaaugaaauauaauuuaaaaaaaacugucucaaaaggcugaaguugaccccaaacauccuguguagcugggacuggccuucaauuccugauucuucuuuugucuccagccccuuagugcuaaguaagauuaagggaaugggccaccaugucuggcuuucaacuuuuuuuuuuuuuuuuaagagucacucugcugucgacuaguuuuccuuacuguugcaggcucacccuggccucccuuuacaggaagcaaaaucaucaccaguaauugcugcaagaggguuuagacaggacugguguuucccacauguugcuaagaaacagagcccucagaugcccuuuagaacugcggaggucugucuuucuaguggucuaauucugcuuacuuacuucguagcaaagcuuccagugucuuuuguucucuccgacuacuuccucccacuagccaaccccaaguaccauacggaugucaggaagccugugcuggccagagcaggagacaggcccuuccuuccacgaugcaggcucucuagcugcugaacuucuggaaagaaugauugaggguuggaagaaaccguuugacauccaaccgcaaagggaaaaauuaguccugugacccucucugguucuguuucauucugcauccugcguacuuuaugaggaacaacagccaugggaacgggaguuauauuucucuuuagaagauucggucacaauuuaauggugaucacaagucuggaggaaagacaggguuggaaguccuaacuguacuuucuuuuagcugcugucuaaguucugaaaaaugcuacagccauucauccgccguguuuaauuucccaucccccaacucaggacagaacauauucuuacacuguugacuucugcuguuuuccugcucuagccuaugcucggugagaugaagccaacugccccacuuuguaagaaagucuugaagaagcauuacgcuccauucuccuugcuguucccucugccaugaaagcaauuauauucuagaggcaaggaagguauuguguugccugggucccauggaaagcaugcagacuauagcacucaauauaacucuaugacugugagauaguggcucauuuguuacugcagcuuacguuaacccaaacggacuagcauaccaugugcaucacacugccaugcuaauauuucucagguuuagcacuagaaucauuaaaugguguaaaacaccauucccugccgaguuuguccgcagauugguauuuagaaaacaguuuuccaaaaggaggguugauuguguucuaguacuauccugaaggugaagacuuacuagacgccuguaucuuaauaaaugcaucgaauccugcaggaaaccaacauuguuguauucugugaccugaaccucgccuuuggcguaacccaccaagcccucccacucauuggcucaguuccucuguauugucauaguuaggccgguuuuaagaagcaguacuaaagaacuucccacugagacauuucaacacagagaggcuuucugaucucuuuaaaauaaaaugguuaaaaaaggucccgugggaagaguuuuccuccuuaagcagacuccuguggaaguguuuacauuuggauugggggucuaauuauuguuuuucccaccacagaucuaccauaguugcaucauagugcaagggucaguuuugugggucacacccaccagugcucacugggcucaugaccgucacucacuucccuucccaucgcuggggcuuuuccuggguagugcucuaacuucuuagccgucccuacaucuguuucaucauucauggugugaccuuccuuugggaggccaacaaaaucuuagcaaguccagcaacccuggccucggguuacugaagucauguaggacagaggugagcccacaaagggaaagucuugagcaaaugcaacaacaaaagcuauaauuaaaaucuaaggucuccgagacacuuagucauuagagcuggaaugcccaaguauuguaacauguuccagcaucaugguuaguucuguguccaaaccagugacuacuuuuagaaacauccgcuccagaugaccauauaguuuuucuguuuuucuguuguccucuuucccaaagacagggagauccaaugucuaugaaugcuuguggcgucuguauguaaauuugguuguuaacuucuuuuuuugucaugauuuuagcaccuuagaaggauaccuaugacauugcucagcaaguuuuugugcaaugaagaauggauggcaaacagaaaaaaaaaaguuacuguuuaauuuugcaucagccuuuaauacuuuacuguuagcguugugucuuauuaggaaaaggacgaagagaaagcccaaguuaugaucuuuuacaaugagaugcacuacaucgcuuauauuuuuacugcuauuuacauauuuuguuuugagguauauuguucauccaggcuucucuguauagcucgggcuggccuugaauuuaguguguagguaagguugaucuuggacuccugauccccucacuuccuuaaugccaggauuauagaacaaaagcccauggcuacugugccuagcuuccuauauauuuacuucuguuaucggggaggaaagucuuuuuaagaaauagcgggggcuggugagauggcucaauggguaagagcacccgacuguucuuccgaagguccagaguucaaaucccagcaaccacaugguggcucacaaccaucuguaacaagaucugacgcccucuucuggagugucugaagacagcuacaguguacuuacauauaauaaauaaauaaaucuuuaaaaaaaaaaaaaagaaauagcaauuuggggcugggagggugcuccauauguaggagcaucugaaccauuguugcauugccagcaucuguacaccgccgcucacagccaacaguaagcucugaugccagugcucucuucuggucucacacuuagcacuuggcccuuacauggugccgaguuauauacauacacucagacaugauauucuuacacguaaaaucaaaauaaauuauuucuuaaaaaaaaaaaaaagacagaaaacaccacaauaccaaacccuacuuaucaacaaagaccaaaaggguggcauauuuuuuaagcacuuuccuaagauucugucauaaaucuuuggucuggagugaaaucuauuuuaaaauaacguuucugcaauaacccguucugugcuccuuccugguucggaucugaguucucgauuccccugugcucuuuugcaaucucuccguccccgucugugcacgggccccuccuucccugccucuaaauccuaucguucuuuaaaauucauuucaagugucauuuccucuggauacaccccucaugaguuagaugcuucucuaucuuagcgcacccugaugcucucugaguauacuuccagcacauccuauuuaucacucuuuauugugccuguuugaucaaugguuagaugauuaaacucuuagcgccuccaggccaaggcuugaauauuacucaucucugcauggugggcaacucauggagugucuuggcaccaauaggugcuuagaguauuuucugcuuguauucacuucgguucuuuauguucaagaaaacagcuuguuacccaguagcaucauccuuccugcagccacuugccuggaaagcuggaaggggguuucuuccuccaguuucagcagccaccauggccccugucuacuacuggcccacgaagaaaggccaggcggacaguuguuccucguccugguggcacaucccucuagaccuagucaccgcucagagauuccaccacacauugucucuaggguuaggauucucaugcaugggaaauuugugaggacacagucaugccauguaguugacucuaucacucugaauugcugaguuugaaggugcaccccaacacuuaggaggcagaggcaggagaauuaucaucuugaaaaacaaucugggauauagagcaaacccaucuuagaaaaccaaggcuugaaaguauggcuagcuauauagcacuugacuaggguguuuaagacucuuaugaccaccugacuuguaauuccuugcugagccuugaauaaaaccuaguguaguauacagaaucccaucugguuuuccgaacccugaacuagauauauauuuccuggcaguuguuuucuuggccucagaauuuuaucuguguauguuugccaaucuuagauguuaguuguaauagaagaaauauauauuuuaaaaguacaauaacaguauaauauuaccaugucuuuucuuucauuuuacaaauaauacaacuaaguuuuuuaaauuuuuuaauaaauuagaaucaccaaaaauccaauauuucuuuaauauuaucacaauuagcagcucucuagaaugacauagagauauuaagaugggugcuccguuaaguuaggugucacagagugcaugggauucuacuuucauuuuguaaacuagacaaucccuuagcacaguguuagucucguucuuuaccuauagcugugcaaucacugagcuggguaaaauguugugauguaccaauuaagaacauccuauguuguuuuuuauuuuuuuauuuuuuuuauccacaaguucaguaaauuacaacuugauugucugaguaaacauugcuaccugcugugacugccuuguugucgaacagagcucugcaugcaaauuaacagcaguuuguaauucccaguauggcacacuguacuuuucccauaacuuaaauuucucuucucucaccaccggaaaacagauugggacaaagcgcguccuuucuuguaucuuuugcugcaguucuuugcuuccaggcagugcugccuauugcugcccuagaggaggugcgauggaaacaccuggacaggaccugucaccccuguguucucacaaagauauuagcaguaugcaaccuaaugaagauggagaaaaugccaacucauuuucucuuugcuauucaaaauuauaugugggccggaauauaauaagccauccuuaugcccgaguaaccugugacccuucagugagguccugcucuuguguacuguguaugguucacugucagguaauuuuaacguccaauaaaaucugccuugaauaaauuagaauauauuugcaaauuaguugguuaauuagauuuuagacaucucuggggggcugagcugaaacagaugugugcaaaaagccccuugccgggcgagggaugugcgcuucugacugaauuuucugaaggaagagccugucauucgauccuguuguuagugucagaguguuccaguaaauacauuccuguagagcccagcagaccuggccucugcucuagagcccauugucagagggaaagggcucacaguugccucugucacuaagcaguugcacugugaaguaagcagugggcucuuagaguuccuuugagggauaaauuauauuucauuguucuaacauuggcuuccuguguguguuaagaaaaauuagccaugguggaaauagucauggcuggucuggucaucuucgaguuuucuaaaucugacugucguugagcaaagaacaaaguuuaaaaguacagaaauggcguuugagauuggggaugcucaagucgggcucuuugugcugaacagacacuggccccacauuaccucuggcuuuauuguucgcuuuaaaauacagcuguucuucuuuuccuaaauuuuaaaaaguaguucauuauuugaaggacaguuguguuugauguagcuuucaccuaccuuccaauaguaccaaugaauacccaaagccuacuuucaggaugggggaaggugauagauagaugauuaacagauagaugauuaauagauagauacauagauagauagaugauguagagagauacauagaugauagaaugauagaugauagauaagugauaaauaugugagauagauagaugauggauagacaggugaagauagaugauagaugauauauagaugguugauagaugauagaugauauauaaaugauugauugauagaugauagauugauagaugauagauaaaugauuguuuaauugauagauaauaggugauagaugauggauugauagaugauagauaguugauagauugacugauaggugauagauugauagauuauagaugacugauacaaucaaaugagauuaugucuaaaucaggaauuccuguacuagugauuuuuauguuugacauuaagaucuggauacuguaaaauguagaacuagauugaaauugagcuucuuuccugcuacagcauucuucauugagagcuagugcagccagaagaaagggaugcuugccauguuuguuuuauuugaauuuccagucaugauuuaugaugagaagacggauuuuugagggguguuuugaaaguuucugguaguugacuguguuaagcauuugagcccaguacauugccaaacaucuuguucucauagacuugaacuuccccaaauccuguagcugacucaacucacaucugggccugcagguugaguuucuacuccuaugggcucaagaaacaaacugcuauuuaugacaaaaccaagugucauugcccguuggaguguuuguuccagggguuagcaaacugauauccuuucauuaaauccucugugucaggggcauggaaacucuucauuugggcaggugacuccaggucuacagaacaaacugaaagggaaggucugggucuagaaggaaguuuugcccacuacagugacucagguacgugaugugggcccaaggaugcuggcucaaaguccaucucuccaggcagaacacacugagcagggagcacagauuugggauugaaaaacagggcuguuggcucuggugagguccuaaagaucccaggccagguuagcaagaaauguccagagguagccuuugcaggcgucugggagacuuauggucugacagaggguaauaagcagggauuaggacugaacuucaaaauguauucggaaauguguauucaugcaauauccaucauaauagugaggauauguggaaauggguuuauuuucuuccuaguacuaaugcagagaaguaacacugaaaaacagaacuuugccagaugagcaaccguauugguucaaagaauuccuagauccacacaugaagugucauggauggccuggagaauggugcccaguggcauaaacacucuggucagauaccgauggaggugaucagucucaccuaagccuaaagggcaaugcauuugagggaagaaaacagcaguuaucuauauugaccuacaagauacgauagaugguugcugguaaggucugccuggacucugucuugaagaugaucauucuggagcaagcaugcucuuggcuagugcugauugcugagugccagggccuacgccuaggaugggaggguuuggugccugggauugccacagaguccacuuaaaaauugagucauagaugcuaaugaugucagccauguguuggagacccugaguauauucuuuuuuaaagauuggccaguucuggauguguguguugaagguaaccugaaaaucaaauuugucuugucucuccccugggggcuuugaagauuucaaguaucagaaccaguaagcuaugguguugcuaauaaaaauugcuuaugaguuguucgcuugggguaguaaguaggcuuauuuauagaacagcccugagccuccccaugggcaagaaggcuuuuuacuaaagcaagaucaugagguagagaaagggcaauguugagggacaggguauaucuuaaggagucuuagacuuacugauggcuacuaggaggcugucaaacuuuuaccccugaggcuuccauccggcuccguugcugguggcugcaaaucucuuucauauggccauuugcaauucgguggaguguuuggaacgagcuaguuaaucccaguccaauucauaaugggcagguagccaauucacacaaaccaccuugacaauccacacuaauugcuuugucuccacggagcagcuagaaauugaauugccugcagagaugaacauuuccuacuuucuaccccuuucuuccagcucccccucucuguccauucccacccuuggguacccccagcugaaacccuacacuuggcugcuugcugugauugugauuuuuuuuuuuuuuuugguauuaaauagcacacauccuucuaggcuauaaauuuccagaaguuuucuuuuugaagaaaugaguagauucaagguaaggaaaggaaacucaauauugucauuauggucauuuauauuugggcaguugguuucauugccacggguagaaacugucuuugaacaaagcaaaacauacuccuuuuuuauuugaaagucuagggagacaaauuccuagacaaacacucaugcagccugguauuagauucagaaagagcuacugacccagaaaaacacccagucuagcagccuccagaaucgucucuaagaauggauaauugugcgccccaaacagaugagagucuggguuacuguaacugacugagagcugcuuuuuaaaggaguaugcuuuaccuacacagguacuucuggaguaguccuacuauguccaaauuccagcgaugcucugggugauccucaggggcaagugggaugcuagaugauugcuuccauuaguuagcuggacaaggaugcaaguuguacccaagggaccugacuagguucuggcucuuuuccucacucagcuacuuuagacuuaaauucauccucucugaaccuauuuauaucaguuagcucugaaguuaaaggucuguuucauuaaaaauuauauuucauaguuauaaaaauauuuuaaugcugcuuacauuuuagagggcugauugauuuucauauauuuagaaauuuacuuaaggaaaggaaagcucccucuaaggauaaaagacaaugaccaguuccuucauggaugcuauguugacuccccuucuccuaacaaccuugugaagauuaaagcaguauaccuccgugcaagcauugucaacuugaacacauuucuaggcauucagugugcauagacacuugguuauuuacagugauuuauaguauuugccccacuaucuucagauagaaugucucucugagcaggcuagccuugcagugaguuaugaugguuggaaaccucuuaccauaacuauccugccugaaaacaaagcaaauggugggcgugaaguccucuugccauccaggguccaagagauagagaaaauuuuucauaaugugaaagacaagagggaguagccucuaaggaaucucgugggcguuguucuuccucaaguuggaaauccuugggaauuuugccuagaagauaauucuagagguucccuuuuuaacacugguuaugguaaaggggguuugauugagccucugugaccuccguggaaaaauccaacaaauagaaagugaaauuuacaagggauuccaacaaaaaucaacaacuguuugcauagcuuggcaggcucaucucaaauauucauucuggcccugagagcuuugggucucugucaagauaauucaucuuuuauuaagaacaaaugcugaaaguaugagcuccauaaagaaaaccacugcuucuacuuuuuaaauauuuugauugcauuggauuugauguguguuuaugugcauuucuguacauauguguacauacgcucgugggcaugacucaacaugcauguggaggucagcagacagcuaagagguugagggugggaauugauucucuucuuuuuccauguggguccucgugguugaagggcaaucaucaggcuuggcagcaacgugcauggccacugagccagcagcguccuaguccugaagcugugguuucuuaauauuuaaggaaagaggcaggagccuagaaaagaggaacaccacguuagggcgagcgaccaugugcuucugagacuuccauggaagcggaagucacuggagaaggccaaggauacuuggugcuuagguggagagaaaagugcgaacugguuccuuggccuagaaaauuucugauucuugugguuuugcagcuguuguuuguuuuuugaggcagugccucaugcaguccuggcuggccuugaacuggcuguguagcccaugauggucugaucaaaugccuguuccucugccucuaauucccaagugcuguaacuggaaagguacauccauccaucgcucucgguaugagguucugaggcaaggacucuaggcauuuuuggcaagcacuccuaccaacugagcuauguccucagcccaagacguguuguuuuaacaucuugcugaaacacauuucucccuguggcucuucuuagacacagaagaguggguauugcaaauaugucaguuugguaaaauuccaugcaacuuacugcauaugaagagucuguauugcaucaugucaggcagcaagugacaggugacaggugaccuggcagcaggaauaauaauguagaauaacuuuaucuucugagcgaugugaagcagcugggaaaggcggcagugguuggcucugaccaagcucaggguuccugggugccuguguguaacaccucugaacucucuggcuuccuacaagaccacagcagagcuacuucucgccuccucagccuaucuugaucaaggugugcagagguggcagggggaaggagcuaggcuauggagcaggggagagucccaacaggggcugugucuguuugaaauuucccuagaaaguccaucgucuugauugacugucuuucugguguccauguguagaaccaaaacuccuaaggaagauggcaucuggcaggaagaucauguauuggccuguuuauucuuacacucagugccaagucauagauugucuuuuuagaacauauugauccucacugccacuagagcuauauucaccccucccccaaagccuagacuuuaacucccuucauaaagcacaucuggauguuaugagaaugacuuuguaaacacacuacugagaggugcccuucuggacuguaccagguaggaucuucuugcauccagggcaaaccacugaagcuuucucugcaguuuuguuuccucaccugcaaaaaaaaaggaaauugauauaauggugcuugcuuuuaugcuuacuuugcaaaguaaaagaaguuuccauauacaagaaaaaaguaaaaagcaacugcagaauuaagcacuuauuagccguguguguguguguguguguguguguguguguguguguguguguguuucauugauuugccuauguugccccaagguuguguguuaauggaugggaaucagagacacucacugcccucccucccagacaguuguguuuggcccuaccacuuacauuccuuucuccaccaguaccuccaccccccacccccacagagacugacuuuguuuccauuguucuugcauguguggagaaugcugcaacuugccacccagcauuccugcguuccacuuuuuggauugcucuucccuugccccuggagcuguguucucccgcaguccuuagaccuugucuucugcagagagggcuucccugguaucuguccucauuaggauacuaccccccagcaucucuagucacauggguggcucuuuugcucucaucccaauguguaguuguaccuuccauuugcacauugucaguguguacagucccuguagaugggauguucugcaggacauauucuguuuccuuuugggaccugugggauauccagcagcuauuuccagggguuagugggcucagagcgaauagccuccguacauguaggcucagaggauguguaaguugacuaaaugagauguagccauuccaaguaguaggagugauaccuuucuccuuucugacugguggaucaugaucauccuagcuacauuuauuccugcccccuauuuuucucaaccuucuaacaggaacgaaaaggaagccaacaaaauuaccagacaccccuuuuagagaaggggugucucucugcauuccuacuugguaucuuuuuugaugguucggaggaggaagcagggucuuacagccuuucucaccagaccaguucaaugaggacacuugccauauggacgugccccaucugcuggcugcaucuggugccuacauucacaguggauugggaagcccuguguaguagcaaaugcuggcugcaucaucuuuaagaguggccaacgcuauacaaggcguuggaaccaaauuggugguccugcugauguccagaaugaccaugaaucaagaguuugcuuuuggaacacacauuuucauaaucacagcagcagacugaguucauucaguaagcauuaccaagguucacacuaggacacaagggauaaaaugcagagugaaaugccaucauucacuguuuuguuguucucuguauguauuauguggaccaagguuacagcauguagcaaauaccuucugugugagacagaugacagacagagagauguggcacucucaugccccacccccccacgccccccccacccccgcuuucgaggugugaggggacuuccuuugugaaccguaaguuuuaagauaacaauuucagacaucucauggaauuuucuggcuuucuuuucacagcccccaaauaaggacuuaaauuuccuauaaggcucaauaaauagauagaauguguugcuuugcauaaauaaauauaacuauauuaaaguggcaggcuguuuccuuugucaauaaauguuuuaugucguagccuccaugccggaguaucucguguaaauuauggauuagacuuggaguagcccagcaugggcugcccguugaguggcagcaggccgcucugugacauucacagaugguucuccacugcagacugggcuauagaugcccauggucuuauauucagggcaggaaaggaguuugaguggguagagggagggaaagaagcccuugggaaagaaacccaauguguuugucucuaguauggcuaauuuuacagaccacaugaaauguuuuccuaccaaaacaaguacuugguuguuguuggaggaggcaucucuucccaacaucccgucuccuaugaguccuuucugacgucuagccacuucaccuggauacaaggcauuacuaucacaguaguuacuauugugauucaguaguaacuauugugauauauaucacaaggguaucuauugugauaguauacuaucacaauagcacagugauacaguaucacaauagcaccuggcuccuggggacagguaagggacaucacaaaggaagcaaagauagcucagcacuugccaauucucucugagaaagugcagcccagaguuccuggaacuucucauuugucauaagaagucuaagaucucaauuuugauaggaauucugcuaaugugaaaauguuaucggggccuaucuggagugaaccaaauguaucagugagcagugcuguacucuaucuaaucgguggcccaaguuagagccccuguuaaaaauucaucucugcuguguauauacacaucucguguuuacaaaggacacuacugagucacugcuguguggucggaaauauguuacaauacauacucaauaaaaucaagacagcucaauaggaaagaaauguacaguagugucccacaagaguaaagucacugagcacccuucguugggagauguuucccuuccugaguuugcuuaugcuaggguugaaauagcccagaaguaauaugugcacauaaacucuuguccugaauucaguuggguauuuuuuuugucuuuaauuucuauuauucuauagagauucaucuaucauccauuuggaauuaaucucuccaguaucauauccuucagauuucuacaucuggauaaguaagaaugauguuugaaaucuuaaucugauaaauaauucugagguuuguuuuuucuuguuuuauuuuguugcguugucccuguuugaggucagagcuagcucuguaacccaucuggccuugaauuugugaucaucuuucccagcuuugguacugugauuacaggcgugugcuacuaugaguagccuucucaacccuucuauuauuuccguuaaauuuguuuugugaauaaguagccacugacuuaaucuuccucaucauuaacacauagucucuaguaagaagacucccaggggaguaggggaguaauccugaugucuggggcuuggggccuaugugaucccugggaggauuucacaagagugggugaacuaaaugaacauaccugccauguuuaaugguugcuugcucggaauaguuuacacagaugaccauauugggggagaaggagggaaagggggucagaauaugaauguaccuggaaaucagcacguaugaguucuauguuuuaagauuucaugguacuuuauuuguauuacccaugagcaccauaaucuuuugugugaaugaugcuuugaaagagauuauuucuacuuauuucugcaugacaucgaagcugacagugggagaccccacugacauuaacagaagcucagguugugaguuuggggguggggguggggcaucuucauguuguuugcgauccucucaucagcuauagaacuccagaccugccagccucagucuuccauggcaaaauggguuuacugcaugaauuugugugccccccccccagccccccaauccugacaacagacugugguaacaugugugaagcugagcacauauguguguggucaaucaguggucauagcuguuuuauugccuucauuaccacauuaagguaucuuuuuaugaguguguuucaugagguuucuuuucccucuucuguggacuuaccuagccccuucauuacucuacauuggacuuuauuguaaaauacagaaacagaaucuguguugugugaucugucuuuuuauuuuucugcccuuccaguuuguuucuaggggaucagcagcugaugauuuggcccgcucugaccccacacuacuaucucuguugcagcaugggacauucuuggguaguugcucuaauuucuaaauuagucuaagaagaagauggauggaaacugacuugguuagacagagcccaguugugaaguuucuuuuguuuuggcucuaguccaagcuaauuccuuauaacuagaguuccccugcccaccucucuccccuuagggauuagaaucagcaggauagccuagucacuguagcagaaaauaucuucaauugcuucucccagcucaagccuuacagccaucacuacaugcagauagucauuacuuauagaagggcagaagcgagacuccugggcuuuuccuaccaacaguuuuguucucugggaagagggcauccuggcugucuuuccuguuuucccagaccacuaccacagccgacucguacugcaauuaagucauuuccaugauuucauaucauguuuuuuuucccacacccuagagauauacaauguuaaggcaagauacaagcauucaugcuguguaugcauuuagggaguuggggaauuuggcuuuuaauuacugugaaaauaugauuauuuagggacaaggcaccaucucugcagagccuguagaauuuugcagcaccaggaauaggggcucaugaauaaggacuagaauaaguguguuggcagugccugcaugaagggcaaggggugugaaccguagcaguucucugcauccuucauuuaccccagucaguuuguuauggcgcauucuugccucacuuugcuuuccugucugugacauggguucaugccagcugccccucagcuauggcucagcaggcaucuucaaugguauaacaaaaccaacuuguuaaggggaagugcuuaccugcuuagaccuccaguccuuaaucacucucauuucccaggcaggaagaagccuccggcuuuguuuugcauaaagucccacagauuuaacuccagcucacagcaggacaccuuugguuucuugagaugaauagcuguggcuugugccuuuugcuuuuaaaguuuuuaauggccucuguaacuugcaacugcugucaguauuguaucuccagcucuagugcuccuggacacuuguccuguagaucccuagcauccaagagggucaaccuucccuaguagaauuccaguaagaauuaauuccaguaagaauuauugauagguugguggauagacaaauguaugaagagaaguguccuuuuuguuuguuuguuuguuuuuuguuuuuucgagacaggguuucucuguguaguccuggcuguccugaacucacuuuguagaccaggcuggccuagaacucagaagcccgccugccucugccucccaaguacugggauuaaaggcgugcgccaccaccgcccggcugaagagaaguguccuuaugcccuacauuugauuugaugucucuucucuagccaguccucaugacccagaggauccucauucacaaagggacacacuauggggggaagcccuaugggggaacuaaaggcagauuguaggucuuggccucaaaaccucuugacaagucagaaaaguaaaaaucauauaaagucuuaggaagcaucguuaaaguuugugucuuccagagguagaacugagugugcuuuugguuggcccagcuuguguuuucuggaacugggaagaaugccuuauacaaaggucagccucagaaagggucuugugucugacucagcaccacaaagauagcuaugaccaauguuaggcaugucucugguuagaaaaacacaacaggauggaaagauuccauuguagucccugugggguccuucaagcuacagcucacauagcuggcccaggacagccuauagaucaguuguugucaaccugugggucgcgaccccuugggagaguugaaugacccuuucauagggguuacugaaugccaucagaaaacacacagucuacauuaugauuccuaacaguagcaaaauuacaacugugaaguagcaacaaaacaauuuuauaguuuggggggagggggcguggugcggucaccaaaacacgaggaaccguauuuaaggguuguagcauuaggaagguugagaaccucugcucuagauggagcaggaccaggaagccccagaagcaaacugccucaguuuauaccuucuguucuuaaagugaauuuagacaaacuuguuguaugccuucauuucuacuuccauauacugggggaaauguagcgcuuucuaagccugcaaucccaacacucaagagacagaggcaggaagaugaugaguccaagugcaggcuggcauccauccugugauacauguauacuuuccugugucaaggaagggugguauggaauagggcaugcacuacugcucaucuugcagugguuugauagacuaguuggcuaaauggacaugucauauauugucaacagauacguguugucauuaguagcacuauguugacuaguugcaggaguuucuauggaaauuucacgcaagcccuauggcuucuuuccuuucaggcuaucgugucugacuacaugcuuuuggccccaacucuuucuaaaaggacccaaaccuaguacccagagaauaacacugaucguccugccucuuaccuuuuaacaucuuaacaaggaguacugagguaaccuuaaaagugucugguaguccucauuguguagugggcaugcuguguacacaggcaugagauaaauuaaauggugcugacagugugugugugcgugugcccagccagacacccagauuucuuagaucauuuaagcacauuucguguaauggaacguguuaugacuucagcagcuuccgaauaagaguuagaggaggggggaaaaauaaaaucugaacaguugcaccagccaggcucccccagggaguuauuuaaggcagcuugggcacuccuguggaguuagggcuuccucaaagaacagccacuguucuuaugaaagaacuccagccccucccgaccccucucuagggggagaagaguuccuucuuuuauuuuuaggucuuaggugagaaugugagcccagaucuauuuucaugcugucuuccuuucucugcucacuuggagcuagccuucuuagcuuaguucuggucugauggugucuugggcaggugaucugaccacuucacauuuggauucccugauuuucaucuggcauguuuagacuaaaagacuuuuuguggcgccuuccagcuccaaauuuuuucaugguuucccuucuuuauuguuacaggaugcacaaaugccguaacuuuuuuuuuuuuuuuuuuuuuuuuuuuuuaaagauuuauuuauuuauuacauguaaguacacuguagcuauccucagauacuccagaagagggagucagaucucauuacggaugguuguaagccaccaugugguugcugggauuugaacuucggacuuucggaagagcagucgggugcucuuacccacugagccaucucaccagcccccacaaaugccguaacuuaagcauaagauaggggagucuucauugcucauauugaaaacguccacuuuccaugcccgccuuucuuagucugaacuugguuacagcuguuuccagacgcguacacucccuuucucauccucuuucccuuccuaccuccuucuuuuccuuuuccucuuccucuuccucuuccucuuucucuuucucuuuuucuuuucuuuucuuuucuuuucuucuuuucuuuucuuuuucuucucuccuuucucccucucuuuuuuuugggggggggaguggggguaagaguaauuuagcuuuuauuucuacauuucuauaggccuugcuggaugcauggucauuugaucucagugcaaacuacccauaccuggauauacacugacauucuugcuguuggcagguuuuggaagccugcagccaggguccuaaggccaucugagucacuguuaaugaaccaaacugccugaaaggcucuagcaguugccuuuuggcacuuggcaggcaaaucuuuuucauguuagcuucaagguugucagauaucauuauccccaaguauuaaaauuuucaaagaaaggaggcaguguguuugauuuauagaauaauuaucuagcuucagcucuaacuucgcuuuggcgaugguuuugcaagcacucgaaaauuaaauccauuuuuuauggcacuacaagguauuaucucacagcaaaugauaauuaaacaccugugaaaucaauuagcccuuuaagcagggggaaaaaguuuuccaauuauguuuucacaccuccaaaacuuuuauaacuccaaacucaauacuuguggguaggaguaugguugauuggcuguugcuaggugaacuucccauaaagaucaucccuaaauuuugcucagacuucauccugagacaguuugugauagggacauauaucagcucugcauaccuauguguguguaugacacagcugaaccaucugcuucuccccaaagccagcuccucacauccgcuucuccccaaagccagcuccucacuuucuguuuugaugccaagguuuacuuggagguuuaucuaaaagccaagaagucuuaauggaaauggagcacuaggauguuccacaugaccgcucuugaagggucccauagccauaaccaucuucaguucagauucacacucagauaacagaccaauuggcgaauagcugaaacuuaagacaguggaaaaccagggaucauagccagcaguuuucacuuacaguauccugugcaucaucaccacugacuggccuugguaagaaauucauuuuucuaaacgccuuuagaaaaugaucuauacuucugaagcacuggauagauuagggcauguacaccaauguaauguggaccucaaaacaaacaaacaaacaaaaacgaaacaaaaugagcccaaagagaagcaugauauauuugacauccucuacuugugauucaggucagaagcuguuccaagaagguuuagccucaucuguucugauacuuagagguacgucaguuugcucaguguuuucuggcucccugccuugcuagauccucaguacaccuuguuaggaaggcaagaccagaucaacaacucucuguuuuauaaaugagaauauauuccauagucaauacgacuuccuuaugauaaaucaggaaccaaguuaagagcagaaacuucacugugaauguuaguuucugcaugcuuuaccauaucuuuguacauaaacauguuaaaggaugauucuacaauuuuuuuagauuguuccugaagacauuuuuaauaugcacuugcuugucaagcagaugacauuuagagaaguugacaaaucuuaacauuagcuggagaaauauggcuagcauuucaggaaacaagaugaagggacuuuguaagaucgguuuggccaaguacguggcuuucuugugaacugcuguuagcagcugaacgcuuuauaaccucauaagcauuauagacccugaagaaugagaugaggguagaaugcucugauauuuguucaacaaagacaucaaaaaagaucacucuaggucagacauguccucagcaauaguagugaacaacaguaacaacaacaacaacaaaggggcaugugugugcuuguuuguauaauauauauguuauguuugggcgggaaagaacaaugaaccugccaaaaaaauaggggcuugaauuuaagucuucaaugccaggagagagcugaaccaaggcagugggaaggucggcucagaggccaaucuaggagccccugucugaggagugugcacacugaugggcaucuugggagaagucuggaagaagcauuggcuuagggcacagcaaguaaauaaugaaaacagguguggugcucugagaaacugagaacacugugcguauagauggucaucaagaaagggggauguugaagcaauggguagaggauaguauucauggguccccauaucuaccggauaggaauauuguucuuaguagcuggaggggccauugggauaauuuugcccagaguaugacauuuuagaggcuucuuuagucauuugauagagaucagauuuuaaaggggauuacagugaacuuggucuguuuuaaagccaauagaauaggaauuugaagugcuucuuuucucugcuuauggugauggaaagcaggaagaacacugcagaagcaccagaggaaaggaugggagcacacucuuauuucugcauaaugacaaauucuauuaguaggcaguccuacaccacucugcauggcuucccugggacacagaauacuaccuggcguacaggaaccgcucaguauuccuuuguuggguacuuuuucaucgcugcagcaaaaauacccaagaagauaauuucaaagaaggacuuuugcaaagaauauauuccaguuaaauauucauuacauguauaugugugcauaucuggcuauauguauaggaaccauauguguacagggauauguagaggucuaaauagugcugaagaggucugaucucugagaacaggcaguuauaagccaccauguggauguacucaaccacucaaucucuguagcccagagaauuacuuguuauaguuuagcuuaauuccgauauauuuagcaguaucagagauuugaguuuacagaucuggguuuguggugaagcaggaacauuuggaagacaugaaucugcucacaucaugguaaacagaaagcaaugagagauaggaggaggucagaguaagcuguaacccucagaaauaugccccaauuauccacuucuucugauaaggcucccacuuucuaaguuuccacuguuuuacacaaguaccacuacuaucugggaaccuguuuuuuguuuuuuuguuuuuuaaacacaugaggcuguucaaaucuuaauauccaaagaugccagagcacaaaggcauccucagaaucaucuggucaaccuucccccacucccccacccccaucagcugcaucaguuuucccuguucuauagcacuguuucagaaugagacuucucuuuagcagcuucuccagaggacuguagaaaauauagccagccggaggaaggagaggucacucagcucuguagacuugucucccccagugugaauguguuuugccaaaggaaauggcagaauccagacuuuugaaccuucccaguccuuaugaacucagcuauccuacaauaguggucuguaacaucaucauuauguaacaaucugauuuuuuuguuuguuuguuuguuuguuuguuuuuugagacaggguuucucuguguagcccuggcuguccuggaacucaccuuguagacuaggcuggccucgaacucagaaauccaccuaccucugccucccaagugcuggaauuaaaggcaugcgccaccaugguauuuuucuuaagcaguagcacaaauguuuucugucauaggaucccauuugccuuugcacauguauacacccccuaccuuuccucuugacaucuucuuuuaugaaauuuacaucuuacaucucagugcccuacauuucucaagcacuugucauauuaauauaugccaacccaaggucuuguuugcagucaaugucuaaggcccgggacuaaguuauuccuaagucaaaaauugaaacucagugauggugaaaguaggagaggagaugggaagguuaucaaagccaggggcauucugcaagguauuuuauaaucacuuaaguguggggaucagacagaagguuuaagcauugacauagagcacaguaugucagacagucucugucuccauccccgccuucccuggcuaugagaaaagcccaucagaaauuccaaccauuugccuuaucagagggcagaugggguggccaggaaggaaaagaggucuuugcuuugauggaaagagaagaacuuagaauauuaggauugguccguuucuucugggaguggagugauuuugucuuuggaccacaucaguguuuguuauugaagaagccaucaggggggcccacaauuguucuucucagcucaggcauggagggagcgcaggagaguguucacugagagcaccacucugcaugcauuuaacaugacuuucaaauaaugcuauuuaucaggccuggugaagcacaaauuuccaauucccaucacuguucaaggagaauguaacuuuuuaacaaguugccagaccuuuagaaauaaagacaaaaugugcauggguauugccugugugcauauacaugugcaucacaugcauaccccgugacauggauccccuggaacuggaguuacagacaguuaguuggaagaugccauguggguguugcaaauugaacccaggucuucuagaggaacauccagugcuucuaaccacugagccauuucuccagcccugagaaaauguacaaaaggaaaccaggaagaauaaaagauugauuuuuguuuugcuuugguuccauucuuaaaguaaacccgagucccacucaacuuguagcuucaccucagcuaggcaggcuugguaugaucaagaguugauauaugcuuacuggcugaagcugaccuugccauaauacagaguuacgucauuccauguccccauuccuucuguaguccaugugccaugaaguaagcugauacauaccagccauggguaaguaggugcugggccaagagaugguagagucuaagcccugacucuugaagugauaaaaaugugcaacuuagucgagugagaaagagagucaagaugggguccaggacuugaguggccauaggagcuuacucuuggaagcaggaauugagguuccacagaaagggaggggagccugcaguguucacauuugggucucagucauccucacuccuaucaacagggcacaagcuguccuaagaauaucuacuccauacugucuauacuagccauaucuucuuagccuuuauuuaguccacauuuucuugccccguuccacuuggccaucuccuguggcauggcaccaagggaaagccuaaugauaaaauaaugaccuugggcuuccccuugcuaaguagccugcuauauaucuuuucuggaccauuuuuccacccaaggccauuguugcagcugguucuuuuauugucagugucuccucuuuucccucugugcccagguaacccuuuauuuagcacugucagaaaugcuucguuucuaaccagagaauuuagacucaugugucuuggaacugcauuccucucagaauagguucuaaaaucuggcacugaaaguauaagagcggacgcagccagaccugugucauccugaaagcuucccaagauuaaugucacagggugcaauguguuacaaaucucugucuucaccuuugcuaccucuguguuacuuuuuccuucuagcaaaaacucugaggcccugugcuccacacugcaagcucugcucuccuuacccaggcuccacaaagccuugcagcuccgcuccauugucuaugaaauggggcagaagcuguaccugcuucucauggugguuuuaacaguaauauacaaugcagaguauggauuauggggcacuguacccugucuacaggaaaggcuuaaucaguaaaauuauuaguaguauaguuauuaacagucaucguguuuauucaugucuuuguguauuagccaauaagcugcuauuuaaugagcaguagcaaggaugguauuuuugagacaaggucucuuuauguaguccuuacuauucuggaacccacaauguagauccaucugcuucugccucccaagugcugggauuaaaggcauguuccaccaugaugguuuucuaccucuuugagauauauauaaacauaauacaauauauacucaguacaugcuauaucuauuaauauaugugaguacugauuaccacauuacaguucugaacugccagugaucauucaagauaaagaugcaaugggaaagauuagagucaacaggggcuaugacccaauguguuuaagagcauauuugauggcagucaucucuuuccccugugguggaagucaggugucaauauauguuauguagugauguaucaaaccuaugcccauggugauacacaugagaauuaaguaccucucacugggaccuucacccacagcaugccaccucccuccuccuguuccuguagugaaagauuuuaaguuggcauagaaugaaaauugucuucuguuugaagccaggaaguaugaaagaaugcauguaaguugucugcccuugguuuuguacaaacauccugucugcaauggagagccuagaauuggcaacaucacaccgagaucacaaaggaagugauaccuuugauauagcuugugacugguggguugguugccuguugaauauucagggcaaggaauugcaccaccuuuaaguagcaaccuuuacugcaggggaguugcuggcuuucccuaagacugucgccacucugaucgaucacauucagagugcaguuccacguauuugaagaacugauugacguguaugaagcagcucagcuuugugcacacuuguggguguguaucagccagcaauucccacaaguccaacagauccuccaugaccccugggacccauacuucucugugccauguugucaaaagaacccagacaguacaguggccagcuggaaccauuuuccaacucccaauucacguuucucaguucagucagugccacggaucaauuuugugcgaucccauguccugaccuuuaagauuucuuuucucaaaaguaauugaaauuuuaaacauuuuaucuggacuuaggaaaggguaucggaaacaggcuuagaaaacaacagaggaugccccccccccccacacacacacacaagucaccuggagggaaguuuugaggagagaguccuacaaagggcaguugcacguugaagaggucagagaugaacugcucacuaauuuucuuaaugagaauuguaugucuucagacauaugacgccaugugggcugaccagaagcagcauuguuuaaagaaaagaguuggggccuucuuacauuuucagcauuucaccucugcccaugaaguugagcuguaugguuggugggauacuucugggauccugucauucuuucgcuugaguucuucagugacucagauucacucucauggaauaaugucugagcuccaggagguagcaagcuuaucaucuccuuaacccccucccccugcccugagcucuuuaaccauuccugacccacuccaaauuggguguuuucccuccccauggacccuuugauccugauggacuaccauuagccuagaaaugcccaucuuccaguguuuguagcucuugcuccgucaucagugcuuagcaaagaguccuggaaaucuucgagauacacaucccuguucucaucuuccucaccaaugccuucuguagccacccaugccuuaucuucccugcccccccccccccgcuuccauaugaacaucugacaacuucacaguguuuucacuggaccacgaucuucuuaagacggaccuaacauguggauggcacacacgcacucacacacucauccaagaacagagaugcacuagucuguauuuccuuuuccucaucacagggcacucuggaacuucagccaccccaaguauuagcuuucugauuuuuuuucauaagagaugugacucaaaucuggguauaaacagagaagaaucauuacuuagaagggacggggcuggcagaaaaagagcagcugugauguucacccaguucauaaguaaauacucgagacaaacuaucaccucaggcagccuggaauugugugagucugaagauuagaggcucauugcuggcuucuugccuguccacuguggcuagcgaaaaagcaggaucauuuggccaacgugcuugugagagaggaucugugggaacccugggaagacagcaagccacagcagcggcuuccuuccuuguacagcuucugaugaggagaaagcuuuuaaacuacacacugcugcuguguggggagcugcggcuucugcuuucauuuucuuuuaacgggucugcuccucguuugucucuuggcugucuuugcaaaacuguuuuuuuguuuuuuucauuguugguaguuuuuaaaaaauguuuauuccauuccuucugauauaauuugccauaauaaccugcaauugcauacuacuuuccugauuauacugcauguacauaauuucauuugagcuucacagcuuugagacugacagaagcuaagagaugugcaugggggucucgcaggagagccacacuccagauucuucagcccaggucuccucauugacagcugccuguguuucugauaaucugcuggcucccuucagcugaagugauuacagcuaucuuuugcagaaaugcucauaaggugcuguacuuuaauuaaaauguaucguuuggaagccgggcgugguggugcacaccuuuaaucccaguacucgggagacagaggcaggcggauuucugaguucaaggccagccuggucuacaaagugaguuccaggacagccagggcuacacagagaaacccugucuagggagaaaagaaauuaaaaagaaaaagaaaagaauguaucauuuggucaggucaguagaaggaucaaccccuuuggaugaaccaggaaacuaagcccagacaaauuaguauuucccaagauugcccaguuuguggaugguaagcauagacugugaacccagguuuggcugcuugaccacugagcucuuguuuacuaaguuuuuagcuaccaguucccugcugcacaaaauguacugggcauuacaauggacucacauagaauccaaggcucuuucccaagaguucuggauucagcaggccugggugauccugagaucugugcaguucccugguaccacaggugauacaaguggcagggacaacacuugguggaaugguaugaaccacucugucucccuugccuagucacacugacucacuauuagugagucaucuuauguggugagggaagacuucaaauaacauuccauagcauaucugaaaugggguuauauucuguaccuuauucaguacaacucuaggaagaaaacuauuauaccuauugcaugguacuggcuuccagguuaaagucagggucaugucguuuuuauugcacauuuucuguggagccacuuagaaaggcucuucuaucuccugcaucauuaccucuggaguguggacuguaaugccacaaaggggagacaacugguuuaccagcugaagcugcaaauucucugaaagcaguugauaccucuccugucucacuguguguguguguguguguguguguguguguguguuuuaaguuguaugugauuauagcaugucuuacaucuccugacuuaauaagaugaacuggucuacuuuagaagauugucuccccacuugaccuauaaagucugucucccccaccucuaaccaaugguagcgacuacuccguucuccggccccgucguuauaugcugucacaaguguuaugaaaauggagcaauguaguguguacccuuuagaggguggcuuuggacucggcauuagcauccucgagguccuuguguacuuaaguaguuugauccguguucuuuuacuucauuauguuuuauucaucugagaagugaucuaggcuauguguauaccacaaucuugccucauucauacuuggaaggguauccaguguauacauuuguggacaguucuccuauguaaaaaugccuucauuucucugggauaaaugccuaaguacagugcugggucauaugaaaaguccauuuuuaguuugagaaggaacugccagauuguccccaaaacagccuuaccauuuuccucucauuguagcccccaaggaagagcucuuguuuuucuuguuuuccauguuucuaucugugcuuguucucauguguccucuuagaucauacacuguccugcagggagcaaguggcaccuccuuguguuuuggguugauuuccguuccuucaaugacuaacgauacucaguaucuuccuguguucuucuuggugcuuuauucauuuucuuugggaaaaauaucaguucaaauuguuagcccauguuuacauuggauucucuuauuguuguaucagaaguguuuuuuccauagucuagaccaguguuucucaaccugugggccucaaacccuucggaggucacauauaauauacuugcauuauaauuuacaacaguagcaaaauuacaguuaugaaguagcaaugaaauaacuuuauguuuagggucaccacaacauaaggaacuauauuaaagggucacagacuucggaaaguagagggccaugguuuuagacaaaguuucuuaggagauggaugauuugaaaguauuucugcuucaggagauugucuuuuucccuuccaggaaggagcuucuagaguugaguucucauaggcagagauagaaaccuguauaaugagacaagccaugacauagaugccagucaccgaaggcuggggagauuuucucagaccuuguacgcgcgcacacacacacacacacacacacacacacacacaccaucccucugucuuaugcauuuggcacuacucaagaaaguuuaaaucaaacuguuggguuuuuuuuuuuuuuucauuaauaaaguguugguuuggggagagaauuccacagggucuggcuaugucacacuggagugaugauucuaguuuucucuggugauggggaugacuuuaagagauuuuacagccuuuuuuguuuguuuguuuguuuguuuguuuguuuguuucuucaagaaaggguuucucuguuucguuuugguuguccuggaacuaguucuauagaccagcuggcuuugaacucauggagaucagccugccucugccucacugcugggauuaaaggcauaugccuucacugucccgcuugagauuuuaaaucuuaucaauuagguucaaucuugggcagauaaagcaacugccuuuggauagugucugucugaaugugacaguaucaucagaaguguuuuuuuuuuaaggacacaugaauauaugcucagguucagugaagcaagagagcaucacaggagaccgaguuaaagaauuccaaagcaggaaaugccccaagugaagccaguaacuggcccaacuaaggucaucaucauccguucucuugaaacaacucaguauuucaugaauuccucaaccauagaaucuaaaagagaaaaagguucaugggcugagcgugcuuaaaaguugcaauggaaaauauuucuuucaguuaccuuucuaugaauagacaccauaaggacuugccuacaguuuuauagggcgaacucaugaccaucauggcauugaauauggcagcaggcagacaaagauugcacaguagcugagagcuugcaucugauccacaaggagcaauuaggggaugguggaaugaaacugggccuguugugagacauuugacauucaagccuaccccuugugacauacauccugcaacaagaccacaccuccuaaaucuccccaaaucaguucuaccaacuaagggccacacauucauauauaugagccuauggaggagcauucucguuuaaaccacacaauauuguuguaaguuauguguguauauauauauauauucuguacagcugucuuuaucuuugugacuauauuuggcagacauuggagcaauugugaauguauacaugcaugcuccuccuagaaagauugugaaaaucuugguggaauggucucaaaagacauuuuuuuuuaaaccuaaaaccaacagcacaaagaauagcgggaacguagaagcugacaggagacauguaaucugaguggcucuuuauuucaggugaggaaacagaugcccugaaaagcacccguguuaagcucauggccuccgagcaggaccuaacagguucagggugcuucccucaucucauuauaugaaugacuucaagcuucaauccugugcuacaucagcaacuaaugcuucuguacaggcacuuaaagucgacacccccuguguaacugucacuugacuuucucccgggagcuuuucugcccuucuucucccuccacacacucuagaaaguaaauucugcaaguggaaacuuugaaacuuguuacaauccaagacacuaauaagauuuuacauuuuuagcagcuuaaugaugaggauguaggacucuucuggucccuccgggguuucuauucucaguaucuuaaaccuugcaggagucugaaguauauucgaccuuucuauauuaaaaaaaaaaucaguuuaacuuucgcucaucaauuugugucgguauauuccccccucuuuucuaccuauuagguaaaauucagacauuaucaacauuugaacuugaacauauuugucaauuauuuuucuguguuugguaaaaaagagagagagagagagaaagcgagagaagucauuacagucguaauuuaauauuuuuauuuagcugaauuugauccuucuuaaaaauccuuuccacuuugaagucuauuuugcagcuuaauuaaugcagcaagggcuuuuuauuuugcucucaauggagauaaucuuaaucuauucacagugaccuuuucuugugcaaauuaguuguacaugcuuguuuaagcaaaugguccuuugcaugaugucucuucuuaaugacggguuuauaauugaaaauuggcuuacucccauaugccuaguuuauaugagaauauaaaaauagauguggacuuuaaaaauaugaauguauguaucaauaucccaaaaaaaguagagggaagaauccagugccuccaggcuaugguuaaauuagacuauuagaguuagaaaaugccggugacauaugcuacugucagagucacaccugucugcgcuacauuggaagugcuugagaaaugagagcgauuucaucuuggcugugcaacucagagccuuuacaggacaugaggcaucucuagcuucccgaguucucuuagacucuuaguuaagucgaaagugcgugcuuaggaauguauuugguauuaauaacuuuuacagggggagccucaaauaauuaaaugcuuuuuuugguccugagucucacugacaauaagagacaggugauagucauguuauaauuuuucuggaguccccccuccccccaaaacaguguaauaccauuaaauggcauuugaguaaaaagaauaaucaccaugcucuaucccaguuugcaguucccccugguaauuuuuuucuuuguucugccucugccucauucuucacaaaggcuuucuucugcuccccauccuuggccucccaugcccuauuccuccuggcccccagccccgagucuuuccccaaaagucaaagcagccauacuuauacacagcacuauuuuucuggaaucacuaaauguucuugguuaaauguagaaacuccaguucgaagagaaaacaaauguuggcuugcgcuuaagguggagguuuccgaaguaucuuuuaauagcaugguguggggaacagagaacaagaagaacauuucguguugcugagugguguggcauuaagggagaagcagauguaucaggaaugcuucuuagucuauggcagcaaacuguuucgucaagcgggggggaggagggaaucuggcuagugcaugcaugccugcaaccagcuacagaucaacagaggcagaagugaguggaucucuguaaguuugaguccauccugcucugcauaccaaguucuaggccagccaaggguguguaaugagacuuucugugcaccccucccccaccugauuuaggaagcagagacuaggcaagacaaaugguuaugagaaccauuagaccugucccuuuguuuuuguuuuguuuuggguuuuuuuguuuugucuuguuuugggguuuuuuuuuuuuuuuuuuuuugguuuuucgggacaggguuucucuguauagcccuggcuguccuggagcucacuuuguagaccaggcuggccucgaacucagaaauccgccugccucugccucccgagugcugggauuaaaggcgugcgccaccacacccggcuagaccugucccuuuguaaacuguuugcaaaagagauccuuauugcuucauacagcaugauuguuccuguuugucuuucccaugcaacaagcucuugccccacuaaaugggaaggugagaguagcccuuccucaaggcuuaguuauuugggguaaauuguuaagguaaauugaugcucugcucugaaccuccaucauccguuuuuccuccuggauuugcacuugcugaucagaccucuuauuguucuagauaugauuaucgggaaaugcugcacaaugccacuuucugucugguuccucguggucgcaggcuuggguccuucagauuccuggaggcuuugcagguaagagacuaugaaaauuuaccgcagcagguugaagauuggagccaaacugguuucaagcuuuucauacuugucuagagucaaaaaaaaaaaaaaaaaaaauaagcccagcuuuugcuaaggaacuaaaaacacuucccaagaaaaucugaaaugguuuugaagagccagaauugggagcaagauugacucccugauuuuggacaugagagcaguuaguaagcggucucaccaccgggaagacuggauucaucaggaacauguuugcagacagagggcagaugggcagaucccauugcuaacauuggcucuugaguuuggagaugggggucucuccuuuuuuccugucagccaaugucaggagcacacccagcuuugggauuuuuugguuugcagccugucuucuugaauggcaagagaaauaugcccucuaccuaccuaccuaccuuccuuccuucuuuccuuccuuccuuucuucuuuccuuccugcaauaauuuacaauuugucugaaucuguguauuugagggguguuucauagcgccuucauccugucauuugaaccguaaguccuacccuuuccucaggcugaagagcuccugucucuggcagagcacuuccggugcuuugugcgcucugaaaagcguaccuucacuacucacuagcauucuggaagcuucaugggugccauagggagcaaauugcucucuggguugaauaaagacuuccuuggcgacuacauuucgucuucagccuguugacauccuagugcagacgggaaacuaguacaacugcaguuugcacuacacacuggagggaacaagguuuugaguuagaugcuuauagaaaaaggagagcuagauguuacaacaguuaaguccacaaagcucuaccuagacagauggaccccauccuguuccccacuggcucaugacauuggggggaaccaugaugagauguaucugaggcacuuccauugacaaaaugguguauacucaagguuuuuaugcucagauuuuuguuguuguuguuguugugaaagcuuucugcagcaaggccauucauccccauggaaguaaggucagccaaaccuauguacuagaauagaaaugggguauuagcauucuaaggcgagacuugaaaaucuucaagucagguagggaugcuugcagucccaugugaccugguaauucugagucacuuacuugcuuucuagccugagcaguguggggcccgugugacauaagcaaugccagugauugaauuuguacuuacucuucuccugauuggaaugguaucccugcugucgguauccucacacucaugaaauccuuccuuugcucaggcugccugugucccuguaaugcucagcaacggaugggaguugccauucuccgaagugauuaauuggaaccaagcugccgucauaggcgaugagagauugcuauuacagguaaggaaggggcuguggccuucggcagaagagcagauuauugcugcccccauccaaacuuucaaagaagaugaauccaaaaggucagcuccauaaaagaaauuuuaucaggagaaaauugccugugucauggugaauaugaagccguuuaauaugauauuguucacuuuccaaccccaaaaucuguccaaauccgcagaauauauugugggaaacagccauugcugauaaaguguaugagcuuuguugaguggggagagguggauccccaccagcuucagcaccagcguuuucagacacgacacucucucuggucccucggcucuauauucauucacucugguugacucugggacauaagcucuaggcuuguugcugugcgcaguguuaccacuaccgcaguacucaacccugaggacccgcaggagggcugucacuuggauagguauuuaaaagaaaggccccuaauaaaaguuucagucgugcaaggaaagggaacucagccugcccagagaauugaaugagcaagaaggggccaugaagauuuccaaagccccgcccccauccccuuacccccccuaccccacccccaguuguguuugagguucucuguaaacugccacauacucuuauaucacaguuaauauuucuuuucauggcauuaaauacuuuaucguuaaaccuccacaagguuguguagaaagauccucuccaauguuuguguuuuuaaaacaaaauuaauugauauccaagacaaggaguuucuagaugagcuucugcucuucuuccugugcuccuggcuggucugcuaauggacugcggaagggaugcagucaucuccugaaacucccagagaaugugcccgugauggagagcacuguggaccaauccagccgaggccacaacagccucccugucauucaguucucagcugugugaucuugggaccucugggaccacagcacaaaccuguggggauggguacucuggaaauagugaaccuguucuuuggacuuagcccauuccacucccuuuuaaaaaauuguuuauuuuuuauuuuauguacauugguguuuugacuccauaugucugauaaaggugucagaucuccuggaacaggaguuacagguaguuuuaaguugccaugugggugcuaggaauugaaccccugguagaaaggguauccaguacucuuaacugcugagccaucucuccaucccuagccuauucuguucuaaacaaaacauaauuccauagguguucacugagaaagguuuggggauuucgaaagguuaguguucauagcacugauucccugguauaauucaauagggacagccuccaagacauacuaagaaagagcucuccauguagacagaguagacgccugagucauacacucagugugguauguggugcuuguccacacugccuuugucuuucuuuccuuuuauguugcuuuaauaauacauagucauaaaggaaauuuuggauaugaaaaccaucagucauuguguucucaauuuuuuuuuuaaccaaugcauucuugaacuugcuaugaacaaguuggagucugucuuagaguagagaacauuccaugacacuuaaguaugguuauccugggcuacuaaaguuuggcuuuuucacucuuugaagccacauuuugacuugacucuaaagauuguauucuucacaccccugugcccacacuugcuaguauuuuuccuccucaucugcaaucuguuuuuacacagcugcuuccauauugaacagugacuguacgguuguuaacaaugguuuuaaagagcuggcacggagcccaaaugugugcucugggaaauguuuuuuguuauguuacaauuuuucauuuccuguuuucgaacagcucugguguuuuuauuugcauauguucuugucagccugucaccgaggagcguacuguggcuuuccuauaucuauuuugguagauccuauuaccacacauaaccuuuuauuaggacuuccaaaucauccuguccaaaucguaauuaauucaucacuuucgcauaccugucucugaggaaaggcagauuaauaaccaauagccaaaugccauuggaacuuagaacuccauccugccaaucaauugaagucauccuccacacaaacugguagaacucuagaagugggagaacaggaugucgccauggaagacacggggugguaucauuggcugagucuaugcaccucccuccucccuuuagaagcaccauggaccuggcuuucuggagaccauauagccaugguagcuuuuggcauuuucucguggccaugauaaaaacagccaugccaaucuguaugacuuagagaaugccauugucauugaaagggacaugcuuauaaaaauuggggaugaggguuuucccccccuaguuuuucuucggcaaucuaggucauuuucucauugagcaaauaaaaauaaauuuucuugacuuaucauggaucugugucaugaaugguucagcucaucuaagaauauuuuauuuccauugaccuugauccugccaguguuucaacuuuaccuucagcaucuguauuuuuuucaguauuaugaucuuuucaaagcauagacuuaguaucuacauugagauauuggcagagcaagucagguuuuccuucuguucuuuucacugcuuuucuuaagggccaauuugaaucuuagcaaugugcuaucaucuccuuucccucugaugagaacgcaacuauagugcagucccauauuuugaguaacuuuccuauuaaugugguuggcagagcauuucuuauguagcccaggcucccaugucugugugauucaucaugcauuagggaggcaagcaugcagaaaggugcgcacagcagggcaguugacaaucacaggaaucuaguguagauuacauaaauagaacagcccuugagcuguacguacagucagggagcaagccuggaaaacuuagccagaaauccaaggaaggcaucuuagaacuagggcuaagacaaauuuauagguagacuguaaacaacuggcccagcucuacuuaaaauaaauugguccaacuuggacuagcaucucccugugucaacaaugguaauagcaguaauaaugaaccaucauaauuaagauuucuauauguagacacuguacuaagcacccaaccauaucauguuaugaaugaacaauccaaaagagcaccuaauucauccaaggaagcauaucuaguaaauaguagaaccagaaucccacauugaugcccuuaacgccuuuaccuuacuaucaagcuaugcuacuauuaaaaauaacaauauccugaugagagcuucuauuggccaugcucaauuaggcucauuucuugaauagcuagcauaaaaacuauucucuuagccacaaaauauauagcaguaugaacaggaagaaaggccuuccuucaaaauuauuuaacuugguauagaacagccuaugaugaaauguuugagagauccagagaaaucagaguaagggcuggaguugagaggagagcucucagguguacaaaagguucaaaggagacuagaagaaggaugugcauguggacauggcuaaaucgguuuggguugagugguuaggcucaugaacagucuuuaaauagacacauuuauagauacuucauggucccuagaguggcacuucuuagaaaaggguuuguugguugguugguugguugguugguugguuuuguuuuugguuuuuauuguuguuguuguucuguuuguuuacugucuccaagaccucucauguccauaucaggaccaaagauuuuguggacuugaggaggaagaggagaaggaagaggaggaagagggaacgggacuuaggacuguaggaguccccuauacaacuaaccugcuaccacagaaucuuagagcugagcuaggccagugcacagucuccaugcauuugaaugcuguugagguugcuuuccuagaccuguuguuuguucugauguuucuuggggacauuuuuacuuagcaguuggugacuuugguggugagccuagccuuuacuggcuuagccaucauuucagccugggugaugauuuuuuaauagaccuguuuucuagaaaaugaaugcuaugaagaacaaaagugcaacccacugaguuguuuugaucaagcucaucucucuguuuugcaguuauaauuacuauguguuccccuuauguuacagauuccuucuacaaucaggucuauucaucaggauaaaauccuagcacuuagacagcagacacaguucuugugggaggcuuauuuuucuucaguugagaagauuguauuaacuacacuagagguaagugagaccauuccacucaugaucuuugaauaauaguucuuuuauugcaaccucuuuuuuuacuguuggguuguguacuuagucaaguaggacaaaaccaaauuuccuguccuugcauaguuuagugacagcucauccugcaaccccacaucuguuuuaccagucuuaagcaaaugcccucauuccugacaaauucucauaguagaagugacauggagagaaguuguacccuggacaaagugauuugucuggcauaauuucagagguaauguggguaaugacuaucuuccugucacucaaacucagugguauccuuugaagacauauuucuggaguaaauugagaaaaaaagauacugaucaaguaaggaaacuauccuccaccauucuuaaacuaugaacaguucaggggccaccauagggcacagcacuuuaagagacagcagaauugcuucugaagacacaaacaacugaaccagccaaccccauguuguaagguugugguaagaagaaaacuucugucaugguuguauccuacugguguugaaaauguuaaucuuuauaaaaguagaaacucuggcucaugaguggauaaacaucuucaaguugcuuuauucugucuguguguguguguguguguguguguguguguguguuggggggcaggggaguuguauugagaaagcacuccacauacacugagccaugucucauucuuuuaaauugccugguuuaaggcaauagcaaaauagaaaaucaugaaaaugauuaaaaccacaggaaguagagcagauagcaauggccucgggcuaugcagagcuuugcaaagagcuaagaaagcucacagaaaacugcacacucaugaguuuccugccuaugagcaggggagugaucagauugucuccugaggugacccuggaacuuggagaauggggcaggacaaucuacuacacacuuggagaguauuuccuucggaaguuaacaaucacucugaaagcuaauauaaucuugaauaaauacaaaacaaccaaguaauaccguggaaacugaagucaccugcuccauugacaugaucaugcuguguucuuguugaggggagggagggucagcaugaguguuagacaaagcacaguggaaauuuuuccacaccagccuaacuucagcuccaggucuuagcucuaggcaaccagucaccaggauuuuuaugcccgguguacauccugcggcuagguaaacaggucuaucuaaguuauuuuccauuccuuuuugcuuuuguuucugagugagauaggagauuuuuuuuuucuuuaaaaauaauaaaucauuuucuagccuuuuacuucuuagaauguuagcaaaacuaacuggauuuuaucugucucuugcucaggaagcccacagauaaacaaaagaaacugccacaacauuuuugacacuugcaguuuuuagaauauuugaaauauuaguuuuuuguccuaagcauucccccucagcuguucacacucauuuugcucuguuuguguuauacccgucucagugucuguggcuucucugcuggcuacauuuagacagagccuuggccuucuaauguauaguuuaucuguacacauacagacacauacacauauuuuacugcaaucauuuuuuuuaauauaucauaccgucuaacugcuuagacuauuggcuuuuaaucauguucuguauuaaaaagguagccuuuuuuucuucauuuauuuucuuucuuguaaguuauuuucuaguuuucccguggcuuuaguuacucuuucgggcuacguaguaugucuucgggcguguccuuagccuuuuuauccuguccugcucuguucaccgauacacccagaccacguuuuaaucugucuucacccuaauaccaucgugugguaagccucugcuuauccacccaucuggugcaggucaccguaaauacuaucugugauuacugcuaucugcauagaugacugggaaugcauacagugccuuagucaguguuuugcuugcauuuugagcuuuguuucugccuacacuucuagguugguauuuaugaagugaaauuagugaaccaaagaguccaggcauuacaaaguucauaauauauuuuguuaaauuacuauguuuuuucuuaaacuugaaaaaaacauauuguuuuauuuuuguuugaugaaaauggcacaugaaauugaaugacauaaaauaaaacuugaguaaugggggagucuacuguaaagauagcaauuuuccucgaucuacacaucaaagucuuaaaagaaguuagacaaauuacuuuuaguuuaaagauuaauuauauuuaguuugaagaauaaaugcccuaccauagccuaggauuauugaaaagcaguaaagaucauuuauuuccauaguuuaauuagcacacauuauaaagcuaccauaauuaugagagcuuugauccaacuucucaaaugagagaagauaugaguuguguuacuugauaccaaauaacguauuguuaguacaauagugggcauauaguauaaaaguauuagcaacacucgcaugaggacuugguuggacucccaguauccauguaaaagccagccauggugacaugggccugugacuacaaugcagugcagacaguggcaggcauauuccagaagcuugauacguagccaggcuagcccaaacugcaagguccagguccaagugcagaccuguccaccucugaucuccacacaggugagcacuccacacucacacaggcacacaaagauaauacaguugauguaauaagauagagguggguauagccauaucauuugaaguuaaagaagcugcucugcacaugaucucaggcauaaaacacacuaagcaugacgaugaaaaucauuaaaacuuuugucaggcagauacaccauaaagaaaugcaaaacugagagcagagguucacagucaauaugaagcuaaaaaauguuaauauuuuugacauguaaacucugauaaagaaauuagaaaaauauccaaguucccaaguaggcuggaauacagugagaccuugucaaaaacacacaaaaguacuuauauuuucagauuagaacaauugaaguacgucuuuucccaaaacccguuaaaguacaucuuucuacaaacauucugaauuaggauaugaaaugaaaaggaaaaacuccuaauauuucaguaauguauguauacauaaauuauacauauguauguauacaauggcagaugcguauagauaaucaguacauacagcaguuugaguuaaugguuuucuuaaaguauauuaugauggugcagaaaauaacaugcauucauuaaauccauauuuugaguacuuauuuuguaccuuuucccaggcuaucaguaugugugauagaauauuguguugugaaucugggcaguggccaugagccauaucucccagucagccacacuuguaucucugugugcuguguugcuaagguuaguuaguaugcuggaugaacugaguauaguaaacacauuuucaacuuacuuuauuuuuagucuauaaugaguuuaucaggaugugacacccucauaaucuaaagaaguaucuacagaauccuuguguggauggauauaauaaagacaagagaugcaaaaguguggaguggcuuaauugcuaauuaaauugaauuguacuuguuccuaagcguauauagucaagucauguaugcaucaggugcugugaaagggauauuuaccuuaacuugaggaaguuaaaauuaaauaaaauacuacuucccaccuauagcaucaguagaugucccauggaaucaugguaguggugucaccaagggugcagaagagagacuuuaagauuagauggaggaugacuaccccucuuaagccuuucugcagaggcuagcaccuuuagaagaaagcauaauuuucacccuguacuucucgagaagauaaugaccuaaugaagaaaguucuaaguagcauaggcuaugguguuuauguuuguuauaacauugcacauccucagucagauagugagaaacagauuggccaauuguaauguaucuacauugaagacuauuauacagacaccaaaugugguaaggauauacauuuauugguauaagcaaauguucauacuguucuuuuaaaaacagguuacaauauauucaaacccaucuuuuauuuuggucaacauaauacagacuuauacacauuuagggaaaaccauuccuaagucaugauauaaaauacuagcuguaucccccuuuaaagucuuauguauuuuacuuuuuguguguaugaauguuuuacccguauguauauauguggaucacauggacauagugcccucagaggccaguaauagguguuagauccccuggaacuggaguucagaugauuguaagcuguuuuccuguuccucugugagcuccacugagucaccuucucauccccucucuguccucuauuuaagcagggauuuaugugaagcugauuuuuuuuuuauuuucucuuuugucuucccuaauuugcugcaaaggaccuaucaugagugacuaguucauucucuugauauuucaaaauaaagcaguccauguaagaaagaaaacugccuuaaaugacacaucucauugccuacaguaggaggaacaguauugcauccacuuagacucuuuaaaugguugccuccacuuagacucucccaggcugucucugagagacccuccucugcugcauucuugugagccuucaugauuguaauuaaaacauaacacacagacaacauugcuaauuugccaggcaaaagaucauaucucauuaauuauauuucuuuugcagcagguuauuguguggauccaguuucuugucuauuaaguuaacagagcucccuccauucuccugcaauaacagcuggauguguuacauucaucacaauagaaucuuacguugagcuguuuucaucuuugagccuagaaaagcuuucuuccccuuggaucuaagccacacaauucuuuagcaacacauuuuuuuuuaacacuaaaaccauauacuucauucaaauuuauagcagcugucaaaucucucuauaucaucccaagauuggauuguaaccaucugaccucucaggcaaauugcaagagagagaacacuugcuuucccaucuuaauucagagcuugcauuacccuaaauucaacaaacagaaaaacagaagugguaaaggaaaugccauccuuauacacaaagcaacaaagcauacguguuccugagaugagcucaaggaccacacgucagcugggcccacuuggccuagcacuuagacacaauaagucguccaauggguuauggcccugcuaaggaagaaaauggacguuaacucuaggcagcauagacuuaaggcucuuuugcuuaauuuaucuacgcauagacucuggaucugugguacuucuuccuuguugaucauaaucuagacccugagagugggaugacaagucuuuggagaauccccacuguaacuucucucaucacuaugaacagaugccuuacaagagccgcuuaggagaaggaaagcuuauucaauucaggcuuacagguuaagguagggacaguaugggaaccggaguaugagaacgcuggucauggccuuuggucuguagauuggaaauagaaaguggacaggaaguaggaccuggcuaucaaaucucaaggcccucccucacuuccuuccuccaggagugcuuuacuucuuaaagguucuacagccuucuaaagagcaucaucagguggacccgaguauucagacacccaagccugggguggacgacauuucacauucaaaccacaacacuagcucuaacguuauagguaguacuuagacacagucgaagauggggucccucauucuccccaaagccaaggaugagcagggagugcauuccuuccgcauggcuacucuuucagacuugggauccuguuagcucucaagacugacugcugcauuuuggaauuagucuccucggagcuggauuuuucuguuuucuacuuacuugcaggcaaauugaaacaauggcaguggacugaguagcaagcugcuaggaagauaguguuucuucaugggucagcccauagucacucagguucaaggcaagcaaagagaaagcaugcaugagaugauagcaaucgcuggcauaaccuaacagccuauggaaguggaggagacgcuguuuuagaaguggggguuguggagcuuucccaguuugcuucuuaguuaucugaccaagcacauuuaaacuacagcacgguugugcuaugcugaugauuuuccuguaaagccagugagcuaaugucaaucaaagauggcuuuggcuuuaaacacaugucaucugauggcacuuggugugccaggcaguaaguaucauuugaucaaggaacaaaugaagaugacuacagccugcaacgcacuacccaugauuuuguaaaagagaauggcauagaacaauaaggagccugucauucuacccuguaaauuuacucaaguaugauccuacugagggccucaacaaacuccucccucucccuuucccucucccucucccucucccucucccucucccucucccucucccucucccucucagucucucucucucuguguguguguguguguguguguguguguguguguguguguguguguguguguguguaaauacccaaggaaguguccaaccucuaaauguuaugucuucuuucacagcaauaaaguguaaacacugagugccauuuaagaauccugagagcugucuggugaagugacagggagagcuagacauuaggagauugaaaaaugaccuuucuguuuguuggaaugagauccaaacuccuucaaacuuuugacaauccaaguugauauauaagcuuuuuagaagcauaucugucagccaggcaguucuggugcgugccuugaaucccagcauuugggaagcagaagcaggugggucucuuaaauucaagaccagccuagucuauagaguaaguucuaggacagccagggcuacaaagacaaauccuaucucaggaaggaaggaagggagggagggagggagggagggagggagggagggagggagggagggagggaggagagacagacaaaccaaagucuuaaagaaucuuuaaugaauguggaagcuuuuuauucagaaguauucucaauucuuugccuagacaaaugacuauuuuggucaguucagagaaauaagcugugaguacuauggggaaacacauaaaaagaccaauauuggcuguaucuagaaaaugaaaugagauuugguuugaaagacaaaaaucaaaucuuagauacaagaauuuagcagauuaguugacauucugagaggcugucaguaaaucaguuuauugccagugagaggaugaaccguggaggccacaccucucuuggccaagauuaaguuccaugugcuauaugcagucacacuuguaucugcuugucaagauccauuuaaauagaguaugaaacgcuuauuagaauuucaagaguguuccauaacugauggucguauuuggaaaauuugaaagaagccagacuuuaaagcgaauggaguccgugaccaugugaggcgugccucccugggacccgagcaaaugaugagcuacuuguaacaucucugaguuccgugucauuuguuuguagcuucaauuucucaugcugccucuugccaauuuauccugugucuugauagccgaggucauugauaugaccccaugcuaaaaggcacauaaauuuagaacgaaaacaaaagggagaucuaaauagaccacuauggaaagggaauaauagccugcauuggggaaguaugcaagaugaaaaaauguaauaaaugguauacagacauuugcaugccguguaaaacucuuuccagcucucacauguugcucacaauagaugucuacaggauggcacugcaaaccaugccucuguaccauuggcaggaaauaucaacauuauaauuggauuccugaaaucuucgucaacucagaaaguuaccuaaccauauaaaauuagcaauuuugaucugagggaaaaauaaaaaugcagauauuacugaacugagauuauuuguuccucucaauuucuacccuacuucucucaguaggaaaguacaggugaugugguuuaaaagacccauaaggcucauuugaguguuguacccaucacugagugggaugacauggugagcauauuaauaacuuagcaaauccuagaaguccaugcuuagauucauguuuccuuaaauguuauaucaggguugauuggcagauucagugauuuauuauugggagucaaacagcgcuuuauaaaugguaauagauaccacccaacuaagccccugagguggcuuuuucuuuguugguuucuuuguuuuuuuugaguuuuaaacuuuuuuccugguaugauauucuguaucaaguuaauuauuuucuacaucauaucuuaaugagucaaugguuuuauuacaagaguuuuaaagucagagagaaagcccuaaaguagacuaaucacauucaacugacaaaugauucagguugggagaagguuugucucuaaauguaaaauuuaaugaucugcaaggucccaaaguccaaugaaacuaaugaacuagccugacaauuacuagucuucauaugccaugguucuugucccauuccguaggauguuuugagcaguuguuaaaucacaacuuuuugaagucaaaauacagaaauccuugagcuggcuaguauucaacgcccugcaacugacuuugaaaauggaaugaacgauggugacaggcaauuuaaaacucccuccugaauuaaagggauggaauggggagugagccuaccuucucuugucuuuguuucugucuccagauggccaacacugacagugcugugcacauagaacggaucuugcugauaagaucugaaucuauauagagaugccccaccaccaggggcuggugaacucuucuguacacuguacuugaggugcuuugucagccaguccuucucuugcucucacuguccugccgagccugucacugcuuugucucgcacacguuccuaucaguggggacuuggaggaggagcaguuagaaugugcgaugucuuuucaacaucaucauucccuaucuugggugagccaagacccuuucugaguaucaucucgacucaaccucaccaccugcugcuuugcuuucuagauuauucaggacagaauauucaagcacauaucacguaacaguuuaauauggaacaaacauccuggaggauuguucguccuaccgcaguauucaucuuaccugggagauuucccuuacuacuaugcuaauuuagguaagugaauccuuuugauuaccccccccaaagugguuauucuucccaauagccagggugggagauuguugucugagcccccuuuaaagaauuguaaauacaacagaguauuagaaaacaaaaaagacaggaagccuucuuucucaucugagcagcuauccuguacauuugguagacuucauugagaaauguucuuaaauuauagaucauuuugaacaugagaagcgauuaaguauaaacuuaauauauaugugugucuguguauguauauagguaugcccguguguguauaucuccaugauuuuuuucauaaucucacuucucuuuauguacauuuagaaaaaccugaauuaagaaggagaaauaagaaauaacuaagaugaugugucaaggaagaauugaugcauucuuccaggguuuaguauggcccucuccuacacagagcuaauggcaggcuagauguuugaagguuugguagaaucuguacucacaagcagcuuugacuugaucucaguggggugaaggaugggagcacagagauacagcuccacagaggcugauguuccuaccgcaggcauugccauaguuggagccccagacgcucucaugucaguggcaucagcgacacguuagcucagaguuacagcguuuagaaaauguggggcaguaagguaucuuucagacugcuaugauaaagacucagggugguccuauucuauaugaaugugcuccaaaacaccuucacccuucuuaaauuguacauacuuaguuugaaacccacgaagugagacugaaguuucgggccuaaaguauucaucagcagugaauaaccauuuaauguaaaccggacuuguugggaggaccauguggaauucaguggaugguugacugagccagugagaacucauugugugucaaaugcaguagauaagaauccuaacauuucucguaaagcucugugaucuucauucagaguuagcccuuuagaaguaugucaaugaugccucuuaaacgcuugcuggaaaaccuaaaagcaaugagugguuuccaucguuaagaaguguuuccucaguccuggguaucuuuccugaguauacaucaagagaagaagaaacucacuuucuuucugaaguucaauuaaaaugcuaauuggaaggcacaauuuuccauguaaaacauuugcauaaucauuucacauauacacucugauuuuaacuuacauccccaccuauaucaaagucuaauggggauguucccacaaugccugguucauaccuaagcuacuaaugugccaaauuaguaggccuaaauuaaugaaguucugaaaggcucuuaaccuguuuguaauuuccgaggucuugaagaagggcucccgaggggauaccuucuuguuucucuguggugguaaugguugauuugcauauucauuguccuugcccauaaagagcucccauugggcagaagucaguuucacauacuuuuucucucagugguguuccuguuacacaaagcagccauucuugaaaaauggaggcucccuuagugugaugcugcugaugcuggagccaguguugaggaugcugauggugauaacacagagcacuucuuauuugcuaauaaguccugugcuaagugcucaguguguaucagggugcucaacucuggggauaaaugcaugucccagccuaagaaacccagaggauccacccauauuucucaaugccacuaacacugauggaagaucugggagucaggccuaaauggaugaugcuagguguuguccuuugaacuuuuccuacauucuaauucuuuuaugaaauguuagucacacaauccccuuuaguuaauaugcaggcacuuguaaauccaccaauggaaaaggcuugcuuauguauagacauaacagguaaguuaugcaccagaacagagugcauagauacauauuggguaacauuuaaaaaaaaaaaaaaaaaaaaaaagauggcaggcaucacuaagggaagaaaauguccacagaaucuggagauggauggacacuggagaggucucuaggcugauuggcuguuacaugucaacuugcccuuuucuccccuucuguccauaaauaagacaugaaggacagcuguacuugagggacagcaacuccaggguaaaccacugggacauggagucuuuuugcugagucuucuauuuuucagugcuuccuuaggccccuccuaugauugccuuucagguuuaaagccccccuccaaauucacugcagucauccaugcugugacuccccuggucucucagucccagccaguguugaagcuucuuguggcugcagccaaaucccaguacugugcgcaggugaguagccuuguucucugcagccucauugcauaccucucccacacuuggcuuuccaggauguugcucaucaaguaacauacccaguuccucuagugauuggcuaggcuuugauacucuccuuuuuaucaacuuggagacucaaaagugaaaccuggcacaagucagauuucagaaugaccuuugccuugguguaaaauguacccgcucccccaacacacacauauagagauguucuguuuaaaaaaaaauguaugaaacaaacuacuuccuuuuuuucuuuuguguguggauauguacgcauguuuugagagggugagcaauauguuuguguauaggcacauauguucacauauguguuuagggcagaggugaaccgaggauauuguuccuuagguacugucuaccaacuuuuugagacacugccccacccuggaacucauugauaaggccaggcugccuggccagcaagcuccaggggucugccuguuucugaugccccacccagccuugggauuacaagcacacacucccauaccuggccuuuccccacggaugcuggggauugcccuuguguuggcagggcagacauuuuacucacugagccaccucccuagccucuuauuucauucauaaacaucaaaaugauaauguaaaccaaaauggccacauggcgggacacagaacacuacguuccaguaacaguaacagacuuggcagugucgggaagugucgacuuuuccuucacagcggccaggagagaggagagaaugauaucugcgguagcaguguuucccaaaucaguagcacuccgagagucuuaacacuguuuaguuuuuuuaacuugugccggguguagauaaaaugguuuacaaaugagaaaaggcucaaaucauagugaaguguucaguuuucaauucauugccuuuaauggaaauuauaaagucacauaaagccagcaacuguucaggggaauccaaagcaggaacucauugugcuucugucucaaauucuuuuaugucgcccacuugccugguguggugugaguucauagcagauguucggauguuugguauacauuuuuauuuaacuugaucacaguugcuauuacacucuuaucauaagauaucagaaguuagaaaacacuugauuaaguuccggcaaacuugaaguuacugcuuuuuauuugugagugaguguguguguguauguauguauguauguauguauguauguauguauguauguguguguguuuaucuauguguuugcauauaugugaggguuuauguauaugugcaggcacauaugcacaaaugugcguauacauauagaguccauaggaugacguugggauuuaucucauuuguccucuuucauauauguuaagguagaguuucuuccacacagaguuuguguauuggcuuagcuggucuaguaagcaagcuuaccacaaggauucucuaccuccuagggacuaggauuuuugguagacauacccaccuggcauuuuuauggguccuggggaucaaacuuaagcucuuuacuugcugagccaucucuucagcccuuagaguuacuacuuucuccuagucucugaaaguaaucauuuagauuucuaccguuccucucugguuguugaagaucgaaaguucuaaaguugguacggguauggacucacuuugaaauuuuguuuugccagcucacuucuaucccucuuuuagaagggggccuauagaaguacucaagacagccgucuaaugaucccugugccuuucagaucauaguucuguggaauugugacaagccucuaccagccaaacaucgcuggccugccacugccgugccugucaucgucauugaaggagaaagcaagguaggaggggcuaaugugaggggacuguggaaaccuaccucuucacagaccaccaugggugcugcuggcucuagaagaucccuuaagagcccuugggucaggguuaugucuaacgcuguacuuguucccgaaugucuagcuuugccagccauggacuuugcaaucagugaaacuugcagaguuucacugcaaacaaucugguagcuagcuuucuaaguuuacauucuuggaugcuauuuccucauucauaaaaggacacuuauaccacacacuuccuaggguaacugugagggugaaaugagcucaaggcucagcgguguuuccauaaaugacaagaaugaaagguggcaguggcagcugcugcugcugauguugcaugugcacaguuuguuuagcuaaugcauuguguccuucaggaaaaaguucuuccuuacccuucucuuuaaaaagucguuucuccuuauuuugccuugaagccuccuuucauccaaagaccagcucagccucgcuggcccauuacuuucauuauccaguccacucugcuuagaacucaauaaccuucugaucgucuucuggccuuucagggacuauauuuauugauggcuuaacuagcaucugaagucauguguccugcccaagauggcccuccagucucuuuuucucuccuuucuucuguagcugcugguuauaaugauucgaaaggccauuuggcuuuggucuuggccugcucucucaacucuccaccucugucagcacccccaccugucuuucaacccccuucauucugccguggucuuaaaagugggugcacuauuaacagucagaacccagcucacuccccuagcugcuacaugguacuuucuuucccaguuguaauuagucacuacucaguaaaagugauauuggagaagcaguguccucugagagacuucuuuugccaguuccacagagacuacuuuacccuagguauaguaccuaagccagaauagcaaaauaauuagguuguugggucaaaccauuugaagcuaucuuggaucuuugaaaaguagcaaauccauauguuccacauaauguggugagaauugcaauggccccauggagaaaagacaaacagagcaugucauuauauacucauuuuccacuuagaacacuguguguugguucuguguuauagacuuacaacacacuggagacaucuggaagccuggacaguaugcagauguauacuagcaacucugaacuuuggaauucuuugguguuuuggccccaugaaugaccacaucuccuguaucucuuugggcugugugugucaagauauguggacaggacucaaugugccugacuggggccauucugaugucuucagauugcacgacaguuucgugcucuaauucacaaauuguauaccuuugcucccagugagaagugcugaagaugcuaaugccuuuccugggaucguaccuugaggaggugccacacucucccaucaauuucuauaacuaugccccuggaaacuaguuuaguuuucaccuuuacuuuggccacucaucccagugggcuguguggcucaugugccuugucgugacucucagugucucggguggcacauucucuagaaguguuagcauuucagccuugcugcggacucaguggauuauaacuuagccccacuucgaugauucagugaaauauuguguaucaaggacuuagccuugugccuacuuaacacacacaaacauuggcuugguuuuuauaugaucugaggggcaugucuuaaucucugugccgucacacaccuuccaauaagcagaaguaaucaugauacccaguuuaugguggcugaaagaaucaaaugauaccauguaugccaggaauugucgacaagauaucauagacucccccaaacuuuggugcaggguguguguaauuauuuccauaguuuuuuuuuuuuccucuguacuagauuugucuuggccaguuucauugucauguuuauaaguuguaaaagacuuggcuacucacaugguuaaccagugaacaaacaggacaaaacccaguuauacaauauugaccucauggguauaugccuuccccuuguguuaguucacucaagaagguaauugggucaaggacuugaaagaaaaucucuuuuucuauacuaaugggcucauaaacuauaguucagaaaaaggaagagagggagaaagagagagguaggagaaggaacgaacgaacaaaagaagacagacagacagacugacugacuuacugacuucccugugaagccagugacugagcccaggguggggaacagccuucuccaucccacaaucuucauaucuagcugggacuucagagcugaugugugcuguuucagcugcaaaguucuguuuugaauuuauagggcuugucuucgcaguuuuccccuguaggcugaacacgggaaaggucagggcauugcuaagcugccagcuaaugguuucugugguccucuguggacauguaaacagcucaggagaaucgcugcaggcggagauuucugagcgcuguagauaugggguugccgaccacuuuguguuuuauuuuauuuugaaagacugagaaagauuuaaacacacacacacacacacacacacacacaaacaccgaacccugacccacuugacagaugugcgggaguagucucugcagccauguauacuacagcucuguugccugagcucucagauagguuaucguaguguuucccagcuuacaggcaugcaccuuggaucugagaugagacaaacuuggcuuccccauguaagcaaagcaugggagucuuugugguuauuaaaugugcuacuccccccgacccccggggccuguuagguggcuccuucuccgucuugccaggguucagccucugcuuugcuacccaucauuugagcauucgaagugaauugaggcggagcaugccucucgggucucuaugugugaaucucaagccugacuuuuccaggacaauggggaugggcuugucacauuuggccaugcaugugcuuuuagguucuuucucgacagccacacuaucugggaacaaacccaaguucaugaccuuucugucuccccaccccccaucacuccccagcccuaagauggguuuguuauaaagauacaauaagacgagggccaugaagggaaggccaggaacauucccugacauacuagcuaguccaggacaauugguuauuguauagcacaguucucacaggcagaagcugugccucucacggguaagcuuccauaccuccaucuaucccaucaaacuucuuagccccaugcccacugguguagaauggccccagugcaccuuuccaauguagcaccuucccagcuucccuaacugugcaccacacaugcucauucuuacccaguuaaaucauuguagucuucauuccuuuuuuuuuuuuuuaagaguagagaaacuaaggcuucucuugucaaucacuagcugucaacaauuuucuauuuauuuauuuauuuauuuauuuauuuauuagauauuuucuuuauauacauuucaaaugcuaucccaaaaguucccuauucccucccuccucccugcuccccuacccacccacucccacuucuuggcccuggcauuccccuguauuggggcauauaaguuugcaauaccaaggggcuucucuucccagugauggccaacuaggccauuuucugcuacauaugcagcuagagacacgagcucuggggguacugguuaguucauauuguuguuccacccauaggguugcagaccccuucagcuccuuaggugcuuucucuagcuucuccauugggggcccuguguuccaucuuauagaugacugugagcauccacuucuguauuugccaggcacuggcauggccucauacgagacaacuauaacagggucccuucagcaaaaucuuucuggcauugugcaauagugucuggguuuggugacugauuauggaauggauccccaagugggguagucucuggaugguccaaccuuucgucuuaacuccaaacauugucucuauaacuccuuucauggguauuuuguucccuauucuaaggaggaaugaaguauucacccauuggucuucccuuuucuugauuuucuuguguuuugcaaauuguaucuuggguguucuauguuucugggcuaauauccacuuaucagugagugcaguaguccucauucuuaauuccuuccacuggcauagcaacaauaugcguguacgagcacuaucuaugauuuuugcuagaauagaaauaaagucaguauuguaaauguuugggcaucuccaguggucuggucucccaggauguguaccaggauggaauaugucaucuucccuguucuuuccugcucucgggauacugguuaucucugggagucccuugugcuugcugaacccuugucucuguggccccauuuccgucucugccuggucauucccaccuagucggagggccugccuaauuuaugaugcccaugaagccuuccugugcucuucugguagcugacucugcugcccuccagucuggcacuuuucauucugagugaaagccagucauguagcucuccaucucuacugacucuggguuccuaaaggcaggccauaaaucacguuugguuucauccuuacugugguuggagugguaccuguaggugcucaguaauugcugccuggguuaauuuuugcugguggucgauggaagacguuugcuguggcagaugucagguaauggaacagucuucgugaugaugugacuggcagaauuuuccugacaguagacucuaacguggcuucuccaugcaccuaaccucacuucucuuacuccccagguuaugagcagccgguuucugcccuaugacaacaucaucacugaugcugugcucagccuggaugaggacacugugcuuucaacuacggaaguaagaauggugccucgggagcagggcggggcucucuggcaggugccuucaggccugagaggugcugggaucgcucuugcccuugccuugcuagaaguugaaaacguuucccaagucuuccugaagugguuuuaauuaacccaguuccugcuagcgccuugccacccccuggcacccugagaaaggcacuuucccccuuuguuuucucuucuaauuaagaccugauuuguguggcuguucuucuccccucccccucucaucuuucaucuccuuuuauuuuuuaaguaguacagcuguaggcagguguguggaaacccagggauggaauaccuauguccugaaacucucuggucaagcaucccacccuucugcaguuacagcgcucucugugcccaggaugcacauuuguggcuucuaaaaggcuauuuuuuugucucaucuaaagugcuuccugcucccacaugcacacacucauucauucucacucucucucucucucucucucucucucucauacacacacacacacacacacacacaaucacacacacacauacugcauucacacacacacacacacugcauucacacacaagcaaacaguuucaucugaaggcugagauggagaccuucuauuuugaauguucaaguauuugugccaaaaaauaagauuacacagggaagucuguguggagaaagagaaagaagagggaagagauaggugauggaaaauuuuguagcuggauugaguauugauugcugaggcuucaggccauagaugagaucaaagauaucucuaugaaaauauagaaucacauuauuaaugugaucacauuauuaaugguagcucuuaaaggcacagagacuucgcuaauuagcuuuuccuuuucuuuuuuuucuuuuuuuuuuuuuuagccuggaaucguuuuuucuuuuguuuuagaaauuggcacuugccagcacgcacucuuucggacccggaguguaggucuaguagacacacuuacgguugauauaggcuggcuaacuacccuuccuccuuaagaucccaucguuguaacuauguuuuagucuuuaccaauuguauuaagcagguccuaaauaaccccggcucaccugguucagugccucuuugcaacccgaguucuauaaagacuuguuagugacuggguccugggaauggacacugugccaaugcaagacugaccacacagccucugugucacaugucucguggcaagaugacaugcuacugggcugaagaugugaugaccaggcaaagagaaggccugaacagugagccuugagacacuccagcugguauuucucugcagcuugcugcaaaggaaagcuggcauccugagagcacauucauucaacaaguguuugcugagcgauuccuuuguucuggucucugugccagguacuuggguuacagagucccugcuuguaucuaucaaaguccuggcaguaaacagaauucaagucagauugcucaaaugagagaauuuucaauggcuuaaggagguguggguagggaugcugaacccuaucaaggauguuaaaacaccugguaagagcugaaagcuuuccuaccgcaucccugaacgaggaaaaggagaggcagcugaaaaggcccuccucccagagcuguguucauggagauguggcuguugucagaacuuuggcaccacauaguucugaaaggacaggaacagcgaagagaccuucuucuugaucccauguuucuguuuuuguuuuaaucuugcugguggcuaccauugaccugaccuagccaugcucuagaacgguaugccaagcagagcagguagagcccucccugggugugcugugaugaaguccugggaccauacaauuuagaggacgggagauugguuuagcucaggguugaagagcucucacuucaucauggcaggaaggauguggcugcucagagaucauguggcagccaugaaucggagagggauaaaggccaucugaguagauggcucccccuucuucucccuuugcuuccuccuaaaucccagaauauugagccucacauuccacacucauauuuacccucacccuccucuaguuaauccuuucuggaaacacucucaguggcacgucuagcagcaugcuuuacuaauuuccuggguaccucuugaguccagucaagucaauagucaaggcuagcuguuacauuaguaugccagcaucccagaauggaugaugccguuccaagggcaaacucagggacaagcaguacauccccaugguggaacauccacagcauauaccuagggcaucuucuuauggccuggaguaugguucaucucaccgcauccccagggcacaaggcaauugcucacacaccaggcuuugguuuuccaugccccauggugaaauagcuucccaccacugugauguaucuuuguacuggauuauuuccugugagaagauaguaguuccaaccacucagugcaugcugggaggaacauguguugcaugugaaguaauuagaagucaacguggguugaaaaugauauguaaauuuaagagguuggcagucuggcuugcuuucgccugcugaucacugaagugauuguauggccuaaaaugcucaugggcagaauuucucuauucuauuuuuuuuuuaggugaguagguguugguuucauuggauuuacacaccacacacacacacaaacacacacacauacacacuguucaagggaucuuagauuguauaagcaucucacugaagcaucaggaauagauuuuuuuaagaggcauucuuuaaagggcauuagauagaggugguuuaugcuuauuuacauuuauacgaguugccacaaacccucaaaagaaaacagauguugauuuuuaagagaggggggcuuauguugaccuuugcugucuuugauguguuaaugaugugaaugaaagcaguguuaucagaagaaucacaguuuuaucugaauuuacuuuugaguuccuuugaaaugacuugaaaaggcccugagauagugagacauucaugcaaugaaagcacccuauugcguucuauacuaguuguuucuuuaucaaagaauaaucccaaagagugcugacaguuggguggauucuuuaacaagaggcuacauaauauacugucccaucaauuggcacuauugguuuugaguaugggggaugucauagguuagcccaaucuggucucaggugucuggucagacucuauccccugcugucuuaacucuccccaguaaguuuuccuaaugcguggucuaccacucuccuucccucccaguuccgggcagguauaguuugugugaacgagucauuuuaagccccuuuucucuugugauggcaauguuuucagagaaagaaaaccaguaagaguuuguuaugaggaauuacuugaugaggucaugggagucucagggccugcaaagucuacacuuuccauauguaagcuggugucucagaaaagauaguauugugguccuuauagaaaaugauagccugagagugcaaauagccaauguuaagucccaguccaaaggcaggaggaguucagugcaagcauaaugguaggggaaaagggcacacacagagcaggugggauggcugcgugggucagagcucuugcauggaacccacauuaccaagccagauguggugguacacaucuggacuuucaggacuccuacagcacaauggcaggcagagacagggagaugaacaugaaguucguagaccagcuaaccugguccuacuguggccgaaacaagagugccugccuugcuaagguagaagggaaguccugaaaacuguucucugagcucugcacaugugaccuggcacaaacaccccaucaaccccaagaccaauucuuuuaaaauaguuaagaaacaucagagacaccuucuuccuccauauucgcucucugugaacucaguggauugaaagguggccacccacagaagaggggccucacauguuagccucauguggaaauaguuucacuggcccacacagagcuaaucucccaucugccuuccugaccuuuguugcggucaaguuggcacacauguuaaccauuguccuuuuuauuagaaagucucugacuagauaguaagugugcaaucuuuggcacagcucagaauggcaggcaucaaauugguguuucauauaaaugugaauauauggcuguuuacaaugagaguggcuucuagcuaagacugaaaaauuuggaaacaaaaauuuauuuuaaaaauuucaugaggcaaguagaacagcucaguggguaaaucuacuuucuacaccagugcucaaaaugucauucaugaaggagucucuguguaucccuggcuguccugaaacucacucuguagaugaagcuggccucaaacucagagaucugccuuccucugcuuccccacugcugggaugaaaggcgugugcugcgaccaccacuaggcuucacaaccucauuuaaauccuggguccugcgugauguauugagagaauuggcugugaaaguuauccucugacauccgcagaagcagcaucucacgccccaaaccccaacccaaaccacuaaaguacacugacguauguguguauggacacggacacauguguguaucuuugcacucaacucaaauaaauaaacuuaauaagaaaaaaauuaauguucugggccaaugauuccaaaaagauacuuuauguaguauauucguuuuaacaauuaucuuauugcuuuaauguuucuuugaaaauagcauagucaucaaugaaaccuaggauuucccugauguuuuuaccuaggaugaaacuaauuaaaaaaaaaauagaguagucaguuuaaagagaaauguuacuuaaugaguuuaaugggugauaugagacuugggcaaaaagcuuggggaauaucaagcuaagcuuacucacuucauuuuuaaaauuauuuuacuaaaaugaauaccaauuuacauauuauaagaucaaucaguuuaaacuuugcaguucagugauuuaguucauucaugaucuauacaguuaaugucauuuaucucuucucccaaaacguuauuaucauucacaaaggaaucuuugcauauguuuuacacugugccuccccuucuuugacaaccuucaucuuuaauuugccaaucacugauuugcccaacuaggauaucuuuauguuuguggaaauguguccuacauggcccuguuagccuucuuucucuuauuuagugcacuauguggcauuugaguuucagccauguuguauuaguguuaccaggaccucucuggcucccuuucuauuccuaguccuuuaucuccaugaaaagaauuuagacaagacacagaacauagcauaaggagaaacauauaauuaaaacacaugaggcauucucauggcugagagugggaaucgcccaaguauaccacaguaaaacacuuucauagugagaaugcacagcaaccaagugggaccccauacugaccuucauggcgacauaggcuaucuccucuuuaagguuucugaaagugacaacuuccugggugaugacuuccuauccaggugauugucagauccauuuggauuaauucuguagaaggggcaaugguuuguccaucuucucuuacaggaaagucucagaauagaugguguuuuaguuagguuucuaagacggaauaaaacuucaugaccaaaagcaaguuggggaggaaacaguuuauuuagcuuacacuuccacauugcuggucaucacugaaggaaauaaggacaggaaccuggaggcuggagcugaugcagaggccauggagggaugcuacuuacuggcuugcuccuauggcuugcuuggccugcuuucuuauagaacccaggaccaccagcccagggauggcuccaccuacuaugggcugggcccucccccauugaucacuaauugagaaaauaccuuacagguaaaucucauggaggcauuuuaucaacugaggcuucuuucuccuuaaugacucuagcuuauaucaaguugagucaguacacacuugcuaaucucuggugcaguucagaaccuaagagagauguguaucagaaccauacacacuggauauguuggcccugccacuuacuagugcacauaaauuacuugguccucuacuuagcuuucccuuuucuuagcugauaaauauaaaaauaucuaucuaccucaaagaguuauuauaagguuauuacaacauguacaguccucuaaaccuucauaugguaaucauuauaugaucauaaauguaucauuuauuuuuauauuuuuuguuuauuuuuauuuauuguucaucagaugaucuaaauggaguguacagauuaaaaagagauaacuugcuagcuccauguccuggcuuagaguagguucagaaguacccacuuuggcuuccuauaaaccuuuucuuuaaaauaaucaugucuugacuuguuuuaacuugggccuuuguccccacuuguucucagugacuucaugagugacugccuuucuagcuguaccuagcuagcauccugugucuuuagaccugacauaccugguguauuuucuuugugacgucuucucuauguuccuguuaaaaguugugcucuuuucaaaaacuuucccuaaagaaaaugcuuuaauuuuagucacuugggcuuugauauaugcuaguuacgaugccugccguauuucagucccuggaugcacacaggaaaucuguucucguuuacaaaacagaugcuccuaugcuuccugugaaucaguggucacagugccuuugggguuggggagaaggaagcaacugcuuuucuguuuuuuuagcuugaacagacugggauuucuaaagggcaagucaggaucgaucucucucucccuucccuuccccccuuucucucuucuauauuaaucuuaaguuucuuuccuacaaaauauuuaagaugugcauaauugcagggcaaaaugucaagcagucaguuuaauuugcugaugaauaugggaauuaauguuucgaaacaguugugggacuccacguuaugaauuagcagggggaggugauguuuuguugacauuuguucaaagucuugauugcuuguuuggcuuguacuuugccuuguagguggauuuugccuucaccguauggcagagcuucccagagaggauugugggauauccugcucgcagucauuucugggauaacucaaaggagcgguggggauauacauccaaguggacgaaugacuacuccaugguguugacaggagcugcuaucuaccacaagugaggagcugagauuucuuuuuuuuuuuuuuuuuuuuuuuuuuuuuauuuauuuauuauauguaaauacacuguagcugucuucagacacuccagaagagggagucagaucuuguuacagaugguugugagccaccacgugguugcugggauuugaacucuggaccuucggaagagcagucgggugcucuuacacacugagccaucucaccagcccggagcugagauuucuaacaacugcauuaauaggagcuuuaggccaaauccaguuuacaacaugaacgaaaauuagucaguauucccguuugauuuuuguugggguagcaaauaugagcuauaaaucuucuuggcuuauuguauuuuuagauauuaaggcaaaguaguguuuugaguuaagccaaaagauaccgauaacacucauaacuagguuggguagcugaauauuaagaggagauaccuaaauaucccagucacuguucuaggugguuuggguucaccuuugaguaaaacagaaaacaucucugacaaugcagggcucauaugcuagugaacagagacauauaaaugcuacagggaaaucagggacagcaagaagacacugacaaaagagucaaguagcgugagaugcagaaaugaggaagguuggagaguggucaggauggucuguuauacagaugggaagugagcagaaacuucaaagcaagagaaagguagccaaggauguuauagauagcauugggaauagcaagaagaaacacccagaguaaaacaauggacgaagauggaaaagaagauugggauuagugacuauggugcaguggaugagaagguccaagaggccugggagccucuaauggaugggucagugcauggccugaacagagcagacuucaggguuguguucccaguauccacucuggaugucgugaugagaacagucaaugagaaagaugacaaaggcaggaagaacuguuagaaaggagugagccaaauggagauggacauuagacuggggccagggagugaacgauggugugaguaguggccaccuugcagcaauacuuggaagcugauucagaauggugaccuaaucagaauuuaauggcuaccaaguuuucugacugacuugagguccagaaggauagagugcuaucaacagagggaauucuacaaaugaguaacuauuucuacaugcaaauuuugcccugggcauguuauggccccuaagaggcuuuucugagaaaaaucauagguagagauaugaaaugggcaaucuugaaaaacagcagacagagguaaaauuaucagauaaguaaauguagaguguucacauuuccacagucccacaagaucacuaaugaaaaucccuaguacuuuauccuaaugaagaaaauguaaccaaccuuaccuuagacuuuuaacauagagaaucgagagucucaucaucucaggacuaagucugaaagugcccaaauguaaacauuuggcugaggaaaucuuaaucucaaaacuuccccuccuccugcuuccuccacacaaaugaauuugauucauucaaauaauuugucuaauuuguaaguagauucucuugccauccguauuggucacauuucucauuacugugacaaaauaccagacaaaagcaacuuaacaaggaaguuugucuuggcucacagucugaagauacaguccaucaugguggggaaggcacagcagcaggaacaugagaggaagccgcucacagugcaucuuuaguuaggaagcagagcaagaugaaugcuggugcucaauccacuuuccucuuuguacucagucuugaccccagcccacagugcuguccacauucagggcaggucuuccuugcuguguucaaccuuucuggaaauauccucauagaaacacagucagcaguguguuuccauggugauucaaaauugcaucaucacaacaucuuaggguucaguuucucuuucuaacugaccagccugcuaccaaauugugaugggcaagcaauaucugcaucccugggaauuucugugccucacuugguucuuccucuguaaaauaaggauaauaauauaauaacaucugccucauagauuucuuagguggguuagaugaggcauuucuuguuaaagacuugagaauaugauuuggucuauagugaguacaauaaaaagcaauaguugucauuauuaaugcauuugguggcaugcucagggauccagagaaugccuguguuuaaagucuacuugucauuauguaauguugcccugcuaagagaauuuccuuugauauuuucagauauuaucacuaccuguauucccauuaccugccagccagccugaagaacaugguagaccaacuggccaacugugaggacauucucaugaauuuccuggugucugcugugacaaaauugccuccaaucaaagugacccagaagaaacaguauaaggagacaaugaugggacagguaagaauaaagaacuuucuucccaaggcuacacgaauacauuuuccucagcuuuaucuggcaguguuauagggagacagaaaaauaagccacaucugaaagcccugaaggaaggaaugauuggcacauggauaauuaagaauauaaagcuuuuagauaacccauaauaugacaugacagugacacauucuuagaguuucccuuauacccuuugggcuaguauaauagaacaacauagacuuagggcuuaaguuacaaacauuuauuucuccuacuucugaaaccuggggauucucaagucaaggugucagcaguuguaauacccaacgaggaaucacuucuuaacuuauguaauuugccauguggcuucaugaugcaaagcugucuggugcaccccauuccuaaggauucuaccuccaugggcuaaucauuuccagaugccccacuuacagaucagcaugucccagucagacaucaguauuuccagggaagguguaacuauucaguccacuacagaaugaaaguucuacagugaauuuaagucaguuuccuguagaugccuacaaguugcgaggaauccuuucuuaacagaguguucuugcucuuguuucucuuuugagaaaauagcauagugaaauacuagaggucauacuaucaauuuucaguucucgaaccagcauuuauaagcugugggcaggccagucaauuucugagauucucuuggcucauuuuuaaaaugaagugguaaaacuuuuuuucaugaaauugauauaauuauuaaaguaaagccaaauauccucuuggguuauaaauuuucaugauaaauauacugucauagaaauauccaacuuccuguguuuauaggcaggaaaacuggaucuagaaauguuaacuuacugcuacaaguaccccccguaaguuagaagcguaaggaaguugaguuuaauccccaacaguguauccuggauaagguaggacgugcuuagaauuccagcacuugggaguggggacaagaagcucagaagucauucuugacaaguacggggugugacgcuaaucugggccaccaaguaagaccuugccucaaaauaaacagacaaacaaacaaguaaauggaugaaugaaaggaggcagagaugcaguaaaaugacucagcagauauauauaauccuaccaaggcugaagaccugaguucugucucuagccauucaugauagaaggcgaaaagcaagucccacaagguaucuucugacuuccauaugcaugcuguggcaagcacaugcucucgugcuccauuccccauggcgugcaugcguguguguacacacgcacauacauacacacacacaaacacauacaaacacgaaugaaugaaugaauggauggaugaaugaaugaaugaaaauacaugaaaaagcuuaaauacaacuacuaguucucccuagguuaaaucauggagugccucgcaugauuaaaaucaacucuuagcauuaccguagcugggcauggugacuagguaacuacuccgaggcugagauagaugaucuaggccaugggggcucuaggccagccccagcuacagagcccaggguaguauaucuuugaaaaacaaaacaaacaguaccacuaacaaaaccuagagagaccaugguuguaucuguuuggguguucgaacuuugugcugagugcuagcuguaaaucuaaguuuuguaaagggaacuuuagcaagcucuuauagcaaccucguugacuggguuuuucuaauucaauaaauguagcacgagaaaaacaaugcuauaagagaauuaugagucaugugguauccuucacagccuacugagcccacacagguucagaguucugguuauggagaaagaacuguguacugggaaaguucugcccuccuuuaacuauugaaguaacaggcagaagcauucgcaggaauuuuccaaucauuaagaccaaacuacuucagaucuaagcaguguauauugccgacugugugcccauauguuuggucgagugcaagcucacagaaucacauucuguuacuaguguuugcuagggagagucuucagacgccccugaggaugcgcagucauccagggaggacugcuagugaccuuuucauauaugugccugcuucuacuacuaugugagcaucuccaguaauucacauacucuagagacaacucuaaacugaauguuagauuugucucccugugcccagguaguauaguguacuugaauccuucuuccuaucauacucaugauuucaguaaaucuuuguguccauagaaugaaugggauuauguuuaagcuuaugcuuuuauuagauugaaaaagaugguggugguauuuguugguuggguuggaaucaaucaagaaugagcugauagcuuuucuauuuccauacaugcacauuuuccugggcuugaguuuggcccuuuggagugagugggccaaugaaaaaaugccugucaaccacaaagcaguggcucuccaccuuccuaaggcuucaauccuuuaauacaguaccucauguugucgugaaccuaaaaauuauucuuguagccauuucauaacugacauuuugcuacuguuaugauauuuaugauaucauaaaucacagauauuuaucuaugcuugccaauguucuuaggugaccccugugaaaggcucguucaaccacagaggggucgccauccaccgccuucaaggcugucuucucugauaggaacucagccaguuauguuaagucuuugccuugcuguuacuugccaaggugcuuucucgcaguacagaugcuagagaacagagccuuccuucugccucuuucuggccuucagagaauccuguaacuuccuugacccugcugugacuugggagcuccuccaccuggcugcugccaggcuccagugugcuucaagaaaacacuucacaaguaguguuuuguuauucugcugcucagugcuaacuugacauuuguauuuaucacguuauuuucaagcguguugauacuugugacuuuaaagugacucugcgugagucucacucuaaaaugcacuuuucaugaaaguauguuucuagaccacacaaacacauacacauaguaaacagcugcuuauuuacccguguuuauaauccuugcauguugagugugagcaccccacacccugcacuugugaucucccuucccagcaaaccagcaacaagagaaacaaacaaacacaaguccaguuacugucaucuauauauccacucaaacucucaguggccugucccuuaaagaaaacuuaaguuuguuccuuccccaacccuaccuggaagucaucaagucaauuuccaucauuuauguugucuaaauaauauuugacagcuuuagaggcaauauaacuaaaaagaugguagccuuuuuuucuuuuuuaacuuugauaaccugagaccaucuauuacuuaaaacaacuguuggcauuuaguggcauugaaaagacaauuguuagguuaaugagcagaauuuuaauauuuacuguagaaucagucuuguagacauaggcacugugucacuggaucugagucacuuuugucucucagucaucucaguagaguagagaaagucuauaagggaguguggguuuaugugcucuguagcucuagccaugagugaaguguaaggguuucguuuguucuugcguuaugcaugcaucuuuuuaaacaagccauucggugggaacuugauaaagguggaaaguuagaugcuuaaaguccaaguccacagcccaugucuccacacaucaaccguguuaacaccugggauuuagaaggcuggagagaugucucagcaguuaagaaugcuugcuucucuggaagaggacuagaggucaggucccgguguacaugucagaugacuuagagcuuucugugauuccagcuccgaggcauuucaugccuucauguagccuccaaagacacccaugcacacauauacaacguguggagucucacacacauaauuaaaauuaaaucuaugcuuaaagaaauuucacauaaguauuuagaaaacuaccuuugaagcaaagacuucauugugagucauagcuuugauuucagauauaaaagagaauguucuguuuagugacuguaguaguugagagcccguugguagagggccgagggccguggcucgaucaucugagcuucagaaagcuucgaaagauuaggugcguuuggucauuggucaagaugccacaucucgacuucagccaaagguaagugggcaugccuaagccuugccuuccccagcuuuguagauggacaggcuuggcaacgaggccacacguucugccagguucugccgcuggucuuuagcagauccagcuacagugcuuccucccccugccuucucucucucacugucuuccuuauuugucuccuucuccccagacuucccgagcaucccgcugggccgacccugaccacuuugcccagcgacagagcugcaugaauacauuugccagcugguuuggcuacaugccgcugauccauucucagaugaggcuggacccgguccucuuuaaagaccaagucucaauucugaggaagaaauacagagacauugaacgacuuugaggaagcccaccgagugggggaggggaagcaagacgggcguccagcugcucucuccuccuucccaaugcagauccgcucacgcccagcaguggagccagacugugccaaguaucaaaaaaucaaaaaaaaucaaaaaacaaaaaaaacaaaaaagacaaaaaaagaaaaaggaaaaaauaaacagcuuagaugaacacagugacaaaacucggcuggaauccuggcuccuggggcugcgccagacugcuccauucaccucacuggcuucugugucccacaacuagguuguguacaguuuaauuauggaacauuaaauaauuauuuuugaaaugauugcuaugcagguuuaaacuuuuuuaaugaucaaaacuauuaaaaaccagaguucuuucuuuaaucaaa

SEQ ID NO: 12528 - RNA, 11558 nt, Mus musculus
gcuuuaguuaacaauguccaccuuuuuauuguguaaucucaucagaagucugaaaggacaguuuuaugcucucacugcaaacacagugaugcuucuacuaagacuuagacagcacauccuggauuauaucaaaguuuaguugauaacaagccuauuucucaauucugucccuguuuuuugacuuuugaaccuagcucuaagcugcagcucagguuucaaguuuuuuaguugcuucuagcagguuaucuugccuuaguuuuagaagacauuuuauagccuuucuacucaagauuauuuuucuucucgucucuuauacuaaaguuccuuuauucugcauuuucauuuucccacucauuuuaaggaaaagcuagaguccagcauuagauauauuccaauuucauggaggaaucuuuggcacaauugacgcaccauaugaucauuaucucuauuaagaagcuauuuguucaaauuuugucauaaaaacgugaaaacuuuuauucuauguacaauaauguacacaaauuuaaacaggucaccaaagagaccagaaguaauuaaagagguauauuuacaguagcacaucacaguaaacggaaagcauucacaguuucaacauccauacuguuuuugugcuugguuacacacugacgugaagcauauuacuccauuuuggaugaacugaauuuuaaacaaauaccucaaugauuaguaaaugcuacuuuaaucagugucaucauuaaauucugcggcugcugcugcugcgccugugugcugaauccccccguuucuuucucuuugagcaucaucaucacagucuguacugucauccucguucaguucucggucagauccagcagcauccucucuuaaagccuccucuggguuuggauuuucauugggugcaauaaauccguuguuguuagaugcauuugaguuauccuugaucucaucuucgauguacacuuucugauggcacauuggacaaguaucuugaauguacagccauuuccgaaggcagagugcauggaaauaaugguuacacgguguuauacgagcagauguugugaacucaugauagcagauugcacagacaucaucuauuucuugcaaguggcucccuuuuaucucaggaagugaauuaauuuucuuaacagcaguucuacgauucaugaaugucuuccagccauuuuuuacuuguaaguagauguuaaaauaugcauguaggcacaucauacaagcccgaauuuuacuuccugacucaaacaucaugguauaggccccauucccaaacauuacuacuccaaauauaaauucgauaauauugcccguggagcgaacaaaguagacauagucaucaagcuuuucccagaggacguuauaguagccaucaaucaugaacagcguguagacagugagggagacgauuaccuucaagcagaguuccacacaaaaggcuguaacugcaaacagccauguauuuagugcauagugaugccaaaggacauaacugaguaagacagggagaaugaacaggcaagcagagacaaacagcacaggaaagugucuauggaaagaugacacaugggaggcacugagcgacauuaauacagggucugucaucccauggaugaaaugcaggacugcaguuaauaaaaggcacauguuucuacuuaagcgaauaagucucucuucaggucuuagcccacuuaaaccagucugaagagccaaaaugaaaaauaaaacaggagcuacaaagccaagccgccugucaucuucuucaguugauccaauaaaggccaauauuccaaggcccaaauaaugggcuauugaagaaauuacagcacucaugccuaguacaguuaguguagaaucacacccacuaauuauuagauugcaaaugacgucccagaaaucaucccaagaaauaaagaaggacucaguuucauuugccauccuuaaaauguacauuaacacuguagccugagcuguaauucuuguuagccagaagacccgaaguaugucugggaaacgaauccucuuccauguguccuccaucaguaacuguaauccauaaauucgguacauaugccucacuaacaaguacacauaccgaguagaguaguaaaaccacuuaaguuucacugccaagacaagcacuguguuaaauaugagaaucaaggacgacaugagcacuacugucucucugauguguaauggcagcucugugauuaagccaauuauaggaaccaagauauuuaaaaucauuaacugugaauagauggacugaaucugcaguaaugugacauauccaauuccaaagguuagcugcagaacgaugagugccauccacagugagggcccuuuccgaggaagcaacucgauuccaaacgcugacguguuguaggcaccauagaagucaaugugcaaagcagcauaguaauucaccaacacugaaguugcagcuaauagaaaggcugagcuguacauguaaaacuugaaaagugaucgcugugacaagaucagaacaauacuggauacaacuauaccugaggaaaaaagagaaaaggguauucgaaugaaguauuuuuaagcauguguuuuuuuaauacuagcaauuacaacuuucuuccuuuauuaugcuaucuuugccguuguaaaaccucaagacaacucaggcuuuacaggacaguaaagauuugagaagucagaguucuaaaccagagcaaacaaguacauuuuaaaaaccuuggcccuuuauuuucuggcuucuaaaguaauucugcuugucauaguauauauauacauccaugcaaaccaaaccaacuaaacacauuuuaaaaaaccuggccucuuauuuucugguuucuaaagcaauucuguuuaucauguuauauauacauccaugcaugagaugacuaaauuaucuucaggacaaaacuguaaugauauacauguacuuuuugauaauuuuuuaaacucaaaagaauacuuucuauguaaguucauaaucauuaaaaaguuuaauguaauaccaucaaaauaauaaggcuuuucagaaugaaaauuacuagacugaaaggauucuucuacuugguuucagaauccuuucaucaaguguucuuuagacaaggugaacuuuuauauggcacccuaucaccuacuuuccuuccagcugagcucaguaggcucucuguaguagauaugaauauucccuaaggguuccaacucaggcccccguacauuccuucacauuucugaaaugcucuccaaguucccuuucccuacaaacugaaucacaucuucagaaaaccaaaucauguuuuaaaggcuagcuggcuauaagcaucagccccauuauuccguguuaaguacuguaaauagucugaugaucgaucgagugccaggcaacauaugcucuucagucagcauaucuccaguacuuuuaggacauauuuagugauacugaaguuuguaauuaucuaguuaucaccccacuacauaguucugucccugccuuauaaaucaauggacugcacaaugcuguauacaaagaaagguuauguucuuaugggauacggggagaaccaacucucacuuuacagaaaacaauaccaacuccccaacuaauaagucuccaaaggaaauauucucucuggugaucuuugggaagcauuguucagguuucuuugcauuccacagcugagacacgggguuuuuuuccuuaggguccaucuuaaggguccaaggaaacccaggaguaguuuucauuagagcuuauaagggacuugcucucuuuuaaaacaccaccuuuggacacagagaauugaauuaaaccauaaccugggaauuucaguccuagacuccaguauaauauaauuacuggacuguuaauaaguucucaaggcagaaaaagaaccaagcaucaaaaucucuucaggaacuuugaauucauauaugaacugaaugcaccaaagaguucagggccuuuucaguuagaauuccaaaagcaagaaguaauaacaggaaaggagggaguccauccaugcauuuuacacuccauggcauguacucugcuuuuaggagacaaggacuugcuauguauguaguccaaacuagccuuccacuugugcccuccucccuguucccagaaggcuaagauuaaaggugugccccaacaaagugcaaacucuuuuaaguauguucauuccugacucuucugcaaacuuaugacugaaauuuagaaggaaauaaaauaccauuuacaccucuucagaucuguaaguaccuuuaaacuguucaaaagcaggcaagaaauacaguaauaaagacauuacucccuuacuucagagucuuaaguaaugaaauucuggggggaaaaaaguacuaugaaaugauguuaaucuguuagcauacuugacaaauaaauuguaccacagagaaacccuuucuaaacuuggcauugugguacuuaccuauaauccaagcccugaggacuaaggcauacguacuaugcugagcugugugagacccuaccuuaaaacaacaaaauucuaucaaacuuucauuuuagggaaaacaacagcaagaaugauauccuagcuuuuucuauucaugaaauugaauuuuaacaaguaugaucucauuaccauaugugaacauggauuuuuaaagaagugguggucuggguuuuugaagacaggucuuuccuuaggcacuaggugucccugacccacagagaucugccuaccucugcuuucagagugcugagacuaaaggcacacacuacuaaaccaaauaguaagguacaaucauuggaguucucuuguucugucuucacaucuauguccuguccuugucuagaauccaaacuuucaacuuccaaaagcuauccauagugacaggacucucuuguuuaggaaugcagugaaugacaguuuggaacuucugaauauccucaggauggagacugaguguuagagaaauacagccacuuaggccugaaaguucuggucccauuccuaccccuuuguccccuuccuacuucuaaggagggggauaauggacaaaggcucaguagcuaagccagaggugaccauuucaccaacagugcccacacaacaaagcaacaaaaccgcagcaggacucaauucugauggcuccagaaaccuuaauuuuguaguucuagagucuggaaaccugacagggcacaggcacuccucaguccucucuuucaccucuacgcccuauacaccuaccucuuccuuccgucugcccuuuguuauacauagacaaauagagacauuuccccagauucugucugcaaucuagcauugaauggaucaggaaacuugaccagagaugaaacauucuggacugaaugcagagggagagggggaggggcagacagacagacagacagacagacugacaucuacacaccguuuuucuuuuauaucacacugucuuacuggcaccaaagaggaagaacagcucuaauuucucauacauccugacauugauuaaauaugcauucauacagagacauauagacagugugcccuuugagguuuuauguuuuuaauauuagaucucuauauuuuauaacuuuuagauauuucugaggacaucucugcacaaguuguacauucagcauuaguuuauuuagaacugaucauaaauacaagauagagguccagcaugauuuuccucauauuuuuuuuuacauauuuaguacuuacaaggguuucuauaaacaauauagcaauguaaucagaguaacuacuacucaaauccuaacuuauacuuaaaauuuuccugacuacugacuaaagaacccuuccauuucuauugaccauucaggguucuucugugaaggccacuuuaccuucuguccauaugucuuacgguuuggacaaguguccuaacaaaaggcuauguugaagacuuagucccugacagguagugagggagacaacuggaucauuagaguucuaaguccagcaaugcauuacuccaugaaugcacucacugcugaauggaggagaaggaaccuagcuggagaaagcuggucacuugcaggggugggggugggaacagugggacugugaaagggaugccuuuaaagguauagcuggucuuggccccuuccugucucucugugcuuccugucugccgugagacaagcaacuuucucugccaugaccuuuggucauaaugcucugcuucaccacgggcccaaaauuaauuaaucaaguguuacagacugaaccgaggcgucaaaauaagccuuuccuacugcaaguccaucuuaagcgcucugccccaacacgaugacaacacaauauggugcuggggggcuuucccgauuugugugcaauuaauaacaaauuauuuguugguuauaaguaauauccagguuuauauccaguguuuuguuuuuuagaugcuaauuuauuaaaagguuuuuaauccuaaaaauucaauauauacucuuucuauaaauugauuauucauacagauaagaggaagggagccaguaauuuuuccauauuaaguaaauaucauauuuacuucucugaaccucaauucaauucuaccucugaaaccuaccaaguuucuauuguacuugugucuauuucugagcugugcauuuuauacuccuagucuauuuguccauccccaggguucucaaccaggauaagauuccuuccuccuugggaacacuugacaacaucuagggucggaauggcugugacaacugauguguguguuacauggacaagguauuaguggcagaagguagggagacgagaaaaaaggcuagaaaugguacucuguagauagugccccauuccuagguuuaugcuguccaaaaugucaacagagcuacugcugaggaaugucggucucuuccccugccagacacaguuacuucugcuucacuccugccuucucacaccacaggguuucacaguuguucccacugaguggaugagcuuagucaguaucaaagaaaauucucaauucuuuuacaaugaagagauucccaacuaacacacauuuagaguaugucuuaaguuggcuguuuuguuauuuucaauagugcuauaaugaauauccuugcucauaaugcaguauaaucucuaaguccucacaacuagauuugugaauuaaauguuauauaguaaaugucacuccauggccagagcuauagcucaaguggcaagaauacuuuccuccccagcacgcaugacagcuggguucaaugccuggcaucuuaugaaaccagcuacagcgguccaaccuuacagucucaucaguacugaaguagagccaagagaacccagagcucaaggucaucuucaauuuggggucagcauaggcuacaugugacccugccucaaucaauauaguuaguaucaguugacaaugccagaugguuuauacagaggugauggcuugccaaauuauaucaauuugccuauuucaaauagguaaacaccugugccaaauacuuuuaaaucacacuuugcauucuucaccgaucuaagagauaaacuauuucuuucauuaacaaugagacuaggaacuacuuuucuuuaugggccaccugaaguuuauccucacauaagccuucuuuuuaaaggacuuauacaugauagaaacauuuuccucucaauuugucauuuuuaaaagauuuuucaauaaagaagguuuuaaaaaaauuuuuuuuaaagauuuauuuauugguuauauguaaguacacuguagcugucuucagacacuccagaagagggcgucagaucucguuacggaugguuaugagccaccauguggguugcugggauuugaacuccggaccuucagaagaacagucgggugcucuuacccacugagccaucucaccagccccuaaaaauuauuuuuaaauacucaaacuuaccuuauuauauuuguaauuucucagguuuuuuuguuuuguuuuguuuuuguuuuuguuuuuuguuuuucgagacaggguuucucuguauagcccugaguguccuggaacucacuuuguagaccaggcuggccucgaacucagaaaucugccugucucugccucccgagugcugggauuaaaggcgugcaccaccaagcccggcuacaguuuucuuuuaugcuuagaauccuuugccaugucaauugccagcuuaugaguaauaaauacuauuaaaacacacucuauauuugccucuucucuucugucuuuaaguuugcuaauucgguauuacacuguuguggggugagcuuccuuuacucucuuaccacuaccuaagaaagagucuuauguucccacacaugugcauauugugugguuuucuuuauaucucuaagaggaaaggcuuuacuuucuggccuuuugaaaucucaaacuggaauuggagagauggcucagggguuaagagcucuugacugcucuuccagagguccugaguucaauucccagcaaccacaugguggcucacaaccaucuguaauggaauccaaugcccucuucugcuguguuugaagagaaguacaauguacucacauauauaaaauaaauuaaucuuaaagaaagaaagaaagaaagaaagaaagagaaagaaguagagagagagagagagagagagagaaagacagaaagaaagaaagaaaucucaagcuggccugacaccagaugcaaguguaguuguugaagcacccuguggucagaggaagaacgcugcggacacuaacucauccaauuagcaauguuugcaaaggaugcuggccgaguccugagguacacgggcuucaauaaugacaaauccccaacuagucuccacucacauuuuucauacacauacauguuacuacuucauuuaaggugauuuuuuucagcuuuuauucuuacaaacaaaaaaauuagcacaacuaguuugcuacaauuuagaaaaaucauuagaugaugaauuuagaggucauuuuuuucuuauaaaaccugacucaauauucugagauaauuuuuuucaaauaaauauuuggugauuucaaaaggaugaaauauguauaacaacguauagucuuaacugagcauuaaaauauuuucugaaaagugaucauaggaacagcuaacacaugaacaaaugcuuuaaaggguuuuuauccuaacucauuuauugcccuauaaccuccaugaaaaagaugcugugaacuuccuuagagaagcugcaccuucaaaauguaaccuccgcaggcugagugcguggaagcucacugacucuggagguggaaggcugcaggugcagagccuaauuacaaucuaccuuggaccaucuuuagcccaagucagagagaucuaacauccagugacuaacauacaaaccuuuuggaauauacuaacuuaaagccuuaguucccaacagccagagcucuagaguaccuucuucuacagacagcauccugggucuauaacaagaaccuuucagcuuugcuuucaccuaccuacuuaacauuccacuaaugguuuuuaaaguguuguguuauaaaacuuuuaucaaacuguuaccauguugaacauggaauuugggguaacgucaaucaguguucaugggccacagucaaucagauuugguuucagaauaagcuaucucuuaucccauuugagaugaguuguguuuuuauguugacaauaccaucauuguuuuuauaaagguagagaaaacaaaacuacagacucgugaaauggagcucuuccugaaauucucaaauacaaaacuucugugaagaaauaaaguauaaggagugggcgggggaacacugacuuucuuaaauguuuuuaccguaagugacuuaagaaaacuccuuucuauaaaucuaccuagugucgaguacuccaacaggaaaugcauuaaauccucagguccccccaaaguugccagaaucugcgguuauuaugccaugaagacauucaaggcaguggcuguauguacuaucucugagaugacuaugcagacuccucucgaacacagagaaugguggaaguggcuuuaauaaagaagagcagaacgacuaacuuguauccccaguagaugacacuaagcccugugcuugaagaguaucaccaccacuuuuucuuucuuguuaacuuuaaggugagcacugcggggucacagcgcuggguacugcaucuccgcacacugaggaagaacaaaagggaaccaucccugaacaccagaagccuuucuaacgcucuggcaaacaccagcugugcaccagaaaccaaacaccuaacuucuccaaccucauuuccucaccuguaaagucuaaauaacacgauccaccuuugaggagugaccgacggauuagguaaaaccugugagaaugcuuucuagcagacaaauguagaagaguuacugccaagaacaaaacugcuucuuuauugacgcuccuuuucugggagaauaaggcagcagaggcgcucgcacuucucaaggucuuggucaggaccucacuaccagguacccgcacccccaaccuuucaauagcaagaacccaccuaaaaacucaucguaaugaucucaucaacaaaaccugccaagcuguaauuaucuggaaaagaucucuuuauguguuucucacuucugguauguagcacagagagaaauagaaagugaaauauaaaauacuuuuagcacucaauccauaugaaaugaagacugaucuuucuagucucccacagaugucucaucacccugggaugguaagcuuucauagucacauccaacaccuuauuauuuacucauagaaagaguuuagggguucguuguaaguauaaccuuccucgcggugacuuuuggaaaugguuucaaggacugacauucauggcuugaguggccauuuaccucaaguacuucacgauccgguggacuccaagacacagaagugacaacguauucugcacugugaaauggguagacagggggcucaagcucuggcucaaguccaaggucacacacggcgagacccggagagcuguuuuuccagggcugucgcauaggacgcuggaagccagcagucauuccccaagagaaacagcagacagacagccgcaugcucacacagccgugcuuucuccucgcccauccaggugccaaccgagcagggcacagacccgccagcaccacucagcugucaacgcuggcacgaguaccacggguccccgcacccccgccaaaaggcccucuggggaaccagaccgugguuccccaagccgcgugccaccagugcccugccguucccgucggccugggagagggcacgccucggccagcgggcuagcccuacgccguccuuaccaaggagccggagaaagaucugaagcccgaugcagaaccggcuuuggcuggaaucguaguaggaguugaagauggcgucgaugauguagaggcagggcacccggagcgccacuucgagcgccgcccagaccugcugcugggccauccgcaccugcugcugcgggggccccaccgccgccaugagccgcugccacaccg

SEQ ID NO: 12529 - RNA, 40325 nt, Mus musculus
auaaacaaaccuugccaggcuacccucucgcguugcaggcagauugcucacccaucuucgucucccucuucaccucccgcggggcgcugcaccuccaaccuugugguuggcuccuuuccgugcuugcuugcucauuagguaagcccuccggacgccuucuuccuccggagcaagacaaggacccccagcaaagcuugcuuucggggugcuacuggacaccccgcccgucuuuuguggcccuugcgaagaccacaacugguggucuucgguggaaccggcgccggagggauagcuggcaucacuggagcggguuucgauuacuauaaggcacaaaaagacguguugggucucgcuuucucucuaauuggggaagugggauuaaggggucgaaguuggggcggagagccugggaauaccugggucgcacuuccuggcgucaacccugagccacagcugacuucucuguccacugggcucaaggggacacuuugugugugcucucgcgugugaagggguguggaugggugauggggugacuaggaaaagagcgacuguagcgcguguauccaggggaugaguaagggugagcagacuuggcggggaguguggagaagggggcgagggugugucuacucuggagccuggucccgaaccagugugaucugaguccagguucccauccaguccagagcccagugcucucuccaagcugugcgugugagagaacgugugugugcugggggagaguccggggugugucccggcgcgugcugcacgcgccacugcgagugucggcggcgagaggagcccaggcaagggugcggcccucuagguaguaccggguuggcucuguaacugcgcgggaguggugguuugugccuccagggucgcgcgggcaucuggcagccccagaguuggcuggagcucugagugucgucauuuucgccuccgccuccccccgccccaccucccuuucuuucucccaggcgguccucccugcuguuuuagcccggagagcagcuggaaccgcucguccguucccgggagaccggucgcggucucugauucagccuguaggguagauucgggaggggcgugaggaaugcugcaggcucuggggaaacaugcugucaccaccgccucugucaaauuaguagcugaagcuaagauuuguggauggcuuccuuacucugccaccuuccgucuucccuugucugucgccuuugcuggcagucaucacggauccccaugcacugucccuugggcuuuaaugugggaggacaggucggggagggaaguccagugguccguguccuagaacagccuucagcucucccucacagacuuccugggcaggucagcuuauuugaguccuugaaacuccugaagaagaugggaaauucaggacagccaauguuccccccccccuuacccccuucagugaucuccuacaccaccuaaagugaacggacaggcgcuagcuauggauuucaaggcaaaucuuucagguugcuucuuacuguuagagauccuagcaauuugucuauuucacaugugugaagugaaugagagaaagcuaggugcagaggaaaaccccccaaaaccaucuucaugggacuugccaacuucuggacaguggcagggaggggccacuguuuuauggguguggcgcaaccagccccaggccagaaggguaccaagucggagcugaaaggugugagggaggcuuuacaggaaggucuggaaaagcuccaagaggugagacuacaguagaugcugucagggagcuaaucccaccugggccuucuuagcuugguggugcuugguaucuccguggccaguacuggggaaggaggacuuuuucagccauaccaaggacaguagcuugacccauaggaagagcucugacauuauuaaaaaucauugggacagcucugcuuucugcccugaccccgguagguaccugauacaauccuauggcuggaggagguaucgcuuaguuccuggguccauuguagagucuccucuccucguaagcuuucucuuggugaaagcaaaccagaaauugcuaacuacuggcugggcuauuucaaaaggaaaucccaacucacacacauccuuuccugucuuuugcuacuuuagagaugagaacugagaucagagauggagaggucuguggcugaggucagccagagucugaacuccguucagagucccuucucagaagucucuugguuaggacugaacuugaguuuugccugaaugcaacggaaugaauaggaacuuaccuucuuaccaaguuuugggugaggccaguaggagggagaggcagaguauauguuugcuuuuuauuguuuguuuguuuugaaaguguuuaaaucauguguugaaguggaagcaaagucaguucagugagaaagagacaaggguaacagucccucuaccugguguuuuuuuuucaguuaguuaccuccccccccccccugcccaacagugcuggggucccugggugcauugaccccugguggcuugaacuaaccccagcaggggacagaaagaaggcaguguuuuucugaugucccaaagcugcaguacuucccuuaugaccuagauccagaggagucaucuaaggcgugccucaaagguccuguaccuucugaggcaagccaacguaaugacuagcacuggggguguagccauagcagagcgaguauaggauaggaagagagucugggacaggagccacagagcauccaaaggaucauuugcuaccuuccaccuccacaggaaugccgccugggcuguaucaucucuauugagguggaugagaaaaccaaaagcuuaugugaaacuauaagugggagaaccagacagacagaaccuuuugagucagcccucaaaacuuuuguguucuagcguaacgauauauccagguguuugaagaaagcagggaagcaguaugacacaugcagagauagucucgggcuuuggaccuuaguuuuccucuucuauaaagguagaauaacacaaacaaucucaucuggguguguagagcuugcuuuggcuaauccacaugaagugaggccaguggucagcacaugaggagcacuguguggaagcuucacauaacaacuagagaggaggagggcauaccugcuaugccuccuucacccucuaggucuagaaguuuauaguugcuuaguacauagcucuucccuacucagaucgcuaugcagccuaucauauugccucauacaauggagguaggaggaggucuuaauucucagguuagaaaaacaggcugggcaccagucuagaaucagguuaauggaucuggaccaaaugacuuuauccuuagccacuucuaacccuaaccuugccccuucuggacccagcuuugggaugggugguuaaucugguggacucacugcaggcuguggaccuucuuggucacaucugacccuaggcuagcccuucucacuugcuuuuucucuccaugggagacggagcugcuaaacguggccuccaguuguuuuguuggaaggagguuuguacaagagcaggaugcgacaccguggcccagcaggaagcugacugcagagguggagggucacguuuagauguuggcauggagcugaauucucuaagguggguguuguagaggagaguucaggcacuuaaggagaaugcgaggaaguccgccuuggcaccucagaauaagaacaugcuuacaaaaucaggcccacaaacaggcucuuugaaacaagaguuucuuacuguccucucuauuuagucgaucuccaugcccacuggcuaccucugcuuucucaugcucugucucucggacuauaggucuaacuaguucuucccuacccaaggaaguagaaagaaaggcguaugaaccugaaggcuugcaguucauuaaguauagcuucuccuuuccuucuaucugaagaaaccuuuaauuuuucacuuuguagucuucugccuagagaggcagggugcaggccagcauccaucuucacugguuuccauccucagcagaccucuccaaauacagaucugauaggcccucuuaagagacugaugacucugaaccuuucucagcuagccagccucgacccuucuagacucuuccacggcuucuccgugguugguagcugggcugagugccuucccguucucauuuguccuguggaaucacgcuguccugucaucugucuguuuucucaugcccccucccagggccuggcacuuagugagugcucuauccuugucugcccaaaggacacugaugagggcgacaaaccagcccaucuguacaggaaugacuggagaggcucuucugaaguguggaagagacagagccauuuugggggaaggaucugauuaggguggccagcaugcagucugaucuuggggacaaagggcucuguaugaagauccauuuccguccuaggcuaacacugucucuaugaugucaauaaauugucucagccucgccagcauagcucaaacccaucccacggauucacagaauaguuccucuagugcgaccaauguccuucuuuggacuuccaguuacuggcuuauccuucagacagugccaaaccacuaacugccagaccucuggugccaaaacaccaacgagcacuccgggaagaucagucaauguaggcauauuccuggcacuuccgcuuccugcuguuacauucuaggcagcccucuacucugccuaccucacugcucagagcucaggggacucugauuaaauacacaaaucccccuuucagcuggggcagguagugcagcccuguagucucagcugcuugagaugucgaggcaggaggauggcaaguucaaggccagccugagcaaacugagacugucucagaagaaaaaaaauauagaaagaugguggggaacauaguucagagauagaguccuauaugcacacacacacacacacacacacacacacacacacacacacggcucaaucuaaaacccaaaaguuucaguccccacagaugcuaggggugacaaugcagcuuuaguugccugaugucagguggcuuucuccuugugaccuuugucccauuuuuccauuguggagcaaagcaucaauguugaguauucuauggagucccgaggcuccuggaggaaccccuguuuggaaaucucuaaggaggaugguuguaccaccuuuuggucuuuuaauaucucugagauuuuacaucccacucuacacucccccuaaguguagagccuucucugauccagccugucugcagggcucuuugugagaugcauuacauaagaaaaucagcccagggcuccacugccuugcccuucccagaaucuucacuuucaaaaguucagaaaacaccaagggagcuggguaagugcuucacagagugacuugagagucuuuuugaacugacauaggaauguccccacaggcauguaggggaaccugggcuugucccaagguaguuuuccuggguucacacagaagugauacugcccugcagaccucccugggguugcaauuuuaaaggguugcuaugcuaccacugguagcacacauugacccucagugcacugcaagggacaagcuacuaaaaauacccaugcuucugugacuccuaccuggagggcagaaucugggccagcugcugacauaacagucagugcugagccagcugugguccccucugguuuuccuuucucuguuucucuaaaggacuccugggaccuguuauuugccuccaacaauggagugagguggcuggccaucuuucucuaggucagaggauggagacacggaaccuuugggaagucauguaagggagauuuacugggcucccuaucccugucuaugaaguuggcaacgccccugccuaggacuucuuugaacacagaaaucaguguggggucauggaagugacuuacggcauuuacugugguguccaguccccauggaugcucuuccugggacaccggguccuggaagucucagagcaguucaugaaugcgucuuugcuggauuucucuuuuguuucaccccacgggaacucuaggggcccaggagagcuuggccaagagggcaagcaaagggguagguuccacagagcagcuucagcucuggggaaugacagaacuagggagcccaggguaagcacagaggagucugagaggagucaagaggaaggaagugagguggggucauugggccagagcugagcacuuugcauagggcacuuuggucucagagcugugccuuccuaccugggcccccaugucuaccuaguuugucgggaauccgaaggacaaacacacauucuuugcaagugaacacagggaagcucauagggguuaugucuucgagucaugaggcaagaaagugaccugauucccaugcugcgaacucccaagccagguucaaucaccucucugaggcuucuugagauuuccagauucugucuucacuacccucacagacuggcuaaugauucucacauggccuuggguugcugugggacacucaaccuauugcccuucgagacccaggguuacauuucucccuguucccagcacauguugacuugacuugaccaggggcccuugaauucuuguuccuugaugaccaagaugugcuugccuagccuuccugacccuugucacucacgaucuagcaucagugguguuagagagaccucauggugcugcacugugggcuggaggacuguucggcauuugcugagcaguuuuuacacauccucuuccccacugggccacucugggacucugggacgagcaauguguaaagcacaggcuguguccucacagugccccagggacuccccagcaccacaggaaggaagggacacugguucauuaaauagcuauuugcagguccuuugaguuguucaguuuaaccuucggcuugcugggagccugggcaccaaguacacacagaugcacacacggagguggagcugaagcucacaguaauacuagaaucugcucauagcaccagguggccuucacuccucuuugaauuuucucugaauuccuggagcaggcaggugggacaggaagaagcaauagcagccaggcugcuggcugguguuaugaccuggggcuccaccucugugggagacuuucacugggaggaaaucugcccuccucuaaucccugcagcuggccaugugagcagaagccguuagacuuggggcaagagugugugggugugaauguguacuggaugaaagaauuguuaucuaacagacauuuucuggaugcucuuuucauacuagggaccgcuaaacucaagcagucucagacagguuucauuuugcaucccggggacauuuggcagugucagcgggcauuuguaguugucacagcuugaggguguggucguccagggccggggauauuuccuagcaucauagaauguguaagggccugaaugucaguacugaagcacacugguagggcagguuuuuuuuuuuuuccaugcuccuggagguccuuuuaggcuacagggggagccugagagccaggaccucagucucaaggccugugugugauucucaggcuugcccgaacccacacugugggaaauuugaagaccuccacuuuacccgggguucuuggcugggcagaguuuguucagcaucccugugaaaugugaaguccuccacucucagcaugagaggugguggugccagaggccagggcuucuggaaggucucucuaggcugcguaggcgaggugucccacggcuaaggucucgggacuaucaacaugcugaauuagcaagacucucggagcauagcuuuucaugccugcugccuccgagcuggcggcagcccaggaauguucacagauauaaaacugacuuuguuuuucgaauguucuggcucccagacccgaaaggcuacauaaagacauucuugugagauggucaucuacuggggagagucacgcuggggccccagaccagcacacccugucuacccacugcaugccguauauuggcaugaauauguguauuucagaggccugcucuugcaggcugaccuguagaugagggucacagggcuccugugagcuugggcaacuggcuuucaggaaguccugagacuuuagcucccauuguugcaguaucuauaaagccuugaauaccuggacuuauaacucauauuuucccuguagguagugagaggcuauauccugggcccaucucuuggcauucuccacccacucugaccucugugugccaccugugacacuucuguucucuggcauuccuuaggccccacucuuacuuuuucagcauuuacuuuuucagcuagacuauggauccggaagaauguguguuuaucucccagaucuauaggcauugccuccugcccucuccuuuccccacaauccccagcucuuccgagcucugcaccuguucauuucuguagcccuuaucuauuggcccuuauggggaauguguccuagugccaacuaaagagaucccuguugccacccuuucuugcccuuuuggguuuggcucagaaguaccauuugcuauagggucauuuucccacauccuguuaguguuccaugucugucaaaccuuuagcauugguuuguuccugucccguucucuccacuguggucaggcagcucagagucuugcucagagguacauauugcaccuguacgugguggcacccaggggccuuuuggucccuuugauuguuaaucuggggacaucuggcaucagcagagggauguccuucuagagugcaucaagaagcaucagagugggcuuggugggucuggacuaggugugaaccugcuuuugggucuccauccaucugcuuguuuguagcuguaaccgugaaccaguuucaggggaacgagggcuuccuuguaguccacgaauggccaugggugugggugggaaaagcuggggacggaggagaggccuggccuucuuauuuguuucauuucugcauuagcuuuuuuccaggaaaguuaucucacugagaagugcugaccuccuggccuuuuuccccugguaggugugugauagcacggaaaugucccgagagcuacaugacguggaccucgcugaggugaagccucugguggaaaaaggggagguaaguagagcugcuuuaggugacgcuaucacaugcuccuagugggcacacauggucacauauuggcauggacacucuugagcaugccuucauuuguauauagcaugcaugcaugugaacaagagcauagcauauaagcuauguaugaagugcacacacacacacacacacacacacacacacagagagagagagagagagagagagagggagagagagagagagagagagagaacagguauuggcccccucuauuucuaucugcacuuagugacucuugcucuucuugucuauugcccagucacaaccccuguaacgggccaucuguuaggauugguuuacagcguuccagcccccguguuucucuguacccuucuuuguuuuccuggccucuugggcauuuggcacugaugauccauccucugugcugcaggcucuggcuggggcccagcuuucuauuggauucagucucugaguugggcagaaaacagaugccgacuagaagagugaggguccagguccuccccgaaccgcacugcccuggcuuccuuggagucaacacacccuuuccuaccuuccuggaccuuuugccugucccagaaaguuguuaaagaugaaagcugauguagcuugaggaaaaggcauugagguuuccauugcccucuucucuccacaaaagacuggauuuuaauccagaacgcaggcauuagcagccacgagaaaauuacaagagcagaagagacacggcuccauuagagucaggaguagcacacgcgcaagguguauggacuaccuagccaccuccagcacucugucacccaagcuugugcccugcuucugucuucagaucucuuuuggccaaguguccuuggaaaagaaucuagcagauagaccaauuuucuacugggcugcuguucccugagauaaaacagacaauaucucuuugcaaggacaaagggacgcccacugagcagaguuuagauucaggcaauggaaaagaccaugaguauugauugauguucaucucuaaccaaggauaguaaccuuguaaccauggcuuucaucucuccacagagcaucacuggucuccugcaagaguucgauguucaggcaaguagaaaaugugaucucuuuuuuauccuccagucuaccuuuucccuuccuuucuucuuuccacuggcaugaaguagaucgcuuuuauaaauguggagucagcagagaucagggaguggccucagccuauacugauacuuugcagcuucuccuggaagaagcuaguuugaguucuacccggggagucaaaaauugaccagcccccaacagggcagacagacagauuaccauguggcccuggagagcugggauguguaugggaaauaacagauguccaguggaucuggagacccugugauguggacacauaguaaucuuggcaugucaggaaaucugaaacuggggcucuaggcauaagguuguaguauccaucccacucagagccagauggaggacuagccaggauguguuucccagcuuugucuaagagccaguuauagagaguggagaaacccugcacucuccaguguccugugccuucauccccaagccugaguacccuggagggcugcaggcaugcucauuuagaccuccaugaguucccagucacacaucuugauuucauccuguucucugcagacagaggaaucaccuaccucugguuuuuccaggggcuccugcuuugaugcacacucauccuuccacauagaggugggguucugcccuugacucuggaagguaaagaaaaaaaaauuagaacaagaguuagaaguuggcuugguuccaucacaggucuaaaggcauaaagugggccuuugagggucugacaccaguaugauugcuggauacuuugaccuugaggcuccagaaauucccagcaugggucugaggccaaagcuucugucuguucuccuuuggggccagcuuauccuguuagcuggcaacagaaaugaaguauuaagccauugcuguauaucagcccuuggaguccacuaagagagguagcaaccuuaacagcacagagauaucuuugugaaccccaagaacccuauaaagcaggggacuuguccuuagguccaaaguagagguagguggucuagcccacacuugugcaagagacccugugggguuuaacaauacaagcauacacucaucuuggcccuugaaauggaacccugagacaggggucaguaucaaucuaaaggcuauucagagaugacaguugcuuccauuggaggguggagccccauggccucauaagccugcaccccccccacccacccccggcacagugaggauucccggaggaacagguugugguuucuaccccagggcuccuguugacagcggcucagccuagucuccuagaggagucuccuugacacacagcccaguuuuuacuguccuuggauguccucaaccugucucuguaguugauaacuuuccaguagggauagcaucccugcauucuguggggaaacugaggcacccaaacagagacuuaccugaaguuauaucauagcucagaccucuguaucccgaagaaacugaccuucuuaagagucugcaaugcuguuuguucuaacuaaccugacaagcugugugccuuuggcaaguuacuucaccuugcugaguaagcuucauccaguugaccauaaccaaguuccaguacuuaacggucuacuaggcacuguuacgaggaugcugaguccaguuaaauucaaugcuuuaauuuaacugugagauguacuccuucacucugcacaagagcccugcuuucagacuucucaucccugcuucaucucaggucagaagaccaaguagcgauggguucuguggucaucucuucaugggagcuuccagguugacuagguggugacuggugaugcuaggacacugaccugggguuacuguggugcuguauaugcugcggugccucccaucugugacagcuuccuaugaguagaauuuccaguagggguucaaagcaaaggcuguggugugcaaggaagcauggcagaagcacaagugggcagaaguggccuuuaaaguucagggacuugauuucuuagccaccagcuucuuagucuacaugcuccuauuuacaugaggucaagguagagacaugcuuccaaggaucaugggugagaacaucagaagccccucccccccagauuaguaggguagucugcauccacccuggaacccaccagauaaggaagacaaauaagcagacaggcucccuaaccccauguggaaaggcagaagagggaccauggauggggugaaggcagcuccuuggguggagaguaucuaaggagggguuuagaggaucaccaguccacugaggacugcuugucacuucaucccuucuuuugccugacuagguauguucuguuugacucccugugaccugguccacugucuaucagcgggcuggggauguaggagaaucauuuuaguagcaaggagagcugguggggcuuccagaaucuuccacguacuuguugcaaaaagggagagacagcuccggagaguggcuugccagaggccacccuguauuugguagaggaggcaaugucccagccuguaccugucucagacccacagaugccugggugguggugauaaagucacugccuguucccauauacaagguaccauacuaagggcuucccagccagcacugcauuucacaccucaguaagcaccuguccacaggcacacguggagauaaugagagggggggugguugugcuucgggcgggggggggggaggggcacagcaggucuaguuuugccuucauuagaggaaauggacguuuuuggcucacuguuuccagguccugaaccugugaguuugcucuccuugcuuccuaugcaauggccagaacuccacaccauccaucucacugucuaggacucagggaugggugugugcuguggugagcuagaagccaauggaauguccugagggcuuugguuuaucuuguucaguccugaucugcccuauuggagauguggagggacagaggaagagcagacauuguacaucagugguggcuaagguugugacaccccaucuugcuccuaaucacugugccaggguaaugagagcuaugaaacuguccccugaggccuugguuauucaauuggcugugugggcugagcagagagauguaacugacagcccuggggcccccugugcagugagggcugagccccacaagucuuucacugauuagggccuggugacuugcuuucuuuucucccuuugccucccugcucaguguaugauugguaaagugauuauuuuuucucagaguugagacugucccagagagaguggaaggccaaugccagcugccccuuucugguuaucaacuaagucccuccagccucuguuuccuauuuaagugacuuuguauuuuagagaggauaauguuggagcuauaacaucacagaacauauuccauccucuauugugucuucccucugauuuuuauugugguaaaacacacaaaauaguugacauagucaccauuuuuaagugugcaguuugguggcgauaaauacauagauuuuaaaaguccacguucccucuccccaaggcccuccccccaccauuuuaccgucucugaaggaauuucuuguuuccaagcaccuuguauaaagggggccuacacagcagcugcauuuuggugacuggcuaauuucauauggcauuguaaucuccagcucaaugugugguaaaauggugugauuugucggcuaugagguccaugggcaagccaggcaggugcccugggauuucucuguccucuuggugagucuuugggaaccugugcuaucagcucauugucucuccugaugguuggagagaccauaacugaaucuguaaggugggccaauugguccaagccugacugggacucuccccugaagaccuuuccuauaguuccagaccuauagucccccaccuccacccaccccccuguccguaagacugcacuguggcucaccucugccauaccucuuuggucugucuggccaaccacaugguuuguacuacauugaucucuuguuuggucuucggaggggaggaggugaugugagguuuagaaugucuguuucuucuugauggccauucaguaucuucauccacuuccuagucuucgcaucucauggggguuggcuuaaggaacccagaugcuuugccgugcccaccugaaagcagucugcgaugcuacaugggggacagcuccuacuuuggcauuuucaaugaaccuagaugacacuuccuuuuuccauagucuuagggguguaaguuuuugcacauuucuuuuaaagcaguagaaaugugugccucaauguucagugcuaaccagaaaagacucucccacccauagcuggguugcccaagcaaguauuaugggccuugucucucccugccugugucaccuugggguuucuucuugucugaggugggcacuguucuagcucauagcaaugcaucucccuuugcuaaagggcuucuggauccuuaggauuucagcuuguggcugcuagucuguggugcuucaggaaggacagaagaucaguuugaucugguccugcuggggcagcuguccuuaaaggguaaugucucugucucuaaguuugaugagcaggcguugugggagcauuugagauuugagcuuuuuuuuuuuucuuuuaacuacaauucuggaauuuguguuuguuaaaacugccagcugccuuugagaugguccugcucuucugcuccagaugucuaaagcacuggaugcacaucuauuccagggccuccuuacuaggucacgcacaguggaaccuaucuuugcagagagaucuguuugaagaugcccagagguacuauugaacgucuucuggaaacugcucugugcucuccccaaaugcccauauaugagucuccugccagccugguaagggcaaugcccugcccuccuugugguaacaucuaagauauaacucuagggaaaucacauggugaugaaauggguguugaagcugacucagcuccuacauccagagauagaguuuccuccaaagguaguuucgggagggcacuucuggcuccaggcugguuggcuuccauuuacuguuaggucuucagugucuaauuuagugguucucaacuuuccuaagacugagacacuuuuauacaguuucucauguuguggugucucccaaccauaaaauuauuuuuguugcuaccucauaucuguaauuuugcugcuguuaugagucguaauguaaauauuugauauguaaugccagagugguuccaaccaacccacagguucagaaacacuugucuaaugccuucucccuaggcucugcuuguugaaauggcuucaucugauuugguuuccaugggaauauguucguauacacgggacacucuggaaaaugaacagauguucccuuuggggccuccuagaggguagagagccagacaggguggcugaccuccguaacuccugagcuuggucccuacuccuuguaccucccuggagcaagcuaggcuuggggcuguuucuuugcccuucuguuagcaagcccgucuacucaugggaaaugcaaagaguggccauuuuggacuaaguucugucccugcaccuuuguuuucuguuuucauucgccaguuaauuccuucuagagugggcagaacucccacagaaaguuaugaguucuuaguucccccauuuccuguccuuucccuucucuggucccacuuuccaagcaagcuccugggauucagaaacuccacuggcagauggcauggaugcacaucuggggcaugugacaugccagcugccugcucugguguuuccuagcaacaucccuggaacaguaaaggaaagccaucuaggcugaggcuuggaguuggggcagacgucugccccaggccaagaucugucagacucucccagguagaccuucaucuggcaacagaaaaaguugcaugcuuuucuuucucaaggcuuaguucuaaucugugaaacauaugcaggggggccagggaguaucaguaccaugaaggccauggccagccuuccauccauguaccuugacccuaugcacagaccacgguguuucuccacuggauuugggguagauuggucacuccuuuuuucuuuuccuugucugaggaacauucuuccccugucuggcuuccuuggagaauaugacccuagguguuuuuuaugaccagggcugacacaaagccacaacaacaggcugugaccuguagcuucucaucucugcuuuggugggaugguaacacaaagggugguggucccuuaggacauuguagucucaucccucaguaucuccuguggugugacuugcuggccuggaaaaggggugguccaugccacuagcugcccuagagucuuggagaguaacauccucuagcaucuaucugcccagggccuccagggaagggugagauuaugguggguguagcagcuggucucuagagcccuagauuauccagccagggacuuaagccauucugucuccacaguaaucacaucuccaacaguugccauaacaaccaacagggagagagguaguuguuugaaaggcacuucuaggucuuagcugugguagcagccugaggagaggcaagcuugccuuuauuuauuccuguucugguuggcauuaacugucaaccugccacgacucagaauuaucuggguagagcaugucguugccuggaccauauugcccuaugagcaugucguuggggaauuugucaugauuauuaauugaugugagagaguccagagcacaguggguagcacuauucccuaggcagauucgggaacuguauaagaaagcuagcgaagugcaaaccugccugccagcaggcaagcagcauccucuggguuuuccaccauacuuugacugugagcuaaguuccuuagcugaggauagccuugugaggaauagcaaaaagggccugccuucacguuucugccuugacuuccuucaaugacggacuguaaaauggacucguaggcugaaauaaaccuauuccucccuaaacuccuuuugucagagauuuugucacagcagaaaagucaguuaguuaugcaucuucccuccccucccccaaaagcuggucugagugcuaguggguacuaaggguuccuucaguauggcuauauuuucacucuucucgccaucacugcugaucaggcuccuagguuggagauaugcucucccuuuuuagagaugaccccagaaggcguauguaguaggacaaggauuugaaggguaguauccacagggaggcuggccugaccuauuuuuagauggagccauguggguuagccccaagacaauaaagaauguagccccacaauagaccauuguucccaugguggcuucagggacagcagaugacccgcgucccacggggcugggcuauugcuccugucuuauggauuuuuccagugcuugcucuguguaggagagaggugccaagccugaagggaaggggcggggcaagggagacagggcugggcuuugugucccaggggacuuauuuugaggaccaauaaggcauaugguucaggagacccccuguacuggggguucaagaagcuggguauucgugccugugcuugccagugccuaccuacgauugacuguguccucuggugucugucugugccugccugcacccaugccaaugggccuaugaaugcuguaucaucacuaccucauggacacuaccacagguucaaauccauauuccagagagugaggagggcucuggcuugcuugcuucagaagucuucagggauaggacccccuguaucucucuguccugguuggaaccgagccagguuaugaguuuaugcgcucacauguguuugagacaguauauagcccaggcuguccucaaacucuccaucuugcugcugucuuacuuuccucggugcuaggauuauaaaugugcacaaccacaaacaccuaggguaaggucuuggugagaugccacacuggggacuaggcauguagcacagugguagaacauuugucuaguuaguaggugugaggcccuggguuccaaccccaguauaugcacacagcagaaaagaaaauauagcauucagagacuauacuuuaaaggugggacccuggaaggaggguucaucccuuguguuuuguacuagugaaucuaugugcguucuuuuauccgggugugcuauacuaguacauccaugugcacuucugugcacauacagacauuuguggguacuauucacuaggacaucaguguguacuguucuauuuaagacuaguauauccauguccaugugcaugcaguguugugguauucuauuuauguguaucauguuaccaguauuaucuaugagcacugcuauuccaggagaucuguuauucguacauccauguuuacugcugugcuuguacauccaugugcauugcuguaauuaauucccaccugcucgacugcuacaaacauguguucugccauuuuuguuacacgcaugaggacugguaugcaaguacacccaugugcacuguuguauguguacgaauggcugucugugcugcaguugugccccaguuggggaaucccuguccucaugggcuuuacagccuuauucugaccaccccaagucuuguaggauggaggcuguucaugugacagguuagggugacuuuuccagaacacagcuccugaguggguggcccucccuaucuauucuucucucacauuagacuaugggugcugccucuccuaccucaugagacacauggguccuagauucuggaaggauguuuuuggcaccugaaauuuucugugccugugucaccugcaugauucugaccaccaguuguagcuuggaggugucacacagcccuuuagggcuuuugcaagagaugaaggaucuggagagaaauggcccagcuacacggaaguccucaguguccccagcagaccucgggagggcagccaagagccaaccacagcagaggaggaagcuguugcuuucagacgaggaaauugcuccugggacaugcuuccucagaagccuagagugacagcaaagaggacaggcaccaagggccaaaggcagggucacagagggucauagauguucacaaccggcuucaugggagguucauuugacaucgggcaggguaaaugagccuucugggagcugaggacucggaacgaaggugaagccugucuuuuugaggguagaagaaagagacauauuccuuguucucucaagugagcauggggggugugggggugcuguggauugcuaagaacuggcuucagaguagagcaggagagagaaggaauuuagggggaucguugcagguucucugcucaauccagaaugggaaguuguuggcccauuacacugacagucccaggaaguagaggccaugcugagacuaaugccuccuuucugucuuuaucaaccccaggaugaugguuuaaugcaggcaaauauuugccuauuggcugcuaguuaaacauugcuaggucaagcccagccccacuuccacagugagucagguuagcuccacuugguaucaccuaacagugccuggcauuugagaggugcaaugugagaauuggccucagucugugaaacagagugugucaagggagcugguguuuguguguguguguauguauguauguauguauguauguauguauguauguauauaugucuuaguagcucuucuauuuugugaagagacaccauuacaaagguaacuauuuaggaaaaaaaaacacauguaauugcagcuuguuaacaauuucaguuauauccuggcaaggagcauggcagcacaaauggugguggagcaguagcugaaaucuauaucuugacccauggcugagguggggaggggagaaggaaaggugaacacugggccauguaugggcuucugaaaaccucaaagcccacccacagugauguacuucuuccaacaaucuuaauucuaacccuaucagagcucccuucucugcugacuaagcauucaaauauaugagccugugggagccauuuuuauucaacccacccauugcauugugcuuugccacaggaaacugagguuguucuuugaaauggggagugacuucuaggaagccucaaagagcaaauaccuauuauccaugggauaagugagacacaggaacaagaagucaaggaaacucaagccagaugcagacaacagaguacuuuucaggcaaugugacuggggccaccugucucuggauuguagcgcauaaccugccaggguccugucuucuaccuccugauacagcuuugcucuccuuaccuuuucauuuucccuuccccucuucucuccuucuucuuccccucucccuuccuuuucuuuccucuuucuccccccuucuccucccccucccacuucacauuccccuucccuucccuucccuucccuucccuucccuucccuucccuucccuucccuucccuucccuucccuucccuucccuucccuugcucucuccuccucuccccuccucuccccuucccuuucauuaucuccccuucccuccccuccccuccccuucccuccucuucccuccccuccccuccccuucccuucccuucccuucccuucccuucccuucccuucccuucccuucucuuucuuuuccuuuccuucccuuucucuucugaucucagacaucugcuguugccagugcagagcucuagagaccauaggagguguguacuugggguauccucagaacacaguugggagcauggcauguguccauagucagugggucagccacccuaaaacugugaaucccaggugaugggccucugucuguggucucuccucaggagcaggauauugagacccuacauggcucccugcaugucacccugugugggacccccaagggcaaccguccugucauccucacguaucacgacaucggcaugaaccgugaguuugggaagcuggaaugcuuggggagggcuggcggaagucagcugcucuuacugcuuuugggacuucuuguuuccagccucagccugggaaaaccugaaacauacucugcuguuaguacuggaugcucuggggacaggaagcgagccccacugcugccuaacaaguguuacaaugacuuaaagauuaauauaugcaauggccuuugauacuguagucauucugaaaagaagccuuguuucuguucuccacugcccugaucuuccauauuccccagcccugcugaggacaccucgucuccucuaugucucuagaaugucauacaagcacaguccuccaguguguaaucccucaugauuagcucaugaccagcuuaguccauguuuucaagacugauauauguuguagcuuugucaauacuuuacuuucuugauggugaauaagacccuacugaauggaaaccacacuuggucuuccauuuuuuccucuaacacauagcauuaucagaccugucacagcaauaccucacuucuaguaccaauuucugucuuagucacuguucuacugcugggaagagacaccaugaccagggcaccucuuaccaaagaaagcauuuaauugggggcaugcuuauaguuucaaagguuuaguccauggucaaugacagaaagcauaaaucaggcaggugcuggagaaguaccugagagcuacauccugaucuggaagcaaagagagagagagacugggccuggcaugggcuuuugaaaccucaaacucugccccucagugacacaauucuuccaacaaagcuauacccaauccuucuaaucuuuucaaauagugccacucccugaugacuaagucuucaaauacaugagccuaugugugugugugugggggggggcauucuuauucaaaccaccacacuggaggauggauacucagggucuuugcacuuaccuguauuauaaacaguguugcagugaauuuucacgcaguggauuuuuaaguugaaagggaguaagccaggcuugauggcuuaugcauauccucuuagcacuugggaagccaagucaaggggauuucugugaguuggaaaucaaccuagccuacauaaguuacaggucauccagagcuacagaaaacaaacaaacaaacaaacaaacaaaagucaagugugguaguaguguugcaucccucucuaaucucagcagucauggguagugguaagaagaacaggaguucaaagacagccucaacuauauagcuagaggucuuugccucagccccuuaacaaaugggagacuuauccuaggagacacagguagauaccucuugcuuuaccuaacauacuuuuuguuugaaaauuaugugugccuugaaagaugucccagaucuuaaagccugagagacccagagaaguucaggaguggauacaucuuguacuauccccauggcaaccuuuccagagaggagacagagccagacccucagccacuucuggcacuggcugcaaauugaugauuuaagaagcuuaggggcuaguucuacacugcaccagacauuaguucuaugacucuuccuuccucuaucaccagagggaggucugguaggaaggggugaagacuuauacuauuucuuuuuaagacagagucucauuauacagugaaacuugucuagaacuccauggguauagaucaggcuggccucgaacucacagagaugcacacuuucuugggagccccucugcugcugcuacaugaagaaaaaaaaugaguguauaccuaacaucuuucucauuugccccuugguguguccugcagacaagaccugcuacaacccccucuucaacucugaggacaugcaggagaucacacaacauuuugcugucugccauguggaugccccuggccaacaggauggugccccuuccuucccagugggguaagagcagagaccuucaccccacaagcagaugaggugcauguagaggaagaaaugccagccuggguaaaacaaaauuauccaugguaaaagacuagauuugccaucucuaagcagggcacagggaugcaugccuggacccccaacacuugggaagcuugagguuagcuucaagucauagcaaaaucauauuaaauuuuuuuaaaaggaaaaggaaagaaagaaaaaagccaagacaauauaugugaauguaucauaacauuuacuuuuaaacuaguuucuuuucuauuugugugugugugugugugugugugugugugugagggagagggagagagagacagagacagagagacagagggaaagagagagugugcaugcaugcaugugaacauuuauacugugcaucucacauagucugcagcuaggggguugggcucgcugacucucauaauaucucaugcaggaggucuccuccaacacucgaugauagaacauacaggaauagcccuuucccuggguuuacgggcuuucugugguguccccaggaccauuuacagacacauguaaucuuuuauuacugaucucaguucuuaauuauuaacuuuuaucaucaaagaagagaagggacaucuggcuccucagggacagguccagguuuaaagagcuuguucaacagugggguacaguuaaccguuaaccagcugacaaaaccaggguucucuaagucacucugagacuccacuuagucugagagaugggggggaugcagaggcucuuacauguuccuaaaccuugcgccccccccccccccagagauaggugaaguguauuuguagauuaagaugugaggugugugcucccaaguuuaacuggugacuuuagggugcuuaaaauagaacacucuuggaacagaauguggcuucucccugcccucucggguagggucugugugacaccccuugucuuggggcuaucaaagcaggauuagggaucaauggcugucuucuccucuuuggagucuucuuccugcuuaggaaucagccacucucuuuuuuuuuaaaaauauccaucuccaggaagcuaacaggaaacugaagcguucauaguuaggugacuuuuucauuauuguaccugggaggcucugacuccaagcugagguaugaccacucccaaaggagucccaugucuuugccccuccuuucuccuaaaggugucuccaguuaaguaaagucacaccauccaggcuccucccagcucuuucaggguccuccacguaucgucucugucuaggguccauuucucuacugggcucugucucagcaucacuuccuuuaggaaacccuuccugaacaguugaacaaaguggauccccuugcuucuauguccuuacagccuaucacugugccuucucaguucagagcuacaguguuagggugggguaugcuuacccaguggaucugaggggugggguuguaacgucucugugugcaagggccugcugguaccugagcuuucagaauauccuguaugggcgauuuguuucucccagggucuggguucucaagaucugccuccccauauacccuacagguacauguaccccucaauggaucaguuggcugaaaugcuuccuggaguccuucaccaguuuggguaagagcaaaggacccuuuuuuccaagguugucaggaaagggcagcugcugaccuccuucucuaccuugaccugacuacuaaagugcagguuggaguucucagucaggucuggaaaggaacuugcuacagcuuguacucaccguuuccucaacuggacauugugcucuguguccugucacuguggccuugcuucuugagugacccccaaugcacauucugucccugccuccugauccuauggaacauucuggaagaguguucccugggaucuuggcuucucuuuccagacccucauucugccccugcaggcuccccuuucuuucucacuucagccucuccuuggguggaacucaaugguucuggcccaauuuguucucauuccaaguuucagaauccagaaaaaagcuuggaaguggggugaggcaacuucuuaaugggccuuccuguaaaugcuaggcgucucagagccugggcuggccacagucaggggaaaacgagcaagaggguugaggcuuucaaggccccagcuguggaccugcagggcacucagggcagccugccucucauggcaugggcaggcuugucagcauccucaagaaugacaugcaagggguggagcucucaggaguaagugaggaaaguuuauaggagugggcaggggcuccaucacaucucccuuuggcgaccuaaaucuucauuugguuuccaggcucaagagugucauuggcauggggacaggagcuggcgccuacauccugacccgcuucgcaguaaguucuuuggcaguuugugaagugacauuaaaaaugauuuaggggccggggagcuagcugagugggcaagagugugccgugcaagcauggagaguugaggacuggaguuggaaucagaacccguauaaaagacaggcauggcugcaggugccuuugaccucacuauggcagugggguggagacaggggcaucuggagaagugcauacaugcaucuguacuaacagcuuuggucuuuuuggugcugaaaugccacacuagauagggcuuuugaucacugguccuguucccugaaccagaaauguggauggcuucucacucauagagaccucugauuuuugcacuguuuuaucucugaguuuugugacccaggucaucuggaauucagaauuaagucuaaaucagagucagacaugugcuagugugacagugaccacugcuagcacugucuuuaccaguuaucuuaaagaggugcaugcccuucagcccaagguauuuugaugcuuaguaagugucgcaccuuaauggugcccaggcguaccgucaaccugggcauccgugucaccuagaugcuagcaugguuuuggaguccuaaauacauaggaauuccaggaaucgagccacaggguaucucugugcccuucucacuuaguuguggcuuggcuauugcacacugggcauucuuucuuuuucuauggcuucuuccuccugcucucuugagggccuaguccaguuuugaauggaaucucaguucugcauggacuaugcaggagccauuaacaucugcucucagguccccacaguugcuaacauagcccucaguauaugucauguugugucucugauuacagcucaacaacccugagaugguagagggucucgugcucaugaaugugaaccccugugcugaaggcuggauggacugggcugccucuaagguaagggcggacagagaagauugguggggucccagccucuacucaggguagcaccuucuugcccccacccccgccucuuuccuuacuguccaagagaguacccuuccucagcccuuuuuaggcuagcaaccauuugcugcucucaaaggucuuagagguuucgcccuggcugcugucccaaggaacccuguugauccuguugauuuuuuuuuccuaagugaggauugcuuucuuuuuuucuguaaaguccccauugucugccaaggauagggagaaauuucugauuaaagccacacaggcuaaugugacaagucucuuacugggauaguaguuuucuuaggcagcuguuggggaaaagggcaugggcuacaccuaucccuugcugucugcuagaugcuguguuucuuccuaaagucuugauauaauuugggagcccuguccaucccuguagggcagccaggaaugaagaauccugccuggcuuuuauuuuauuuuccagcugagaaagggacauuccauuuggguccacuuggcugcugguccacuguucuaagccaaacaaggaaggcuggggcacuggccuccagcugagagauaggcugugguuuuaaugaauuccccaugugaagucaagacagccugcauaucuaaggccauugguaccaaaaaugaguaucagagccuuugaugccuggugacuuacaggauccuuacuauggccugaugucacgguuuuuaauaccuucaguuaaaaacaaaagaccugagaucuagggccuucagcccccacuccaucuccagugcuccacagcugcaaguggccauugggccaguccaggaccccaggucaaguguucaucucccuugccuaucucuacccaagcagaacuaccuguguuaucugccuucuaucuauagagcaccuaggcugucugacucuucucuccgcuguugaguccuaguugcugauuucuuuccuugguucauccuccacagaucucaggauggacccaagcccugccugacaugguggugucccaccucuucggcaaggugagugguguagaccuguguccuguguccucacggagcaguuaaccaugugacacucagcacagagccacaugggcaugugguacaaaugagaugcagucaaggggugacccaggcugaagucugugaauuauugugaaguauugacuaauagccagcaagccauucauaugauuuuucuugucucucccacauugagaauuuuauacauguguacaauguuuucugaacaaauguacucugaguucuuucccuucagcucuucccagacuucccuccugacuucauguguguguuuguuuuaaauuacaaaacccugcugguacugagucugguaugagcgaguauauaggguuauccaccagagcaugaacaaccuaccuggggcacauuccuugcugaaaacugaucucccuccuccccuugagacaccuucauuagcuccucaccaggggugggguuucaugauaaacuguuuuuuguugaagcacaguguguugcauauuugaacaaaucuaccagucaucucagcaacugagaugauggaaauguccuucacccuucuccuccaugucauugcacugugagccauccucuucucguuccucccaggcacccucugcucugcuuuuuguccaucaagugacuccuguacuccucucuuugccauggcuucugucccuuagcaugauuauuuuagaaucuacucauguuuuuuuggacaccauaauagauucaguacuguguaauauuccacugaauggacauaccauugguuuccuguugaccuguguagggccuucauuuguaacaguuuggggucauuaggagugaagucugcaguguacaugucugugggaugagcucugugucugugugaggcacuaucaccaguucuuuccaaggauuagcucagggagccuguucaggaacucucugaccaugagguaaacaugacauucauuccaguccgagcugaagaaauucagaccagagguugaauggcuuggguaaggucuccaggagaccaggagaaguaugacugggauuugaacuuguaaguguaacuacaacauacagucuccuaagcugcuuccuuugccugugucuuacaugagcugaagacagaauaggcacccauguagccauguugacgcaaggccaacagccaugcgcgaggcuguccuuuuggcucacauccaaguucaaugccuggaaaaccccucgguuguccagacccagugaagcacugcuuacuggauguagcagucucugcugcugagcuaaugaacgugacaacacuugaaugcccucuugagucucagggcagcagaaaauacccugcuuugguguaacuccuuggcuuguaguugaaauggcuuagagcaaccugagguuaucaucacacaguccagacuguccccaagucccuugaggcuuugaugaugcccccaaguuauugcuguuaauucgaccagauuccucagaccacuuucccccagaaugucuuugucauggcuaaggcuccuuacuuuugauccccuaaggggcagguugcucugaggucuaccaugaagcaggagucccgaguuuagcugaggcuccugagggaaagcugguucucugguaccaguaguuaucacucagcugucuguaccagacucacucaguuaguuaccccugccucaucugugccuucccuucuuaucucuguggcuggagaauggugacaagccuucccccucucuucccucugucacuacaggaggagauacacaacaacguggagguagugcacacguaccgccagcacauccucaacgacaugaacccgagcaaccuacacuuauucaucagcgccuacaacaggugagagcccugugcaggcacagaagcugccaggucacacugggguccucaucagcuuccugcagcaaaccugggauggaagcagagagcaggacuggccgagcagcuguagguugauaggguggggcccagggaaggacaauggccgugugggagcugccucgcucuuugcacugagugagcucugcugggaucugagcucccacccagacuguggggccagaugagugggauguagcugaguggucagaguggagagcugaggagugugcccaaggcugacucacaauaaaagccccugagaguggagcugagcaaaggauagaaacauuguaaggauucagaacccuagaggcugcugggaggagaggcagcugaggguaaaggaugagguaccugagguuuccugggggagaggacuacacaaggauauuagcaucagucagaaguucuagaaccuucuagugaaaacgugugaaguaccucggccacacucccaauacagcggccagcagugagccuugcauacagaucugaccuagggcagugccuaagacuuaaccugcuggaacugaguuugcauuuguaaugaguuuagguucucugauggacucugguaccuuuuccccaguacugucagcaucucacugcaggggccccuggcauucucucugcugucugaagacgcaguuggguaccaagaagagggagauggaugggcuccugacuggacagugggaaucacaggagucccugcacagcggcuaauggaaaggggcucuuaccaaggcuauuucccaaugagggcgcaaaugcacagaaagguuuagucugcuuccacaagacacacagcuaggcaguggcaugguguggugacuuaaauccugccacgcuggcuucagucucagagcuucggaggguagagaggccagguguucacuugcagggaucagcucuacacuagacaucugcuaggcaaguggaacaccaguguaggcuucagcacacauagaagagcaggucugaguuuuagagaugacaucagagcugccgagggaaggcuucaguuagcaguggaggggugcuaggagucaauuccugagcuuuuagcaaugauagguagggacucuagcuaggggcacagggaggcagggaccuuuagugaggaccugauuuguuuuacuguagaaauaauauuaauacugauaucaaauuuugggcaaaaugaggaggguuuugcuagaaacagaugaaaaccugcugcucuuaacugcuucuauggacaccaaguagccauggggucuugaaagcugcaugaccucaugaagaugaccuguggaugguuuuuuagaauggucuauggagguuccugcaggguugguguagugggaauggcugcugggguagguuuguucaugcuaaccacgugcgaaauaucugcagccggagagaccuggagauugagcggccaaugccuggaacccacacugucacuuugcaguaaguggcuacuuucuccuauguugucuuccuggcuuuauucagggcugcuggugggggcuucugcugggugggagaaacuccaccuuaggguggagcacuacaguagagaugacuaucuaugugcuaucccagggaucugacuugaacuuuccccuuugaguagcugaagucagcaucaggaccaggauugugugaucauaucuaaagcccuuggauuaggaggcugacugccuucauauccaacaccgauggcuucccaaagccuauagauuaaaaaaaaugcaggaucugacaugagagaguccugaaugucuaguaggaaaggucacagcuaacauauuccacuggcauugauggugucuuucuaugugugucacacuguuggguaguuaagaaccuggcuuugucauuuaugccagacauuuuuucccccaucuuaauuccuagaagauuccuuuuucuccuuccuuggucagaggugcuuuggaaugaagucauuaagacacucaaucauugggcugaaaguuuauacuuauguauaaguaacugccauaccauuuuauucagaguucaaagcagaggaucauaccauagagacagaggcacagagggcucuaggaaaccuaaagagccuuuuagaauccugcuguagccugaagucugacaucuaagaaccuggagauggacccuaggcugacuccucuuccccuuucccaugcaggugcccugcucugcugguaguuggagacaacucuccugccguggaugcugugguacguaucaguucagcaggccaugggugcucaccuguaugacccuccaaaugcgaagacauuguuuaaaaugugacaucaccucggggcagagcucagaccagcuucucucuguagccacugguucucacugccuggccauccgcuuccccugcccuccugcuuuucaugggccccucgucuacauggcggaaucaaugcuaggauucauggcuagggauucuuucucagucucagccgcaggugaacguuucugcuuagaagaagagcacggcagcugcggcaggcagagcuuucugccucagucuauccuuuaguucacaccugcacugcuagggaagcucagagaggaugccuacuuucugucauucccacgucuggggagaugugugaugugaaauuguuguucagaguuaugacuaucucgcucggccucugcagugcuccauggaguugguugucccugaguuggcuccaggucacagagccagucaugauaaggccaggcuccaaagccacaugcuuuaacaaccuaaauguuucaggugguaggacagggugcaggggacucaugacauuggcugugagucgaguacuuaccuggccuuucuccuuguuuagguggaaugcaauucuaaauuggacccaacgaagaccacccugcucaagguaaugaacaggaguuggccugcaguugucaugguuucaaggacucacauauuuugagagcugagcuaugcuuauugaagcagagaacuguuuuaggagccauaaaggcagaggcaggaggaugucagcuacauggcauguucuaggcuagcccagaucguauauuaagacccugucucugaaagacaggaagggagggaaacaugaagagagagagguagggaaggaaggaagcaagcuuggaauccaucugaggcugcuaagugguccaucccagggacuagacugcaggggucuacacacuuugccuguguagcuaaaggaagagagacugggagcacaggacaaaagucuucuuuuccuaggaugaggcaaagauauccuugcaccagaugccucuggguagugagagauuguaaggccaaggaaacagccuccagcaaagucuccugacuacagugugauugcuaccuugugcuuagaggucuacaacccccgccucccccccagcaugcagucaggacuguuugcacacccaaagccaccuguguauggcagcugugucugggaugugccccaggcucgggcuccuucccgaggaucucucuucacuggguaugcucuggagguugggaucuugaaaguuccauaagccacuuuggcuuccauaauagcacaguugagucuguauguaugcucuuagggguugauauggagugaccugugggggauauugcucuguauaagcuuugagcaguaguugccaaggaagauaagggguuacagucaacagcagcacccacucaagagcagugcuaggugggugaugcuggggccagucccacagagcacagaucaccacagcuaugcccuggguguuuggugcuaaccagccucccuccuuccuagauggcagacuguggaggccuuccucagaucucucaggugagugaaauuguggcuuuuucauuuaaaaccuguuaccuucuacuggugggguguaugugccuuuggggcccggaaacucacauuuuccuacugucucugugugccaaaaugguaguuuauaaauauauucuacaugaaaugugcuuuauaaauguuguggagucacucgaucccuaucaagcagccuuuggggacuggaugaccuugagggccacaggcuuaagagauuugccagauggaccuggcuuggcuauggguucagaaucuugauugcccugcccuagccuggggccacugggagcucgagccacgagcagagggagggauagagaauauaucacaccaaaauguauguucauacacccccuccauacacacacacacauacaugcauaugcacaugagaauugagcaugugugccugugugugcacauauguacauucaugcgcaucuauaugcacauggauccagguguguggggaccugcaucuuugaaucuacacagcuuccuugcucaucuuccuccugcccauguucugcuuccuguucucuuuauuugcuugcagccaggacagaccuagccucgucuggacuauuaaacacuauguaaacaccagugggaacugagcuucaagccugauuacaauguauccccucccacaucccuucccaggcuagguguguuagcaaaagacuuucucaccucuggccacuuuguaccucaccuucuuagaggcuggaggugcuggcaucucagcucagcaucauuaggggaaacugaggcugcagagaaggauuguugccuaugguaacaguugccagugauacccagcuggcccacuuuucuuauucagaagaaguccaacuccaaaacaaaagacauccuuuuucucugcagccaacucaugucacaaaaauccuagggggcaacuuuugcauagucaaaugucacuuggguucuuugccucauugcagaugaguggcaggauugugcagggaccacacggucucugugaggagacugagccacuggguggugucuuccugaacugggaucaagggauaacacacauauaccguuggaggcaccuugucccccaguucaguuaauugaguuguguagaggagacagugacucugaaaguggccuuggcacugcccugaucacuuauccaaggauagccugguuaaccuagcuaguguuauagcuacccacccauagccauuuauuucauucaucuuuccuuguauccuuuuuucuuccauuucuucucccaccuaucuuuuuccucuucuucaacuuaguuuucaucuuccagucaaugcacaaucugaccuucuauaccuuuuccuucuuugacccuuguuccagcccuuccuucucuguuucuuucuuucccacuucccucccccuguccuucccuccaccuccaucccuucuuccuucccaccuucuucccuccuuccugccaucucuucaucucuucaucucuccaugcuucucucccucuaucccuccguuucuccaucccccucuuuuuauaguccuuucuuuuguucuuccaucucucuaucccucuguccuucccaccauuucucaucucucugucccucuguccuucccaccauuucucaucucucugucccucuguccuucccaccauuucucuacccccccaccccggccugucuuuucacuaauauuuuccaaugaccauccuuccuucuacucauucaaccuuuguaucauuaaccugacaugaaccaccucgggcacaaagguuccuggcacagaggccuccgguucauccauacaacuugcacuuauuaguuccgguccuuggguccaggcagcugccacccauuuuauucaucuaugccacccacaugcacuugggaguacugguccuggaaggcuggugucagguuuccuggagcugguugugcagagucccuagcaggccauguggcucauggccuugggcugugagcacagagugugucuucacccuauaugcaguugaggacacugucugggggacuuuugggauagcauuugaaauguaaaugaagaaaauaccuaauuuuuuaaaaaaaaagaaagaaagaaaucuuggaaguuauccaugcccuuucaacaaugaggcagguuuaagcuggucaaaacugauucugguccccacgagcauccuggguuuuucuuccacuucuaugcuuuuccuguuuacauguuguggcuccaucuugggccagagcucuagcuuacagguacaggugacccaggaugaucuauaucuccagccauugacuucacucucucucucuccuacagcccgccaagcuugcugaggccuucaaguacuuugugcagggcaugggauacagugaguauaacaucuugggcacagaaagguguuggggugguaaugucauagucagugggggcuggagagggcucugucaucuuggcuggcuucagcucuuaagcacuaggcaagucuaagaaggaguaguaacaaucacacauggcugaaugaggaauggaucagcacccaguuugguuuuugugcugcauaugucacacagcaaacuaagauggugcuagccuaucugugcagcguguucucagaggaccucaucguguguucagucugauuuuauaucuauauagauauaaauauacacauaucuauaucuauauagauauagauagaagaaguugcuucacaucugacauuuauuuagcuuuacaugagaacauuuaaaaaccauuugaugcaagaaugagacaauauuguuguuggcaaggcuggucuuugaacuccuaauaguccucuugccucagucgcccaagugcuaggauuacagacaagaagcacuauucuaggcuaggacuaucucuuuaaacaccaccauugccaacaauaacaacaaaaaaccacaaacccaacaacaaccaaaacaaugaccagcagcugaauaaggaaugccccuaauuuugaucacaugcucacucaggagaccagcaguuguagcaacgauagagaugauaacggugaugaaggauuaauaaggauuuuugucuccuuuaaccauaccaucauaauaauccuagaagggagaggcuaagcaggccgcaaagagguuugaagcugauugagccagagcucuauguaagagggagcccagagugccugagaucgaagguagggugcuuccuugauagaucacuuuuuaaaaaagaucuauuuauuuauuauauguaaguacacuguagcugucuccagacacuccagaagaaggagucagaucucacuacggaugguugugagccaccacgugguugcuggaauuugaacucaggugcuucaagaagagcagucagugcucuuuaccacugaaccaucuccccagccaucuuugcuagaucauuauaucaaggaacugaaggacugagcaccccgcuguauccugcuuuaagcuuagagugagcuugucauucaggcagucccauagaucuaggagaaaaauaaaagggagagacacagacccaaaggguggguugcugaaacagaagguuccagcucacaggcugccugccugugauccugggcuccuaagacucguccauugugugucuggugucaugggaagcugucauuuccuggugaggucaucaggacucagagauuuggguggagaaaucgagacgcaggaacaaacauaggggucacagaugugcccugacccuaccucuuucugaauuaaaaacaggcuguucugagaugguauacuucuguugucucagcauuuggaaugaagaaguggaaggauagugaauucaaggucuucccagcuacacagagaguuuaaggccagccugggauaaauggagcuuugcucaaaaccaaaaacuaauggauaaaaacaacaaccaggaagaaaaggaaagaaaggaaaaggaaggaaaggaaaggaaaggaaaggaaaggaaagaaagagggaaagaaagaaagagaaggggagagagaaaagaaggaagaaaggaagaaagggaaagucagacagacagacaaaccaggaacaacacuaauucuuuaaggagugaauuccacugagcaaggacuaauccaauuuugggugucugaucuagggcugugcuucauugggguguggcauuagucaccccaaugaguaaccuaagagauccccacaaauaaagcucuuaagcgucaagaaugcauuuuuccuacaacuucagaggcugcaaaucugaggucaagguuuggacagggcugggcucacuuuucaaggcccuuucuugccuucuggauucugcugacuacaucauaggccuucuguggcuucuggcugcauuacaccaaucucuccauccauaugggguggcucucucuuguuuucuuuuuaaugauauugggcuuuagauuagggaucauucuaauccagaaggaccuugucuuaacuaaauaucucuaaguauuccaaacaaggucauauucugaaguuucaggugagcaugaauuuggggggagcacugccacccuagauaggaggaggauugucuuguaucccauucugucagucaucugcugugguaugcgcaguuuuggucaugcuaagguuugagagcuagcaggcuuuuggaaggcagacagauggcuaacauuuccuuaggaaccauguggugagaccuuggggguuauucuugggaugugcaggaacuaaccuugcuggcuuccacauucuacugccuacugacaguacauuuaagaggagguuacacgaagucuucauuuugcaaaugaaaaugggaaggcuucaagugugaugaucugguggucaccuagcuaauaagcacauaacaaacugggggucagacccaggucauggcucaggacucuugccauguaauuguuaugugccuuucccacauauuggacuuuacuguccucuuugugagugacacagaagguagauggcucacaggaugaagacaauagagaagugguguucagcugggcucuuacgauuaacugucauggcuggcagccagggguagagucccacaccuguagaggcuuccuguauccuaaccauauuugucuucuguguucccagugccuucugccagcaugacucgccugaugcggucccgcacagccucuggcuccagugucacaucccuggagggcacccguagccgcucccauaccagcgagggcccccgaagccgcucgcacaccagugaggggucccguagccgcucccauaccagugaggaugcccgucucaacaucacccccaacucgggugccaccggaaacaaugccgggcccaaguccauggagguguccugcuaagcaaucugugcaucagucacccuggacugguggccucucccuuagcccccaacccuugccugccacccuacgcuaaugcgguauuaaucuaaagcugcuuuuguaagaaugaacucuggcgguggcagacccaggcuguucugacugccuccugggaccaggguggguggugguggaccaaaggcaagaagcaguucagcguacuguucugcuaacaaguggccugguggacccucucucuacccucagacaccaaacugccaaaacuaagaaauagauagcuguaacacugccuggcuccaagcccaggcugauccagcauucugguucauaggcguuuugccaaccugccuacuuccuguuuccuccccacuaaacucauuccuggaaacaaacuucuguuuugaaaggagagagagaggcaggaaaguugggcgccuuauuuuaaguagagaaaccaagaaaggaagagaaaaaaaggcagggucuagggcagguagaggaaaaacacaacaagucuacuaggcucacuugaaggaauugauuuuaaaguucuggacacugaaacccacaaccuguuuuucuggcaaccuuuuaacgugcaagaaaaacugguaacaaaccccaggcuuuauagagaaagugauccagcaaauguggggcaucagugauuuaagacucuugcuaugcagucuacuguaccccgcucccauuccacagugaaugaguggaugacaccucugucccucgggaagaugguuuugauuuguuguugcauucuuugaggcagagggagaacccagcaggugacagggguccuugucugggaugagucuuuaggaugggaaggguggggauagaauggcccugggauuuugaggacucaugguagggccaagugcuagaaccuggugggugugauuucauugaucuggaaucuugugugacugagucacaccuugucucccauaauugaugucuggcauugauuugaaacuugauagcugaaugucucuuaacuggcccaucgcugguucuucagagagaaccguauguucuagugggggaaggacugguuuuggguucuguacauuccacgggaacuugcuucccucuccugccccuccugcugacuggguuuguagcauuggccucuuaagcaaugccagccuaaugcccaugcuccauacuacugccuuuugauucuuacuguggcuaaccuugaaccuuuccuauaggaaaugugaucagaucagagacacuugaucguugggagucagcccucaaggccuggcgacuuccaggaucuuggaguugcuagaggaaaaguaguuaugcccuauaggcggcaugagagacaagggaucaguuuaccugccaacuccuaccguggaggaggaguuccacugaccuuguguagaaagaucaggaauccaggccagggugauugaaugcugacaagaaaucacuguauaugucucuccagggcaguuucuuaauaagauguuuguauuuauuuccagaccaauaaauuuguaacuuugcagugg

SEQ ID NO: 12530 - RNA, 22546 nt, Mus musculus
gcgggcagcggcggcgguuccggcugcggugcugcgggcggaugagcugcuaggugagcaggccgggcgggaugcggagccgccgccgcgcccccagcgccuaagaaagcgcugccgggucaggccgugcugccagcugugugccgccgucggagccuacagcucguauugaacgcgggccgagccgagcgccgaccccggccacaguccgggacccggcugcccgccccacccccgcgcgcgccgcuccgcccgcgcucggcgcucaugcgggccgagccccgccccccggcccgagcccgccgagcgccucccgagcccgcgcucacugcccgcccgcaucaugcugaagugcaucccgcucuggcguuguaaccggcacguggagucgguggauaagcggcacugcucgcugcagguugugccagaggagauuuaccgcuacagucguagccucgaggagcugcuccucgacgccaaccagcugcgcgagcuaccuaaggugagcggccgccgcaccugcugccccgcgcucaguucucggggugguguaugacuucuggggcagccggcuggagcgagaucucagcaggcgcugcccgagcugggcaccgcaaccuccagccggcccugcagguuccuacuggucagagccccgccccagccagccccacccuccuccagccgccgguguuggcaccugguggcaaccugucuggggacuaaguagauacugaaccuaaaaggggagccaacagagaagcccaugagagcacaggaggaggauggguccagggugcgagaccgacccggguuagcaacuguuaaagcuaguugggcuacuuuaaggguaggaaguugguuuucuugcacuguguucugccuucguuuugggaggagagguuugcagugcugagugggacucuccuaagauacuugcagugucagaucuauucugucaucgcucagcggagagcccaccuuucacugucuguguuccuuccugucggguuuguuugggguuuuuuuuguuguuguuguucugaggccacacuagaaggaaggccaaaggaggcagguuauguaggacuuacuuuucugagauaggggacucaguggucugauauucuugccggcugguggcguugcggguguucuucauagaccuuuaugguauccgugugugaaucuuggacauuuugcacuuguguuucucucuggugccuguuguuguuauugcuuuuuuuuuuuuguucuguuucuugagacaggguuuccccuucguaacccugguuauccuggaauucauucuggcuguccuagaacucagagauccaccugccucuguggguacuaaagaugugcaccacccacaacccaccccagugcucucugguguuuuuauuguuguucucucuuuguuaagcucuugcuguucauuguugggguuccugaagagcuccaaacuccuuuagaagagguaguuuggauaguagguaggauacugagagugacugacccauagggcagagggcaggggcuauccauuugggagcugcugaugucuugccuggggcauguuaucugggugacaucuggguaauagugagaggugggcuuuccaccgagaaaugagagcguaggucugacaguaucuuaggagagucccccucagcaguugcagaguaucauugcagaacagcagugguacaugugacaaaugacacaagggagaccaggcaucaggugggcagggguguguuuugcaggcuucuuugucugguuuuucagcacacuggguaucauggcuagagccgcagaaccuugugugaccugggauacaaagagguccaggacccuguggccaugauccuccugguuuggaaacucucccauacccauagggcuuuggcuauagagccuguuccccugaucacaucuucugcccacagcccuucuuccgacuguugaacuugagaaaguugggccucagugacaacgagauccagcggcugccuccugaaguggccaacuucaugcagcugguggagcuagaugugucccggaacgguagggggggagggcggguggcacuccgugaacauaggggggagcauaggggcuccugggagcuccugaggcgugccauccucacggcacccucuccaaacacagauauuccugagauaccugagagcauaaaguucuguaaggcucuggagauugcagacuucagugggaacccccugucuagguaaguguuagcccacagugcggguuggcucuuggccacggcagggucuagagcucuuccaugcguaucugaggccuguguugcuuuguuucuccagacuuccggauggcuucacacagcuacgcagccuggcucaccuggcccugaaugacgugucccugcaggcacugccuggagaugugggcaagugagugccccuugaugaguggaucuggguauaggcagugcuugucuugguucugccuuccucagcccugguccuuggucucuuucagccuggccaaucuggugacccuggaacuccgggagaaccugcuuaaaucucucccugcguaaguuuggggccuccacccagcagagguagagcuacccuggggcguggccugaguggccacaugcagauguugucuucuguacaggucccugucuuuccuggugaagcuggaacagcuggaucugggaggcaacgaccuggaagugcuggugcagugagggcugccuggggaagcaagggugugcuguggggcagcugcugcuccugggugucacacugcuuucuccugucuuuguccauucuugcagccugacacccugggggcucugccuaaccuucgggagcuaugguuagaccgaaaccaacugucagcgcugcccccgguaagugagggugggacuggcuuuauccccuaccugcugcccuuugaccuuuugucugucugcaggagcuaggcaaucugcggcggcuggugugccuggaugugucagagaacaggcuggaggagcugccuguggaguugggugggcuggcacugcucacggaucugcugcuuucccagaacuugcuucagcggcugccagagggcaucggucagugugccaaucaucagugaccuugugaggugccaaagaggggcuugggcuaggaucugacuuaacccagguuagagguguccaaagagggcaggugcaguaagcgaaggccaagaucagauacccauucauccaguuagcacucaggcgucagggcaguuuguuaugaaagaauugggauguagguuuccaagggucagggguggggaagagucucggaagcugagucugcaguaagaaggguggggccggguauggggagcauaagaaaucuuggagacccagagaagcccacugucacugaaaugugggaccaggcuauggccguucggaggaccuacaugcucaagugccuuugaccugauuucggucuagucaccaugucuccuugaugccaggucagcugaagcagcugucuauccugaagguggaccagaaccggcugugugaggucacugaggccauaggggacugugagaaccucucggagcugauccucacggagaaccuguuaacgguagggcagccccgaggcaccgagccucucagggugugaugagcgcggucagugcaccugaugggaguggcaugugcugcugguggcuuaucccaagggaggugcuugcuagggcacucuuggcauaugagauugccucggauccacuggacccuguagggguuaaagagcccguguguuguuucggacaugcagucugggcuuaagacuggaaagaagacaaaggcaaauuggacagaagcacgugugcuucauacaaauagggugagcagagugcuagggccagacuagagaugucugugcuagugugagucucaggcugagagacaguagcgagcaacuuuccugucugugggguacucacagucaugguagugagagaagagggugaugaggaaacgagcagcaggugugaguagcagguaccgugaguaguggaggaggcacagaaacguggccuugguagauugagcuggguggcuaugggugagggccagagagaacagucuagggugucagggagccuggcaggauguaugcuguccuuaagggggagagguggaggagggugccaacugguucuaugucuagauccccuaaccauaguuccuuugggcuguggggaacccugauagcuauggaguuuaccuuaagggagaccuuuacuuucccaaggccucccuuuuccuccuaauaaucagggguuucucucagccugagacccuuccuuugcccggcaggccuuaccccacucgcugggcaagcugaccaagcugacuaaccucaauguggaccggaaccaucuugaggugcugccuccugaaaucggaggcuguguggcccuuaguguccucucuuugagagacaaucgccuggcuguccucccuccugagcuugcccauaccgcugagcugcacgugcuugauguggcugggaaccggugagugucugugugaccccuggggcccagguggcauccugcugugugcugacugugcccuccuggccuccaggcugcggagucugccguuugcgcucacccaccucaaccucaaggcacuguggcuggccgagaaccaggcacagcccaugcuccgcuuccagacugaggaugaugcccagacgggugaaaaggugcucaccugcuaccugcugccccagcagccccugccaagucucgguagguugcuguuggcugggcccugaauggugggcggugaaacagagagcuuagcaugggucucugacucugccucccacagaagacgcuggacagcagagcagucccucagagagcuguagugaugccccucugagccgugucagugucauccaguucgaggacacccuggaaggugaagaggaugcugaggaagcugcggccgagaagcggguaugaagggguggggacugugggcuguguacuucugucccaccccugccugaccccuucccggccucuguuccucaucccuguccccauggcagggccuacagcguagggccacaccucaucccagugagcucaaggugaugaagaggggcauugaagagcgccggaaugaggccuucgucugcaagccugaccccagcccacccucgccuucagaggagguaggcgagacaggaucaggagcccuggguguccaucccuccuggcagugggagcuaugagggcagaggcuucgugagggaggggccugcagaugagcuggugaauggaucugggacugcacgggcaggcggcugcugaggguugugcuggacaaagggugcagguggguggcucucauguagucccucccuguggagucagaggaagguguagccuggugagggugucccagggccaagugcuaggcacgccaugguggcagagguugggcugagggaaggcuuuauucccuucauucucccaccugaaccugggaaggaguuaggugcuagaacagggcaggucauuugcuucuuguggagcuucugucauuggggcuggggcaugcuucuaggaaucuagacaguggcuagacgcacggggcgugcguguaccgacugugcauggcuacuucccaacuuagggcaagaacucacuugagguugauguccucccaggaucuuaguauuuauucuccugagucugggagaaagcauugccaaggucugagccauagaagcgugagcaugcaagacugcauucagacugggagugauuguaagaagugagccugcuggggcuguuagggcccgggcagcaggaagccuaggagaucugccacacgggguagccucuggguaacaaacuucugugcagccugacaucaccacuugcuguaggagaagaggcugagugcagagucugccuugaguggaggcucugucccgucagcaagcacagccucggaaggugagccugagauccugccggcugagguacaagggcuaggccagcaugaggccaugccugcacaggaggaguauacagaagacgacuauaacgagguaagagcagacaggaagaaagcccgcagggcagaagggcgucugggggucaaugcugcucauccuaucugugugucuuccagaggcagcugugugauuggggccacaccaguuaugggcugagcaauaaugagauauuaaagggcuuccucaggcaguuuugcagagugcaguacagggcagugguccugaggguuccugggaagcggguuccaggguagggcaaauuucacuucucagccaggcucaguacugucagauuuaguaccugugggcuuucccuaaacacugucccccacuucacugcccuggguauagugcuccccugcuaggucuuuaucuguuguuaaguuuccguuugcauuuccaugugugucugggaagagcagcaucuucugaucuuagcagcugaguucucuguaucucucuacacguacaguggggacuggucagucucaggcuguuaccugucggccccaaaccugggcccugagaggauugagccagggccaggcugccacccucaucuuucuucccacuuagcccacagugcacuuugcagaggacacacugaucccuagggaagacggugaaagugaagagggacagccugaggcugccuggccgcugccuaguggccggcagaggcucauccgcaaagacacgccccacuacaagaagcacuucaagaucuccaagcucccacagccugaagcugucguggcccugcugcaaggggugcagaccgacagggagggccccacugcagguuggcacaauggcccacacacaccuugggcuccucgagcccaugaggaggaagaggaggaggaggaggagaacagggaugaggaggaaggcgaggccaccacggaagaagaugacaaagaagaggcuguggcuucugcucccucugucaagguuugucauucacaccccuaucugacccaggcucugcuggcuuguuagcaggcugcuuuggaaccugguggguagcagcauggaggacaucagcccuaaacugacaggcacagucaggcccuuguccagccuccuuggcugucagaagaaggguaaugaauguguuugcugugauuggccucgcuuaccauuucgucccaggauuaccugccauugaucuucgaaguucccggcagcucccugggccuaccugguugggugggaggccaagggcacuuggaagcugagggucccucugugucccgugcguuuggagggagucuuggacaaggucccccucaggagcugcuggcucucucaggauccuuccuaccucagccagccuagaggccuugcugcuggcccauggcucauccuguggcucuugugccuugagaagucuuuuugggauugcggcaaaucuguagaacaguggcaucucuuauccuuguguuugauuuugaugucucaaaaagagcuuacccacucauuggggacuccucgaggccagagaaagccccagcuauuaaaaguccaacccuuucccugagaguauaagcuguuaguauaugaucucugggaaaauuuugggcuuaagucagagacagccaggaauagagccuucaucuaagccacacuauauauguggucugcagaaaugcuaaugauuuuacacacuugggaguucuaggggguaagguccugacucagaucacaggggcuugauggguguuccucuguccugucuacucauggugagggcuggggaaggugguggcacuucccagcgguggcuaaccugcaugccucgcugcuccuguccuaacagggggugucguuugaccaggccaauaaccugcugauagagccugcucgcauugaggaggaagaggucuguacugcucgcugcugcucuaugcucugggcccggggcuacugcugaccuuugcuuccugggcugcgggcucucacuucuucccaucuccaugacccccaacucacacccucucccagaagaguuccugacagcugccacagaacugggguucugguuccacuucccuagggccuccugguccccacaguggggcaaccugcccuguaagggaugaauggagguauugggccguuuucauauccucugugagcugugagguaacuuuacauacaggagcaaggccgggcuucacucucuggaggacagcuagcuuuguacuacaggagcuagcucacagaaguugugccugcccuugaauggcaggagccucccugcuucuuucugcuacccaagugagcacagauacccagggaugagcugauuguagugucuacagccagcccuucugcugcugcaagaccagggcaucacgggucuuuucaugcaucuguguccacucuuguuuccaguuaacacucacgaucgugcggcagacggggggccugggcaucaguaucgcagggggaaaaggcucuacccccuacaaaggagaugacgaggugagcagccgccauccaguaaccagucuccagucuccagucuccuugagcccucuccugcgcacaccugccacucuugucucaggagauggccugcuuauuaguauccuuuagaaugugcugugugggucaccccagggugacaggucagcggguggucaucaagcaggauguuaggcgucugagaacaacuaacagggcaacugagcuguuuccucuacagacagcucuggggucagaaaaguuucucguaagcuugacuuguguguucuagcuucaugagcgagagccuucccagcacugagaacagcccuucuggccucgaagccugcuguucuuuacuguauuuggggucuuggcauccucuccagaggguaggccagggcugucuuuguacuguccaguggccucugcaccucucaccccauaaggagacggguuccugccucugccugugcucuuguggacugguccccacuuuuccuccagggcauuuucaucucucgagugucugaagagggcccugcagcccgugcuggaguccgaguuggugacaaacuucuugagguaaguagugaccccuugccuugcagcaagggacagcuguucccucuaagguccguagagucuugaguacugagacacuugggugucuccaucuuccccagaagucuagggcccaaugauaacugggucaggcuauugugcucuuucuuaaucaguaggcuuagaaguccucugucaaguucccucuccaucuggaucuagguuagugguagaucucugacuuacuaugcaugauacuguggguuuaaucuccauuucuacagaggaugggauguuuaaaaaaaaaaaaaaaacagcagcccucgggcuaggcaagaggcuccaggcagauucugaguagccugguggggucagaccucuguggaagcccuggagguuucuaucuggccccuuggccauuggagagcucuuaggauagcuuugaccuugcuguggagacaaggaugagugaggcagaggagggcucugggacucccaaggggaagcugcuguuccucgugcuuuccuacucagcucuaaucccagguccaccuaggagcgagcgacuggggcuggcagcuuaauaccuuccguguucucugccaggcagaugacagguccugagaaggaggcaccaguauagagugguuagccuggaccauguuacggaaacaaacacggaaagagcacacacacacacacacacagucugauguuaggccggcugugccuggaacuggaagcugauugugccauggcuguggccuuuugucgcccacaggugaaugguguagccuugcaggacgcagagcaccacgaggccguggaagcacuucggggggcaggugcugcugugcagaugcgaguguggagggaaagaaugguggagccggagaacgcagucacuauuacccccuuacgcccugaagaugacuauaguccccgagaguggcggggagguggccugcgccuuccccugcuccagccugagacuccuguaucccuccgucagcgucaugcugccugucucgugcgcagugaaaaggggcugggcuucagcauugcugguggaaagggcuccacaccuuaccgggcuggugauggggugagauaguggugugugggguauagagggggcuaucccugaugggcagaggcaugucaggucuccaguaucauggcuuuaguguggcuucuccauccuuacagggcaucuuuauaucccgcauugcagagggaggggcugcucaccgggcaggcacucuacagguuggcgaccguguccucucggugaguggggccggguguggccugacuaaugcuguuuguuuguccugcuuccuaucucugaugugagugucccugcagaucaauggaguggacaugacugaggccaggcacgaccaugcugucucccugcugacugcugcuuccccuaccaucucccugcuucuggagagggagacuggagggacuuacccaccuagcccucccccccauuccuccccaaccccugcugcuacuguugcugcuaccgugagcacugcuguccccggagaaccucugcuaccuaggcuguccccuagccucuuggccacugccuuggaaggaccauacccuguggagguaagacacccacccauguccuucucagucccagggcccucugucagaagugguguggucacucuaggcagaacgaaguacacagccuuucuuuuuaauuucaggguuuuuucuuauuuauucuuuucauauauuacaucccaaguguaguucccucuccucccagucccuccccugccucuuccuaucuccccuccuuccacuccucuuccucuucccuuccgaaaagagcaggccucccaugguucgcaucugaguauacauggcauaucaaguugcagugaaacuagauucaucccuucaauuaaggcuugaggaggcaauucaggagaggauggggucccaaaagcaggcaagagucaaacucagcccccacuccuauugucaggaguccuacaaaaacacuaagauacacaacuacagcauccgcagagguccuagcucaggcccacagaggcucccugggagcccuucugagcccugguugguagauucugggggcuguuugcuugugguguccuugaccccucaguacacagccuuucugcacaagcccgagaagcuagggcauccagucagccuccgugaugguuuccauuguacugcccaagcauaauccucuaucagcagccugcuguuacaugcugcuguccggaaggacgugucgauguugggcugugugcauaucuggguagcagacugccccacagauagggagaugggcagcauaggcccauccuuucuguccuugcagagcccauggccaguauguuggucccuuuaacccuugcccuguucugacugagguccacccaauguccccaggaaaucugccugcccagggcugguggcccauuggggcuuagcauuguaggagguucugaucacuccagccacccguuugguguccaagauccugguguauucaucuccaagguaaguaggccuggcaggcaacucugcaggaagcagcccgcccaggcacucagggauucugaguggauucucucuccuacccugcaggugcuuccucggggccuagcugcucgcuguggccuucggguuggggaccgcauccuagcagugaaugggcaggauguucgggaggccacacaucaagaggcagucagugcccugcucaggcccugccuggagcugugucugcuugugcggagggacccaccacccccgggcaugcgggaacucugcauccagaaagccccuggggagaagcuggguaucagcauccgcggaggugccaagggucacgcggggaaccccugugacccuacagaugagggcaucuuuaucuccaaggugagggcucuuucuucgugggaccguagauagguagcugcugcuggucucacacuguucucccuacaggugagccccacaggagcugccgggcgugaugggcggcugcguguggggcugcggcugcuagaagugaaccaacagagccugcugggccuuacccaugcggaagcagugcagcugcugcgcagcguaggcgacacccuuaccgugcuugucugugaugguuuugacaccagcaccaccacagcccuggagguuaguugucuacgcuggggacuagugcuggcugccauugaccuuuagagucugcacaguacugagcuuugugucagugauggguacugugucuaguaggcccuuugcuggucauuguacuggaggcuguggucugggcagguaggcagugcagagguggguuugucugucugugugaucagguccugagagaaggucucugagaaggcaguacuugagagcauguggcagcuggcugaaaggacaaggagcccugcccagucccccugaaucugaccucccaaagcaaaggcagcccccuagcccugcuggcccuuagggcaccccucuggcagucccuugguagagcuuacucccacuuucuggucacuggcuuuguuuuuguaugccacagggcaugggcacaggguagagagagcgucuaccgcucucuugcucccuggagcagaacaagaauagccagccaucagcacuaggccuaggcccaagaggcaagcgcccucuggacaggccucccucuaggcucuccaggugcaugcuucgucauuguccugcuuucucccugcaguccucgggaccccuccacaucuucaccuguagguccaaguaggucuugaaaggaccuucaugugcacuggcugccugcuguucccagacauccuugugagccauucuggucucuaguguguuggcggcuguauuaccacuccgucgguuuuaucgcuucaaccuuagggacguguagccacccuggguugguuggucuucuuguagugaaucuuuggauuagugacuuccugucagaugcuggcagaaagauacccucuggccacacacccugcacuuugucccggacgagcuugugaguaucacuuggaugggacacaaguuacuuuguccucccaucuagauggauacugggcuagauggagccugugugaggugcuacucccuugggcugaaggcugcccuugucccacuucuccccaggggacuccuguguccuggggaaguaucucggaugacuucacccuagagaagaugagcuuuuauuuccuuacauuagcacgcguauuuaaaagugcugcuucaugcaggcuucaguuuuugaguucggaacgacgcucucuggaaagagugaggaccucaguguuggagcugcuguggucccggguccccuuggcuaugcaugcgucuggucccugcugcuguaaccuaggcugcuccuacaguacauaggaggcucaugaguguagggaagcagcuguauagcuacgugugcugaguccugccaaggccugucuuggcuggaucuucgucugaauccugucugaagagcaaggcuagugagaagcuaugggcccaggagagcugaccaagagccuuugaggagcccuuuccugcccacgcagugucugcuguaaccaccgucccuucccucugucucaagaugccuuggcugcucuuuuguugcaagugcacaccuucacaucuucugcugccuaggcccaccugacagggggaguucacccugggccuugcauagagcuccgcuggcagcagccugcccuucgacccuucuugggcuucccagcaugaaguugagcuuuuguuuuccugaugcuucuggcuccaggguuuguuugaaacaggucucccuguguagccgagguuggccauccccuaagcccucucagguggcagucacauuugugugccaccguauccagcugugguucugccucccuuugaaaauggggugcuuugguugccaacauuuacagaauuuaugaauuaaggcuuuuccuuuagagcuguguauggguucugauuuuauuuuuguucugauuuuuaaaaagucaggaucucauauguagcucuggcuguccuggaacucauuaaguagacuagagugaccuugaacgcaccaagaccuaccuaccugccucuaccucccucccaaaugcugggauuaaaaguauucacuaccacgcccagcuguucuuucguccguccauccguccuuccuuccuuccuuccuuccuugcuuucucucuuucucuuuuucucuuuacuuucuuuuucaguaauuuuuuuuauucacuuuauauccagaucacagcccuccccucccaggcccacccuuacaagucccucucccuauuguccccccaccccuuggguaccaccccauccugggacaucagguuccagcaggacuaggcacauccucucccagagaggcacaacuaggcagugcagguaggugaacgggauccaguggcagggaacagucugagucagccuccacucccauuguuaggggccacauaaagaccaagcugcacaccagcuagaaguguguagggggcauaggucuagccccugcgugcgugcucuuugguugguggcucagucucugugagccuccauaggcccagguugguugaccccucugcuucguccaguucucagcugguuuuuccuaggagcuuuuccuuggaaaggcugggagaguaacacacccugccuuuucuacucauuugauuuuuuuuuucugccuuccccuuaaguuuuuuaagacaggguuucuuuuauguagccauggcugucccagaacuuaacucuauagaccaggccggccuggaacucacagagaugcgcccaccucugccucuugagugcugggauuaaaggggugcacugcugucgccugacauuuucccagcuuucuucuagacuguugguggucaaccgacuguacguuaacagugaagccgguggcuuacucggaauuacagugucucugaacugaccauuuucaugucccaagucaaguuaggccauagaagagauaagaguuuguccuuucagggacauuugugggaguugcuucuccccacccugucaauccuagggagugaacucaggucgucggccuugguagcaguugccuuucuccccccacccccagccccagccaucuacuggcuucucucuucucaaaauacccacuugagucauccgggccuguuugaccuguggaaucaguucgccagcuguuuaguagcuugucccuguaccuuucugccucccucaggcuuuugggugcuggcucuaccuugccugcccuacgcuaaggacugguucucucagggcuccugcaagguaccuagauguaggcucucgcuuguugucagaccugaggcuguuggacuucccaggcuccccacagcggcuggggggcccugaaaggggugccacggguuagcucaagcucaccccaucucaggaccgcccgagaggaccuacuucaugugguuucucaacggaaacuugauuuugcguucccauguguuugguguaaagagaauauuuucugcucuuacuccuucgcugagggucauguguucaucucucucaucacacuggccugucuuuccaaucagagagugcuugacuugcagugcuggcacucagggcuuugugacagugugacagugguugcagcaguguuauccacuguagaaacugcuucaccagcccugccccagcuagagcuaccuugaagaacaccugccucuccuguccucacccuccagucagucugaacgcugugcaugagugaguccucacaucuugcucuugugccugucccugagcaucuguccuaaggacuggcuccauccuggugguguccugcucccgucuuccugccugucacccagacuugccuaccacagguggacuguguacuugucaccauuuuguuucauuuaagaucugucauccugugugcaugaauguauguucacaguaugcgugcaugagcccauggaaauccgagagggcuuaggauucccccaaaaguggaguuuuggacaggcgugagccuccauguaggugcugggaacugaacccagggccucugcaguugguguccugcugaaccgucccuucagccccagucacaguuguuuaguuguuuauuuaguggucugauuguugcaguguugucuuaggggcggggcuucgccugaucccaucucugcuccagcacuuccugaccuucagacuugucccacaccuggcccagcugugggguuggccacuucuccgggagugcugaguucuucuagcgaacagaaaugucuagaagccaaggagaauauuacuagugcagugcuccugggguauuguggccagagguagggacaguguaugaauaguuacugugguuauuucuggggccauaggaagccucaggucacuucagggcauuguccaucuuuccagucaacaccacacgucagccuucuuacuggaguggccuuuucugaugugggaaaccuggcucccucacccuugcucuuuuuaccuucugcucagucucugugugacuguccuucccacuccacugagccugcuucucuugggccuccccagugucuuuuugacuaaauuauuccagaaauuaagaagggggcaccucguuuauuguuugaccuagugguuuugucagagucugagagagccaaauucaucucccaccgugaguguucugaccccguguauuuauuucuggugacccugcucucuguuaggcuccuuguguguucgguguuuacagugauuggucaguggacuucuguagacgcauuugcugcuguuugugucccugcuugucacucucagccucucgcucuauccucccagcugugagcagccgcucagugcuuucaguuggcucccuuggucucucuuuucagugcucucugcgcaggcagccagcuuugugucugagaccgcauagcauaguaggaccgcucguggcagccaugugcuguccucuugccuuuggcucuccugucuccuauuccugugcuccuggugagagaggacugagcuaguccuugugcucugugggcuagaaggcaggcagugccacacacuucugccaccuguguuuauccuucaucucagcacaguuaggccaggcccugugcucucggguaccugcucccugccgagccucauucacagcagacacucaacgugcagauccucuuuccuucccacaguuccagucccagggccaggcuaggugacucuccccuuacaguguuugugaagucucacuuaguacccagacuccaucuucuagaugcaaacuacccaucugggagugacauucugcugccaagccuuugugauggccaugcuuccuuugucuccagagugaccauacucagcuuguuuuauccccauaccaagcaguguggcugagcauagcugcuuuacauuccugucaugugcagacaugaccaacacccacagugauaccaugaaccuaggaccacaaauccucuuugucccuggaaggcuggggacagguacacaagggucauggguggaccaacagguuguugagagugugaggucuuggguccaggccucagccugccucagaagugggaccucgcuagcaggucucuucucucagccuacuucuuuccuuucagguguccccaggugucauugccaacccauuugcagcaggccuuggccacaggaacagucuggaaagcauuucguccauugaccgggaacugaguccugaaggcccaggcaaggucaggaucaaaguggcuggcaaccugggacuggcccugagcuacuaguuccugaccaugucugcucugccaacaggagaaagaguuggccagucaagcccuacccugggagucugagucugcagagaccacggugagucccacacgggccuagcucagagcccaggguagacucuacugacaggacauugcaguggugaacacaucccagagguggcaggcagccacaucccuggaauguaaaucucuuagcagugugguccacucuguucuccagggucggaaucuagagccccugaagcuggacuaccgugcccuggccgcccugcccagugcugggaguuuacagagaguaaguggugcaugccggguguuacaccauggccugucccuaaccuguugucugccuaucaggcucuuccuugucugagggagcuacugcugcugccugugucccaaggccaccacgaagagagcuuuugucuuagaucaggcauggcuuguagcuaucagagcuguaaugcugccucccaguuaggcagcauuugaggguuuuguuguucuuguuuggcaguggggauacaagauggagccucuuggaugcaauagucaggcaaccaccacugaccuccauguccagcccuugucugucgggcuucucacuuuguggcauaggugcagaggauggccuuugaaagccccuaaccucuucccuaguaucuacccccaaagaguuggccuggcagagcuuaaccugcuacaggcaggcugccgggaagaagaggcagcugucauuccucacagccauccuggaggggucucaugaguggucaccauggagcgggugggcugaagcagcagcugcagccuguggaaggagagcucaugggugggggagacugagcagugcugacagcuggucugggaguggccacucgggccucaggagggauguggccuucaaggcaguugugggccugaggacaggcagaaaggacauuugguccccauuguucuccgggagguuugcaaaacuaucauucccagaagauguugggagaccauugccagaaugugagugcucaaggggugggcuuggccaggacauugagcagcagggggauagggaaagaucaggaagggccuggaugaggaaguaacacauuuggauuucugggugcucucucuucccuccccagccgcucuagcagagaagccagcaugguuugagaaaggggagcagcgggucuaggcugagaugcuucucagggucagguaccaguggugggugugcuuuugggucccagcuaucuaguuucaaucuguucaucuguucccagaucuccuuggagagcuuagggcugcacccuuggcaguaacgcacugcugugagcaggcaccuaacuguccagccuaggcccuggggagagcagaggaggcuagggccuuggagaaggaaaguccuuuacggaggccuccuggucauccaggccuaacuggugacaucccuggacuguggucagguuaggacacacaggagcugucucugugcugccaggauaaaugcucagacccguuccuucccugguagacugcuagccuaggugacucuccuuuccaaccacugccuucuuccucaagggaccaucugcgaccaccggagggaagacgacugaggcucccuguuccccuggcagucagcaagugagcaucccaguuacaggugccccacuggggcagcagauggguacugguaugcaggguccuuuggggugguggugucauacuuuuuuguccagggauaccuuucugguuaaaccugaccuugaugaaggcagggacacugcuggaguucaggcauccaaaagacgagcauaagaucauuucuguacaguugcccucuaugggucacgccugcucccaacauccccacuucauggagcagcauuccugacggugcauuauagggugggggugggcacagggccauucccgccuagcuccuagccucaacccugccaagauagauauuuggaugaguguguccuuguagccugcuugucuccagcgugcucucugucuuucucucucuccuccuccucuuccucuuccucuuccucccucccuccuccuccucccccccccuuucccugcuuucacuccuggaccucugauccugcucuccucugccacuguucccuucaccuuuacagacaaaaccgggggugauccagccauuggcucaggccuggccaaggaacuccccggcccccaggggcagagguggucccuguucugugaguguccuguuccguagugggugaggguggaacaguugcuuccagagcaggauggggaugugggucaguggugguuggaggauauggaggugggucugggcaguggcugcacugggaaagcugcccagccucacucguggguguuuccccagccacccuccccugaugaacugccagccaaugugaagcaggcguauagggccuuugcagcugugcccaccgugcauccuccugagaacagugcuacccagguaugugcaguggugcccugcugcuacugugugcucuauagagugggcacccaaggugagggccccaagagaaacagcagccaagucugagggcccacucccccucuagccuccaacaccuggucccgcagccuccccagagcagcuguccuuccgugaacgacaaaaguacuucgagcuggagguacgggugccucaagcagagggucccccaaagcgugugucccuggugggugcugaugacuugcggaagaugcaagaggaggaaggugaggagccuaacuugaggagaggccuggguggagcaaugaccuagccuugucugauaugucuuccuguccacagcucgcaagcugcagcagaagagggcacagaugcuucgggaagaagcaguaaccucagggccugacauggggcucgccucagacagggaguccccagaugaucagcaggaggcugagcagcccugggcugugccaagccaugcaggggggugaguacaggaggccaaaccccauuaccuggcuugucugcuucauccccuuucccacaaugagcccugucugcugcuccagcucuagcccaucaucacccccaccccugggaggcaacgccccugugaggacagccaaagcugagcgacgccaucaggaacgguuacgcaugcagagccccgagcuuccugccccggaacgggcccugucuccugcagagcgacgggcucuagaggcagagaagcgagcucuguggagggcagccaggugagugccucccuaccaccuaccagaucacccacacacacaagguccagucagcagcauccucuuugguucuacagaaugaagucucuggagcaggaugcucuccgugcacagaugguccuuagcaagucccaggaaggccguggcaagagaggacccuuggaacggcuggcugaggccccuucaccugcccccaccccaucacccacaccauuggaagguauguuuccaggggccagcggggcuccaccugcugggagaacuccuaacucuauucuuguucccuuagacuucggccuccagaccagugccuccccuggacgcuugguaaggagccuauaucuaagacccuucccccauacuguggccugaggcagcagggcucuagacucccccagccucaccucccuugcacucugccuuucccucaugcugucuuuucaagccuuugucuggaaagaaguuugacuacagggccuucgcagcccugcccucuuccagaccuguguaugacauccagguacuggaggccgcuuggcccaucugcacgcuccucccagcccauccuugccuguccccugccuguccaguccuuucugugcuuccuacuguuuccuguauguggggccucccuacccaccuuguuuucagcccaguguacucugaccaaugaccuaggcucugugagccuagccccagacagccacgccugcauggguaaguucaggcaggucugggaccugcccugaccagccugucuccccaucagucaccagauuucguggaggagcugaggacuuuggaagcaucucccaguccuggugaguaggcgccugucuggguugagugcccuccacccagaguucuggccgcccuuggcucacagccuacccugcucaaccaggcucccaggaagaagauggagaaguggccuuggugcuccuuggcaggcccucaccuggcgcugugggcccugaagacaugacgcugugcagcagccgucggucugugcggccgggacgccggggccugggcccugugcccuccuagggccaggugccuccccagacuuagggugggagccugccagcuucaucaccucccuuaucccaagucuguuagccuugguguuagcauuuuaaagagaccccucaggaguucuggcuucugauuaacugccccguagccgggaucucguggcgagacuguaacuagugauguuuguacaaccaaagacucuauuuugugguuuaagaa

SEQ ID NO: 12531 - RNA, 8435 nt, Mus musculus
uugacgcggccugggcagauccuugcagaaagcugcaggcuagcucgggauuccggcuucgcagacagguaccucugggagcggcgggcggauauccgugccaguaguggugggugggaugcccggguaccccuggagaagcgggcaggcuggaccguggcaugcuccgcgggcaccucuugcgacggagacucggagaugguguuuugaccccauccuuugaaggucuucuccuaacccguacagaacucuuuggguuuugugacccgugagacuggcuggcucuuaacuuuuucgagacaccuuucccuuugagaauccagugaaaaccaaagaugcuuccuuccuuuauuuuuugucagaaugaagagaauguauuuuauagccugaugcaaacuaaagcuucgcacaguaagugcauuucccuguaaagggggacaauuugaucuacuucucagggucauggugagcaucaaaugucccaacaguuuguaaacaugaaagcacucuuaaccuacgagcugcaggcuguuaucauucgugauuauaaauaagggacgucacuggccggagaaauggaucagagucucagagaacugguugcuguugcagagaacugggauucgauucccagcucacaaacgccaguaacucuaguuguagaaucugcagacacaaggcacgaccaugguaucccaggcaaaacacucagacacauuaaaaacaacagcaaacaaagccuuugaggcccuugggggaugauaaaacguuggacuccccagagggugagcaacaggguugguugggaaccaagugcaaaccuuuaauuuucuuggcccauagucuucuaugagagagcuucccuaaagaacccuaggauaccuugaacgguguguguauguguguguguuuaaaaaaaaaaaucugugaaggggacuagagaaaaggcucagugaauguggguacuugcugcucaagugugagaccauggauucaaguccccaacaucucaguuaaaagccuaccacaagccggcgcgugguggcacacgccuuuaaucccagcacucgggaggcagaggcaggcggauuucugaguucgaggccagccuggucuacaaagugaaguuccaggacagccagggcuacacagagaaacccuaucucgaaaaaccaaaaaaaaaaaaaaaaaaaaagccugcuacaagcucggaccccugcaaugcuaacacuguugguggcggagacaggauugcuugugcucgcuggccgccagucuagcuccagguucagugagagaccccaucuaaagggaaugcaacaggacaccugacguccccccuccagacuccgaaucugcacacaaauauuaauaaaguggauacacacacacacaccuaccugcacauaugcaugcauucagcacauaaacacauaauuggaaaaaaaaauguaccaugaagccuugugguuuuaugacuucucucuacuuguuuuauuuaaaaagcugaccucuuccccgagccuaagugauguuacugauuuuaugagcauugcaggacguugugcugugacuaaagcuagugugccggugagugucgugauacuuaucgagacugugauaaguaccgcucugcauccgggagugaaauccgggugucgcuucauggcuuuaggaugccauccaggcugaaguucccguacuuggugauguucuuacuggccaacgggaaugguagaaauuuccucccuggcuccacacugugaugcuggcgaggccaacucgugacagaguugccugagguuagcaucacugugaagccacacaaacuuugguuccaaugcccguucccaccaaagaccuuggcuuuccaaauggggugacuaggagaggcaugucgaggggcaguugugagugaaauggguuuaugcaaaggccuuagccuauacugccuggcacauaagaagcacccagcacauggaagcuccuuccagaacuauuaggaccucaagccuucuuuugcuguucuguauaaauggauaacucuucccaguagguacugcgguaauuggcaaucaucaagguguaagauguucuaauggauagagaacagugaaaugaggucgcugaucuguuugacuuuaggagacggaagugcugguguuuucucgcugggucaggaaggagaaggaagugcuggcguuuccucacugaguuagggaugccucucuuuggcagcauauucagcccaaagaagaccccuccucggaagucggccucucucuccaaccuacauucugugagugcagacuggguggcgggaguggucucuggguggagaggugacucugugggaaggcauccucgggguuuauauuauuagucaagacugaauuccugcaugggaacuacuacuggaguuuauucaagaaccuacuaugacaggcagccuccuugugauagggucccagguggugguauccagucuggcuugcauuuuaguucagauaauucauuucagucauguuuaaagaucaaauccaagcuggguguagcgguauaccucuacucucagcaaucaagagguagaggcugggggaucucugugaguucagggcuagccuggucuauagaguuccagggcauccaggguucagagagagacucugucuccaaaaguaaaauaaaauaaggucaaguucggggccuugagagauggcucagccaaaaaggguacuuguugcucuugcagaggaccuggguuggguucccagcccggacaaggauggcucacaaccaucuguagcuacugucccaggggauccaccgcccucugcuggccucuacuggcacugcacuuacaagguucacaacauacaugauggcagagcacuccuacacauagaagaaaaauaaauccgcaguuguuuugagaauggagucucuguguaacccuggcuguccuggaacuugcuauguagaccaagauggcuucaaacucacagagaucugccuguuccugccucgggaguguugggauuaaugguguacacccacauacacugccccccccaaaaaaaaaaaucaaguuuauuucggagauucacaaaagauguugacuugucaccguuagugacacuugaaaggauaauaacaguucugaaagaggggguccaaaaacaucuggggccaugacagcacugggacaaagguaacuuuccaaaggcaacauggagccccccugaaugcagggccugcgcuuagaaaauacauaauaaagccauuccuaguuaugagauguagauacacacagguccauuccuagcuaugagauguagauacacacagguccacgcacacaggccuuucagcaucugugaccacaaaucugguccuucguucccaccauauuccugcccuuacaucugggugcuacugcugugucuuucacaccaagagaugauagacccucgucucuuugucccuuucccacgugacauuugugcagaugagccaagucuuuacaagucuguggguuagguagcaagcaucaccccagcucuaaaggccaugaguccauugccucuaguccccaguuaggaucaugacggcagccccucuaaggccagggauaaacagugugggauccuaguucuccaugccuuggacuucaagccuccuuccagacaccgacgacagagaugcacuugguacucucacugggacaacccuuguccuuaaaggcagcagcgugcuucuaacgcuacugucugagagugacuggaagcucacccucccugcaguauuugcaggacaucacaggcaagugcugggauaaggaaacacaaaacauggugcacagaguccuuuuaagauguguguauuuauuaugugugcagcauucugccaucaggucagaagaaggcaccagaccucaucauagaugagugugagccaccaugugguggcuggauaugaacucaggaccuuuggaagagcugccagugcuuuuagccucugagccaucucucuaucccccagggggcucaacagcauccuguuauuccaggacaguggcucagguccugaggaaggcacauaagguaccucauagccgugucuucugugcaccuuuugcuugggccacccauccuuacaagagccuguaaggcuaugccugcugcucuaugccuguugcuuugccugcccagaggcaucuucucuagucaucaauuucauagcagccaauugauaacuuuguguauccaccaaccuuuuaggugcugaguaaggaaaagagggaccuggcuuggugguacaggucuauaauuccagcugcuugggaggcugagccaggauuacaaguucaaggccagccgggacaccacaagacccucugaaaauugauaguauauuuaaaaaaggaguuucuggagaaggaggagaugagucaggggagggaugugagggccuaaguuuaauccccagaacacuuuuaaaaucugggcgugggcugaaaagacagcucagugguuaauagcacuugcaguucuugaagaggacgcaggucagauucccagcaccgacuuggugcuucacaaccauccaugacuccaggaccaggaaccuagugucuccugagcuccacagacaccggacaugcaugcgguguacacacacacacacacacacacacacacacacagacaccggacaugcaugcgguguacacacacacacacacacacacacacacacacacucacacacacacacacacacacacacacucacacacacacauacacacacacacacaaaccuaauuuuaaaaaaaucuaauaaaauaaaacucuggguacuguggcacaugaguggggggcagugcauaggaagaagacaccaggcugaggacaagaggcucuugggacucacuggccggccagccagccacccuacuucaugagcuucaagacagugaaagccccucaccauaggugcugaagaaggggccgggugggggcggggugacugggaagaaggugguuacuauggaaaaugcagaggggagggaaaaagagacccuaccuauagcgcaacccuaccuacagcacgccuuuguuugaaaauaucaucaugagagcuaauaccuauaugcugacuucuuuauuguuguggggggcagaguugagacagggucucuccauguagcccuagaugucccgcuccuucaucuguagauugaacugaccuugaacucacggagaucgacuugccucugccuccugaguauuggggcuagagauguguggcgaccauuccuagccugaaauuguuuucaaacuguagauaguaccugaggaaugacagccgagcuuguccucuggccuccacacauguguguaaacauucaccugcacacacaugaacacuuauguacacacacacacacacacacacacacacacacaguaagagauauauguccguggaaguauauucaagucccaagguucaagccccagaaacagaaacagaaaaaaaaaagaggaggcgaggggccagggagaaccaaaucccagcaucuguugcguggguagacauuuuaacaaggagagugauguggaaagagaguugucacuuuaaauagggugcucaagggaguccuaaccaagcaaaggacauuuuagcauacacuugaaggaguucgucccugucuuuuucuaucucuuucuauccacacaugcacacacacacacacacacgcacacaugcacgccugccugcccgugucaagcuggucacgucuccucucaggguuggaggauucccucuggcagagcuggccaugcuccuaucugaaugcacaggagucaggccugacuugaggaguguuugaugaguucugucaaagaauacagaaaugagacugcaggacauuagacaaguccuaccaggaacuguuaggauuuugugcuuccauauuaagcaaaggacaacuugcaaguuucuuugaauuauaaauauacacugaagaggaggagaaugaauuaaaaccaaguaugauuacauauguaaaaauguauggugggauucucugaacugucaaguaguuguaaaaaaaaauacucaauuuaugaagggacaguggcacacgccuuuaauccccacacuugggaggcagaucucugugcguuugaggcuggucugguccacauagugacagccaggauagccagggcugcauagugagacccugccucaaaaaaaaaaaaaaaaaaugugucucuaaaggugcuaaggccuggugggaggagagcugcccguguuguugggucuacaacuggugggaaaagcuggggcgucaucucuccuucugauguaucucuuguucuuugguuuccuggugucuuaccacaguuagaucggucaacgcgggaacuggagcuggggcucgacuauggaacuccuaccaugaaccuggcggggcagagccugaaguuugaaaacggccaguggguggcaggugaguggcccuucuggauguuuugucagucaggcuggcagaaggaagacuccuuucauuccuguuuuguguccucuagacuccgugauuaguggggguguggaccggagggaaacucagcgccugcgcaaacgaaaccaacaguuagaagaagaaaacaaucuccugcggcugaaaguggacauucugcuggacauggugagggagaaauccccagggaugccuagguuucuccuuuagggaaguccuaccuugagucuagccauccaacugauuuccccagggccuacuuacugggucuguuuccuggguauccacacacaaauguaaaagccaaccuugccaccaaaggcuggagcagggauauauuacaguacccacaauccccgugcccgugguaaggguacuccuuuaguccaagcagggucugauagccacacagaagaggucuagacagcagagaggggcucuccgacgaugcccaggauaguggcaagaauggagauuggacgaaggcaucccagguggugagggugucugcucgaguuugggggcauccugccucagaucagcugaaucagugaccagugcaaaccuucgaagggcacauaccaaauuaaugucggucuccugugucugcugggccuggcagugcgugugcagggggggacaggcgugagggagcuggugggcagcuucuuugccccaccggcuacccacucugugaccucaucacuccagcaagacaacuggcaucagaguagcaccuuccucuuggaccuaauaacaagagaaacacacugagagcagagaccgccugccuuccugcccucccucugucuucauguucagugucugcccccuucuacuguaaacccuagucaaaagauaaugaugaggaaaggagaaguauuuuuagaacaucccaucccccucccccauuuuuuuuuuuuuugguagcauuguucgcuaagugccauuacacgagacuagacagcgcagauuuauaaucucugaacugcagcguacccagcguguguguuucuguccuucacacaugguaugccaugcagcuguguagaugugcuagaggcacgaggaggagcaaucccucugucugccaaggcuuagcugggugaggacugguaguuuuccuuggugcacagccgcugcgcacgucugcagcggggccuggccguagcuuucuuuguaacaauccaaugcucuuacuuccagcuuucagaaaccacugcugagucccaccuaaaggacaaagagcuggaugaacugaagguuaccaaccgcaggaggaagugaagagagccuggcagcacucgcuaggggacuggaaagagcccagugaccaggggaggaggaugcggcagagcccuuugauuucccgucagauuagcagacuaggggagagcauuaacaggcccuggcucccuugggcaggggauagggaggagacacaggauggaagaacccaaggugccaggccagggccauagccaagcaagcaccccagguccacccagggugucaaucuaaaacauaccccaggaaggccuagaaauaaugagccuuggaugcugucggcaagugacagcauguaacugccugugucucagaaucaccauauucagacagcuggcagcucaccucuugacacuggugucugggguuuggcacuccucccagagagcaccucgcgugagggugcccaguaaguggcucuggguugucugcaccccagcccccggaacccccagccguaaucucucugccuuuaaagagcccucauccucaaauccacagccucuucuggcaucagcuucccagcagcaagcuccagccuuccacagcacacuguaauuuacucuuuuuuuuauuaaacgguguucaauaa

SEQ ID NO: 12532 - RNA, 16599 nt, Mus musculus
ucaaguguaaacuccaagcaugcuuuaauaaacuuuauaauuuaauuuaaaucuagaguauuuaauuuucaaacaaauuuaaguguacagucauuugcuauuuuacauacaaaagaaucaaaacaaaauuucuagagagcuguguuucagccugaugaaaggcagggaucagggcagccacggaggugggaggcuuagguucauagggggaccccaccacucagacacgagcaguauaaagggcucccccugucaaauacaauuccuucuaaaauuuguuucuccaggucuaaggccacaucagaaggaaacagaaucaacagcagagggcugugcgcugcucagaacuugagaagcggugaguccacguucucuuugucagccucagggcucagcuggaucaguggggagcccaggucgaucagcuggaagagaauggagagaucagggugaacacagcugucugugccuccacacaagaagcugcagugacugagccaaucccaccuggcccaaggacaggaaacagcagcaguguggcaaggagacucagucaucaaucacgccuaagacucuuaggagagaaaccucaaacccaucaacacugacuuccugacagggcaggcaggcaggagaggguugggaauacgacugcccuaagaguuccuccagguccagccagauaccugacggcaacgggugaccauggagaagccaagcaugagucugagacagacccugugagcccaagggcaccaugcagcacccagcccugccagagcccugggcugaagucagcacgaauccccugcugcugcucaccuggcccagcucagccuuugcaggcuuccccacaucauuucuacccaugucuggaguguucauuaugaggucaaucaggggccagcugcuaggucccaaggccguguucgacucagggguguugcugaagucgaugagagggcagucggccaggucucugccuccugcuucaggggugauggugagcugguccagcuugagguccaggagaagacccuaagcagggcagagagggaaagucggugccaagcaaccacccugggaagccaggcuuugcccaugacccgagguucacggccuggagcccaagggaaaggcaggcgugggcccucaaugggaguaaguuccucuuugggcaguguaccccuacccacagcuaguauagagcuucagccugucccuacuccugaccucuaaccccugaccaacuccuuugcuaagcauuuuugcccaggguccugagcaccucugagucugcuggaagcaugggccccagccccaaggugagucccugcucgugacucuccauguaccucagauggcguguggcugcaaccaccuccaugcaccucacugggcagcgugucuucaggaggcucugcuucacccugagcugcuccuguggaggagccuuggggaggaggggaggcacucuucucuggagaaaaguuaagugcuugaggcacggaggauggaggggaagagcucucaucugaggacaggcccugggccugcccaccacugccgcugccgcugcucuccugcgucagcucugcucugggggaaaaaggaggaaaacguauacgaucgcucuuuccaccccgaucagcagcgacggugugaaagcagcuucugucgcagaggcuggccacaaguggccgagcuaugaggauagccucaucugucagauccugccaucugugcaagagaaccaaacauuuccaaggcccccuucaccucgcugauucaucagucuagcuucaucuuguguccaugucugcccuuuucuuuaguuacuaagucacucagcaucggcuccaccucugcacacacacacacuguggcgagccccuccaggccuaggugagccaagugccugccugccugagugucccuucccuccccacugcucccucaggaggccagguuggaacccccgucaugcauggccuuccacacuacagcaugcuuacacuaacaggcaccuguaguacggcgugcuucccucuagccucgacaccuagcauguccccugagcaccugauggcucaaagcugaaugaacuguggaaacugaacaggaaccauuuccacaaaauagaacagaauaccggcuucucauggcuuaugggguucggaacaaccugaguuccuucuguaguauacuuaaaacauacacacacacacaccauucacaugacacaacacagccucacccuacacacacacacacacacaccauucacaugacacaacacagccccacccuacacacacacacacaccauucacaugacacaacacagccccacccuauacacacacacacacacacacaaaacauucacaugacacaacacagccccacccuacacacacacacacacacacacacacacacacaccauucacaugacacaacacagccccacccuacacacacacacacacacacacaccauucacaugacacaacacagccccacccuacacacacacacacacacacacacacacacacacacugccuauuugcacucugagccuuuugcuccacagaccuucuuuuccuauuucuccuauuugcugccuguaccuuccaagcacagggagaccccugaagucuggggaacacucaagacaagcuuauuuuuaccuaacuguagaucuucuccugggcucagaugagagucgccgggcaggcacacacaguggggacaccagagcccugggcauggacugaggugccauuaauggaaggcuggagagacgccgacuggcagguguaggcaacacugacauccgucuugugcucagagggguccucauacugccgggcaggccuuguggaguagucccugaugagcgucucacaggagugcugcugaccacccuggugaagacauggaggucuucaacacagaccacuguaguugaaagggcagccagggggccugggugggcucuguucuugagaagggcuccagcaugggcaggacucaaggcgcuugcagcccccccacguaaccuuggaugagugucaaguuccucagcaaugaugccuccauccuaguccacuccacccuguccccuagguaucuagaacaucuuugaacauggcuauauucaagguacccuccauugagggucagaagggaauuaaagagauacuugugauagaagacaucuaggcuccuaucagacucuggcuaagaagugaauugaugaugguuuuccccacuggccuaucaugcccaggcuuaagaucccugagucagggcuugggagauggcucagcaguuaagagcauugacugcucuucugaagguccugaguucgaaucccagcaaccacaugguggcucacaaucauuccuaaugagaucugaugcccucuucuggggugccugaagauagcuacaguguacuuacauauaauaaacaaauaaaucuuuaaaaaaaaaucucagaaucaaaggugagaacugagucggggagcuaggugcuugcucccuggcaguucggugccuuagccaccaucucacccaaauguuauuuuguuguuguucuuaaugcggagguugagucagguuguuacuagcuauggacuaaauguuuguauccuccaaauuuauauauugaaagccuaauccccaagaugaugauguaggaggcugggcuucaggggugauugggucagaaguuagagcacccaccaaucagcaugaugagcaucauuauuaagaaagaagcccagacacuguguuugucuuuccaugugaagaugugaugagcugagcaauggacccgcaucagacacucccacguacagaugcccugacccuguaugccacacccacuuaaauccccagaugcccugacccuggaugccacucacccacuuaaauccccagaugcccagcaugguggcacaagucaauaacaacaaggaaagggaaaggagacagagugugagguuagcccgucuacacagaaagauccaggcauuggcaugcuuguuacaguagccccagagcacuaagacacuguagugaaacaacucuaggucacaggacuaacacuaagcccuggcaggcuuagaagucaucuaccaacuuuaccauccaucaaggacaacuucugugucuuucagagucuggaaacaaacuuuauaaauagcacgagaugaacaccgggcggcuuacucacaucuaggcacugggugcucucagaucaaggcccaggcccaccgcccaagcaccuucuacuguggacacuguggcucugcuacaagcgccaaugaagacaaauaugcccacaaugggaccccugaugggacccggaaggcaggaguuauuucacuuuccagguagcugagacaugggggugagauagucuucuaguuugcuuucugucacugugauaaacaccaggaccaaggcaccauggggagcuuauguggcauacaguugcacaucugcgcucaucucugagggaagcugcuaccuugcucuggagcugguucuguuaacugcaugggaggacggccccucagcauggcuacagcuuuacgggaagcugucuagucuggaaacccccagccccugaaguguacuuccauggucacccugaggaugcaaccuaagacgugcugauggccucagugaccagggaacuucugaaauauauugaugcugggcucugcucccuugucccaacucccuccccaacccacugagucaggagcuuuggggguggucuaggcucagcaccuaaagcaauacugaagggguuucugugaucuggccuggguucacccagcacacagugagugugacagacggccucuaccucagaagcuugaccugcagcccagguggcacuccauggagccuacagucacaucaguagcucucaaaagguaagaaaggaggcaaacuccuguuggcuaccugcucgcugguguccaggacugcagccgauguguccgugagaacuuugggguuacuccuccaggugacucgccuaagaacagggagagccaaucagaagagagcaacgccaggcagugguggcccacaccuuugaucccagcacuugggagacagaggcaggcggauuucuaaguucgacgucagucuggucuacagagugaguuccaggacauccagagcuauacagaaaaacccugucucaaaaaaacaaaaaacaaauaaacaaaacacaaaaacaaaaacaaaagagagggagaacaacauggcaagccuggcaugugcaguaccaucuaggcacucuccucuaaacauccccacuuucccaacuguccgagucaaguaaagacagaaggccaaugagacacucaggaaauccucuugagaccccagcuggggccagggccaggucugguacugagagcacucuguacuguuaggccagcuacuuucccuaacuggccugggccugaguuucauggcaggcuccucccuagucuccucuucuggcaggcugaucccugcaccccauguccacggaaaucacguggacagagccccagcaagcagcaaagccuucaugucccugagcuguggcaccccuagcuccaagcacaucacauacacauucuauaggugacaagaaucuuuagguggaugucccagcugcuauuugacagucagaauucagcaugggcucacuagccacuaagcaaagcccagcauaacccagauggccugucauaccacugucccuccaccacacgauuccaugugaaacacaaacuugccucccaugauccugagagucaaucuggggcuccaaagccucaggagcccggaccuccauguauuagcuugcugucuuagaagccacgggcaaaguggccccagccaugaaaggggcccaucuuagcaagcgauugaaggccagaugcgcuccaaaacaauacugcugaccacacauuuucuuaauuaccgacugaugggggagggcccagccuaccaugggugguuccaucccugggcugcuuaagguaugagcgaggagagcagcacccuccauggccucugcaucagcuccugccuccagguuccuguuucgaguuccugcccucacugccuuugaugaacugucauuuggaacucugagugaaauauaccccuucuucccaacuugcuuuuggucacggugcuucaucucagcaauaguaacucuaagacaggcuccagccuaugcaguccugcuggccucagcagaugcacacagcagggucauaguguccucuauuuagacuuugacacgggagggaaaucaacauccuuuuuuuaaaaaaauaaaaccagguugugcggcuugcaguagggucuauuccaacugcauucuugccgcuaucuucccguuccucugggaacucaagcacauuuccgccauuggacuuuuccagcaucauuuccuccaccugagcguucucuuuggguucuuuaguggcugccucuucagugggcuucugaucucagcucagcauuguugcuuggggugacuauucuagccaaaagaaccaccccaucugugccugguauucuuaguugucaccuuguuacaugugagugagggaagccuccaucagacuggcauuuucuccauugcuaacugcuguaggaaagggcccagcccacugcgugugguaccauccuugggcauuccuccauggucuuugcuugaguuccugcccugacuucccucaaugaugaaacuaugacguggaaguguaagccaaacaaacuccucaaggugccuuggucuugguguuuaucacagugacagaaagcaaacuagaacacuaucuauccuuuuccccagacagcuggagcaaagccacacagagggaagaacucuagaagacucuacaacaucuccugaaagggcaguugcacagcgcagcgucaggcaaugccucaaggucaaggcgagcaacuaguggagagcaaggccgaggaacagcacaucccacccagccugaguggccggagcaaaccaauaggacacuagcagugucugcgcagaaccccacgccugugacaggcuaaacugcacccacccuauacccaucuguggcaggcugcaggguggagcaggcuggacugcauucacuggcugccaaguucagccccuuaaggaaaacauaauucaggcggugaaaaacacagaaccacagaaacggaaccaccaacaucaacagaacaaggacgcucuaaccccaggugcgacaaaagccacagcugcagacauaaugaccacacugaggacaacagagagaaagacgcaggccaagagcaguggcucaucuagagggauggacacacaagugggcggcagaacacacccuggacagaguaucagagcuaaagaagcccaacagcaccagccacaccaggaaccucuccaaaaccuuaaagcccgccacgauguagcucuacucaccaacagaaaacuggggcacuuuaaauggguuuguugugguagacacggccucugucuugcagcucagauaggagucccgucguuuuaugcugacaguuuuauucaacugaggugucucggugucgggguccagccuugguccucuuugcucuggagucugggguuguugggugagaggacucaggguggggaccuugggcugcucagccacugucugggcagcaucagccuuauuggcuugucugccaaacacccuggcaggggcugcuggcaaagccuggcgugacgcggcggguccuauucugccugacuugcugguacucguccgacgcugggagccgcuagcaggaauacuugaacguuguucacuggacuuugcugcaagagucgaucaucaaggcugguuacucaagccaguuuccaaacaguuuaaacacacacacacacacacacacacacacacacacacacacacacacacuuuagacugucuaccuaacaucagacccaucaggcaaugacuguugggaccagcaggaugcccaaaccugagcugaguaccaucuaccucucagcaggagugugugcauucacaaggcuaagcucuucuuucuucacuuccuugaugagcagaagaaaguggacagucugcucaacuagcaauggaccuacucugugaguccacagugaagacucaaggggaaauuuuagggacuaaugcuguagccaugucuaugccauguguuagcccuacuagguccugccccacaaucucaucugacccuacaguuauuccauaaacaacacauggugccagugucccaagucaguggagaaagacccaucucagcuccugggcagggcagccaugcauuguccugaucauggacucauggaccucagaagggucguugagcacuuccagacucauaggaacuucccccaaggccaacaggaucaccugacuuaaagguaagggcacagaugguuguuaaccaccgaguagcagucaggacuccagaccaggcugauucgagagcucagacuucucauaucuugugaaaagcccucaccaugcgccaguggacaaaaccagaauccacaggcaaaccccagaugcauucuccggucccuauaccacuccaccacuagauggcagccuuguuuaggcagguugagcccaagggcccaugccccaaaggacucaggcugggcucaauggcccuguguucucacggaugcauagcucgugugaacaaccacauuuucaugucaguucaugagucuguaugccuccagcugagaucaccucuccuuacaggagggaaguauucagggcagcaggacaaugagucuaguccugccuagcccucagcccugagcuguaacucuacagcauucugugcagccaaaacaaguggugcucagggcucccagggagaguggagcugcucaccuuugccugcuacugaagaccuguagacaccagacucgaggcuugaagcagacccugagguagaggacuuccuugugagauugccaguauagccagguggcuuuaacagggucuucuuuagccccaacugagagaaaaguugaaaaauuagccaggauuuuguuaacuacacacauacuuacuucugcuaaaguaggauuuuaggauaaucuuuagugggauuagagagauggcucagcagguaagagcacuugcaacucuugcaggaaaccuggauucaauucuuagcacacacacaauggcucacaaccaucuauaacuucaguuucaggggaucugacacuugcuucuaaccuccucagguaccagaaacacacauggaauauaaacauccagacaaaacucaugcacauauacuaaaauuuaaaaaucucaaaaaaaaaaaaaacuuagaacaauaauaucaaccaaccagaccccccagaacucccagggacuaaacaaaggagaacacauggcuccagcugcauauguagcagaggauggccuugucaagcaucaaugggagaagagguccucaguccuaugaaggcuccauagaugccccaguguaggggaaucaagagcggggaggcaggaguggguggguggguggaggaauacucucauagaagcagugggagggaggauaugauuggguguuuccgggagugggggaaaggggauagcauuugaaauguaaauaaagaaaauauucaauaaaaaaaaucucaguaacaauuaucaucuuuauagaaaaaaguaauauagucaucccucaguuucugugggauccuguggguacgaaacuacauggauccuccaaauguaauagugugauaauugcaugggaccuacacagauccaccauggaccaguuaccucuagaugccaggugguggugguucaugccuaauucgagcacuugggaggccuggaggcaacagaucuaggcucaaggccugucuggucuacauaguaaguuccaggacagccaaggcuucauaaggaaaccgugucuggaaaaaccaaauaaaugaauaaauaaacaagcaaacacccucuaggagauucuaacuuuaauguaacguuaagacugcuguuggaccauguaaggcagccugguuccugguugagcaaaggugagaaaccccggugacccugaagggauggaaggcgguuugcacugcuccugggcacccagcuucugacacucccacagcccuccauagauuuauggccaucagccacuuaagggcuacaccccaagccccuucacagguagaggaccuauggucaagacagaucuccauuuuaaugagguaccuuaaaggccuggaggcuuagccaauaaacucuucuucccagacacuccucccugaaaaaggucuuuaaccucaggcccacccugagacaugggguguagccucccacaagccugaagcaggcugaacuagaccuugacuuugcuuaccacuaaggagaucaccuaggguggagccugccucccuggaucacucuauuguucugccacugccgcaguuccggagucuacauccgauccuacacguggucaccugcagcugggcuccaaggaugauuuggcgggaaugggcuuuccccucuccuuuauaaagcguguccgccauuaaaaauuggaaccuugagcagauuagcuugucuugguuccauuauuucucuacccacauagauucccuuucucuuccaguuacaagaugccuuccaggcucgaaccuggacaugagggccgcaggccggccccaacaaugggguaccguuuuacccauccacuuuccaccaugacaaaaaaaugucuuaaaacuauggacugccucuuuucauugggauccgcuguggggagcaauagagaaggcuuucgccuaaagagucaccaucuaaucucccacagaggggccucucuggguccccagccaugaccaccaagccaagccagccgcccacugucaagccuaggacucauucccgugggaucuagccauagcuucuccccuuaccccccucggcccugggcuagauccagcccgagggcccccacucuguucucaguucuuccgagacucccagugguaccugggugcccaagagccugagagccagacggugccagccuccuugcaggccugggaccccugagccaguucugacuguccugugcuucaggcuguguuucccuacccccggagcuuccccaccccuggagugcugucccugaggcuucccugcagcccaacacuuggccggugacagcgugggguaagcgggguaaguguagucaaacucccugugucuuggcuccccaagccugugguggaguggacacaggaccccaauaacccuccacugugcaagccaucacacucauucaggcacacugauggggagaagcuauacagguucaggacagaggcaacuucucuuuuaaauagcuucaaucuggaggcccgacugcgucuagaacguaauguguaaaccucugcuagaggaaugugcagagaacuagcagcaauuaagauugcagacuuccaacucagaccucaaaucagcuccuauaggcucaguagcagcuuuaauacaugcuuucuaauaggcagcucagaguaccagaaaggugacagucucuaugucugugagcucugaacacagaacacaaaacccaauaccucaaguucccauagaggcggagggaucagugagaaucagcugcugggaacaacagcccaagugacaaggccaguucacugcacauggccaggccuguccucuccgcagucuaacacacacacacgaagauuaggggacaauugcagaugacuucccauucuuacauuuacuuuggauacagggucucacuguguagucccgguuggccuagaacccacuaugcagaccagguagagacccaccugccucugccuccaagugcuaggacuaaaggcauacaccaccaccauggccagcuacuguguaguuuuaaagacagggucucuggcuggccuggcacucaccaaguuggcuaagcuggcuaaccaacaagcuaaccccagggauccaaguguccucugccuccccagugcugggauuccugguaccccaccacacaaggcuuuuaaaaugugaguccuaggguuuaacuuauguccaugcauuuauuaaauaaaaacaaaacaaaaccuugaagaccuaauuguaaucaagauacuaaacuggcaacacguuccuauagaacaaguggcagcccuguagugccagccaacucaccuugccaggaauggggagugaccgcuugccuggguggccuucucgacuggcagcaucuggagcugugcuggguuuguccuggagcacgucacucugggaucccuuuucauucacgaguuucguccucugaaugcuggcuggcaccucuuuuuugagcugaaaaugucgauuugagaggugaagacuaccuggucugacaauuccagagcuggcaccgcucauccuggaugcugccccucucaacccauccacuagugugagagaaggagcacugagaugagacuggaccuccucacugaagcagugucaagacuagggcaggcggccugcagaaggaucuccaaggcuccuccuuugucaggcccugacuuaagagugccaucgagggguccagacauaugguacaugccucuaauuccagcaccuggaggcuaaggcaggcagacuucuguagguuccacaaagccagccuggucuacacagugagucccauggcaguuacauaguggaacccugucucgaaaacaaacaaacaagccuauacucucuggccugcaagcccagagcaaagcccugacauagugaugcaagggcaucaggaccuucuccucgugcacacgcagcaaggaugucgagaaggaaggcggugcaagcagucgcuucagugugaggccaacagcaaugcuccccuuguagcgcuuccugugacccgaagcuccccccugggacagacucagugauacugucauucuuuuacuaaaaaaaccuaugccacuaucggaugugucguuuuagcuaucuguucaucgguuaaugggcaucugggcuggcuccauuuguuggcaauucugcgguugugaaaaccucguguuaagcugguugaugacacuacaauccugccugguauccugcaugugcugugacccacagccaugcauggaucacacacaaauucuguuccauauccacgugcugcuagcaaucccacccagggugucuuggugucagauguggucaggagagggcucacagauggggagaggggccgugcagggcuucaccuucccaccaccucaccgucauuccuuuaacuguacccucaguacaaaugaggcugcuauggggcugcuuggcccuacacucuagcgagccuuuacucuguguuuccucucgggagaccuccgucccccuccucugcaaaccuggaaguaaguuaucucugacaucugccuuucuaccuacccccaacuaggccuccagggcccugaguuucccacaacuggucaacugccauuucccugacauucauguaauacccgggcagaagaaguauaaagucccagccauagagaacagccagagcccaaugugaggggcagugcuccccagaggggcccggccgggcagcuccccaucacugcugccuucgcuguccagauucugguucuauucugggcuuuccagugcucagagcgcugccccucccgagaggcuucccuggcagggcaugggcugaagagaggcaaggaggcuguguacaucgcaacuguacuaugccuggguuuaccuucucuguagccaggugaagguuucuuccucucacaggcaaagcccgagguggcuggagcuugcuggugauccucuuuugaggcccagccugacuuggaggcugggagguacuugauucucuuggcaacggcugagaggaacagggcagacccugguugcucugggucugagcagggccugcugagacaggggagcugagcaggccuggagaagccaggagcuggggcucccccaugggcgguugcacccucgaggauggcaggcagaaugucucucuuuuaagugacaugggacuucugucucucuucuguucuuucucaaagaggcuuacuuuuaacugugaguccugcacaaacguuuccuugcccugguucacaggauuuuggggcguggcagccugggccaccucucuucggcugugacuuucuaucuguaaggccaguaagugggcuucuuuguacaccuccacaaacuucuccccagugagagggcucaaggugcaagggcuaccagagcccggggcaagaggcugcccaggaacccggcgguuuaaguccaaacuggcagcaaugcaucuuucuuuauguccaacaggcccaaaaaagacuucaucaucuucauuugugcugcguuuaaagaaaaagauuaucagggcugaaaucacaccagcaucuaggcgaggggcuuugaugaaccugucuauaccagggguuagggaagaaaacgcauguuuaccuugaagaagacaaggaaagaucgaagucaaauuuuucaucuuccaaaagaagaaagucugggguggggauggggagaaaaaguucaguuauuuuaggguaacauaaaacaggaaagcacugguuucacaguugcuaugaaucucucaguaaaguaauagauuguugccugaauucaaucaauugucaugggcaccucaaguccuucuuauuucccauuuccacucucaaguuccaggagccacucugagugcacugauccaccaucaaaacacagaaccuuaccucuaugauagaaucuaggguuuccaagaaggcuaagucaccuucaggcacaggcuauuuucuaaagaucaacuacuuuagcuagccuggaauucaauuaugagacaucuaucagcgaugaguucaaagaugguucaaacucacaguagagaccaacgaguaucuguggagcaccacugcuccucgggucccuuuccaaaaaaacaaaacaaaaaagaaaacaaaacaaaaaacaaaaacaaaaaaaaccccaaaaccuaaaccaaaaccaccaacaaaaauuuugcucugccuauccacauuccuagcauagccuugguugaaccaacuguggauuuauucagcucucucucacagaccagccacuucccaguaguacuuaaaggucugcuucaccggagggaaccuacauaauucaggacaaaauccuaagguggaggaaggucauaggcuucauuaaggaugcacguuacagccugguuaaguugcauucuaaaccuuuauguuuaugcucauaaauuacuggacugggcugccagccuaggucauuagaggugcuucuuauaaugggcaucacuguguuaagcagucuccuaaggugucaaagaggauacauaaccugauagggugcaaaggcccagugcucagcccuaaaagggagaaaauaauuguaaacccacaucaacccucuaagacucaggggagcaaaguuacuucccaccacaucugaugaccugaguucaagcccugggacccucaggugcuugcacaccuugguuaccacccccaaacacacacauacacauacacacacacacacacacacacacacacacaaaccaagucaucguaaagauuccuccuccccucuuuuagacaggguuucacuguguagguuuacaaagagaacuaacuguucuggaacucacucugucgaccaggcuaggcuagccuugaaauaaaacucaagagaucugccugccucugcaguuggggcauuaaaggcgugugcagccaccacguagcaagucuugcuuuucaaagaauuugccagcacucagaaggcuuccgaagguggcucucgaugaauucaaggccagccuggacuacagagugaguuccggguuacaaagugagggcucaaaaaaacaagcaagaaaggaaaagcaaacaaaguaagucaguggaggagaaaagaaugaaccacaggggaauggguggagugagggacucugcgcucagugcaagagaaagcuguugccauuuugauagcacagcaacugugauuaaccacaggagacccucacaagauuaagacccccacuuaaagcccuucuggaaguggggggaggccccucuuaagauuacauaagugguuuuaaaaaguggguggggauguuguaggggcuucuuuggugguggagcuaugaauugcuaauguccuuguaaguaacuucaguuaaauuuauuugcuuaucaauccagacuucguuucuuugaucuguuguagcccucucuauuuuguuuggggugaaaaggaauacacuccagaacagccuuacgaacagaaaggacuuaccuucuuuuuuacuaccagcauccaucuucaccucucucuccacugguuggccgaaggcacgucgcggccgucuccuccuuccacagaguucgcugcaggaagcaaggggacgggagaauua

SEQ ID NO: 12533 - RNA, 52178 nt, Mus musculus
uccuccgcgcccgccaaacggucuuccgguagaguaaagaagguuccgguucccggagguucccgggcuuugcgguccgcgcccggccggaaaccccuuugccuagcagccgguuccgguucggugaguggcggcgggaaacugggggaggggugaggauggagggagaccgggccgggaggcugugucaggcugggcccgcgggccucggcggggccgagcggaaaggaggacggcgguggggaccgugcccugucuuccgccccgccccuugggaccaccuccauuccccccugcugcccggucgcggcugccuggcccgggucugguaguugggcucacugaggccgcccuuucagcccuccggucucccgacccgcggagaggccaucuccccgcggucacagcacggccuccuucuacaucccacucuacuuuuccaaagagagaaggccgguugggaucgcgggaguuucccgccagagcaggguccccgggaggaagagcuguucucuacgaggaaguugagcugucgcucccaccugcuucgccucucuucuuccuugaaaccugaaugcuacuccucgccuaccgagucucacguaaaacaauucuccaacucuuuuuacccugugauaauucccugggaugugauauugcuagagccaccaccagagagaaacgucuggacccuucugcauagguuaugaaaacccccuuaacugccgccgucuccuuaccuggcucaucgccucuugguaaugaauucccuugaaccuuuucuucguauacccuaacgugaucuuucuggauauaugcuggcuuccucuugucuugagcuuggugauuucuguuuuaucaguaccucuacaguuuuucuguuaucuuguuggcaauaacuugcuccuuuaucacuuuuaaggcacacuuguuaaaauuacuuacuucacguggcauacuuaauuguauuuggagugauggugauucuugcaaaauuuuguauaguccuuuuaugugcaaucaaccauuugauguaggguuuucgauguaguaggacauucuggaugaaguaaaacauguuuaaguauucuucauaaagaugauuuguauucacgacucuugcugaaauguggauuacugcccuugagguuacagugacaccuguaauagugaccugaaccuuccaguuagacuaccuguccccccccccaccccacccccucuuuaaagagcuucauucccugauuucagucaauuauccaaacggcaaacguggguagccuaucacucaucugaugaauuaggucuggagagggaguggaugaguuuacaaacagguucugccacuuguggcuaaggugauguaauuuucuucuuccacugucuucucuuucuccuacccgucauacuaguuuugcugucugugugacuggaucuggcuuccucgccuggccugaaaacuacuaaagggcaaaggccagagcuuucuuguguuuauaucccagaaccccacacuuaguguauguguguaagaaguuaaguacuauuuaaagguuagaauaguaaggugcuuaagguacuaauuuaacugggggagagaguccacauaaaaauacuauggugcggaccugaacagaugauggcgaaguguaaaguguaucacaggugacagaugauggugaaguguagacuguaucacaggguaucauuguguuauucgcaugcuuacuugcacauguuggcucuggauacagguaacuguacagggcuauauuuuucuaguagcuucauuagugcgcuaaaaauuaauuuuuguaaugaucucuuccaaaguauacagacuuacacaugauuuacuacuuuguauucuauugcaggcaauuucugucucccucagauuuaccuuucacuugguguucagcugcuaacuugauucacauuaguaagcagcugcuuaguaacauucuggaaauuaaaugaaugaugacuacuagggaugaauuaugaaaauuaucuaucuauaugugugugugugugugugugugugugugugugugugugagaguguguguguguguguguguguguguguguuuugaaacaggguuucucuauguaacuuugguuauccugaaacucgcucuauagaucaggcugaccucaaacucacgagagauccaccuacugugugacucuaccaccacccagcaagacagauuuucuuaaaauaaaaaaaccugucaucugugcuugaauuugaugacaucuaaggcuccuuauuaaggacucauguagaauuuugauuuuguuguuuucuuaaaucucuucuuccaacaucauugcuaaagaagguacuagaagcacaacaaagaagcaagauguauuuguucugaauauggagcuuugaucauuuacauauaugagccaggauagauugcucaaagcuaguuggaaaggcuacuuuucaauugcccuugugaaucuuugaaugaauaucuucugucuucuggauaugccagaagauagaagcuagagugugcacuugcugagggauucuuggguccuuccuuuugccccaucugugugauuuuaugcaagucaguuuaacuuuuugaauuauuuaauuucuagcuuguuuucuccuuuuacaucucuaaaaugaaaaagaaauuaacugggauuauccuacuggagaccagauuuuuuuucuuccugagagaaugucuugcuguauaauccaagcggccucaaacuuggaauuuuccuaucucucauguuguggguacuagacauuuauuuauuuaucuaucuauuuauuuugguuuuacgagacaggguuucucuguguagcccuggcuguccaggaacucacucuguagaccaggguggccucgaacucagaaauccaccugccuuugccucccaagugcugggauuaaaggcgugcaccaccacugcccggcccuggauacuagacuuuuaaauugguauuuuucuuauuaaaaagguaugcagaauguacuagucacaauuagaaagugacuuugguugauucgauuuuuuucccccugccuuaaucugaauccuaaagaauucuacccuaaugcaggaggaauggcucagugguuaagagcuguggcugcucuuccagaagacuuaaguucaacucccuucacucacauaguggcucacaggggaucugaagcccucuuuuaaccuccacaagcacugggcauaugcacauggugcauagacaaacauuugggggaaacacuucuacacguaaaauaaauaaauuaaaaaggggggcuggaaagauggcucagugguuaagagcacugaaugcucuuccagagguccugaguucaagucccagcaaaccacaugguggcucacagccaucuguaaugggaucuggcgcccucuucugguuugucugaaaacagcuaaaguguacucauaaaaauaaaaaaauaagaaaaaggaaguuuaaaaaaaaauucuaccccguuaaggaagaaggggaaaaauagccugaagaaauucuagguggaagcuuagagauguauuugauccuaaaucuaaggcuuaaaccuuuucaggauccuuccuggcaagccuggguacuccgcucucaagcagccuaccuucucacauacucuucauuauugggaccauuaagaacgccuguugacaucacguaguuuucuugaauacuuugaagauucagaauggcuguggauuugauaaucaacugcucagucuccuuaaacuaugugcauaaaagcggauguauaugguuaugcuaauuaaguaguucuaagcaguuaggguuuuaaccacuccccaacccucuucuggggaaauucaguaucugcaguuucacuuucugcaguuucguaauagucguuuguuuaaaaaaauaagugaaaaaaucaggcauggugguacacacuuuuuaauccuaggagauggacaugcagaucucugaguucagggucacucuacaaagcaagauccaggacagccaaacuuaggccaugaaggaguuggaaaacagaaagcuagugauaauguaauagaacaagggggggcauguuccagcuccugcaagcagcagaacccagcagcuucggccauguggcucuggcuuaguguccagaauagaagggaguacugagacaauuagaugguuagcuggagcuaagaaauuaguggugauuaagaagagaucagcaucacugaggugaagccugggaaguguuuucugaaagcacaaagaaauuguguuccagagauagccaagguugcacuuccuguugcagcugggcuugauaagauguaagagucacacaggugguacugguuuugagggcaugaaggggucauuaagaacagcugaggcuuggcacuguuggaggccagggaaugccauugguguaggugcagccucaguuguaguugauggcccaggacugaaggggucauggaaaagaguugagacuuagcacuaugaaaagagccuaugagaggcuauuggugaagccuauuugcagaggaagaccccaguguguuggauaugccaguaccaugggaugaucaccaagaacagcagcagcaguggaguggcucagccugagcuuagagagggcagagcuggagaagugaugccagcccuuuggaggagcucagaagaucauguucauuggaacaagaagcuguaacauugaaguugccuuggagacagaccccaagauguuugagaugccagagcuguggggcuaucuacugaggaaagcugcuaacggaguggagccagcccaggagaaagaaguuuguugcagucaacaaagaugaaaaaggaguuggagaucugaagccugcuuugacuccagacauggagaugcagaguuuggaguuugcccagcuguuuuccugucuugcuuuggggauuacagugaagugaguggaugaaucuaagaagaggcccugaacuuuggacuuuuaacauuguugagacugcuguagacuaugggggcuuuugaaguuggacuaaauguauuuugcauuaugcuauguuuaguucuggcccccauagauucauauguuugaucaagguuaugggggccagagaguggaaugugaugguuuguauaugcuuggcccaggaaguggaacuauuagaagguguggcccuguuggaguugguauggccuuguuggaguaggugugucacugugggucugggcuauaagaacccccauccuagcugcuuggaagccaguauucugccagcagccuucagaugaaguuguagaacucucagcuccucuugcaccauaccugccuggaugcugccgaguucccaccuugauaaugaacugaaccucugagccuguaagccaggcccaauuaaauguuguucuuuauaagacuuaccuuggucuuggugucuguucauugcaguaaaacccuauuaaucucuuguucuaacucaugaauuacacuuuuauugaaguguaucuguguguauaaucaguacaacuuguaguuucagacauauaucagaagccuuggaacuuauauccuauacaaggggaacuugggaacuucuauguagauaaaaccuuguuuuaaggagguuuaauuugguuugguugcuugcuuuggcacuaaggauugauugaauaaaggacauugugcaugcuacacaagggagcuguauuccagccauuuuccagcagcuugguggauaauguugaguggagcagugcuuuguacaacugaagguauuccuugauuuguacucaguaaacuugugggauuuuguuuguccacuauauaaaguuuauggaagauaaaucuuaaggucacaaaguugucacuuaccuagaaaaaugaguuaggaugagguagaagaaaucgggguugauuggggagaauuucuaguugugauuucauugcagugacuaacugugauuuauacacacauggcuccgucuccugggggguuggcucuggcgacuugauucuugcuuugaugauccgugauucucugguuaccuguagcugcgguugaguccaguauaguuugcagcaguguuugcaaguccuucuugccaauuugauuuuuuuacuccuuuucucaauaagucaguggccuucaccauuuuccuccacuaaggaccuaaacgucagcaagucccugucauauaauacuugaccuagaugcuucacuguguaauauuuauguuuugugucgucuuuuacaggauucugugucuuuacuaaagccagugaugugaagagaccugaaauggguaagacuaacuaaacuggucacuuuguccuuuuacacagugguuaguuagguggagagagaggaugccugcccaguaguuguucuguuugugucuuugugcauaguaauaaauuacaagaucuuaguccuaaguaaacauugcuguauaguuauuuuccuauuuacaagaucaucuaagaucauuuuccuaucuaguguauugaaaaaaagaaaaaagcgaaugccuauuggcagaacuugcaaagcuuccuauguaucuauucuaaguacugaauauaauaaauacuuauucuuuccauuguuucaaccaucuuacaagaauaccuaauaguguguacaaaauauacacaauaguguaccaacaaggaaagugagauacagcuuaagaaaccugcucagagucauauacuguauccugcagaguucaggguccuauucuuuaauacuguguugcacugccuccuguaggauaaauaauuucaguaagguaauauauuauuucauguagcuagugauaauaaaacuuugcaauuagaacauuucccauuguuugagucacaguauuuuguaucuguaaaaggagacaggaauagcagccaguuucggaauacauugaauggcuaaacaggacgacuagaacaugcaugauucccuuagccuuuucuuuacuguuuacauucccccaccgccacagccacgguguacucucucccucuccugcucacucauuccccuguucucuaugcuguaagcaguguuaagucacuugaauucucuuaacucucuuguguuccuguuucagcgcaucuaugguaaaauguuucuaaaguaagaaucugccaugguauuauagucacagaagugacucuaagagcaauacaaauaaauucuuuuuacagagaaaaaaagauucaaugaauuaaggcuuuuuuguuuuguuuuaauaaugguugguauuuggggagagggugcaugcacagguaugugcagguaugcgugcccgugggaauguguguacaggcccgaagaagauuuugaauauccugucugucuuauuucuuuaagacagggacuugcacugaguuggaagguuacugacuuugccagcuagcaguccagucagcaagcucucagguucugccuguuucuacuccacaaugcugggucacaggagagcacagccauguccaguuuuuccuagggugcuggggaugcagacugagguucucauacuuguacagcaagcgcuccucccauugggucaucgccccaacuccuggguuaaacuuuacaacacuguucuguguuaagauagacaaucaaccuaagugaaccgcguugcugcaaggugguauaacccccuccuuccagucuuuaaguagcaggcuuccgaguuguccaugcuaauucuaaacucaugggccagaugaccagaaaucuaccuuugcuucuccagaagcugccuucuuacccaucauccuggguuuuuuuuuuuuuuaauauuaaauuucuuguacuuaagacauuaaaaguucucuuugggggaaauuucauuauuuucaaaacaaacuauagggcuggugagauggcucacugguuaagagcacugacugcucuuccgaagguccugaguucaaaucccagcaaccacaugauggcucacaaccacccauaaugagauuugacugccucuucuggagugucugaagacagcuacaguguacuuacauauaacaauaaaucuaaaaaagaaaaauuaaaacgauaaaucaggcuggauuuuauucuuguguagguuuugagcugcuuguuagaugcucucagucaauucuaaauggagcagugucuucacaugcuaggaaggagugguauuauuugucuguauaauuccucucugagaacaguguuuuaggggaaaagauugccucacaggaaaguguuguugaagggcugugucuugcucuaaucugacucuuccccuagaugacacagcugauggggugaagauggacgcuggggaggugaccuuagugaaccacggcuccacuuucagaacccaccgcccgccacagucaggcuuuccagaggagcagcuucugcuuucugaccagcagguuagaauccuucuucuccuuuaaguaacuaauuguuuuccucacuauaaauguucaucugagacaguuugaauaccacacuaaaaacuccaagcaugugaacuuuuuacaauuauaauuuuagugguggauuucuucuuggauuaagaaaguuaagacaaaacauggugugaugguuuguauaugcucgguccagagaauggcacuauuagaagguguggcucuguuggaguaggugugucacugugggugugggcuuuaagacccucauccuagcugccuggaagucaguuuucuacuagcagccuucagaugaagauguagaacucucagcuccuccugcaccaugccugccuggaugcugccauguucccaccuugauaauagacuaaaccucugaaccugcaagccagccccaaauauauaauguccuuuauaagacuuaccuugguuaugaugucuguucacagcaguaaaacccuaacuaagacagaaauugguacauggacuggggcauugcugugauaggccugaccaugcuuuuguuuagaagaauguggauuuuggauuugaaagccauggauggaauacuuuaaguggggcuuaaugggccaguuuaguucaaguaucauauagcagggacuugcacagaagugacguuuaggaacuuaguggaggaaaauggugaaggccacugacuuguugagaaaaggaguaaaaaaaucaaauuggcaagaaggacuugcaaacacugcugcaaacuauacuggacucaaccgcagcuacagguaaccagagaaucacggaucaucaaagcaagaaucaagucgccagagccaaccccccaggagauggagccguguguguauaaaucacaguuagucacugcaauaaaaucacaaccagcaccaauugucccaguaguucuuucuauucuggacucuaaagccagagccacguggccaaagcuguugaguucugcugcuugcugaaacuggaacauuucccccuuguucuaugacaucaucaccagcuuucuguuuuccaucuuuuacugccuaagcuugguuuccuggaacuugcucccuagacugauuuugaacucaagagauuggcaugccugucuccuaaacacugggauuaagguguggucuaccaagccuggauuuaaguuuuucuucaccuagaacuugcucuguucuaggcuggucuugaacucagagaucugcuugucucugccuccugggauuaaaggcuuguacuaccaugccuagacauaaacuuagcugggugggcucuugccccaagaucacuacucccuuaauucaacuuaaucuccuccaacacaggauucagcuccaucucacuuccugcuuccccuuaguacacaaacuauauauuuuuuauuuuuccuuucucagcuugauacauuuguucaaaaugcucuucaucagacuuaaccagagaacaaagucucuguugggauuuuuugagacuuccuuugucaauguaauuaaucugagucucuuuaccuuagguucacgcugagucuuuggacaaugcaaaaagcagccacauucuucaccaaaauaaucacaaaaacagucucuuggccacauauuaaaguucuucuccacugaagccucuugggccaguaggccuacacaguucaaaugacccucagcaccacuguuguugacacacagaucucuguucuuuuaaacuaguuacuaagcauagcuugggggacagaagugauguacagccauccugagcuugcuaugauguaauugguaaaggcucggaacacaacagagcaugggcguugcuugagagccaggccugauggggaaucuugagcgucuagugcugaaacagaagccauauguaaaagcaucccuagcugacuucugugcugagaaagacacuuugugccacacgugauggcguuggguggguuccugagaccacauggugccacacgugauggcguugggugggucccugagaccacauggugccacacgugauggcguugggugggucccugagaccacauggugaaggaaagaacugacuccuugcuuaugccccaggugggcaauaauacauuaaauuuuaaaauuaaaacagagaaaguucucuuacucaguaggaaaaccaggaguaguuugagugagaggacuuguuguagcaggucggacacuugucccccaccaucauaaggugucacagagaugcuuacagcuuccacuuggauuaagacugcaacagcacuccccacgagaacuacucugauguccgcaaaagcaaaagcaaaagcaagaugacugugugagcuucuguaaccuuugauagcuccuugucugaugaguaugguaaaugcagacccaccguccagugagcgcccuucacguuguagagcagaucaucauuuuccaacuuuccacugaaauccgagucauuuccugaaaugucuuuuucuuguuagaaugcagguauuuauaacauaauugauauauacauauuauauugaguugcaaaguccauccuaguucuguuuaguuauguuuuucuuaauguaaacguauucucuuuaauugucaaaaauaugauuuaagaaaaccaucuucuguuuucagagcuugccuuucaggcaggguacuuuagauggaucuuucacguguucuacaagaagcccagccuaucguccagauuaucacucagguauggcucaguacuuggauucagucacugcaugucccucccauuuccucauagcaaacacuuuguguuuaccaucugugaaagugaaaacauuagcagguauugggacacggcucagugcuagagugcuuaccucuugugcucacagcccuggguucccuccuuauacuguccaaaaaaaguugaaagcauugucaaaagcaacaugacauuuuuccauuaaaacaucauuuuaauaagguguuuauguauauguauuuggucacuaaauaguuuggauguaauguuagucaaauacuaauccuugugugaaagaguuguuuugcaaucuguucuccuuguguacuaucccauuauagaaaauaguauagcuuugcuguguuuugucucuguuuugcuaugugcauguaauacaaaggauauuuguuugguauugauuuaaacaauacagcuaacuuaugucuguucuugaaacaauuaaaccugaacauuuauuucugcccaagucuauuucuccuucagggcaggaacuauuaaccacauguuucuguguagcaccugccacagccaugugcuugugcauucaaggacuuugcuauucagccuguaauccacgacagaaguuagcauucucuaggugacuccugucccuggccaucgggccucuuaucuaaccccuuccuacaguguaggcuucugacaguauucugucugacuuggaaaacucaaucuguccauucgucucugaacauugugacucaggaagacuauagugaccuuccaggccuuucacucagcaucacucaaaaucucauuuugccacacaugugggaguaaaaggacuacuguagagccugccuaugugagauguuuuuguaaggauaagcuaugauaaauaugaaauaaauaugcacauaauaaucauuaucauuuggcuuucucaggauucuuugucagcaagaugagaucuccuccccuaaaaagacguuaguaugaugcucuuuuagauguguguuauauuaagugugcguuacucaggugggcgguacuccaccccgggcauuagauuuccccucaggcugcucaguggccuccaaauaguaugugucaagaauuucaaugguaaaagaacugagaaaguaacucuuuagucguuauugaaaaggccuuuugguaacaaagaaaucuggugugauagaucauaauuaaaucuacaaaaagaugauuaugaaauuaauaaaauccaaucauuaauacuuccauuugagucgugcuauauuugcuuguuauuuuauaugcuaguuuaccauuggauaaaaucauuccauuguguuuuaaaugauugcuuuauaguaaacaauuguauagaaaauuagacuuaaauccccuugacuaaaacccaaauauuaccuaaugccauucucuuuggccucuugugauuuuucucucuauauauauucguacacauuauauaacuugacacauaaaaucuuuguaacuuaaaguuuguucacaagcucucucuuauauuuauuguuuucuguuaauuuuuaaucuguggcuuuuuaugcacagccauagucccuuauguguaguuucaaacuucacaaagcucuaaaaaacuguuuuuuagacuugaucagaaaaaacaaaaacaaaacaaaacaaaaaacaaacaaugugaaguagcauggagagguuucuguuugaccacacuuauucccuuuuuccuguaaauaugagugcagaguuguuuugcugcaugugcaggguuuuuauagagugcugcuccagaugauacuggccaguggcguacagaguagcaggucaucuggcugagaucccccucuguaacucugcaguacuauuggaacccgggcuaugugacuugggugauguccagugccuuagucugcgucacuacuguguucccuagggcuuaaguccacuacuccuuuguuaguuguuaaucauacuucuuaaaagcauucauauaguuuuucucuuuaauuuuaauugaaccuuaauccugacaaagauguaguugagaucaccccacauccucauguucuugaguguagcaauauuucaccagguucuugucuuucuaauuagucacagauuguugagaguacacuuucccuguguuuaucaucauacccaaguugauucucgugccaaaaguucuucacuaaagcuuaucucccacuugaauuuaugaccuuucuuucuuuuuaaagauauuggacauuuauuuauuuauuuauuuauuuauuuaauguaaguacacuguagcuguccucacauacuccagaagagggcgucagauuucguuacagaugguugugaaccaccaugugguugcugggauuugaacucgggaccuucggaagagcagucggugcucuuaaccgcugagccaucucaccagcccaauuuaugaccuuuuuaagaaaguaaaaauguuuuguaauauuuuguauacaugagacaacuaccaguagauugacacauacugaugaagaguucgacgcuauccuuagauugauucucugugacugucuacagcuggaaucaggauucaaaucugucugcuuagcuaagugcuucuccgccuucuucacucugacccuuuaacacaacaguuccuacaguuccucggguugugcugaccuccaccuuuaagauuauuuucauuguuacuuuguuuuugcuacuguuaggaauuguaauguaacuaccugauacauagacuaucugauaggccaccccaaaggggucccaucccacagguugagaacugaucucucagauuucaucuaguuauugauuaaacaaguuuaugacauaccauagacuuuacaaacagaauuuuacaucuaaugugcauacacagggccugugguuugauccccagcaccaaacaaaaacagagcuacuuuuuaccauguacuuuagaaaccuuuuccuuugccauccccauuccaauucauuacagacgcugcacaguuuugucucugcuguuugcuuugaccuugagcaccacucugcugauggggcugaugugagucucuugguuccugccauagucuucuaaucggggcacugcugguguuggcugcugcuugcugcuuugcccuacucuugucuuccaagaggaaaugaaaaugggaaaguccagauuguagaaucuauuggaccuaacucugaauaaugccaugcaaaacugcuucucaagucugcucgagauuaaacuauuguaaggaaguucuguccaaacuguuuacaaagcauaaaugcagcacuuuccuuuaagagccaggcuuaucaagaacacaauggaagaaaucuaaaguguuuuaaucccaaagagccacaaaaaaagauugagaugaaaagaauuuucuaauccuuuaagugcaucaauaucuuuagagcauagguuagguuaggaagcuaacauguaguggguuacguuuauguagugugcuguaguaacgugugucacugcgguaaugaaucagucccagugauaagaggggagcaguggguuccugccgcagugcaugauuaccugacacacuauucuuuaucuuuuagaaggagcuugaggggaggugagcagacauccucuaaauaguggaguccauuguucuuaguaguuuacuauguucaugaaaguacugccuguuucugcugaaaacuuggagaaaaaagcacucagucauuucauccuuagaacauaaccacaauuacguuuucaggguauucuagguuuguauguaucauguaugagcacaugauaaauuaccuuguuucuggcuuccuagcucuaauuucuuagugaugacaaaauacuuaaauuuuacuaauaacaaaagauuugcagccucuuacuagucccuuacucccgccagcaguuagaggcuugcucagugaugucauuggcuggggauagaaccaccggacggagccaaugcuuuccccagcccuguagagcugaagccuugcucucgugcucuaggaaggcugugcugacuuaucucagauuucacaucggucaggauaauuuguauuuuuuaacagauuuccuccucaaauacauguuuuuaguuagaucguuuagcaagcagugugaaagccaguuauuucuacuguuacgucucugcauuuagcaaccauuguuuucuggguuucuuacugagacuccuguucaguagcuucauguaucuauccuuauaguaacaauaaucacauauguuaagcccacauauuuacuauagaggaagaaaguucuaauucauuuugaaaaugaauuuacugacucugucagccuaguuacugcgcugacuagugaaucauuugacucuagccgugcuguggguugcuucuucucccccuuauguuuaccccaaaucuguuucaugcuuugcuuaaggagccuucuuuuugaaggguguuuuauuuggauagaguacuaaaagacaaguguaugcaugcauaugugugugcguguguugagacaaucauacugcagccaaagcuggccuuaaacuugugauuguccugccucagcuucucaaguccugggauuacagguguguaucaccauacccaugcuaaguacuuucauaacacgaaugcauacuguugugcaaaguccuguguuaauguucuuugaaaggagagcuucagaauauuguuaguuaagacaaguucugggaauagagaguuaccacuuuuacuuaguccacugacgugccaaggaguuugauagccuaaugucggaaguuauuuugugggagcugguuuaacauaucugguccuccugauagagaaaggaaggcauagaaguuacucuacuccuagcugucauuccaguuuagaaucuagaguucauaaaguuaaaauaauaaaugauccucagucugacuauaguagcaaccacuggauuauugaugaucuauguuacgauuguggcuuuaagaaacugaagguuguacuagaaccagaggucuacagugggucguuccugccauaagccagccggugugagcagcaguuugagagauucucuaaugcuaauuacaaggagggagugacaccagcggcuuguuaagcgauaacuguuguucauuugaauuacaaucuccuuggcccuccacuugcuuucucacuggucuggccuaccuucuuucaggcccaggccugggagugcuugcaagauauaguugggguaaaauguugacuuuugguggacaccacggagucacauugaugcagauaaggcacauggcuguggcaggcuucagcuccuucaucaauuuucagguuaguauggcugaaucgauuauaguuuguagacguucccuuacugcagauuuauuggcaguugagacugggaucuuuuccaugagaggcauggugauaugcuacguuacuuuggaaugcaaugauggaacaugguugcaaucauaaagaggccuagaucuaguuauuuguucaacuuacugaaacuuucauuuucuuuuagauaacccuuccucagacaguuuccuuggcucaggugacguaagaaccuuuggucaaagugcaaauggacaauggagaaauuccacuccagcgucaggcucagcgccacaaaaaccaagaaauagccgaagucuuugccucgaaacccggaagaccucaagguuagguuuggucuaccuacuucucaaacccuuccucagguacuggggaacggcuacaacauaggugcuacauuagaauucucaaugagaaccauuucagggcuuuaagccaucgcaaaauuugcaaauccauuuccuuugggcugaauugagugauagcaacccccaugaacugccaacaacccacucugccccucagggcccuagcauuuauauacccuauggagacuucccaggauuccacacaucacacaauugcagaaaccaucugcagcuggcaaaaccaugccucugcuagagcacgaggcaaaccauggucagcugcugcgaagcagccccggaucccacaccugagguuuaaaacgaaagcacuuucuucuauuucugugguuuuuaaagaaacugaaauugcagaaaugucacuacacuuguggacacugggaguugaacccaggucccuggaagagcagccagugccccucaccacuagccaccucuccagcccugcuuuuguuauuucugagaaguaaaagucaucacuguaacuuuccuuacacacuucuuuucaguggauuaucaaacaccuuugugggcaaguccaaucaccacugccacaugucugcguaugaaaagucauuucccauuaagccugccccaaguccauccuggagugggucaugucgucggagucuuuuaagcccuaagaaaacucagaggcgacauuucagcacagcagaagagguaaggaaaagcugcagccagagacgccaaggagacggccugucacgcucuccgcugcgugcuccuaaaccauuguacuuaccuaguccgcucuggucuccccaucgugacucuuuauaaaguuuuguucuaaguucccaaggacugggaaaacauucuuuuuccuacugcuuucugcuccugcugucucaccaccugcugaaccguucuugucuucaguaaagccaugagcuucacucagcagguuuuguuuuaauaaauuugauuuguuagaauaucucuuacuagcuacaguuuucaucaauuauaaaaacaaacuauacaauaaaaagaaauuauuuuuagaaagccagcgaggggcuauggaaauaguuuggucagugaagugcuuuccaucaaagacagggcuguaggccaguucccagcauccacauccaaagcuaggcaaggugcuuucugcucagaauccccgcgcuugggaggcagagaccgccaggugucaggcggggcggggccuucgcggcucacugguccagucucccuggggacuuucaggccagugaggcccuguuucaaaaagagcuucucaagggacagcacccacggcuccacacguguguuugcacguuuacacaugcacgugcagauugguuuugugagugaguuaagugugcuugcuuuuccuuaggaguaggaucguagaggucauggacguucucagaggaggcuguugugcugccgcuugacuugcucuuuucucuccguaaccgacaggaugagacugagauaguggacaguuggcacagcaggaagcgugcaucuguucaguugcaucuuaacucgguaucuugguaauuguagcuguuugcuguagagauuguguuuuaaugugcucuuucuauuaguauauuaaauaauugaauaauucuuuugaccucguacaauagguaaaggugaguuuauauucauaccuuacaaaugagagaagaaagucaccuggcuaguaaaugguacagcaggucuauuaauauugcagaagucagucccaugagguuauuaauagacuuacccugugugugaugagccuggguguagcugcaggagcauaagaacacuguaacagucaucacgccaguguucacccucagaacaccuccucaucgcagggagcgucgcucguuuuagaagcugcacaccauuaaucgucccaaacacucccucguugaccaagcugcuugaaaccaaaguuaaccuuuuuuaaguauucuuccuaugugauaguuucuguucuauauuaguauguuuucacuguacauaagaaugagauucacuguaacauuuuuauacaugcguauaaguauaugaucauacaagcuccuagugacccucucuugccuggguccuuuuccucugucaaauuagccuguuguccuuuccuucccuuuccuuucccuuccuuuuuuuuuuuuuuuuuuuuuuguuuuuuguuccuuuuuuuuuuguuuuuuuuuuuuuuuuuuagacaaggccccacuguguacccuggccugccuuaccacuguguagcccagaaugcgcuuuauuuguagcaguccuccugucucagaccacaaaguagugggacugcaggcauaaaccaccauacccaccccuacuccauaucuaaagucuacaugugagauaaaagaugauauuuguauuucugaaucugcuuuauuucccaugaugaucuccaguucuguucauuuuucugcaagcagcugaucacaaguuauaguugaauaacaaguccugugugugucuauguauccguauaucauauuuucuuuaucuguuacucuauucauggaaacuagguggauguguuaacuuggcuauuaugaguuuugcugcuaugagcaugguaaugcagauuccuuucuuuaaaugucuuauuuuauuuuuauuucaugccuacaaguagucuacuugcacuaugugcaagccuggugccugaggaguccaggaaagggaaucuuaauucccuggagcuagaguuacagaugguuaugagccaccaugugggugcugggaauugaacccaaguucucuggaagagcagauaguguuccuaaccacugagucaucuccccagcccuaaauuucauugugugcugauugucguccccccuccccccccccacacacacacuugguauauacccagagguaauauaacagaaucauauauuauuucuauuuuuaguuuuguugagaaauccccaguaggaauucccucuaacagcacauaaagggucuuuucccgccccauucucacugcucuuguuuguuuucugaugaugugcuucuacuggagugagacggaaucucagagcaguuuugauuugcauuucucugaugguuaaacauuuuauguauuuauuauuguucuuuugaaaacucaucaguucauuugcccgguuuauaauuggaucauucauucuuucugaguuguuuuggaggauuauacuguuuuugcaguacugggagucacguccagggccucaagccacugggcuauguuuccagcccaguuuuuuaauucagaauuccucugguauugucaaucuuucauauugugcgaucaguuuuggguugauuuuguauggugugagaaguagggaccgaguuucacucugcuacauguggaccuuagguuguuccagaacuguuuguuaaaacugacuuuucuuuagcauguuuuguuuugguuuugguuuuguuuggucaccucugcugagaaucgaauggcugaaaacugugggguuacuucugaaucgccucuucuguuggccugugucugguuuuuuggaaguagcaugcugguuuuguucauauggcuuuaguguaauuuuacaacagaauuuauacuacuuugucuauuuagucuuuuucauguuuacauaugaauuuuaggucagucgguugguuuguccauuugccuccuuuccuuuaagcuuuugaaacauggaacucaggcugcauagccaaagaugaccuugaacuccugguuuucuugccuccauauccaggagcugggaugguagguaugugccaccauacccaguuuaguguugggugucuuuuucuuuuuuucuaugucugugaagaaugccaguggcauuuugauggcguuuucauuuucuuuauagaucacuuucaguaagaguuaauuuuacaauauuaauucugcugauccacgaacauuggaguuguugcuguuuucugugucuucccuuucuuuaguguuguauaguucucacugaagaagucucgccugauugguuagauuuaucccuccguguuguucugcguuugcccuccccuaggcacccauuugugagugugaagcugcuguggagagaauccuuuucccaaaccuguuuauuuuguucuguuuugguuuuacuuuuuguugucagcucuuuucaguuuauugcaugaaagaauuaccagauuaaaagccggagagauggcucagccguuaaaggucaggcuuacaaccaaaaguauaaaagcagaccccagaugguuacauuuuacaagcugugaggguguauaaacuuauagcagggacagaaggaaaauucuacucauugcaaggaaauccucaguuaaacuugagagagcagccacuuagauccuagcgcuuucagcggagccuccuuagcccagucucugaggaacuggaguacauccugugcuggucacccagcagcugaaucacuucuccaugcucuccaugcucagguacaccgccaccgccaccgccaccgcaggcagguuuccccccgagucaucagccaucccugacagcaccggcucuuccugcuguuucucugugaauucuuagaaggaagcaggccaacacccuuccaggcaucaacaagggaagagccuggggagcagacagacauaggagucauguccuggguggcucugggagaagcuguugggggaaauaacuguguuuaguuuguaucuugcuacuuuguugaaaguacuuaccaacccucaaagucuguuaauggagucuuuauggucuuuuaaguauaggauccuaucaucagcaaguggggguaauuggugacuuccuucuuuccuauuuguuuuucuuuuuuuuuuaagauuuauuuauuauuuauuauuauaugucaguacacuguagcugccuucagaugcaccagaagagggugucagaucucauuacagaugguugugagccaccaugugcuugcugagauuugaacucaggaccuucggaagagcagucggugcucuuaaccacugaaccaucucaacagccccuuuuuuccuaucuguaaugcuuuuuuuucuuuucuucuucuugucuuacugcucuacuagaaaucaguaagagugagaacccuuguuuuguuccugaguuuagaaaaaacaccuuucauuuuccccccauucaacauaucccauaaauacuauaggguauuuauacacucuuuuuguuuucuuacuuuuuacuuuuuauugauucuuugugaacaucacauuauguauccuggucccacucaucucccuauccccucauaccugcccucuacacuugcuaccuccucugcaacaggaaaaaaaaaaucuccuugugagcugcaguguaucacacuguauccacagaauucccuuuuguccacacuucuuugcuugcaaauguucauugcagugauauguugaucugguacaaggccucuggcuucugcuacucacugggacuccucagauccccuguuguugccauggagauccugcaguuuuuggaucuguaggaucagcacugcaguaguucguugaugggguuggaccaauugaaagcucuggaucuggaccugagagguaucggagauggucagcccaccagcucucaugcucucgugccuccaggaacagcucaccuaugacccccacaaccagagccugcugccaaggcaaggugcugcagccagugaaggauauggccaguucucccgcucucaaaauccuggaaccaacuuuaccuucugccacagauggugagggaggaaaggagggcaucucucccuccucugcaccacuaucuagcagacaagaggcagggcugacucccacucuggcccuuguggagccggcucaccugcaacccacacaggcagcuggcuauggguggagucggcucuccugcugucaugucucuagggccagcuauccuacagugcccaggugaggagcaggacaagauuugcacagcccucagacaucaacauguccccaugguggcccaaaccagggacaucugccuagccuuuggugguaacagaccucugcugcugcagggccaccaacccagacaggucccccagugucagcacagcccaggaacccacccaucauaggucauagguggcaucaccagcuacucacaucaagcuguuucucacuacccucaagucuccaguucuuccucucuucauugugcccauaucguucuguuucucugucucuuccauuucuccagcccuuacuugcuccucuuaguggcaucuguggucucugagugucugggggucgauucaggagugauuauggugcugggcagggcucaucuuaagcaugaucuguccuguccuccccccaggccuggggguggcagacugguguucaucacaggcuagcuuccuaucuggacuccuugacaucagucugugguggucauuucuggcucauuccucuacuggcccacccaaguggccaucugucuaggcucauucccaccuggggcccguggccccuggcaguguucuccuagucucuggcuugcuuccuguccaggcccuuggugccaguuugguggcugucccagggucuguguuuucagggaguauuaagcgucuaaucauucagauguccacaggucagaacccugaacacagacauggcccuguccuaucugccaccuacugacacacacgggacacagcagccacaccugcaucaccucuaggcuuuaugguaugcggcaucuuaccuucaaggcuuugaacuugaagggcauugagcucugucagacuugcguuugcagcuguggggacgauagugagauacuacgucuugcuuucugcuugugagugauuguguucccugacaugugugucagccuugcaucacuggaguaaaaccauggucuacacuguuccuauuguguugaguuuucuuuggaacuuauuuaggauuuuuacaucuauguucaucaaaggauuugguuuauuuucacuaaagguagguggaucuuagugaguucaagauuaggcucaucuacaaagcaaguucaggaaagccagggcucuuucacacagagaaauccuaucucaagaaacaaaacaaaauagaaaaaaaauuuugguuuaucauuuucuuauuguguccuuauccaguugucucaggguaguacuggcucuauagaaugaguuugaaagguugcuuuccuauuuguggaauaguuugaagagcauugguauugguucuuaagucuggaaggauucuuggucaaugucugguccugguuuucuaugucaggagacuuugauuagugcuucaguaucauuauugaucugucuagguuauuguuguacugcauucaauuuuguuaggucauauaaauaucuaaaaauauauacauuccuucuggauuuuuccaguuuauuggaaugcauacauguuuugaaaauuuugcucuuuuuuuucuuuuuguguauuuugucuuguuuuuagagacaagguuucucuguauagcccuggcuguucuguaaccacgcugcccucaaacucagagguccaccugccucugccuccugagcuaggacugaaggugugcaccaccacugcccacuggaaauaguguucucuuucucucccucucuucagugacauccaacuguagucauucugcgugcgcacaacaauucugauuuuccuuuaggucgcuguggggcugugcugucuccauggcagcccuuacucccugacgugggaucucccaggugaacucacaagucacccgcacacccagucugccuagcuagauugcuccaggaauuccaucuccaccuugugaacacuggaguucuaggcaggcugccgucuauuccccaauggcguuuagcugguccuggggagccagagcccauccucggcucugucugcucucagccuagaacggaucucuuuaugguuuuauuugggaggagcagccuuuucuuggaggcucauccucauaucacccagaagggaaaaaucaagcugccaagacagcagcgacacagaagcaaaacaaagacaagaaacagugaaggacagucacuaggccacggacauagggagggagggagggagggagggagggagggaggcagcagcaguguagaauacacugggaacuuaaaaguuaguaaagguaaacaugagaaaaacugaagaguuaaaacaaaggagucuaggaaagaaaaaaggaagaaagaagcaaggguacaggaaaagaguaauuuacagaaaacaaagacauuuaacauuuuccuacugucgggggucagagauaagacuugaguccuacucucuggccaguaauuaaauccugccgcuccagaacuuuauucuacaggaucccgaccccuugggaccucuguccaccaaacgcuugcuuaguuuuuccuuuuguuuuaaucguuuagcugucaacugucaggagauuggaguggucauacuucacaauugaaaugucuaugacagugcagcaacagugaaaggcucgggaagggaaacauuagugccugcuuacuuucagaauugguuacuuaguucauucugcuuuuacuaagccuuuacaaucacacaaaaugguagugcuucuauugaauauguccucuaaugcauuuugugaaaaugaguggcugagaaaagcaaagaagccgugucuguuggugagcccagcauggcuguguguagaguggaugcuugcacuugcaggaggccuugucucccucccugugaccuccuuuuuucugcucguccuugauguuaagacuccugagugcaccaagcaccuuccugucuuaggcucgguguuuguguauacacagccuucuacuccccaucugcuuccucccuuaguugagguuucugcugaaaggucaucuuagagagauugugccucuucuugcucuuugccuccaucacuuuuaucccccuuguccuuuaaguuucuucaugccaugaacaaguuuuugauugacagucuuuguaauaacuauaauauaaacuucacaaaagcuggcaauuuauuuuauucaguuugugagucucaaaugacuagagcacaguagauguucaguucagugaguaaauucuacagauuauaugcuuuuuuuuuuuaaauacuaaauugagacuuagagaaaaauaagugaaugguggagauagaagccaucuuuaaagaguccuugcaccuguguagaauaaggagcuguuugcaggauaccucugauggcaguuggcuguaugcuucucuccucaggaccuuuguaaucagcaucagcacucaagggguuauucagcauucuaauuuacaagucuuauuuuuguacuccuuaucaucugagugauuaaauaauugcuucugacuuucugguuuccuagucaauaccuucucagcacuguuagcccaccgugguuuuccacagcaugcuaucucugaaagcugagucugcuugucaucucccacgcacagucauuaaugcaugauauuucccuaucuucaggacugcuagagcuuuggcagaaaaucugagaucuacaugccgauuugagaaguguguuuaagaucuuuucucucucucccuuacagacaguucaagaagaagagaaggagaucuacagacagcugcugcagauggucacagggaagcaguucuguguagcgaaacccaccacacauuuuccguuacgccugugagucacgaacgcaucuuucguaugaacguaacuguacaguuugcuacuugauauugaaacugcacucuucuuuuacuaggucucggugucuuaguuccaauaagaacucuuugaaagacucgcuguugagaaacggaaacucuugugcaucucaugucauugguucugauacgucauccucuggaucugccagcauuuuaacugcacaggagcaguugucccacagugcacauucccugucaucugguaccccagauguugccuuuggauccaaagacucugauccucaccaucaccucgcugcaccucaucagccaaauagcuuaccagcaucaaauacacaguccgaagguaaauaauacuaacagccagguaacucuucauuggaucuguuguaggcaaaacuguaguacauauaacucaguacauaauagauuuuaauugaauacaugugauccagguagcuaagccgugcuaacaccaagcccaggucagauucguuccucucuucccuccuuucucuucccucucccccucucuugcucuuuaaaggaugcuccuuucuccuacgcacccaugacuugcuauacuauuugauuuauuucuaaagggcucuuacuauguaugugcccugccugcuuggcacuugcuaugugguaggcuggccuugaacucgugccaguccuccccagagagcugggauuacaggauccucuaccaugcuaggcuaaauguuuuaacuuccugagaagagucaaagcucacucagcccagcugcuucagggauugcuuuuuguuucucuuacuuuauaaugcacgugggagguucucugcaguucuguggacucucaaacauuaaucaaguauuuaucguauaccccuuaauuuugauagaugcuucaaaauucagaguuuaaagacauuuuggaaacgagucuccugccugacuuugagcuaacccaaauaccuggccuaagccuuggugcugguaaagacucugugauguaguuaauccucauuuuuaaauaugucuucagauuauaauggaaaacaaguuuuaaauuaagugauuagauaguaggacucuuuggacauacacagcaccuaucuccuuucucaguucauuugauuuucuauuguuauuuucuauuauuauuacuauuacuauacucacugucugaaaauuuuuacuuggggauucaacuuuuggugauaucacuauuuaacuacacauuauuuauauuacauuuuaugaaguaauuuauugagaauacucuuaauuuccaaaaaucuaaaauuaaaaaauucuucaaccucagaaauaccuaucauguaguaggauucugagauggagcuagacuggaacaacguguggcauagcauuggccgugcccuaguauaagugagggcggagucccagcacuggagaaggucaggagcccugcccucagugaguguucagagacacgggggaaaaucuguacauccauauggggucuauaagucugccugugucguugucgucuucccuuuuuaacccuaguuuaguauguguuauauuaugaacucaagacuuaaaaauugugccaugucuuguucccuagagacaggaggagggaacacagaguaggcacagucuauggguagaugcugauggacagaugugcuugugccucugauggcucuuauuugugaggcacaguggagcugcuccucucucuuccaucuuaacuguaugcuuaggcuggcugcuguuugcccuaugcuuaauguucugccgucgacguauaacaugacaccauguagacgcuucaacuuaaaugagaacugguaagugcucaguuuuaccauaaugaaaugcucuuguguuucucuauuuagggucagacucugugauuuuacuuaaagugaaagaaucucagacuccagcuuccagguaaaucuagggaaagggucaguggccauccccacuccaccccuuuacugacaauaacauaguauaaacaucucuuucauguguuuuucaaauuauuuuagugacuuccuguugucuuuccauccagccuuccuucucuuccuucuuccuuccuuuauuuuauuuauuuauuuuuuuucuuuuuguuuuuucgagacaggguuucucuguguagcccuggcuguccuggaacucacucuguagaccaggcuggccucgaacucagaaauccaccugccucugccucccaagugcugggauuaaaggcgugcgccaccauacccggcucccccucuuccuucugucuugcaccaucccaaguaguccaugcucugcccgccaugcugcagccacaguuagcuuucuaacauucauaucugaucaguaaagagauuuaauagccagucaguuaaauuaccugaaggauaccucauuaaggcagaaugccuuagugcgauauagaagaacuccuucacauauacgucuuacauucuucccuuuagugagucuuuauugagacccuguggugguucggguauugguagagacaucagacaucagcagugacuaagacuuccuguucucagggagcugcauuuuauauaagguuacagauuaguagugaacaaaaguggugauuaucaguguugugaagaaaaaugaaguaagagacacuaggguuacuuaagguggcugggacaagucugugaucaaaugcagcugauggaagucaaaggagcuagauuuguuugguggcuuuauuguuguuuuggguuuuuuuugggggagggggugaggcguugcuuuuuguuugacuuaguuuaguuugguuugguuugguuugguuuuuuguuuguuuguuuguuuguuuguuuuucccccgagcagaguuucucuguguauccuaggcuguccuggaacucagagagauuugccugccugccucuuccucuauagugcugggauuaaaggcaugugccaccacugcccagcaggagcuauguuuguaaauagguccuuuuguauaucuugauauacuagacuuguuugucuguaaauaugauauauguuuuugucucaacaucaugguuucucugugaugcuggugugagucuaaguuugaacgugcucucccagcuccagcuucacuucuggaggccgcagacuuccuucucuguagguuaguuacucacaccgcugucaggaucauacugucagcaucccacgggcauacagggccuccccuggcaguuugucugcccggaugguaacaguggcagucucuuaggagaagauugcagaugauagaauguccuauccgcccauccccugcuuugcagcucaaauaguuacucuaagcuuuggguauucuacaaaguuuucuuaauucuuggagcagaguauaggguuuggauuuguuauuucuugcaugguguuuagagucaggucugacuucugcuuguagccuuuuuggccuucguguaaacauaaguuauucuucugaaccucacuugccaaaauaaugugaguguuaaggccuugcuguuuuaccgugugaagaaugaccuacccuaggguuaugguggcucauuccugugauuccagcacuuacagggccaaagcaggaggaccuagcuguccucaucuaccuggugaguuugaacccagccuaguucaaaggaaaaaaagaaaaagaauguauaguuaaggcauugaguacuuacagacguguuucucucucucucucucucucucucucucucucucucucucucucacacacacacacacacacacacacacacacacacagacacacacacacaaagcuaauauucucucccagaggaaguugguauuagauaaagcauuucucaauuucucauugauucuuuacuaagucuggcuuuccuuuauggauaauuucuccuaggaaugacuugaagggcacaggaggaggagaaaagugugagcuuuugaaggaagaguggaguaaugagaaguuucugugguugaagcuaagcugccuucccaaggcugggcugcuuagccuugacaguuaguuucuggcccugcuuuaguuaaguucugacagugaggaccugcccugcuuuccugggauguggcgcgcacaccucuacuucagacacucuugauccuucugccuaggauucuguccuuuacuugacuacugauuaacucuugcuuuuucaaaaucugauucaaauguuaguuuuucuagguggugucucugagccccagaugauauucgaccuccuuguauuugaccacaaauaucuuugcacuuaaccacccagugauaaucuuagugugguggauguuuaguaaacauccgagaaagcucaaaacgugcucuuguaguccaaguacucgguucuccuuguugcuuaagguguuagcacacugaaaggcacuucagcacaagaggaggagacguagucuuuggaaugggacagagaaguuucauaguacuuguuccaauacaguguguccuucuggaccucagcaugguuuuguuugguuuucuguaaaguaugaguaauaauuucaucuugcauauuaaauuaauauggagaucuuaugaggcuuaacaauauauagaaccacuagggcgguuuuacaaauagaacaguaggaucaacuaugcucaaugcuugucgcucuugcuacuguauguguaaucucuuuagaaaugcaauuucucuuaugauuguccuuccugagccaacagauaccucaguccauugaagagacguucuugccccuacauuauuccuuauucagcagucauggaucugcucucuagcagguaguauucuacuugaggaggauacaguaguuuauaaauagauaaaaaucuguauuuucauggaauucauauuuuaauuaggagugcagacaaauuaaugaucuguuaaugugaaaucuuggguauuucuuucuacaucuuuguaucauguuauuuauaucuucuuguguugauuugguuggguguguguguguguguguguguguguguguguguguguguguguaaaacacacaaaaaacuauacugcuacugaugauuucugcggcuuucugucucucuugcccucucagguguuuauugagccuaaagugacuagcucucauuaaccuuaauuacacugaggggcagaacaguauuuuuucugccaagucacagccuaugcaaugggugaugggugacuuaacucucaaacacacuguguuuuauacaucuugaaacugaagcccauagaggugaagugacucgcucagaaucagaaaacuugcucugaggaccucaaaggucuccuuuggaaaagaguucguucuuguauuuguuucugugauagaucucuuaguuagagauuugcaaggagauaaagcacuugagagggagcaaagcuguuggaacagucaacauagcugugacuccucaguguuccucauuggguuugucuacaagagccuguggaauggaauaggccugcgauccuuggagcagagcugccugcugugucuccaccuuggcucauugacgccuuagccaauuuguugugcgauauuuuguggauggagauuuuuacuauguacuuuuauuugauuggauauguguaaaugucacuuuuauucuucuguugucauuguuguccgggaggcuuucugccucugucugcuaaccuaggccuugucugggagcuaagcuucuagccuccauacauucuuaucuaggccuggaauguuucagccucugagacuugcugaauaggcuccccuuccuaguucuuccugaucucuggcuggcugguucagcucagcuguucugccucaagcuccucucccaccugacugauucaauugggcuuuucuuucagccucugaauugcucugcuuggccucagacuaacucuagcagucguuuuuaggcuucuggcuccuucucauucucuugcuugaucugucuucaccucugucuuacuuguucucgcuucaaucugucucuguaagacucuucagguaaagcugccuccuucucccgcugugcugcuccauucucccucucaacucggcugcacugcuccccacgaacucgacuguauuccucugcagcucucucccuccuguacugucugccucuccuuuaaguagcuucucuuuccuuuucuccugaagguuggguaucuccuauucugucacaucugucucugauucaucccuuugucugccacucaguuagacaucacuuucauacaugggugcuuccuucuacaaacuaauuuacuuucauuguuugggauuaaaggugugugcuaagggcugagccacacccuaacuauaaaauauccuguaacagguucaaauauucuguaacagauauguuuugacucagacugggaaguccaagaauuuaaaaauuugguuaaaucuuuuaagaauucugucagccugcaccauuugggaacaguaacuuucuaucuuaauuuauccucuuagaagagggauuuuuuuuuuuuaacauauguuauucucuccuacaauuaucuugagagcugggcuaaauaaacuucauucuccucuaaucuuuaggucaucuuuuuaguacauguguauuaauuauguucuuuaauuuuaauuagauucaauuaaaauucaaauuaguuacuuuguaucaauugaauagcuuuuaucccauaauuacaaaggaguccuacaaacuguugaaaugauuauuuuuguuugugaaaauauucuaauuuccuccuaaccucuucugcuuauuuucuuuucccaccuauagcccuacguucuuccaggcagagcuauggaucaaagaauuguaaguuauuauuuuuugauacuauuuuuucuucucauuucauuuucauuuacgaagaaaucaaacaaccagcgguuuauuuuaauuguuuuuacucaguaagaaauaccuaucuguacucuucagcuauuggguuuuuaagauucucuuagaguuaaaauauuuagguuuuuuuuucuuucagauuuuauuuauuuguauuuuauguguguuuugccugcaugugugugcgucuugugcgugcagugcccacagagaccagaagcgacugugggccagcauaugggugcuaggaacugaacccaagucgucuggaguucuugaccauugcgccaucucucuagccucaguuaggagaugucuguucucauauuugucaacuacguaacaguuguugaagcuaaauugaauuggaaaauauuccaaaguuaucuauguaaagaauaaaguaaaugccuuuauuauuacauacacuguugaguuauuagagaguuugagaaauaacugaaaacauuuaguuucaagugccaaaccuguucaguuuucuucagcccuugguccuuguaagucuaaguacauaauauuuagcugcugucuugacaauauacucucuuauucuguggggcucaguucugcuuuuggauauuuagaguuuagcuucacucucaccagucuuauuaagagguaugcuuuugaaauaggacuaugcauuacaaauacccacagaagucacacuaauuauauuuaaauuaguccgguaaaagugauaaauuaccguguuuuacugcaucuugaacuguaaauguagugaggucugaguggaguuccuguaugcgugagcugcucacuacuggugacuuacuguguguagccgagacgugcucagugcucagacacugaucugccuggguugcuuucauuuccuagaacuagcguuuaugacucucgagcucgggaaagauugcgccggauugaagagcagaaagcauuggcacuacagcuucaaaaccagguaaaaaacucuuggaaaagacucagguuccauuuccagcacucaauggcaguucacagccaccagaaacuccaguugcagggaaucuggcacccucggaaaccaggcacccauuugguauaaaugcauacacacgggcaaagcacucccuucuaaaaaauaaaaauaacccaggggggguggugcaugcccuuagucccagcacugggaggcagagacaggccgaucucugugaguuugaagccagcuuguacuacagggugaguuccaggacagcuagaaacccuguuucaaaaagccuagauagauagauagauagauagauagauagauagauagauagauagauagaugaauaaaucuuuuuugaagaaaauuauaaaauaaauagcaccuccagguugaaacuguuggugagguuaccucuaccugaguuacgcuguuugcuuauauaguaguguagaauuuauaaguggcucaugucccagagugacucaccagaggucaaauaggagacuucuuugucccgcuuauuguaaauucugucugcagcgacugcaggagcaggaacaugcaguacuugacuccguagagcuucaccuucgugugccucuugaaaaggagauuccugucacagcugcccaagaaaccaggaaaaaaagccaccagcugacugacagugaagacgaauuuccugaaauuacagagguaaagaagagacugaaaaugucugcaguggagcugggugugauggcgggcaccuucaacccagcacccugcaagcagaggcagguacagcucugccuuugaggccagccuggucaacaccaguguuccagaccagucagagcuaccaagugaaacccugccucaaaacaaaguuagcugagggaaguuucaaauguaagucaguagaggaccugacauuuagauuaauuuagcuauacuuuucauuguauugguauaauuauguaccaguguuuauuuuuaaagguaauuaaaaguuguucauauggcuaugguuggguuuuagcaacuucagugagaagguauguaguaaauuuauauuuuauauuuguuuuuaauacuuuuuuauuucaaaaaaaauuuuuuuuguuguuagguuuggcuugggagauugcauucuguuuugauuguagugaggagacuugagcccaccauuuccuauaugcugacauaggagauaauuugauaguaaauugugagcugagaaguacuauuucuuuuuuuuuguuuugacuuauuuuuuaaugagcauacaaaggaauagauuucauuaugacuuuuuuauuuauacuuuguuuuuauaauguuucuuuuuaagcaauaguaauccauuaugaagaauuugggaaauacuuagaaaucuauguauguuuuaaaaccuguuccuuaauucauaccucuuugaaaaacguuauuggaccugggugcagcuuggugcuagagugcuggcuucaugugugcaggcugugguccuggguccaacgccagcugcucgggagccagugagcagcacagacauggcauagcccuacuaaguuccauuuuuacaccuucaaaaggacgcugccuuuacuccagggugccuuuuguagcuuuuguuucuugggagaccauaagaaccagaaacauaaaacauaaaccucugaaggagcuuggaagauuugagcaaagguugcaucagucuucaggaagugauacaaaaacaaggaucugaauguuguguaaaaggaaaagcagggcaaggugggugggagguaaccuggaagacgacugcaggaagagagacugaccgguggcuacaaguaagcugacagcggggaacuaguaggcaggugacucgugcugaacacagccagggcacugaugagaaaccaguuuuuucugaaacuauuauguuuggucuuuuguuuucuuaggaaauggaaaaagaaauaaagaauguauuucguaacgguaaccaggaugaaguccucagugaggcauuccgcuugaccauuacacgcaaagacauucagacucuaaaccaucuaaacuggcucaaugaugagguaaucuuuugcucccuuuguaugcaaauagcaaaaagggugagaaaacuaaaggaaggcguuaccucacuguucugcagaugaggcucauaggcagccucuguaaacagaauggagcagaggagcuuuggggggaggugggaggcagucgucccucuaugcugugugcugucgagacugcugcuuccaugcucucaugcuucaccacgcuuaaggcaccugcucugcgguuggaauuucugagcagagaguuacugucagagcguacugcugcgugaggggacucuuggguuucuaggcagggaccagguuuccuuccuucucaucugccugccuuagguuacuuacguugggcauggaagcuuucugaaauaaugcuuauuugaaugugguauuuuuaaagcugacaucgagaaaauuaaauugcuuuuauguaguugauauguagcaagggggaaugauuucaccccccaauuucaauuaaauauauuaauuaugccaugauuuuuaaauugaucuauccucauccuaaaccuuaaaaaggcuguuugagccaggcgugguggagaaugccuuuuuucccagcacuugggaggcagagccaggcggauuucugaguucgaggccagccuggucuacagagugaguuccaggacagccagggcuacacagaaaaacccugucucgaaaaaccaaaaaaaaaaaaaaaaaaaaaaaggcuguuugauuugagaaggcuuauuuuuccuuuauuuauugugugcaugugacaacuugaacaucugaaaggcaaacaaagcauagaagacuaagaaacucccaaguucauagagcaaauacaaagcagaccagggcaguggugcugacuguaagccacuugccucagccccucagaacugggucuauuaugggacuagauguauagcacuuaagaccauccagaugcccaagacucugaguuccucuggaccagcugagcugcuccauugucaguagcacuggccaguuuauaagacagacugugcuugcuguuuuuuuccuuagaaugauaagaaacacaugauuugaugucucuguuagaaaccucacucacaucuuuugacuccucggauaauggaacgcuggauuaaaugacaguagagaagagcucacaaaauuaaaagaggaaaacaaaaaccaauaaugaucaaaaguauccuccuaugcauuguuuuugaugugugaucauucaccauuucucuuccccugccaacugcuggagaggagagucagucauuccacaaggaccgcagccuuuguuuguuauaaguuaugcaaaaccuagggggcagcagugagucggacauaggcugaauucuugcccuucacuguggcagauaccucagagaguccguacagaggcagcauuuaucaggacagacuuuccuuugcugcaacccauuagaggccagacugugagcaugcaguuagugggaacuccgugauuagaguagaugcaggggaggcaggauuagacugugagcaugcaguuagugggaacuucgugauuagagcagaugcaggggaggcaggguuccuugucugcugccuacagugcugggcuggggggagugcuuucaaagccacaguaagucacaucuucaagaugauaaugaggacuaguuuaagaagcaccaauuuuagaguauaguauuucuuagguuuaaguagccaacauuugaggaacuauuacagauacuuaaauugugauguuuaauuacaaauacuuaauucuuuuucaucaauuaugaauauucagucuuuuacaagugcucaugugcuuuucaauucuauucuucccucaaauacucuuguaaauacccauuuuuguuuuguggguccugccaguauuauaggauauguuaaaauucucugcaaaauaaaguaacucauaaauuauucuuacuguugacaaacuaauacaggaaaugaaaaaaaucagauacaguuuuuaaagaaaguaaaaucuuccguaguccaaaggaagaggaggaagggaaguaaaagaaagaaagaaagaaagaaagaaagaaagaaagaaagaaagaaagaaagaaagaaagagaaaagaaggaaggaaggaaggaaagaaagaaagaaaauccagggccagcaagguagccaggaggcaaaggguuuacugccaugcugcugaccuguguuugguucucaaaaccacacaguaggagggaaccaacaucuaccaguucuccugugaccuccguucauguccgccauggugcaaccaugucugugcauauauacacauauaaauaaauaagugugcugaugaaaaugaguaaaaucuaaaaacccugaauggggcauacauauaaagccauuaugccacuuuuccccuguggcacccacagagaccagaaagggggucuggaucccgagacuggagcuggagacucuugagagccaccauguggggcagggaacugaacuccgcagccuuggcacaguggccagugcucuuaacugcucagccagcuguccagcccccugaacacugcuuuguagaucauuaaauacauuuagaaauacauggaaguaauuuagguauuuguacagauaaaacugguuuugcuucuauacaaaauguaucaauaucuaaacauaaaaauaucuagacaaaaccauuuucuuacauauuaugaagguaccccaguggucuccgagagaagugagauuguggauguggagauagacaaaagguacaaagaugacaagaccaucagugaggucuaggaugcugucaggcagccuggugcaacugcagucucagaagaaaagcaauccacaaggagggagagauagaaagaagaaagagcgcaaacauaaagaugcacgcgguaguagauuuaacucagccaugucaguagccaaucagagugaucuaguccagcccucugugguagaaauacaauaugaaccacgcauguuacuuuaaauugaguaguagaaccacuuuuagaagggacuggggucuaguucaguggguacaguacuugacuugcauaccugaggcccuggcuuugcccuccagcagcagaaaaaaagaaaaguaaaagaacuaaguaaauuauauguaacauguuuuguuuaacccauuuauauacaaaauaugucauuuuugguuuguaguccauauuaaaauauuaaugaguuguuuuacuuucucuuuaaaauaggauguaaauucuauaucuuaguuggugauaaucgcagcccaagcaccuuaaccuggccuaguugcugcuauauggacaggcguaagugagaacaagcacugagcagaggggcugagacuggaaaggagacugucuguaagcagcacccuucacugcacugcuggggcugagccccagacagaccugggugccuuagacucugugugcuuuguaucgagacacaugacaaccaugcaagaucuuauucugaaagugaggagacagauaggauuauaaacuaaaggaugagaacaguugugucaugcaaacacuaauaaaaaaagugagucuauuaagagucuacaagguuuagucuggagugagcacuguuagcagugauaguaauuucacaguaauagggaaagcuucacagcccaaauaaaauacauuuaaucacacacugaaaacgugugcagugcagcugguggaacuggaaggaggaagacacaaagcugugugcccucagaggcuugagugcucucucccugacgcugguagagcagacaagugccccggugugaagaggcguugggacugcagccuucccugugcucauuuggccuccaagaaccuagucuccacgcauuauuaaggaccaguuacaugggugaacuggagacuggaaacuagccagaagauauggcugccccuuuugggcguguguguguguguguguguguguguguguguuuguguguguguuugcaagcucauacuaauuauuaccaguuguuuuccaaguaaauacugagauauugaaagaugguacuuguaacuucaccugggaaggaaaggccauggccaugggggcaaucacagcaaaugugagaaucguuugcuaaagggggaauuaagguagugcguccauaacggacacguauacagccaagcggcugggcuaccauucggaagcuucaucuuugaagaagaugccuuucagcuuuccaggguugcaguaggcuuguggauucagacagucucgcuacuugauugggugugggaaguaaaguaaggcuguacggaggcacugggccccguggguuuuacagcagacuugagagcuagaacuggagcucaugcugaccugagacacagugcuuagugcaaguccaggcaugguuuuauucagcgguagagcuccugccucccaagcacaaggcucuggccuugacccucaguaccacacacacaguaauggucacagccggucauucucuccaguggacggauccccaugaugcucggcuagagaggccacagcccacaaaacuuuacacugggacuaggagggucuuuauagggaagaagucaucugcaugagagggaagagacuaggaagcagaggggaccuggguaaguggguagguagacugccagcugugauguucccauggcagugagacagaccaucagagugaagcuaauguuuccagggugacgcucaggcuuucuuacacauccucugcaguguucuccaaacucccucugauaagccaggaccuuaugcaaggucauaugggaaagaguaauuauucuccauaaguauagguguugccugccuguccucuuuaaaauacauuagcaguauuucuggguauuuguucuugaaauuacacauaaggagacaaagucauguguacaguggggaagcuguauuuuuaccaugauaagguggucucugagcauaauagucacgugcuucuguuuuguuaucuuccugucucaaugucugcucgggaagucuguuggaacuuuucuuccugagacaagcagugugggucagcguagcuaugggagagcugaagaguuaaacaacacgccguugcuaggaauaggauacuucuggauuugucugcuuuauugggcaagaaaaaaaagagauaccaaugaucauuuaugucaucaugguaacguucauggagaaaaaaccuccucagcuccccaguuucaguuugaaaacacuguagaguuuucuggggccgaagagauggcuccguguuuaagaccacuggauguucuugcagaagacccagguuugccuuucaguauucacauggcagcuuaaaauaguccaucuccaguuucaggggauccacaugcaagugguacacagacagacauucaggcacaacacugauaugcauagguaaauaaauauauauuuuaacuuaaaaacacaacacuagggcuggugagauggcucaguggguaagagcacccgacugcucuuccgaaggucaggaguucaaaucccagcaaccacaugguggcucacaaccaucuguaacaagaucugacucccucuucuggagugucugaagacagcuacaguguacuuacauauaauaaauaaauaaaucuuuaaaauauauauauauauauauauauaaacaaaaaaacaaaaaaacacaacacuagaauuuuucuuuacagagaggcuucuucccagcuucaggcuggcagcucaucaaauagaauagaaaaggagcaaagacacuauaaacaacucccuccucaaacaaggccgcacagacaagcagaugcuugaugcugaccaaggcucuucagggaauaggaaggcaguuucuuaggcacccgcagcccagccgggggcagcugugcucccagaaaaguggcaagcggucugaccuacagugcuugucagauggcuuuagaggcaagacggacagcaagacucugagcugggggacuuuagccgcuuauuucaaaggagaucuaagaccugcuaggcuaagagaaucucuguccgagagcucuugccaguggagaaggaagggaccuuuguuuucaugaacuacaggcaacugcuguggcacugcugcugcccuuucauccugagcacugugaccccgucucucauuucucucuccuugguccccagccuccucagugagguggcacggaggauuccuuuuguagcuuauuuugagcguggcagugucuugcaggaccacggcaguuuucuucacuugaggagagaacgacuugcaucuaaacucagccugcauaucagauuacacaucucagcuaauggaagggggugucagggucaccaaacuccaucuccugggacgagggaagauggaacggggccuagagcaugccguagagcuggcuaguggcucgugggauggagggagacccagcagugagaaaagauucccuguucuccucagucuagcagucuuguguaguuggugcucucugggagggaggaaaacccugacuauguaaaaacuugucuagguuuccuucugaaaacuagaauacuuauguauaacaugucaacccuuccccugucuuuuuaaacuucaagcuagugauuccaaaaguaaugaccacuggacaccugggagagaaaugccugcguggcuuuugugcuugacuauccgucucucucugcccagguucucucugcuuucucuuuagaccucauugcuugauaaaguauauacccuaccugccccugugaaaagauugacuguuuaguuaccugccuauauacuauagcuuuugguacccugaauauauaacuauaauauauauuuauaauauauauaaauauaacauggauaacauaguagacuaaguagauccuauccacuucucugagaggaaacuuacccauuccuuuuugguuaauuuucucucaauagagauuauaguuuacuauauauaaaucuuuguuugccuaggcagauaugccugcauucauaacuguuuucacaaauggagauacaucauuuagggacauuauuguuuggcaguuaaacugaacacuuagauuugaaaacauaccaucugguugcaccuugauuccuuuucguuauuuaaagcuucagggaauauugcacagagaucagagcugcagcagaacggucuucaggccuggcccaucaccuuagagcucuugguuugguuucccugaagcugccugugcgucuguaucuaugggcccuuucucuggucuagaccaggguuggguguauuccuggcaggauucccuguggacaguggcucacugcucuggcauccugguguguaaauauuugucaaaagacgggggcuuuuucccauuccucaaaaaacauucugaaaaaugucccuguuuucauagucauauuuccaagcuguggcucaguuagcccauucauuccuuucaguugacagacacuggcuuggccuuagcuauccacauaaaguaaguaugcuguaauuuuuggccuaauaacuuuuaagcguuaggaccaggacucuggaccuaaaggaaccacagacagcauaguuacuguucuaaaagacauugcuuuguugacuaagaaucgcacaucucuucuaucaaauauuuuaauucaucaugcgcacacuugauacugaagaagugaugcagugaugagaaagcuaaccaccucgcuucgucaugcuaggaccugacgccuggguucccaggggagggugcugugcuauugcaggcauuuccuagcuugucucagggguuucuggucuuagauuugcgcgaaaccgaagcaguuugcugcugcacauggcugagaaggccucagaugcggagcuggguuuucucugugugcaacuguaauaguugaagucuuuaauuccagcacucaggucucagacaggacauguaccacagguucaaggcuagcuugggcuuuauagugaguuuaggacagucugcuacagagugagacccugucucaacccaagcagugagaagaggaaggagagggaaaaugucagggagggagaggaaggagaaaagggcagagggagaauaagaccagagcccaggauccacuugcucagcacagacacucagacagcucccacugcacuccugucuccucucuccgguucucaucuuccuccuccccuccaguuuucugcuagucuggcuagcagcugccuaucugcucugguuuccagcaguuaacuuaguugugugauacuuaagaaguaugauuaauaaagucuuuauauuaaggaaaacuggauauuuaaaaauuaucuguugaagcauucguugaguuggcugccauccauagcauaauacauacgcauauguuaaugacauucugauugugcuaguguuuggacuguucuaauguguaaugucuuccugcagaucaucaauuucuacaugaacaugcuaauggaacgcaguaaagagaagggguuuccaaguguacaugcguuuaauaccuucuucuucacuaagcuaaaaacagcugguuaucaggcagugaaacgcuggacaaagaagguggauguauucuccguugauauucuucuggugcccauucacuugggugugcacuggugucuagcugugaguaacuccuuuauuuuugauggcaugagaaagagaucuacguaggcagcauagccagcccagugggccauaugaucugugucucugcuuugcuauggaggagagguggaauuucauagugaugccucggcuuuagaguaggggaugcuuagguucggaaguuacaggucaucccgccgccgccucaggugaggcaaggaacaagcauguuuguggugccaccagccccagcuuccuaccuagcucugacuugccuugugcauguggggguuuagcauuucugugcucuggaagcaugaagacaucagcuuaauguuaauaagaguuauuguauauucuguuuugaauuacauuucaaagauaucaaucuggggcuggagagauggcucaaagguuaagagcacggacugcucuuccgaagguccugaauucaaaucccagcaaccaccuggugacucacaaccguccauaacaaaaucugacucccucuucuggagagucggaaaacagcuacagugugcacuuacauauuauaaauaaauaaauaaauaaauaaauaaauaaauaaauaucgauccaaaaaaaggaaauaagauaaaaacaaacgcagaaucuugucaccaucuuucuuauacugugggaaugaucuuaugauaguuaauuuucugugaaucaugcauuguugaucauggagaaaguggcaugcaaaaaaagauuuuaagacaguuaauaggccacugguggaucaccccagcaccacccuagguaaacaguccccuugcucuucccaugcuagaauacagcacauucaccauacugcucacagucucacagacagucuggggaaaggucaaggccaagggaggccagcugaugaugcguguguccugacuguuuugucuuguuccagguuguagacuuuagaaggaagaguaucaccuacuaugauucuauggguggaauaaacaacgaggccugcaggauccucuuguaagugcaaauugaggacaaaagaaauguuuguugcuuucugucuuuccagcaaucugagugagaccuucggagaugggauuaguggcauugucacaucaguauaaaugcauauuuuaaauacaauauguauuaaugagggcaguugcugucuuggcacacugaaauauagaguaaccauauacauagaaauacagucagcagaacucauauuuaauucagcuuucugaaauuuuaaacgaaaaagucccacagagaugacuuugcuuuggucuuacuacuuagugguucccuuggaaauuagaaugggaaucucuuacacccauuugcuucucuuuguaaacaccagugccuugcucugcaacugauacauggcaagggggauaaguuccugaacagugcgcauuuccuucuucaaaagagugcucuuggcuagggagaggcucagaggcuaacgggcuugcugcacaagcauaggaaccauaguuaggaucaccagggcucacauaaaugcucuaugugugcaugguucccacucaacuccagccuuggaaagcagagacaaacugacuagcaagacuaguaguaucaaugugcaccaugcacacacucaugcucacgugugcgucaacacaugcacauaccacacacugcacaccacaacauauacacaugaaaauuggggaagaguccucugaauuuguacuguuuuguuuguguuuuugagacagguuuucucuuuguagcucuggcuguccuggaacuuguucuguguaauagacuaagccagccucaaacucagagaucuuccucccucccaaggacugggauuuaaggcuugugccaccacugccuggugugaauuuguacuuguuaaauuuuaaaauacauacccugauacugcuugagacauuuuaaauuuuauauuuauauauauauauauauauauauauauuaauuuaauaauaaguuaugcauuagguugauaauuguaaaaggaccauacaaaccaagaaaaaauaaauauaaaaauauuucuuagaaagaugaguagacugaagaauuuagaaagaauauuaccuaucaggaaucucagaagcagcgguccugucccuccuggcagguggcagaaugggcugcuugugggaccugugaggguugucuucugagggucgccagccccauucuguggguggcagcugccaucaagcugcacacagcucaucucggucucuucugaugucuuuaggcaauaccuaaaacaagaaaguguugacaagaaaaggaaagaguuugacaccaacggcuggcagcucuucagcaagaagagccagguacguuucauguugauaucauagcaaucuuuagagcugggguguuugggggaagaggguucugguugcugucugacuccuauggacugucuaauucaagucuagccugacuucagcuuucucugguuucucaagggagaugaauuauuuguggggaagcucaugauguguuucuugugcaaaacuguuuucuaaaugcugagcuguuugcugagauuuuuacuccguugagaaauacuuguugacuguuuggugcuuagaaggaggaccaguuuguacacccuugggugccaugaaagccugagagaggcuccugugugaccagugugaagcuaacacacaaagguggaaccacagugcugcauccuuaaaccuccuuccccuuaggagacccaagggaaaugguguaaaauugauaaaagaaguuugcaaaaauauuuuguuguuguuguuguuuuaggaaaucccacagcagaugaaugggagugacuguggaauguuugcuugcaaauaugcugacugcauuaccaaagacagaccaaucaacuucacacaggugaggcaggccugugccuguucuguggagccucugcccugaccuuuacauacuucaggcugugucucagaucacugcacaaaaggagaaaauguuggucuacacgccaggcuaccauugucacauauaauagugacugagucuuggguuaagaagaaaagucuuuauugucuguccaucucccccagcccgagacacacacacacacacacacacacacacacacacacacacaccccaccucuaaccuuauaggaaacacaaacugaaaccagaagaagccuucuucacuuccccucaauuuagcauucagguuuuggaauauuuuggaauagacccaaguaaaucucuuuguguccuuuguuacacacccccuucccuggcccguugucagugccacuggucaguuuuaccucaaagguagaaggucauuuuccuagacagcauccugaacccaagaggacugagacuacaaaucccagcugauucugauauguuuucuacuuuugcuucuguuggaaucagcguccugucuagauuuugucugaaccagggcuucguaaauguuuuccucuugaugaggcuugaaagaugcucagugguuuaagaugcuugcugcucuuccagaggacuggguucaauuccuagcgcccacauggccuauacagccuuugguaacuagaguuccaggaaauccaccgcccucuuguggcuuccacagguaccauggaaugcacauggaacccagacacacaugcaaggggcauuuguacauauaaaaaugaaugagucugaaagaaggaacaaaacuuacuauucgucuucauccaaaaaguuuuuacauugcccuagauauauacauauauuaaauagauuagugaaacauauaauaaggcaaagaacuuauuuuaaaacaguccucugguauacauguaauuuuacaguugguuaaagacaaaagcgaguuuguacacagaugaaauggaagguuuuggguuugcauguggccuugaguuuggcugacucuaauguuaacaggauauagcgcguccucguuguuuuccagaguggcugacaguuagguuucacagucagcaaugcugagaaugaaguaguacaggauaggaauagcaugcaugugggagucagacaguuguacgaauuccaagaucuaaacgcaugucaucaagcuugguagaaguuucuauacucacugaguuaugucacuggcccaguucaauaccaagguaggccagagugauaauaggaagguacuaaaauucugguuuccauaauuaagcuuuuuuguuucugucaaagcaaaaaguguuagguauaaguaaaacggcugcuguuuguaacguacaguggucugaaaucugaacugggguguuuccagcaacaauaaauggcguucugugcaucacagaucacacagugcaaagugugcuguguauacucagagucaggccuucacuaaagucaugcaccuuggauucauugaacguuugagccugaauuaguuucuagaccugguauguucagaaaccuaucacaguucucagauucuucagaguguccauauucaguuaaaaauucagaugccugggccagagagguggcccauaguuaagagcacugacugcucuuccagagguccugaguucaauucccagcaaccacaugguggcucacaaccaucuguaauggaauuugauucucuuuuucuggagugcuugaaaacagagcacucauauacauuaaauaaauaaaucuuuuuagaaaacaaauucagaugccaaauucacagcccagaguuuaagaaaacccuuggaaaaacugggugcggugauacacacuuuuaauaccagcacucagaagcaggccuaucucuaugaguuagagggcaucuugguuuacauagaguuucgggccagccaaggauacauagugagagacugucucaaacaaaaauaaacuaaaaauuaagacacugagauuuagagcaaagacauuguuuuaaguucucuuacuucuucuccaauaaaguacuuuucauuuuuuggccuuagucucauuguaaacauaaaaaauuugauagacuccauucucaaaauucuuggagucauugggaauggccuagagauuccagguggugcccaguguaaccuguuaaggguauagagcgaaaauugugguagaaagaagcaauaaaggaaaagucagugugaccaagacaagcagcuugagaggccagaggugucaccaggucugguaguugaaaccuuaaggagaaaggaguauugugcccacacaagugagaacuaagagccuaucuguguccccacagcaacacaugccauauuuccgaaagcgaauggucugggagauccuccaccggaagcucuugugaagauucucagugagcagacacugagcgugugggggaccaaccuuugccaucgacagccggagaccuuggaaagagcugcuccucccuccccuguucuuguacagcccuugacccuggaccaggcccggcgagaugcauucacaagcacaucugccuucccuuuuguagcucagauccuauuuuugcaaagaaacuuuggugcugugaaggggugagggaacaucccuccugaagagacugcuuuucacuucagcucugccgucuucuuuuccaagggcucccgcucacugagucccucacuaggagcccaagagagccucgggaagaaucucgguuuccuguaaacccuuguugcucggccuuaccgagaagcaggaaagagcaugggcagcagguagggguaaaaccaccagcauguaggacacacauccccaagacgcagagucggcaauggagcugcuuaagucccuccuccaggaccuuccuauuuaugugcccuccaugaccgacugcuucuccuccaagcuguuucuucacugguagcgucaucccauccuaagcacacuacacaagcccuggcagacccuaaagucucgagcaguccguuccuuacaagcagggcugcaugugcgagcacgcacgugcugugggagggcccccagaaguacugagcgcagcagccgggccccagcuucagugcugccugcuucugaccaagaagaaggaccuuggcgguuagcaucacacgccagaguaggaugaauacaggucuagguggucuguggcuaguuaguuuaaauaugcuucuagccucagagaguuuuauauacauauaugccuauauguguguauacauacauauauacacacacacacacaaugugaaauauauauuucacagggauauguuuuuaaaaguuaaaaaaaaaaaaaagacugaauguguuuaccauuuagucuguagguuuauuuucaucuuucaaauuccagcacacagugaucccagcaagcccuguguaucgggccuuuguagauuuccuaagaguguuuugagaccuggaugaaucugguuuaggaguaaagguuaucaagguaaaugaugcugucagcugaagauggggugaauuagacagguaaacuugagguuuuuaaacugcucuuuguuguuguuuguagcaccucucccccugcccaucucagagcuccugaggugagauggugaggggacacagugccagugucguuuuguacuuaaguuccacaacagggacguuuuucuacuuuguguaugguggccgguaguuuucuaugcagucuucuccccgauucccugcgcccagcccugccagcacugugcucucucuccuugggcuuauuuggaaauuuuacucuguuuuauaccaaucuuguuuaguacauuuuucuauguuuuaccacaagucacaauuugaaaacaacaacuauuuuuuuuacuacuccauuguuaaaugaauguuaccgucuccacuccagcagccugugccccucuugccucccccugcauguuggggaugagggccacuguccaugugugucuccuucucucgcugccucuccuucccccucuccucccuuucuuuuucucuugguuucccauaggaaauaaauagcuuucuauaugag

SEQ ID NO: 12534 - RNA, 7932 nt, Mus musculus
aggcugcgaaaguugggggagugugcuagaaggacugcggagcggagcgcacgcgggaccaggcugcgacugggucgcuggucccggccacagggagugggagccggcuggguagguaccccgcagggagcguguuucuguuucuagggacagugcaugaaagagaugggguguacgcgcgggcgaaaaggaaggguguuuucgggucggcuuacgaggagggguguguagggugcauuuuugguauuaaaggauagcucuuggaguagggugagccagggcuugaaguuuaggaagcgggcgaagggucugcaaggugcuugguuuugguagguagugggcgcuuguuuaggagguuuccccgcuaggaucuccagugugaggcacucuguacucuggguuuggguguugauugccggguaggggguugucugagcauggacugggaaaagguacucagagcuucggcguugcugggauccauccaaguacaaguaagauuggauuuccacgggucuccuucccgggcucucagcccccuuucccaguguuuacuuaauacuucauaggcuguacuuagauuuucugauucccuuaccgaacuuucuuucugaaccgugcuggaagaccuggggguugcugaaggaaauggcuagcuagguuggcuggguaaugguuguguuagacuaaguugucagaguaucuagaaaccuaggagcuguagccuggugcagcuacugaaagccgcacguggagccuggguggaaguugcucacgauagagucucgauguaguacugacuaggggggagaccccuucugucaucagacagacuuguauaccccaguggucuuuugagucuguuagguagggugcagccugcgggcuuggucaccuaacagguguugccaggaccugccccaagccggauucucccacucccucuuucaaccccgccucuuccuccuccuugagacacccccacccccucaggaggcuagaugcagaucuguaucuuguguugcggacuaucggccugaagcuggguagauugguggggguugauccggauguaggauguccaaguggagaaacaggauuugaauggagcuggaacaaacgcccaguccugacuggcugccacccuucuuccuccacccccaacccaucccuucccaggcuucuugcaaacagaggcagaaguggccauauuucuuucuuucucccaggugcuguaugcccuagggacuugacacggggcaggcggggugggaacugguuggggggggggugcuguuuuaugggaagucguaugccuagccagcgguggagcuguccuggcuaggcacccaggggugguguggggaaugggagaaauacugggacuagagggucucaagggccagcagguggugauagucuuuuucuccaccccacccucugcuccagcacccucugccucagcacccucugccucagcacccucugccucagcacccucugccucagcacccucugccucagcacccucugccucagcacccucugccccagcacccucugccccagcacccucugccucagcacccucugccucagcacccucugccucagcacccucugccucagcacccucugccucagcacccucugccucaguguuccugugugaccugucuuuucaacuagaaagucuagaacuguacagaccccagaguuggagguggaaagggacacuagguccuggagccuccucugugggcuuuuuugaccagaugagaacguaagggccuccuccagcuaccccuggucauucaggugcuucagguuugugaccuuugcugagacccuggaugcugcagcaaacagacaucugcuuuagcagagggacagcuugucucugugcauccgcugguaggauccuccacucuguccaauuagcuugcggcugcugcuggguucugaguguucucuuacaaaaugacaagguuagggggcuggagagauggcucaggggcuaagagcacccauguggcaguuugcaacugucuguaacuccuguuccaggggggaucugacacccucacacggacaaacaugcaggcaaaacaccuauuggcauggaaaaugaaaauaaaugaccggguuagcugagaaauuccuuuugagaguugucuuuucuccaguccagagacugcucucuggaucuuccugcucaguuccucgccucccuucaauauaugguauuuaagguuuuacuuuuuuuugcguuuucaauuguuuuuaauuguauuuauaugugucucugugugugcacaugagcauggguguccuacaaggcuagagacaucagauguccuggagcuagaguuacagaugguugugagccaccugauguaguugcugggaacuggauuuaguuccuguggaagagcagugcaugcucuuaaccacugagcaacuucuccacccccccccccccccccaguauacgguauuuaaaacucuauagcaaugcuacccaacccauuguggagcuggggauggugagguggccuaguuccccccaacuccuggaaacaugucagaaaguacagagugggugccugugggaucagcaugcgggggguggugguggugagguguggggcugcuuucucccgaggcuaccgugauagacaguuguaccuuggcuggcagccucuaccccauuuccaggaugucagucucugcagacguaugggggagguggggaagggguauacagagccuagggugugccugggaauguacucccaggaagugacugguugaaaagucagcagaucuccugggggauagaggggugggcugaagcucuguggguugccucucucagcccugaccugugaacagggaggcuggggguuggaggaacacagcuucccccuguuccuggggggacaugcuggacagccuuuccuagcucccccggcccacugggguguggcuggucgucggacugagcucuuuuggaccuggucucugccugugagcuuugugacucguugagauagcauuugggcugagggauugggagucuucuguucuuugguccugacacccgcuuccuugucuaggccugccaccuggcuccccccaccccccuccccggccuaccaaguuucuugcuucccuuacugaccccuccuccucccuccuuugugucuccucccucuccagagaugcccuguauucaagcucaauauggaacaccagcaacgagcccaggaccgcgugaccaccugaccggugauccccuggcccuugaguucggcaagccuaccauggaccuggccagccccgagacagcaccugccgcaccugcuacacugcccagcuucagcaccuucauggacggguacaccggagaguuugacaccuuccucuaccagcugccggggacgacccagccgugcuccucagcuuguuccucugccuccuccacgucuucuuccucauccucggccaccucccccgcuucggcguccuucaaguuugaggacuuccagguguacggcugcuacccgggcacccugagcggcccauuagaugagacccuauccuccagcggcucugaguacuauggcagucccugcucagcccccucgccaucuacacccaacuuccagccgucccagcuuucucccugggacggcucauuuggccacuucuccccgagccagacuuaugaaggccucugggcauggacagagcaguugccuaaggcuucuucagggccuccgccaccuccaaccuucuucuccuucaguccucccacuggccccagccccagccuggcccagaguucucugaaauuguucccaccaccagccacccaccagcuuggggagggggagagcuauuccaugccagcagcuuuccccggcuuggcacccaccucuccgaaccgugacacuuccggcauucuggacgcacccgugaccuccaccaagucccggagcggggcuucagguggcagcgagggccgcugugcagucuguggugacaaugcuucgugucagcacuaugggguccgcaccugugagggcugcaagggcuucuucaagguauuuuguugguucugggggacgaugauaucauguuggagguggggguggagugggucauccguugggaucuguagugaccucuccugagguuucuucccagcugguucuguccugcaggacaggggacaggugugugccaucuuagaggcugggacuuuuuauucagcagggcacacaucucucuagggcugcagaaagcuggggaagggggcagaagguguguguguguguggccugcaguggugcucagaaacagaaaaccuagugggcagccucugguucuccacagaacuuguguuucuggcacuggaugaaaggacacaggcagaggguuugguucuugcuggggguggacuugggaacaggcuguguguuugucccagugcugggugccugcuuggcuucccccaccuccacccccuuaguccucuccucugcgccaggaaaagggcagguggacacaugcagacaccuguuagaacaggugucuggacggccgugggaguuccuagacccuggucuuggguucugggaucuucccugugagguugaaaccuucuccaguaucucccagacuccucucugcgcucuggcccuccguuucucccuccccuacauccaaauguuaggaaaauagcuaugaacagagggcgcuuuugucugcgucggccacaggaucuggacgguccccuccccugggcucuccaccccccccccaaaccccaugcucugacagccuguuccguguccccccuuccuccagcgcacaguacagaaaagcgccaaguacaucugccuggcaaacaaggauugcccuguggacaagaggcggcggaaccgcugccaguucugccgcuuccagaagugccuggcugugggcauggugaaggaagguggguggcaagauggugcccucggcauaggcgaccugauggggugggacagccgggcucaccaggaucugcaccuaauucccacucccacuucuagauuccagccccuaaaugcagguguagcuuccaccugcuuucuggaaaggguggggugaggagggccuugugggguccccaucauggucugaguucucugucucugacuucucagaagugggguguauagugugcccugaagacccuccuucuccaggucuccuuucucaauacugcccgucucucugcaguuguacggacagacagccuaaaagggcggcggggccggcuaccuucaaaacccaagcagccuccagaugccuccccuaccaaucuucucacuucccucauccgggcacacuuggacuccgggccuagcacugccaaauuggacuauuccaaggugaggucuugcccgcccaucugcccugcccugagaacauaugcaaugccuuugugccuguuaggaaaggcucucccuccagggcaacaucaggaaacaagcauccucuauguacuggcuaguuggagaaaugcauugggauggguguggggucggggagccaguuacaaacagcugccguagcccuguuuuccugugggaauugacaagcacaugggcccagaauagggcucuuuugcacgccuggaucuggugucccagugcaugagagcucuguaaugcagcuuguguaggcuuugcuguggacccaaugcaggacacagcugugugaugcaggccuugcuguggagccagugcgugacacagcuguguggugcaggcccucauguggaacuuaccugcguuccuuucaguuccaggaacuggugcugccccgcuucgggaaggaagaugccggugacgugcaacaauuuuaugacuugcucucugguucccuggacguuauccgaaagugggcagaaaaaaucccuggcuucauugagcuuugcccaggagaccaagaccuguugcuagagucugccuuccuggaacucuucauccuccgccuggcauaccgguaagcugcccaccauccuccuagcccuggccccagcccugcggccccggccugccuggacccugaguccugacuguucucugccuucugccagaucuaaacccggugaggggaagcucaucuucugcucaggccugguacuacaccagcugcagugugcccguggcuuuggugauuggauugacaacauccuggccuucucacggucccugcacagcuuggguguugauguucccgccuuugccugccuguccgcucugguccucaucacuggugaguggcagaaacuagacugggcccaaggguugcaggaccauuggguagguagcaucuaacacuuuggggaccccuagagugccugcaacauugggauguuaggaccugcaaagggacuuagcucuauucgccccuaaagcuuaaaucagccuccgaaugaccccggacuccucagguacgacuguaggcgcugggcaucuagcuuagggauucuguuuguuuaaaaaccuagcugucaaccucacaagacacaggaacgugcacacaugaauuuuucacauucugcgcuuggauagcuaucgccaugguccagaaacaggaccuacuucagcucuguugggcucccuccuuauugucucuguaagagguaaccacucugccagccucaguggcauuccugucauggauuuuacugugcguaucacaggguauggacucuaguguuaaauguagagguuucugggucccuucugcuuccgcucccauuuccacuuaaauuucuuaggggauccuccugaguagaucaagaccaggagcuggaucuugaaaggguagggagugauaucuacacccagcucguccuuagucuguccugcgagacuccaggauuuuagaacaguguggagccuggaccuccagaaaaccuggauuaggcuuuugccuuggccagccauucagugguuucaaauauugaccagucuggacagugggcuccugugggacgugcuagagggcuggggaagcuugucagggagaaggcgucaacugagcggggcugacucuaccuucccugcugcagaucgacacgggcuccaggacccucgucggguggaagagcugcagaaucgcauugcuagcugucugaaggagcacauggcuaccguggcaggagacccacagccggccagcugccugucacgucugcugggcaaacugccugagcuucggacccugugcacucaaggccugcagcgcaucuuuugccucaaguuggaggacuugguacccccuccaccuauuguggacaagaucuuuauggacacauugucuuucugaccccugcccugaacaugugugcgcacacgugcgugcucuucugucacccaugugccuuuaagccuauagcccacggacccccagaccacccuacccccagccugguuuugagcuaagacugacguaccuccucacuccagaagauggacagagaacucaagaccugggggaggguguguauucacgggggugaccccacuauuugucuuaucccuccagcucaguccuggccuucguguguuuuuguaagauaaaccauuuuuaacacauaccacucuguuguaaauaagcugacgcuacuguaaauacagaaaggaagagguugagauggggguugggaggaagggguggggcucccaccagcugggcgagccuccaacucgagaucucuuccgcucuccuuccauguguacauaacugucacucaagaaggugauugacagauucugauuuauauuuguguauuuuccuggauuuauaggaugugacuuuucugauuaauauauuuaauauauugaauaaaaaauagacauguaguug

SEQ ID NO: 12535 - RNA, 13415 nt, Mus musculus
aaaaguuuauagaaauucuuuauuauuacacaaaaauagacucucuuuuucccucuguuuaugugaccccacucuggucucuguguggagggaaggcaggaagcuuucaagcuucucccaucccuccaugaugggcccuggagcuggguggagcuggcagggucauuccccuccagggcuccacuacugacaccuccucaccccccucacaccugucucugccaucugcucacaugccaggucaccuuaggggcccacucacucagcuuagcaggcaagggcaggaaagagcaguggcccagaugcugccacucccucuuucacaggggccaggccaggguagugagcgcuguggaugcugggagggugcagugugggugugcacucggagcuuguggcuuuccuucauuuccucuggcccaguagaacuuuggugaugaaggugacaauggcacuugccgguugguccgggucaagcuccgcaaagaggugacacacauuuucccagggacuuccuggcuucuuggccacgaaaccaaagauccugcagggacaaagccagggacaggaggaugguguaagccacagggggcggcuuguggcgagccagggccgagcucagcagggagacuuacuuggagguggcuccaucuggguugguccaucuguaaagagagaggaugugagagagugcggcccagggcacagcuccugaacacccuggcagcugaggccggcaggaccccagcaaagagcuccgaggaagacucaccugcgguccugggggucagugcuagagaaggugaugcuguucacuggguaauggcggcgaaagaagagccugugaggggaaaguggggaagaaaagucacacucagaaauccaaggcucugggcuggggagggagcucagagcuuacagugcucaccauccacacaagcaggaggacaagcuugagucccagaacccguguaaauguuggguacaagcggcccaccugcaauuccagucucagaaaacagagacaacugcaggagcaaggcuagcaagacuagcuguaucuaugaguuaaggugaacaagcaacccagauuuuuaauuaucaaacuggagccuacacacauaaaugcaaauguguauguacucauaccacacacauacacaugaaaagaggaaaaacaaaaaaccaagagauccccauggucauugcuugagacucgagacggggucugagccgggcuuacuuucucugguugucugucagugugaugccuugagcugagaccuugaaauggacaauggcuggcacugggaccgggcugcagcucagagcugcagagcuggccuuggccacagccugagggccagucaaugacucugucuccaccgaggucagguagagcacacugcaggcuaaagagacaggagguagguugaugagcuacauaguuuugccaggacccggaucugucacccauucgcugcuuaucccaccaucuuguguacuucccugaccagugcugcccaaaugcacuggaaucacacacugacaaguuagaaagacaacucccagacuccaaggaagcaacagccagcaacaguggggcaaagacugaggagacacauuuuaaguucucaccucugcuguggcuaugauuccuguauuauaagcccugagaacuugaccuguaaccccuuccucaccuccugaaaauacagggcuucucugccuuugcagguuaaauauaccugcugggucugccacccacagcccuugcagugccccuccuuguaucuggagucuacaguauccuccuaacuaccagggagaggaagggagaacgaagacucuaccugcuccuugacgcaggaggucugcugcugugcucauguugguaggcacuggggccucugggguuucuucuagaggaucugaggagaugaaggccaccaagggacgucaaaagggaggggcucuccuagccucucuaagguaggguggagguaaugggaccucuauuuagguguagggguagcuagagagcuaggagagagaucacucaccuuugcuaggaauucucagacagcagggcagggagaugggagagauggagugcugggagaccagggcagacaggcuuccuaagagggguuggggggaagugacuaucauaggggccauagucaggguuuucucuuccauucuccugaggccucuccuuuaaccuucccccuacccccagaacccuuucagacucuugcuucucaccaaaauagggcucagugggacaacccuugaucuucacgccuuugggcccagucucgaugaggaaauggcggaccagcuguucugagggguccccugagaggagugaggggugaaaauaaagcuuuauggcaucccaggaacucaguuucuccccacagaacucucccccaagcagcaggcggcuugccucaacccuccccuacauggagacguccugugcaccaccucacucccaccauccugguccuacaaguucuccccucuccccaucugcaccuucagcuugagagcucuauaccuuuccagggcugcgcacuggguggagguguagccaccuugagggcuagcccauaggcuccuuggaaugaauggcugucucuaaucaggaaggccccaggauccuugucuuucagcagggcaauggcugcagggcagaaguuuagagauggcugucagccccacacaguucuacuagcagguucccaagucucucacucugacagcugugaggguggugggaaucuggggcuuugggucauaggacuuggaacaacauuuagucugaggccaaaacuuagaaucucuauuuuguucagccaagagcagagacagagggaaccaaaggcccuaccaggauaaugggcuuacagccaagacaggccugggagauggacugggacaggcacauggcauuuucuggccucuuaccuuggucucgggaaagauguggcuuguaccagaacuuugauguauccuggacaaacuugacauugcuuugguucucuuguaaaggguguucuagaagagggagggacugaguucagacuccagggcucgccauggucucuaucuggaaggugagguucuuuaaaggacacacaauccuccuagacccuuauaccuggggguugggugacaucugggagaggagaugcaaaggugacauguugauuggugcuucuggcugguggcgacggcuguugcccagacccaggcaggugucguuuuucaggaaguggaggcugaaugggaccauuggcaucauaggagguagccagggggaaggcaggggugggugagcucuggggugguucugggcugcccacaagccagggcaucuggguaggcacaggaguaagaggggagccaucugggcuaucugaagugccccgagggcccugccacggggcauggcgaaguccaggcagggugguuggcacagggcuccgaggacuagcacuguugguguggccuccugggcuccuuuccugaggccagccauugggugagccgggugcagaggucugggagaaggggcuaggguccaguugcucaggccugcugcuugucaacagcucaggagucuuuucagcaacucccuguacaacagagggcaaggccucgccaggacucagucucugagugggugccaaggagggagaccugguggugucuugccgucgguugcugcaaggaaaaguaggugaacagacagcuccuuguuggggcugcagacacccauauaacaugcccaaguagccuuggcccucuguguaccuuuccuugcccugaacugggcugcugguguguaaggguguggagggaccagacagcucugaagaagcacugcacugaggaucucggggagaccgagguagcgugcuguguccacuggagccaucccuccaggaugguucaggugacucugagacgggagggaagagcucugggaaacaggagccugcuuuucugccuggcucagcuccuucccacccacggccuccccaguagcauucagaacccuccuuuacccuggacauucccacuugaggguccucaccuguagaagccaaggguccuguugaggccagguguccagaaaguggguacuugucucucccauccuccgcagaaaucucauaacccagcuuccugggcugcagguaggguggacuccccggggacacagauccagcccguggugagugggcaccagggcugggguacccucggccuucacuuggagauccgcaacugugaggugcccggccauaugcugggcaguagcugggaaccgcuccuccauagccauagguuaccagggcaggguacccugaaugcccauaccugccuucagagcacacggcauaggagcagcccucaugcccuuccucacccaccuuggguggcuucaggcagccauagucaggcauuggggcaugaugaugcccacaggcaggcaccagcagaggcaauggguguccaggccucacugggugcaggagaggcuugccuaccucgcuggaccaccccucugcagccucccucucuagucgcaguccauacagggcugcggugggcagugccagcuucucuucacaggcagggcaugagcauaaagcaggcaccccaggguccuccaggaucaccaccucccgguagccugcuggacgguagccaaaguccccauuggcugguuuccccagcucgggugcauagggguacggcccuucugacagugaccugcagaggcgucucuucuccacagaggcuucugcguagcccugggggugucccucauagcccccauaggguggucgucgucucucuaggguucccucaggccgguaguagcucccauuagggaccccacaaggcucccggaagcccugacggcaggagcagcgucgacugaguccaggccuguggccugaauacaucccaaggugcaggccuccacccacagagggcugcucuucaucaucaaggauggcggucucucgcccagcaccacggcccgcacuggccacuccacaaccucccagcagacgauccagcuccugucuuucagcagcaguugggggcggccggccgggggauucugcuguguguucugugguuagcguggaugaguggccagagucgcugcugacagagagcaucgggggugggggaagcucuggagaaggugcugguggugucuggcgggggacccgcugcaccugggcauaaggacugccauccagggggccccuugugugggccaaggcgccugagcagagaagaauuugugaguggggacagugcugacucagcgugccucuccccacaagccgcacagcucccaccugccccaccaccccacacaccguccacgcuauccucauggugcugauugaaguuuucauaggagucccagcguacagcaggcucugucguguuguaauccacggagacagagggaucauuccgugggguguugccuguggaaggccaccggggcacugaguaggggacugcccuucccccaccccaagccuucaacaccucgccccuccagcuccugcaccuucaacacuccguccacucuuaccagcucccacucuuaccuuugaccuucucagggcuggaggagaaaacaaacuccacugaggcuuggaaaggaaaccgcucaucuguggaggugguggaggugaggagccacgccccgcuggcguccccuucccuacccacuucacuggccucugacuuaccagcccaggccucaucuaguugguccuuugggaaggugagccgugauccaugaauggugcauguguggaacugaacucggaacacgaggguccggucuguccccuggccacccuugugguagcagguuaccugagggagggcaggaggcuggggucaggccaucacauccauuuugucuuaccuacaccuuugcuccaagggccaccugggccacugcuucugucaugccccaaccucaacaugaacucucuugggauaguauggguaggguucccuuuuggcccagggagugacacuauuugaagguauggucuuguuggaguaggugugucacugugggcaugggcuuuaagacccuacuccuagcuuccuggaagggagucuucuacuagcagccuucagaugcucccaccuugaugauaacggacugaaccucugaaccuguaagccagccccuauuaaauguccuuaugagaguugccuugggggcuggagagauggcucagcaguuaagggcacugacuguucuuccgaagguccugaguucaaaucccagcaaccacaugauggcgcuuacaaccauccauaaugacaucugacgcccucuacuggugugucugaagacagcuacaguguacuuacuuauaaauaauaaauacaucuuaaaaaaaaaaaaggaguugccuuggucauggcaucuguucacagccguaaaacccuaagacacaggccuugucagcugacuaucuggcuagaagccccccacccccguugcagucugcauccucaggauuccccucaguguuacaacccucgccccucaccaugacgucgccuuugaggagaagggcuggcuccaggcugauacaaaguugcugaggcccuggaccugcuaugcggcuguggguagagagaaaggcagaauagucagaggcauccagggagggcacagagguagcuagacauagucagccucucuggcugggcaaucaggcagaugucagggccugggagcagggcacucacuagacuccagauguguagaccagcugcauagacugguagaucuugaggaagggcuggaagccuggagggguggaagaggccaugagaggugugggguaguagguggcuauccucacggaauacaucccggggugacucaccuguguugggcucaaaggcuggcagcacaggaacaaacacauagugcaggaagagugggcugcuguucauucugauggagccagacagcaguccgcugaaguagcugacauagcuggcgggggaagugccaagaaagcaucagcgucuuccucuagagggcgccucacaccaacucagcagcucuugggagaccuagacugcucuuuuaaucuuaugcuucaagggggcaagcccugcucauccuguggagucuuucuuacaagccucugcuuuauucucuucacagaccuuaucgccagccagaacgaucuagucuguuuacgcauggcuucuugccuucuacucuacuaacauauaaaugccaggagaaccugaucuuguuuguucugauuucccagaaucuggcacagggccuggcucugcucccgugcacugugggauucaggugugcugcccgaacaggagagucagcccuuccccacuggggugcucaccggcgcugggagggcugcaguuccguggccaccuuguccucacagaauuuccucauggugaggguugccagcgccuggucugcccuggggagagcagggcaggucggggguuaggaaccaguccuauucuggccuucuauaccuaaaccccagggaaggaggaaucaugagauccucuguacagaggaacucccagugguggugaggagagccagaggcccuacagcauagucaguuucccgguuguugggccuagggcaacuguccccugaaccuggcuuuccucgcuugucaaagggggcaguuagacaaccugauggauugaacugugucccucccccggagaaauguaccucaaaugugaccuuauuuagaaauagggucuuugcagaugugguuagauagguuaagaugagaucauacaggagcaagguggguccuuaauuagggcgauugguccuuagaagaggagagacagaaauagacgcacaaagagaacaccaugugaugacggaggcagagguuggagggaggcugcugccagccaagaacugucaggcaccaccagaagcuggaaagaggcaaggaaggagucugccuagagucccagagacagcguggccccacugacacuugacuuucaacaccuuagaacuguaagacaacugagauauaucauuuuaagccaaucuacgauggcaguuugcugacagcccuaagaaacuagcccagcuccucuguuguggagugcugggcccacuaguggagagaggugguaccgcaccaaguuuauagucugacuaaagagagaaaagcucagacagggacagaugaggaaaggccacugaggcagggcaacucacccugcagagaucuugcuguagugcauauaagcagagacgaugaccccaagcuugccuuugcuccccuacgggauaaagagacagagcuggggaaccugcgacauuuaggcugagguugcccuagcgcugugaccccaaggucccagcucaccuugcaguacaacacaaccacgugcugagggucggcacugagccacgucuccauggcuuugcagauggaacacaacuuguccagagguggggcauguaguucaggccaaccaaagucuugcaccuggggaaguaaaaggguacaacucugcauauauauauauauauauaugugugugugugugugugugacaggaacauggauauggauacaauacagggaccuggggcaaaggugggcacuuaguaguaguccacaauagcuuggaaauuuuccgccauacuguggggugauauccccugcaccauguuuuuagguaucuuaagugguaugagaaagguggaugucaauugcuacuaccaguaacgagccuuuucacauuucccuccuaccuugggguucaggcgggugaggucaugccguuucucugaaagguugaagagcugaaauaaagcagcguuagaugagggugacuucagacacaggugcuggagguggacccucagugagcaucuugcucuaaaauaguucgauugcgauccgcuggggcggaauccucugcaagcugcgugccuggcucagcuccggccccgccccuccccgccuggccccgccccgccaugcuagcaccgcccccuugccagccccauuucagguauugauagcgaaacaguagcuucgccccauuuugaucucccagcccucucauugguugcaucuggcccacccgcuccucaccagguacuugucucugugcuuggauugaagcacaugggcuagcucgcgcaaguggccucggugucgcugcucguccggucgugcaggaaaagcugcggccaagauccgcuccguuacauaggugagguccaagucccagcgacgcuccaugagcggaucuaggcugaagcuccugggagaggccacaaagcugauuuagggaacagagaaacguggcgccccagagggcuaguaugaugguaaggacccuggggaacgcugggcgaccuguuagguccuuaggguggauggucccgagggggagcacugucuuggggugacgugggaucgccgggcauccucacucaccuggguagaguacugcguugcuuugagugguucagagacuugguggaccccugguggauuagaaaccguaugucgacaucacuucggaugcaucgauucuaggcuucccggucaaaaguucuacaaaccguggucuucuggaaauauaggucccuacuccaagagcuacccacacgccccuccccgcucaggcuccuagcaucccuuaccagguguucuaugcgccggaccggggcugugcuucuccgcuagagggaggaugugggggaggaaaugggagugguuagggcaggggcaaggaccagucuggaccugguggggcggggugggagcgcaugucaguguucauucccuagggacaggacucuagcccccaacaagcucuagaagacaguaaccagaaagggcuccgacagccaucuguugaggacaacugaccaauaaccacagcacucauuucuacauaaccuccuggagacccacucugagaccaccagaccccggggauacuagucagguuccuugccuucccugccccauccuagaacacacucaccagcuccgcagggggcaaggccugacaggaugaagucaccuggaaagaggugggaguuaaaggcugugcuggugaaauggggugccaggccucaguaggaaggugcaggggcugucaccugaugaacaaccucuagcugagguuccucuauuuaagggagccuugcuucugccucucggucucccaccccuugggcccccugcuuguugcucuuggcucucagcccccugcccacacagacccccauucauccagcggcaggacaggaguuauauauagagccagccagccaggcaauggccagggguggacacuagccucuuucaccguugagaccccacccaugggcacagagcucccccaagcuagcuugaggcccugggacuacccccugcacugauggagcaccaggaacguuccucagagaugcagggcuaccuuagguucucaguggacagcggguaccagcuacaggguauuauaccugaacaggcucagcuuucacuacccaggaugagaccaacgcaggcauccugaggacccuuuccucagagggaaggcaccucccaucagggugccuggucucugaaaucuugcucccucucuauccaccccgcccuuccuccccccgcagccacccccccucauccucucgccagcugcagccugggcacagcaccaagacaaacgcugucucacuguccacccuccugggccaacccuccagggguggaguaggguguuucuuaaagagcccaacacaacaccccugccacccaggaagggguguccaggagugagugacaggggacagggugacaugguggcccaugccagugaggcugaagaugccugucuggacagggaaagacaccaucuccccauuagauagaaccacauacucaccuuugcuucacauuuucuguguguggccaccuugcagacuagagagagaaaggguagagguuagcagaggcuuacgggaauagucaaaauaacugugcuccagccccacaggccuuagaagccagcucugggacccugguacacuagguuacuaggaguugaagaacagagcugguuaucaacagguucugcucuggaguaagggaagagggccggggguuggggucuaggaugaauagaggugaggaggggaaagaggaagaggaggaagaacaguaggaggaagaagaggaggaagaagaaaaggaugaggaagaagaagaggaacaggaagaugaggaggaagagaaaggggaggaagaggaaaaagaggaggaggcagaagaggaaaaagaggaggaggaagaagaggaaaaagaggaggaagaagaggaaaaagagaaggaagaggaagaggaagaagaggaaaaggaggaggaaaaggaaaaaggaggaaaaagaagaggaggaagaagaaaaagaggaggaggaagaagaagaggaggaggagcaagaggaagggaagacccuagucacagguaaggaugggaaggugguagagucacaaaucuccugggcuguggcaaggugggugucaagaagagugagggcauuuguuucugaauuugccugucucuagagccugagccacacagaagugcugccuggagggcucaggcaccaagagcaccaccucaccucggcaggagacaccggucccaucgauggucaccuuacacacugcacacacuggaguuuucuuccggaaaaccuucucccggaagcugugugguucugcuuuccucggcugcgggugggaugacagacaaauagggguauguguuccuagugggcucaucuccaaggcugggcagggaccuuuccuuagagcgaugcugcuucccucucuuccagccaaaagucugugaacucuaaggcacacuuggccacagcuguuucaggguagucaugaggccuguccucuacagggcuuggaaugugaccccuugcgucaccuuggcugggucaacuccucccuaaggguucacucaggacuucucacguggcggagcuaugugauguccuugucacacacacccccacuuccaaugugagggcuuucugaaucuuggcagaguggggggucugacucuccucccaucuugcccuccccacaagaggcuuguauacugugagcugacggccaggacacacaagcacuaucacauaauacccagacugacugcagccaguucugagccccuggcucucaguguccccaagcuccaggcagcuaauaugacccccucccccacggucagaacaacauguuuacucucugugcacugaggcggcaggcagcaauugucuaagacguucgcucggaaggaggaauagcaguggggacacacaggcagcugccucgcugccucugcauguuaugacagggguggccagguucuccggaugcccccuccccacccagagguagugaggucaguggcuggcugggcugccaccaguuguccaggucccccuuagucccuacucacugcaaguuuucacugcaguucugaccccucccaccccaguucaucccuccuaucuagagucuguggacaaucucccucacuccucccaccacuccacugcacauucuucaccgcuguguguucaagcucccgcuguccccuccucucccuggaucugcccaccguagugugaagaggagaauaacaugggagcagcguuggucccuuaacgacugggggcgagacccaccaggacacuuggacgcacuuguggaugaugacgucgugugcagaugacgucaguagaaggcacccucccuucccucauugccuucuucccauaccuuuucccucaagcuucccccggaggucagggcuugagcucuuagcugaacccucggggccuauccaggcucaagccaggaaauacacagagaagucaaaacagaugcuagaaucacacugcuacccuacccuagccaccucagggggucaggcgaaagaaagaggagggggaugcugagccagccaggagaagaggcugaaacuaggaagagggucuggucuggccugaauccuggcccucccgccuuguccgcaccuccacccugccccaccuuugcccagcuggugggcacuccuacccugcugguggcccggcugcugucccuccuccccagggcucugagcaaccuuuccacagggccgcuggacuucauggugucuggcuggcuggacucuuggcugcagggccugaacaaugcuggggccuggccuggggcuuccuggaagcagccugccgaggcagccgcuucccuu

SEQ ID NO: 12536 - RNA, 5328 nt, Mus musculus
ucaugcuaacuggauuucacgguucaccuucucuguccuccccuuuacuccucccuacuccacaaucccuuuagccagauguacagcucccaaauuccgggcgagauucccaggaacaaagcaagaaaaaaacaucagaacaauuugggaaguaaacagcggcggagaagaagggagggaaaagccggguggacccagguggguggcccuccaguccacccaguuaagggacugccuuuuuccccucccccuucaccuggcuuuuaaggggccgggcccagaccucugcuucuuaaagaggagcccgcagcagcagcugcacuggacucucuggaaggaguguacagggcaaaaacucugaccaugaccugggaugggcugcccacgcagccgcugcucaugcugcuaaugcuguuguucgcugcgggcucaggguccgccuuagcggggugccccggcugcggcgcugggaugcagacugguugucgcgggggcugcguggaggaggaagacgcgggaucgccugcagacggcuguacagaagccggaggcugucucaggagagagggacaaccgugcggggucuacagcccuaagugcgccccaggacugcagugccaaccccgagagaacgaagaggcgccuuugcgggcgcugcuaaucggccagggccgcugucaacgcgccagagggccgucgggugaguccaugucuccccccucccuccccgcuucccaccugccuaccugagauaggagaagcaagucucuccugguaggaaucuggacagaugcagguugggcagccucuucaagccucugggaccggcccauugguucuuccugggccuugaguggaacgugaaguggaaacgucaggggacagcuauaaggcugauaggggcaccuuagaauaagcaagagagaugucugaauucuccucugcucucccuuucccuuaucuauuuucuccaaagggaaagagacguauguaggcggaggauggaggauuugaguuucagcuuuccucuauaccccgcagggucaacgccauggcucuccaggcucacacuggagacaggaccuagauuccuuauggaggaggaggaaagggaaucucaaacucuaguuccacacacuaagaaaugucuccugcuccuccuucagugccacugugaacggcagugggcaucgggagcaucggcaccgggggaguaaacacagugggcagcgggcaccggggguagcaggcacugcagacggugggcacgggggcaguggacaccggggcagugagcaggcccuagagggccuggggagggcugaagaagugggaagagaaggaaucugccaaaucagacuuaugauuuaaaccugguaggaauuggaugcccuccagccccacccuaucccagggaugaacacagaagacugagucauugggugggugggacuagagugagucagcaccccaaagaugggggugaagagcaacgggagauggaagauagcaagucccugguuuuuccauagaaagggaugagaaaugaauuuggaucauuuggcagugcaggccugccauuccagugcuuagggguggaggcgggaaggucagucagugucagccuuggcuacauaaucucaggccagccuacacacacacacacaccauacacacagaggcacacacauacacacacaugcacacacaugcacacaugaauauauacacaagaauacaugcaugcaugcacauacacacauacacgcaugcacgcacaugcauacaugaguccccccacaugugcauuggcacauacgcaugcacauacauauauacacacaugagcacacacaagcacacacauacacacaggaacacacacgagcacacuggagugagggguugaagcuccaguuucuagugucagagcucaggguucuagggcuccucugagaagguguguuuugguuggagaaggcaguuugaagcaucaucccaguuuggcauuaaauggggggagugagggacaaggucugaggaagauaugguacccagacagacaacagcguugacacugcagagggaacggaguaagaacaugugugagcuuaucuuuuggcauguugcgucagcucagccuuuuccuagcuauggcuuacuugcguccugagcuuuucccaggaccccagaagcucuccagagccagaugcacccugcagguuggaaaccuuuuauuuucugccccuucugcaaccuucaauuuguccugguuaaggguugaacccaagcguuccuagaccacuaggguugagcugagacaaaaaaggaagagguccccauguuuuuugguuuuuuuguuuuuuuguuuuuuuuguuuuuuuuuuuuuuuuuuuggagacaggguuucccuguguagcccuggcuguccuggaacucacucuguagaccaggcuggccucgaacucagaaaucugccugccucugccucccaagugcugggauuaaaggcgugcgccacaacugccggguuguuguuuuuuuuuaagauuuauuuauuuauuauauguaaguacgcuguagcugucuuuagacacaccagaagaggacgucagaucucguuacggaugguugugagccaccaugugguugcugggacuugaacacuggaccuuuggaagagcagucggguacucuuacccacugagccaucacaccagcaagagguccccauguaaggcccucaaaguaacaucucagggcugggagggguggacugacuuacugaggggucaugucagggacauuccacuggauccuuauugacacccucuuaucucccccccacacacacacacaccucacacacacuguacaaauccacuguucuuuugcccaucuuucugggcuggugugcccucuucuggccucuaguggaauaggcaggucuuuucaaaggaauccugaagguugaaaauauccaacacuacuuuguacucaugggauuugggggaggguuguggggggugagacggguucuccauguagcccugacuauccuggaaaucacuuuguagaccagacuggcauuaaacucacaaaucugccugccucugccuccugagugcugggacaaaggcauacgccacuaucagcuaggauuuuauuuuuauuucacauguguggguguuuugccagcaaguaugucugucuguaugaguaugucuguguaccacauggcuacacagggguaccacagguuacaaaugggguuggauucccaguaacuagaguuacaaacagcuguuaugagacaccgugagggugcugaggaauugaacucugguccccuggaagaguagccagugcucuuaacugcugagccaucuuuucagcuccuguugaauagacuagacuggccauggaccugugacaguucucuuaccuaggcuucccaagugcugggauuauagguacacaccaccauacccagcaguauaguuuguuagagggagaaauugcaguuaggguaaagccaggagagacugaauccuucagucccucucacuuuacugguagaaguggaccuagguuccgaggcugcuggucucugcucugacugaucucugauuuccccucccacucuuccuguggccacagaggagacuacaaaggagagcaaaccccaaggaggugccucccgcucucgugacacaaaccacagagaccggcagaagaauccacggaccucugcugccccuauacggcccaauccuguucaagauagugagauggugcgugggggggugguagggaaggcagagggcuggagauuuccacuggacucaaggaagucuggaccaggcaggcuccuagaauccugaguaccgcccucacccaccccuguccuucucuagggccccugccgcagacacuuggauucaguacugcagcagcuccagacugaggucuuccgaggcggagcacgugggcucuaugugccaaacugugaccucagaggcuucuaccgaaagcagcaggugagaagaagcugccuguccucugugcaagcucugugcgcggcagugaggaaggguacuugaugcaaagcugcaaaaaggaugcugguucugcuggagcaugucuccaaaaacaacagccaggugguggagagaggcagguggaucucugugaguucgaggccagccuggucuauguagugaguuccaggacagccggagcuacacagagaaacccugucuggaaaaaccaaaaccagccaaacagcaaccaaaaaaaggauggauacacacacacacacacacacacacacaaaacuauuucuuccaauuuuaagacccacauagauaugaaaaacaucaggaagauuguaacuucaagacuugccuaggcuacaagugaagggcugguaggaagacagagggcuggagauuuccacaggagaucuuuccauggacuugaggaagccuggaccaggcaggcuccuagaauucugagugaguucaaguccagccugggaaauuucacgagccucugucucaaaacaaaauguaaaaugaaaagaaguuuauagcucguuggcaaagcucugcuuagcaguacugugggcuccaucucuagcgugaucugaaagaaaaacaaaggccaacaauugcaaugggagacuuaaagucucuucuaggauaaggccuugugguggccucaaaugggagcccuggggaaucaccuggaggcgucugagcuggugcugguggagccccuucugcauuuugugacucaguaggucugggcuagccugugaacacaaguuucuaacauaagugauguugggcuguugacagaaacugcauuuugaaagcuauugcucuggccuagcagagugggcccuauucaguagguaaagcaacuaagagcucucagaugcuuuccugcucaaagccuggaccucacccugaccugcaccucucuccccagugucguuccucgcaggggaaucgccguggccccugcugguguguggauccgaugggccagccuuugccagugucuccagauggucaaggaagcacucagugcucugccaggagcagugggugaagccccgagggagccuccaggacgccagcaggaacagggggcugucauuugagcuguaugugaagcaaugaauaacucugugccccaagacccaccuucacgccccaccccauugucccugucacccuugggccuuuacacagcuaguuagaaagauugcuguuggcuuguguacuaauaaaacaguauugggggggugucucuggcuua

SEQ ID NO: 12537 - RNA, 5432 nt, Mus musculus
aaccaaaaaaacaaaaaacccaacccacucguaguagcuugggaagcuuccgccgagggucugcuccucccagaaggcggugcagaugcccgggcgagucucgcugaggguuguggggcggguagcucggauccauaagaagacacaaggagccgagugggcgggggacuccagaucccagcaugccccgcggcgggcccuaccggccgcgacuccgggcuuggccccggcccuagcuccucggcgguguacuggggugcguggaggcuguagucacgguggcgcccgcggggacggaggagggaaugagugaagaggaucagggcuccggcacuacuacaggcugcgggcugcccaggugagcugccucgcuuggauuccugaaggacgaaaagugugagguggugaggaggggcggcggcgcggccccagcaugcaccuggccugaggguuguucccagcaagcacugggguagugggcagagguucccggcaugcacuggggcuguggccaacgccuccagcucuaguuugggguuggcuugauucccagacugcacuagagcccugggcuuuaugccccgacguucaguguauuugguggguacuggguucccgaauuguauugugucgggggaaaugcacguucaaccagcaccacggcacaggaucccucgccuuaacugagaacaguacauucuccacuugccuugggaccuugcuuucccucaugcaccuuaacuuuuaacccagccaauggaugcuauacugccugggaauucauggacccuauaauguggcuaggucuaaugugacagugauuugccaggugggugccgaaaggggaagugugauguuggucugugccccuucccagcauagagcaaaugcuggccgccaacccgggcaagaccccgaucagccuucuucaggaguaugggaccagaauaggaaagacgcccguguacgaccuucucaaagccgagggccaagcccaucaaccuaauuucaccuuucgggucaccguuggcgacaccagcugcacuggugaggaaggccugggcagccuggcuggggugugcauucacagggcccguggcuuaauaucaugcgaucaccucacaguccucuccuuuaaagccagggagggauggagauauuucagggggaaagaaggauuggaacagggcugugagacgguggacgggacccgagagacucacuggcgagaacaggaaaugucacagagaucugcuacuuuaucaccccagaggaagaguaaaugagacauugaacuccucguggguauuagggggagcacauacucugcuagccuucaugccucacauugaacacgaagaacuuaguaugagaaauuaaaugguaggcuccaguucacauguaauaaguggcagagcagagcuuugacuucagacccucaguugucucuauuuccuauuuaccgagggaagagaaaaggggaaagaaagacagagcaaaacaucccuccgcaacccaccaguguuggagcucaaaaauccugccuggcacaguuucauuacgggagcugacugaaagaggagguguucaaggcccauuucuguugcuguaguaaggcuccgaaacuaaaagcaguuuagaggaggaaaaggguugauagguuuacaguucagguuacauucaugacuaagggaagcuaaggaagaaacucacauuaucagucaagaccaaagaaaauaaucugauucuugcuacuucugacuaaggaacucacuucacagccacagaagcacagcaggaacaauggcagauacuccaugcuggcuggcuggcuuauuuauacucuacuagauuucuuacacaguucaggaccaccugccuaggggugguaccacaauagugggcugugcauaucagcaucaauuaacuaucaguccaucccccccacccacccccagacaugcccucaggccaggcugauguaggcaauuccucaguuaaggcucuccuuucagauccuuuuagauccuagguugugccaaguugacuguuaaugcuaacuaggaaaaaggcuaguccaacaauuaguagaacccuuccaguucugacaggggagguuggucagagggcucuucucacucccucuggcuaugaggagauaggcugugggggcugguuucucugcuguccugccggugaccuccaguauugcccacgccccuuuucuuaggucagggccccagcaagaaggcagccaagcacaaggcagcugagguggcccucaaacaccucaaaggggggagcaugcuggaaccagcccuggaggacagcaggugagggaggaacagccaaggcacacuagaagcccgcugagaacccaggccucugcacuaucuacuucucucccuaagccuggucuggugacucauggccacccucucguggccccuuccugagaauuuccucugaagcugaacaggguguuucuagagugccucagaguaauagccagcccccuuugaugggugguggcugcucuggggcaugagaaaagggcauaggggguggaggcaaagacugauaaaguugguccuggcaugcccccucuuucuagcaagauggcuuucccucuuccacauucagguugcagcuuguuggguagaaagagacucuuuucugagcccccacccuaaccucagugcuucugagccaguguggggucagcagaggaucccaggaggaagagcuguugcugaggcucuccgagucugcaucggggggaaggaguucucaggggauggaaaggucagaaggaccucacacccucauucccuucuacaugggugugaauccaagaccuucuuccccucgggaaguucuuuuucucuccuagacucuucaccgccugaggacacuccugucguugcugcagaagcugcugccccuguuccaucugcuguacuaaccagguaucuugaguccccugacgucuuggaggaaggagggggucuuggcuucuagucucauagcucuuggacucaggcaggucaggaugaggaagccugagaguaaagacagacugguguaauugaaaaauuugcaccagcugguugguaagccugagcuaggagguaauuuaugaugauuaaauagccaagcaaugaauguuagauuguuuaaacaucuuagaggcuccauguuugagacccaaaagguacuuccaggacuguguguacagcuccuuuaccuccaucacagggacauugcugaaggauuuccacaucuaagugcuccugggaaguagcagagccucacuuggugggguguggggagggaggagaaaggcuagauguuuggacagauagcugccugccuggugaggaauugggaggugguaguggcuggcacuugauccaugaccaggacaggaggaaccucugcauuuuccucagcacuggccugggcccuuuuuucuuuaggagcccucccauggagaugcagcccccugucucuccucagcagucugagugcaaccccgucggugcucugcaggugugccucgucuucauugucaugugugcuaucuucucugaaguagggcugaggcaggggcgugugcacuuguggguagggugguccuccuucucacucaaagguggaggcucuugguagaaggccauuggcuaaggacccuuuccucacuaagccuuggacucucuuaugguuuucuuucaaggagcugguggugcaaaaaggcuggcguuugccagaguacauggugacccaagagucugggccugcucaccgcaaagaguucaccaugacuugccggguggagcguuucauugagauugguaacuggggaaaaggggguucacucaccuucucucuuugccacacuguaaccccaaacacaaggugguucuuugccuggcugugcucugucccagcuuccuuugcuuugcagguccuugcucagcuccugccuuccugucucucccuugucccugcccaucuuucccccucuuaucuggcucaccaacuccucaguuaaaaagaucaggccuugagcuccucuuugcagugguaucucauugggugacugucuaaguuaaccuagagggaaagcauuggucuguuaggaauccccaaguugaacaauuccuuccccacccucaggcaguggcacuuccaaaaagcuggcaaagcguaacgcagcagcuaagaugcuccuucgagugcacacuguaccucuggaugcccgggauggcaaugaggcagagccugaugacgaucauuuuuccauuguaaguggcuugugugggcucgacaugugguucacacugcaggacaugguacggaauuggguugggucugugguuuggaagugaguaugggccugcuuuccuucccagggcuccuugaaccugugcgcccagaaguccccucagccuauauguagggucacuagugaaagcuggccuagggcaaagccccuauaggcaacuuuuccugggaugaggaaggcugccaggagucagagcauaauacccaguucuugggucccacaguccuuagcugcuuucucacucuuaucucauuagggcgugagcucccgccuggauggacugaggaaucgugggccaggcugcaccugggauuccuugcggaauucugugggagaaaagauccuaucccuucgcaguugcuccgugggcucucuaggggcucugggcucugccugcugcaguguccucagugagcucucugaggagcaggcuuuccaugucagcuaucuggauauugguauggccaacuagagacuggggauggaggggacuggaucaaagcaaguaugaaggaguugggagaugggugauguguacacuguuuggugccccuuccccaccagugccucccuucucuuucuugguuuccagaggaacugagccugagugggcucugccagugccuaguggaacuguccacccagccagccacuguguguuaugguucugcaaccaccagggaggcagcccgaggugaugcugcucaccgcgcccuacaguaccucaggaucauggcggguagcaaguagcaucccacugcagugauggauaugcaucuuuuacuucuugcuccuucugccccuggguccauguauccaccuagcucugguacccuccagaggugccaucucuaccucugacacagccugucugccuugagacugaggaaggcacaggcaagcaaggagccaugaaccacagggccccagccagcacaggauuuguccucauuccgugggugauggaugaaucuauuggaguccugaauaaaugcugcucuuuggcuuccaaaacccugcucucucuggccuugggucaugaggguauaaggaauaaacauggugagcuuguucuccuuuugaa

SEQ ID NO: 12538 - RNA, 22478 nt, Mus musculus
uuuggucagugggggcagugggugggguuuauugcacuugcaacagaguuuaaauaaguugggguggguucuggaggagaggggaggguuggcuagggagagaggggcagcgucagugcagcuggugggcagaacccaggucauacaggccuggggcuucccguucucucuggggaaugaguggccaggcugagguuccaggucuguuugccaauguggccugguuaggguccugggcaauuccugacuuguccuaagucagggauaaauagguuucuaagcccaggucugcagcugacccaaaugccaccuugggucugcuagcauagguucuuagaauccgagacugggcuccagaucaacccuaggccccagacugggucuggcuccauucucuuucugacuuccauggaucugggucugggccagcaucgaccuuuguuugggauuuguccugagcugguccugcagcaccauccacgguuaguguucuucauuggccuuccaggaugggggcuguuggaguugccaggucucacuccccaagucucaggcucuuagcugcagacuuccuuugguucucuggcaagaccaaagaugcaucuuugcaggccggagucagaugggaaguccuguuggcaugcccggcccagagaaccacaacuggauucccuaauuaugguuccaaguugauuucagaaaagucuccaaaaugcaaaggcugaaggaaagcuggagcuucugucccuggaccugaggcccccauccacgagagggcauguguaaacgaggguccuucacagugcauggggggaaggauccacaagcuucuugccccccagcucuggcccuucaaguaugucucugggcuaggaagaagagcuucuccccagcccucagcaccuucaggaagugccuagucccucccugucggaagguauuggacuggcucuucgggaucaugagucugagaucaggagggcucaggcaucugagguggcuggaggcuugagcugagcuuuuuccauggcugugccguaggggagggaacguuugaagaagccgagcugaugagaaaggaggcacaauuagagaucacauucucccugaccacagauccagggggaugaggacucuccugccucuauccuccccacccugccaaaguggcuucauucagauacuuucccaagggcuccaauagaugugggagaucuaaaauuagggaguuauuaugggacagucauuuaucaagguuuuaaaaugauacugaaaaagauacuaguuaagccaggaaggguaaacaaacucaacucaacaagugccacaucugagccuagcccuggcugccacuuguaggauaccaucacuuauucuuagauagauguuagaagagacgacagcacaaaugccaucauguauuugccaucugugguuuugcaauaugggcaaacuuauccagagacaggaggccucuuuguaaacuggaggcugcagacugaagggagggguccaauaggaaaaaagacaaauggggcgugaguagcuagggcauacaugggggucugugcuggaaaacagaucugaggguggccucuuugauucuacuggguaaaaggcagagucugacaggcuggaagcuaagccaaggcuuggcguggcugaccuuguagaggacguagaugagcagaccuaggagcaggaggccaaaaagaauggcuaggaugaugauccacaacgggacaccauugcugccuucugccuugguccacugcacggcuguggccaccuguggacaagccaaugacauuaagaaccugugaauucuucccggccuguuccuggcuaccucugucuguuggaucuggacccaacucucauuuuuuagcuaacagcauucugaacuuaagagucugaagugcacaaguguuucuguguucacaugugcuguuuucuccacccagaaucuucugcucuggagcagucuaguuaauuccuucaggccucaacuuguacaccacuucuuacaggaagucuuuccugacucuguaagauuggguucagauauuccuaugacauguuuccauagacugucuugccacauaucacacugaugucacugcccucuaggcggugaacacuagagcagagacacguguuaaucuggccgaucuggaccuacaaagccaggaaauauuugcacaaagcaagaccagccucuauccauguccccauccugcuucugacauucuugagcuugucuucugcgauccagacuucuaaccuugaacucaccugaaguuucuuuuggggaagcugccgaggcaggaucugguagggcaucuucagagcuucauauacagccucacacugaaggcuaaauggcugguauucccgcuguggguggagaaagguggucagggcaaccccuaugggauucagaggacacagggcuuccccacagucugucucaggaugugaucuuucccuauuauggacucauuaaucucgauguuccuuaugcgaaauaauaaauguaaaauuguguaauuaaaacuaaauaaugcauaaucagauaacuacacguucaauauacauuucuuaaugauuaauauagguuaacauccaggaccaugguuggucuauaauauguauucaauaaaugauggcuuuuuucucuuacauauagguugcugguauaccagcuaggcauucauuuauguggagguugaggauuugaagucuggucuucauguuugcaucuccccagcccuauccacucuggucuuuacacuuauggauuggguauacuaguuaugcacucuaccacugaccacugaccuacauccccacuuguuuuucuuuuuguguguguaguuauuuguuuauuguuuuuguuuuuguguuguugcuugagauauggucucacucuguaguccugguuggccuggaauucacuuaugaagaccagauuggccccagacucacagagauucaccagccucugcuuucugagugcucagguuaaaggugagccagugccagcaugcucaccacguucuguuuuucuaucagggccagaaagggaaguaguugcuaguugcuucaacaguggccaagagguggcgccaaggacacacaacuggucuaaaucagggugagggagggaggagacuuggagagggagagagagagagagagagagagagagagagagagagagagagagagagagagagagagagagagaguguguguguguguguguguguguguuuguccaguuaccaaagcagagguggaagggaugacagcauggggaaaugacagggucaguccugcuaggaccaaagguugggguccaggauggaugaagcucccuuaccugcaagaaggucuuggcccagacucggaaaugcagcugcagacuacggcucucuuggcggugcaguggcccaaacucacagcgcagccugaaacacuuggcuucagggcauuucuagcaagauagaaggagucugagcccagaauucucaccugaugacccugagaacccaaacagguguccaacacuugggacaaacaucuuucccugcagcaacuuaccagaacuuguguuccugaggcaguagaacuccucccuggagccucucguuucugcaggugguguggagaggucucuggauccaacuggaagaagaggcaucuuuaguugcaccuucugcuucauuauagcuccuaagucagccugaaccuauguuccagagccagggacccgauucugucucugucccuguguucagcuaacccaccuauugccaagagcaaaguguaccuugcucugcaccguguagauuuguaaagaaaucauuaagucuuucccgccuaagggccuuuguacuggcuguucccucuauugggaauguuuaucccuugucuuacaaggaggcuucagcuuugucuuucagguuucaguugaauuauuacuuguuuauuuagcagugcugggauugaaccuagagccuuggguaugguaggcaaguguucuaccuggcuaauggcuaccucuucaagagcugucacaagucagauuuguacccauagcacaucccacagguccacuugccugucuuccuucuuuccuucaagaauucucacuaugaggcuuugguugucccagaacucacuuuauagaucaaacuggcuuuuaauuugugguuguccuccuguuccagccacuucuaagggauggugauuaaguuuacagguguaaccaucaugccuggguagcuuuauuuuuuuauuuuuaauuuuuuuuuaauuuauuuuuuaugguagauaaguacacuguugcugucuucagacacaccagaagagggcgucagaugucauuaugaguggaugugagccaccaugugguugcugggaauuaaacucaggaccucuggaagagcagucagugcucuuaccugcugagccaucucaccagcccaucuucuuugucacuuuauacuuuauugcuuuccacccgucuuuguugucacucagggucucucucauguaaguacuugagaauaaucuugaacuuccaguccucuugccucacuucacaaguguuggggcugccuuaccaggcuucagcacuuuucuuucuuucuuuuuauuuuuuaagacaggguuuuacuguguaaguccuggcugucuuggaacucacuccguuguagcccaggcuagcuucaaacucagagauccuccccacucugccucugagggcugggauuaaagguaggugccaccacaacccgguuucuuuuuacuuuuuuuuuuuuuuuccgagacaggguuucucuguguagcccuggcuguccucgaacucagaaaucugccugccucugcccugacucccaaaugcugggauuaaaggcgugugccaccaugcccaacucuuuuuacuucuuauugucuaccagcuuucacuagaugcaagcucccagaauguggggacuuugugaauuucauuuggugugggguuuuuccuaggucuaacgcuuacuucauuaaaugcuguuuaugaacaaacacacucucaaagagggccagaggacaguucucacaggacaagguggcacagaucugauagcacaccaugagagagacuacuucagagcaaaggacacaaauguaguagaugugaaucuuuuuccuccuuucagaucuugaggugccugaaucuccccaccacuuccaauagccuccaggcaacuuuucccagcuccauagucccauagccccaccgcuccaccccacaccaugaccagguccucaccuccaggcccugugaguuggggguguaguuggaggugcaguugcugaguccugucaccuuggucacauagaggagcuguuggccuuccagagccuguggacagcugagcuccagcacacccuggcugauggagcugggccccugguugaugagcugagagaaagagcacacuuugaggaagggaaagcugauuugacaugcaggccuuggucaccacccauacauagugcaucagucugagaaaugaaagaacacccaagagcagcaaucaaguccacuucagccauuacuccaagagugagacaaggucucacucuguaauccaugcuaguuugagacucauaguaauccuccugaaauagcuuuccuuuguaaggcaauggaccaacaggccccucuucuggacaucucucacagauccucaguauucuccaggccgcccccucuucucuucaccucacccagguccuagguacugucauuuauaccggcuccuacuuucuuucccuucauauggcucgaucccugaggcuugucuuccaacccuucucaccucguagacaugguggacagcugggcccaagucuuccuccuucugaggcuggucuugaggauuccagucgcugacugggaaaaucacagcuucaggcuuggagacacugaagaggaggauaguuuagaguggacaaaaggaaccaauauguccuucucuaaaguccaucacccuccccucuaaaggucccuuucugccugggcacugacccauuaagggagaccugggcuugagccuccaccgagagugggaaggagaccacguugcuuugugaguuguucagguucuugcugugggauggaggcaagaggcaagcaguuugacaagaaucuccagguucugccauccaucccaccuucccuucuuucaccuucaacucagccccaguccagguccagucacucccuaccugaggaucugaaagucaaacuggaugguuuucuuugugucuugaagaugaggaacagugaaccgaaggccaccccagagcugcauaacaaacaaggaggagaaaggggcuguuagauaggaugucuaccugugugcuaggaccugucacaugcucuauccuagcccuuccucuucuaccccucacuuacacuggugccugccuucaugggguugcccaggucacacaccagcuggcggcucugguucacagcaaaguagucacagcucaggcuggagaaguucuggggauaggcaggcacaggccagucaggcuuuggcaccccucuggaggggaucaccacugcagucccacuugagagucccuucucaccccugggugucugacaaguccugaguacucggccucuagaggggcugugacccgaagcucggcuucauaggcaccgcccucacccagauuuugggcauggaaugucagguucagugcguucuugucacccagguacacauguuucuucucccuggaggggcacacaggguaaggacaugaaagaaugaauccauaaaccagggcaauagggccugggaauaacacaguggggcuggcccugcugacuggaccccggcucuggcaggcauaaggcgagacgcugcaugcugaguaccguguuuaauaugucuagagcuagagaaacgaaugcucccuguagacaaacccaaauccagagaugcucacggaucucacaaggccacauauagcuagagugucccugucucucugccaugugacagugccacucacccauacacauccagcugcaggucaggcacacagauauugucuucaccacaguccagcaagaucugggccuggggaguggagcagccuugagaaggguucuaccaccccucucccagggcccugccucaggggccaggccugucuucccaaguucuuuccuuaccuuguccucuauccugcuuuugcuuugguaguguagaacuggccggaggccauggcuguccaugggagcuuugggguccaaggagaaguugagggcaaugugaauuggggagaguuugucucugaauucugauucauucuagggccaguggaaagaauucaugggauuagggauucgggggugggguggggcgggguggguggcgcuuagugaccaugcuucuuagccuugcuucucccuuuaucugcucagagcccaaaucugaccucauuucucuguaggccuagacuccuggugucuggcucuucugacagaaagccuuuuucuuuacccucuccccacagucauccagccacaugcaagcacacacgcgugcacgcacaccaucacuauugccaccgucaccgccaccacaguccuuuguuuuagguggcuaucuacccaggccaggccacccucauccucaggccauacccugagguagaucuucaucucccugcaguccucccgagccccauucuggauaagcagggucuggguaaggguggccugcuuggaagucaggaacagugcccgccggaccccucccuuuugcuucugccaguccaguuggaguuccaccucgaagccuaugaccaggaaacacagugucugucuguuuuucuuaccuuccacugccccaccccucagcuggcacacucgagcagcuucucucaccuauagaguuggggacauguuuuccagaggcauugaggcagaagcuaagguugaugcuggagaaagacggaggagagagugcucagguuaacuagaacuggccuccugccugccugacucagaaagacccagacuaggacaccccuguuugucccuuccugaggcagacauggccccccugcccacuggcaggcacaaaucucugcaggcucugggcacagcucaccaggacacaggguucccuuccaggcugcaacugcgcuccucuggguugaacauggaggggaagauggugagagaugcgcuggcagauaugaugggccgcccucugccaagaguggaugugggguacauagaauuaaggccgggcaccugcuccaggaccccaguucccucugcaccgaugguccuagucuuagcaccccccucccuuucacaccugccgaaguuuuuuuuuuuuuuuuuuuuuuuuuuuuuuuuaauuuguuucucauuaaggaugguugugagccacaaugugguugcuggguuuugaacucaugaccucuggaagagcagucagugcucuuaaccgcugagacaucucaccagccccccagucuuaguuuuaaaagaaaaacuaguuguucagacugccucagucuuccugaguucauaccuguacaccagagccuuguccacaccaaaggauccaacgauuagaucuguagaaagucaagauccacccuuuauggcaagccccaaaucaggauugccuucaucugaggcuuucuaguuucauggcucagaggccugagccaggggacugcaccaucugguggcagcugccuagaauugcaucacaaagcuugcauucuaagaugaagggcaguggccacaacuuaccaggguauccauugccauccagaucucguccuccucgaagggcagagccaaagaagucugggguacggccagcugcccaaagaggcugcaaaaccugggaagguuuagugcucaguccuccugggccucccgggaauauaaauacgacucccugcugggccuccccaccaaauggagccccaauggcgacaucugcaagacacaacacacauuauuuacuagguuaggaggccagggguccaaauuucuaucaaaaaacccucaggauccuauuuuuccacaucaguuccuguucuaauaucuuuaaaccccaauaccccuggaaagucaagagggcccgguacuuuaguugacagaagcccucccacuaaguuccugaccaacuagcauccccccuacuuagccucagcacccugggccacgauacuuaccauuguagccgucuugguccaggucccccaagggugucaaggagcugccgaaucggcugaacucaucuugcccagugagggugagggugggugugggaucuaugcccgcugggcgcugcagauagauguagacccugcccaccuccugaggucucccaucagcuguccgcuccaugagcaggggugccccuaccaguaggucaucuagccugaggagaagggaagacccaagcauucugacaacccugucuugcuauaauuuauugcccuuguggaggaacuccaggcauucuggauccccaggcgcccugagggcucugauguagcauccagcccucuucuugcccugaccaaggagaaggcaaguaugaauuagagucuagaaaaaaaaauauccugagggagcagucugccugcacugucccaucccccaucgaucaggucuggaagaugcaucccuucccaucacucacccaucuccauugguaucaguggcagccacagcauagccgaaguaggaggccaucuguggggacaaaggguagcauggagucagaacaaggcuggucaguaaacaggaucaagagaggcuguaaguggacauucaugggcuccagagacgguaggaaguuugacacuguugguccagggcugcagauuagauggcaagauggagaacugaggguauccucaccuguucuccugagacguuguagagggaguggaugucugagccauuaaggacggugaccugaagaugaagauaaaggccuauagguccuggaugccccaugucugaaggucugggacacaugggacaggccuuccucaggggaaucuuagcacuccucugucuccuuccaaauuuguccucucuccaccuccagguuuucucucucacuuuacuguucugccuucuuccuuuauacccuugauggauuuucauccccagccacuagauucuagugaccagaaucagaucagugggacccagagcaugaucuuuggucuuugccucccagagcuuagcaggcagcaggcaaacagcaauacuggauacacacugggucuucaaacccaauggauucagaacucuagccaucccucacacaccagggucugcaagguacucacaucucugcugucuccucuuagcuacugacccagcagaccuccacgucucuuggaucuugcucucugcccaccccccacuguucugcugagaccugguaugaaccuucccaggacaggcuggacuauagcuuggguuuuccccacuggcacugaugccagaaagcagauggaggacugugauucccaccuguacaccccaggggcccccgcagccacugucagucccugccucuuggccagcccucuaagguucuggugucuggcccuacugccuguguuuguucaacccucccuuacaauucucacccuccuuuaccuuaugaggcugcaaacuaggcccagccccauauucucuguguucuucaugccugugccugggacucccucuugccccaucuguguggaacccucacagaaccuucucugaggcacccucucuggaaggagauuacuaauuucuuaaaaugugcuguuaucuugggugcuuuucuguaacuuccaauucagaaagaguacgagauuuagaguaugauagauauuaaauauuuauccagcugccccuaagcaacauaauugguauuuuaggacaacaguuuucuuguguguaaacugucaagauuguucuccauuccacagucccaugguggggaagggaacaccaccaugcauggacaguaccugggacaucgagaggcuaacaaacaauggcuuccucaggauuaaagcuguguguuuuagcucacauauuugacuagaagcaccuuaagagaugggauaagaugucuucaucucaucucucaccuugccucaauaaauguuguuaauugagcgaccgaguguggcacuugucauggucuaauaauagcugguggcugcacacggucuaacaauuuacaagugcuuucauuccccucacaagugccuugugaggucagaacuauuauuaccccauuguacauggaagaaacagcuuagagcggucaagcaggggacaguguagcaauaaaagaacagauucauuuauccagagucagugccagaauuugaacuugagucugacuucacacacuuccuucccuugaaccagacuucagaaaucugauguguucucccagagccuaugcucugaucucuuuccuugauauacccaacaaacuaccacacaaggcucugcacuuagccugggugagaggcagcggguggcgggcagggucuuacauagccauaggugagguuccccuugggcacgccagcaacaaagucugcaaagagaagagaaacugauggguggaggugaggacaggguggacucagaauguuguuucuggcuuucuuuucaguccccacuuuggcuugaagauugacuuaccuucugugucaucaccacugaauucacccacagccacagaguauccuggggacagaguguguggauguuagcauugccuccuuggggaccccuacucucuggcccucaaucccuucauugucagccuguacacaaguauggcagcagagcugguggcacugagugggagaagcagggaacugagugaggcuagaggccccugauuuccccucccauuuccuccccaccugcuugccuacccaaguagcugucaucauagacggagcuggccuggcgggucugcagcugccccugaacaggguugaugagauacucuggguaauaggacuccgagaucugcucuugaguggcggacaggaucuggccuggaaggggagcagggugaugggcagggggaggucacagaggcuuuggggagacugaguaggauuuuagaaguauggaucaaagcugggcagugguggcagaugcauuuaaucccagcaguugagaggcagaggcaagaggaucucugaguucaaggccagccuggucuacaaaaugaauucuucacagagaaacccuaucuuaaacaaacaaaacaaaacaacacaacaaacaaacaaaaaugagaaaggaaaaagaaaaaaagaaaaaagaaaagguuuggaucaaagaagggauguggcaccaaagcuggaagagggcagaggaagggcuuaccuugccagaaguagcuuccagguccacccaggaccacacggccagucuguggggaggugcagggaagauggaugagcauauauaucaucugguacugacccuagauccucacuuccugccuucccuccccagccaccucaccuuggugaacucagcacugaagcccccuuggcaguagcccugcccugcugcacugccaaaaucugugagagaagacaaugagaugagcuagcugcacacugaugggcugacagggaagagaggcaggagcaagaaagaagacugcucaagggucaccugagcagccuugaaaaaauauauaucaaugccuggaggccuugaagagaaagccccagguaccaaggacccucccacggagaaggcacaaugguccacuacacucuggcaccuaccugagcggcaaggugcguacuccagaauccgggugaaguuuucuguggagagguagcaggugcccacugggucauucuguggguccuuuucugugcgccagcuauacaguggagcacaugccugagggggcccggggcaggggguguucagauuuagcuuaguaagaugaccaccuuccaccccagaccaggccuggcccucuccaccacagcuuaacccuuagcuaccacaccacugagcucacucaugccucaccaagauggaggagccaugggcccgaacuguugcuccgaaccacugcaaggacuuguacuccacaggcuccucucccuuggcacuguacagugaggacuccagaauccgggagccuuggggaaguagaaaguguacucucacacuuguucucaggaaggugacccuagccuuggucuaggaugcucagcauuuguagacccugagacccacugggacaggggaauggaaggaguuuuagacuccuuuauguagcuggacuugacugguucuugcucuccuuacacacacauccacauacauauaucaacagagacacccauacccacucauacacacacccacauccacagaaacauacacacccacucauacacacacacccacauccacagaaacauacacacccacucauacacacacacacacauccacagaaacacacauacacacucguacacucauacauccacagaaaaacauauauccaccuccccacccccaccacagcuucccaaguugucuuguuggcuccucugacuuccucguagcuggaacaggacauuuucauugugguguugggggaacauuggccaagucccauggcucaucucugucuguuagccagcccugugacucuaacggccucuccuuucgccuccacacuagacuucccuuucugucucuuuccaagucuaaacucugcccucuguagcacugcuuuccugcucuucuuacucuccaccucucaggcuuuuuauuuguuuguuuguuuguuuuaagacaagugucucauuauguagcccaggcuggcuuugagcuucuggcacucuuuuucugccucagccuccugugcccucaggcuuuuuaaagucagccuuaggaacuggggcuguaacucaugcacucauacauccacagcacauguuuaccacgaaucaaacuuuggguucaaugccuaguaccccuucagaaauuagcaggcuuccacauucuuaugcuuacuucuuguccucuuaucucugaggacagacugccugaguucacagccuugcuuucuuacuaguugggugacuuaaccuugcuuccuuccucacaggauggggauacuaauacuucauacaguugcugcaggauuaagugugccaaggcacaauagugccuagcauggaguaaaagcucucugagugcuagcugaacagccucagcuuccuuagguccaucugccugaaggcugagcccccccugggggcaguggcugaaucacacugugcccagugugcacuaucacuuaguuuaggaacagaacucugcagccuccucugccuuugucugcauuauggcccuggccucccagagcugugggugauucagugaaaugagagccacauguuucugaaucaugcccgcccuucuugggcugggcugggaacauggagugagugccacgggaagcccacagcuaggagcuggauggagcaccagaacuacugcagggggaaggggagggggaggagcacccuucacccaggccccacccccaaacugcaggcccgcccacccacccucuuaugccaggcccuucccugaacucuuccagccuaccuuugcugucaaauugaaugguggugcacuggauaggacuggugccccagggacacacauagacagcaccaccuugcaguacaccuggcuggcuaguguuagccuugggugccccaaccagcacacugacucuguggaggggaaaggagaaguagauuaggacggguccuauuuccaggucagugucuggaggcaagaugcacccagaccuuugggccaagagugggggugggguagaugucccuuggguuguauuuauaucucagaagaugccacagaugccagaggcaggggcuggagucaggcauuccccaugugcugcugucacuaacucagcuccuccccuccucccacauucucuuaccuucuuccccuacuacuagagaggagaagccagagucaguuccuggaaagggaaaagaagacuagggucuggacucuggcuuuuuugucucuuccaucuacuugccaagguuagauguccagcccaacuagggcuguagcccaggaguagaggauguucucggcauacgcaaggcccucagcaccaggcuaagaaacaaugccaaaugcaauguaugaccuuugguugaaaguggauuaauguguguguguguggugugugugcgcgugcgugcaugugugugugguuuuucgagauacaguuucucuguguagcucuggcuauccuggaacucuauccuuagaccuggcugcucuugaagucacagagaucucccugccugccuuccaaguaccaggauuaaagguguaugccaucacugccuagcuaaaauauauauauuaaagggacaauuuagcuccagaaccccaggcuccuguagagccucauggcccucaccuuucuuuccaagccaaauuuucucccuuggauggaacucaggcaaccggccacuuaagucuuggggcauguuggaggaaaaaaugagucucugaaauuaggacuaugaaagcaggccacuuccugggccugguuugccccacccuguggccuauaggggaccucaccuuccuagcugggccucugacacacuuguaccucuuucccacaaauuagccccagaaaauuuaacucaaauccuguucuuuugaauccucuuccuggacacacaugucugagauggggucuuucgagggauggcuccuagcauccuucuucuaccaauucugguccuuugcuucuggggucuccacacagcucuccucuacuagccccgaucucuuguuuccagcuccuacauacagccacagccuucuucucugcuggcacucuccucaggaucuccugcaaugacugcaucuggcagucugggcagcuuuccuuggcaccccagcucugggccaguguuccugccagccuuggccucuacucuccuccccuacugccacuggcauugcuccucagccuccgccuguacccagcacugcuugcucuccugauuuauauucccagguccccuccugucuuuuuucuuuucaaauuauuuauucauuuaauguguauggauauuuugccuguauguauguuuacgugccauguggguacuuuguuccagaggagaccagcagaaggcacuggauccccugggaauggaguuagagguagucaugagcugucauguaggugcuaggaauugaacccuggucuucugaagagcagcagccaauguucuuaaccgcuucuuuuuuuccuuuuuuuuuuuuuuuuuuuuuuuuugaaauaggguuucacuguguagcccugguuguccuggaacucacucuguagaccaaucuggcccuggacucagagaucugccugccucugccucccugagugcuaggauuaaaggcuugcuccaucuuugacuggcuucuuccuucuuucuuauucucagaucguaggccuuuucaccugucuuagucaggguuucuauuccugcacaaacaucaugaccaagaagcaguuggggaggaaaggguuuauucagcuuacacuuccauacuacuguuuaucaccaaggaagucaggacuggaacucaagcaggucagaaagcaggagcugaugcagaggccauggagggauguucuuuacuggcuugcuuccccuggcuugcucagccugcucucuuauagaacccaagacugccagcgagcuguuccucagucuuuaucuguaggaacgagagcucaaaaggggacuugaggaaaagacagaugucuucugagagucauacugaggggcaagggggucuaagagcaucaaggaaggaagcccccaggacaccaguggaguauggguggagugugagaggacaggugagaauagagaaggcaggggguccagaggaguaggauggagacaaacaggaggugccuuaaguuauagagaggggaggugccagcuuugguuaccagggggacaggaaauguuuacugccuguggcuuccggucaguuuucaaccucucacuucuccauuugucucccaccucuuaggcauuaaagccaauuagagguuugagacaccacuccauuggccuagugacuuucaggugagaauucugagaaaaauaggaagcuguagccccagggcaggggugaggggagagacaguggugugguccuuguguagcucaagcugcugggcuacacagagaacuuggccacucugucuuuagcuccacaagagugagggcagagcacaggaaccagacugcuacacagggagcugagacucugguucuugcccugucucaguguaaacuuggguuuccucucuuccucuggguucuaucaggauccccaaauuucucccauaccaucugcauucauggagaaacugagaaagaagcaucugucaguccuuucaaagcugcugaaggcugaaagcccauaggccaggggcauaucuguucacugugugaagguucggggaucccagaaugcaaacagggcacaaggauccagaccaggcccccugacccaugacuuccaccuaaggcuuuagugguguguccauuuuaguaguccucauucuggcacccauacaugcuaggugaggugccugugccaagauugccauguacccugauucuccuccuaccugcugcuuccuaaaucccacagcaguagaaucuucacaguaauucaagaggguaccaagggagggucccuugggcuauuuucuuuuuuuuuuuuuuuuuuuuuuuuaaagauuuauuuauuuauuauauguaaauacacuguagcugucuucagacacaccagaagagggagucagaucuuguuacggaugguugugagccaccaugugguugcugggauuugaacucuggaccuucggaagaacagucaggugcucuuacccacugagccaucucaccagccccagcccuugggcuauuuucaauauugcagaaagccucacggaaacccugcguuuaccugauaaggcaucccaggcuaauuaaaacuccaagugcauuugcuuucggcuggcauuacaccaacuuguauggggaaccugguuaucucaggcuggucagaagcucugauuggcagcuauagauacuuuugguucauaaaagaugaaaagaccauuaauuaucauccacugaacgcagcuuggcaguuauacucuauuagaguccaugggaagaauacuuggcaucguuucucucgaagccucaggguuuggagguucuaguuagucuuuugagagggaacauccacuggcuuuaggacuaauguagaugcccuuugaguggugcaugcaguaaaggaagggccaccucaguucugacauccuucaacaaguucccaaacugcugcccuagucuuaugaccuuauuugacagaugggaaaacuaaauccaagagaagucacaccgauccagaguugcucagaaucuuucccaggaugggaaccgaagccuggagaccuguaaugcuguuuccuaggcuaguauucuguucugccccauugccaaaacaucuccuccucucuucacuaucuuccuagccaggcuuuugauuaaccaagccguuguucaauauucaguuacuguuugacucccuuggcuugacaaggucaggguagagagcauuaggugggucagggcccaacucccacaauccuaccucacuucuggccagaccagagguggacaucuacuucuggaaccccauguacaucccaacgggagacaucugauuggcugaguaagagcugccucuagcagacugguccauuuaaaagucacuuucccuccucuagccuuucuuucucagugaugaguugcuuuugagugauuccuaagcuaauuucuacuucuaaauuucuuugacuucuaaagcaauaauacuuucucuguucaacacagauuuuuaaaaaauaauccagggcuggcgagauggcucagcggguaagagcauugacugcucuuccaaagguccugaguucaaaucccagcaaccacaugguggcucacaaccaccuguaaugagaucugacacccucuucuggugcgucugaagucagauacaguguacuuauguauaauaauacauuaaucuuugggguggugcaagcagggacugagggagcggaguugaucagagccagcagguccaacuggagugagcagagguccuaaaaauucaauucccaacagccacaugaaggcucagaaccaucuguacagcuacagugaacucacauaaauaaauacauaaauaaauaacucuuuaaaaauaauucaaugagaaaugaauaugaaagcuuauaagauaaugugaggaaacuguuauaacuaucacaguuauuagcaaguacuacaagcauuguaaggacugaggauguagcccagcaaguggacugcuugccaauccugcacagaggcccuggguucaaucuccauaaacugggugugguggagggugugacagagccugcccaccauccuagcacucuagaaagguagggucagaaguucaaggucauccuuggcuacaguuucagaccagccugggaaugaaugaaugaaugauugcaaguaagaaagaaaggaaaacuuagaauaggagggugucagggaagaacaucagaaucaggaauuccuccacagaacucgugccuuguguauguugcucauccucugugggcaggcaccuuuuagcuauugucuccuucaguccuaagaaucaguuagguauccugugcaaggggaggcugaacugcaaggauuuaaguaacuugcucaagcccgggcucuuuagugaaugguaagcacucacacccagagcugccuggcuucaagcuucuucaccccuuuaugucuguguaaccucagcagagcucaccccguucucuucauuauucaauaugagaaguaaugcaggaggaacaaggaacaccaagaccacagccacaaaggggcugagagggguggaggggagucuaaaacacacaggugcugggagggaagucacaaggaaggagaaugccccagagcuuaugcccagagcaaaggugagggcggaguagaaugugagcuggacaccuggguucucuugaggaauggaggcuggggcuuguuuuagaagaaaccucagggacuggaggaucaggccaggggcuacugggagugcaaaguccaacagauauuuuaaaagagaacugacaguuuuguguggggaagagugacacccugaugggggaaaagacccuauacccccuccauccucucugcuccauuaggguugugguaagaaauuugggggacccuggcagaggcuccgggacagggugaugaaaugagguuugggcaagaggccagggugcgggguggggguuggguggggaccuugaaaagcucaaauucaacggcuguggccuaguuaucuuucuguuuuuccaucccuaagucccucagauaaaguuaaaaaaacugucccuuccccaaccaaauuagcuagaguuaaucccacccccagcccccuaauuaaauaacagcuaaaaucagaugacuucugacaaagguccaaucaagcccuaagaucccagggucgguguaggugcugccaugggcagagagaggcucagagcuaguagguggagaaacaccuacugcugucaucaaagggguucaggaauauggcaucuggggucccuuagcccagcaguugggaccgucacuuuucucuuacuuccagaccuccucuccuuauuuaaacaaacacguuuguuucaauguggccucuaauuuucccaagccucugggcaccagucuaggucugcuuacuacccggaaauaaggauucuccauagagauuuucaggaaccuucguucugaugcucuugggcccagagagccuauaucuuucucagcuuccgacccuagucccagaagucugaguucuacuacagccgacaagcuacaggaaaucagcuuuucucuuccucccaagagcuagagcaagagggaaaccgcccaccccccuucaggcgcgcgcacucacaccccucccgacacauccgugcaccgcccuggauugauccggccacuagcccuaguacccccagugccaggguucugggauucuccccaaguucuuggaucucuucgccugaagagacugggggugggaggcaauucaggagaaugaggagaaaggggagggagccuucgucuuccucccgggucuuucccgagucugaguugaugggggaggggaggaugagacuggcccccacauaaccuuccgacccucucagucugucuuuccucuuacggcacacgcuuacccagcuccaacccucucaauagccccaccgaggaucucgagguucuuccacugccuccuaaggcccugcccggccuccgcaccccccucgacucccacccgccacaggucucccgcagcccacagaucgccagagacccuaagcuuucugcgcccucuccucccgguuggcccuuagacccugccuguacuucuccagcuucuagauucggguccucuccucaugccacacaaguuucgacaccgaucucacacuccacgucggccacggucccucccugcugcagcgcgggcccccaauucuagcuugggcccccaacucaagucuuggucuuuccaaacuccgcccuccaacucaaguccuggucgcuuccaguccucggcgcgcccccaguuuccagguggcccccugcccgcuucccgccgccaaccucgccacucacccgucccuucccggccgguaaaacuccacggagaagccaaaaagggagccggggggcccggagagcaccgccggggccuccgcgucuagguugaagcccccaaccuggagugguggcggccacaguagcagcagcagaggcagcagcggcgguaggcgucggggcccccagcgcagcagcaccgcguggagaggagaucgaggcgaccguggcguccagcuccccauagugcccgcucuucccuguccuggggccaccgacccggagccgcuuccuaaaccucccagaggcgaaugacucaacgcggggaggaguuugccaaacucccggcugggcccuccccccggccgccgggccggcuggcgggggggcauuccugggucccggggacgccgaggccgcgccccgcacccgaaggggcguggggggccgcaccucugaacccuggcuccggccccagcugg
